United States Patent
Tan et al.

(10) Patent No.: US 9,580,736 B2
(45) Date of Patent: Feb. 28, 2017

(54) ANALYSIS OF NUCLEIC ACIDS ASSOCIATED WITH SINGLE CELLS USING NUCLEIC ACID BARCODES

(71) Applicant: Atreca, Inc., San Carlos, CA (US)

(72) Inventors: Yann Chong Tan, Palo Alto, CA (US); Gary Withey, San Francisco, CA (US)

(73) Assignee: Atreca, Inc., Redwood City, CA (US)

( * ) Notice: Subject to any disclaimer, the term of this patent is extended or adjusted under 35 U.S.C. 154(b) by 0 days.

(21) Appl. No.: 14/586,857

(22) Filed: Dec. 30, 2014

(65) Prior Publication Data
US 2015/0329891 A1    Nov. 19, 2015

Related U.S. Application Data

(60) Provisional application No. 61/922,012, filed on Dec. 30, 2013.

(51) Int. Cl.
| | |
|---|---|
| *C12P 19/34* | (2006.01) |
| *C12N 15/113* | (2010.01) |
| *C12Q 1/68* | (2006.01) |
| *B01L 3/00* | (2006.01) |

(52) U.S. Cl.
CPC .............. *C12P 19/34* (2013.01); *C12Q 1/6804* (2013.01); *C12Q 1/6806* (2013.01); *B01L 3/502784* (2013.01); *C12N 15/113* (2013.01)

(58) Field of Classification Search
None
See application file for complete search history.

(56) References Cited

U.S. PATENT DOCUMENTS

| | | | |
|---|---|---|---|
| 7,749,697 B2 | 7/2010 | Oleksiewicz et al. | |
| 2006/0193748 A1* | 8/2006 | Tai ........................ | G01N 30/34 422/70 |
| 2013/0225418 A1 | 8/2013 | Watson et al. | |

FOREIGN PATENT DOCUMENTS

| | | |
|---|---|---|
| EP | 2036989 A1 | 3/2009 |
| WO | 2012048341 A1 | 4/2012 |
| WO | 2012148497 A1 | 11/2012 |
| WO | 2013134261 A1 | 9/2013 |

OTHER PUBLICATIONS

PCT/US2014/072898, "International Search Report and Written Opinion", mailed Jun. 24, 2015, 19 pages.
PCT/US2014/072898, "Invitation to Pay Add'l Fees and Partial Search Report", mailed Mar. 27, 2015, 7 pages.

* cited by examiner

*Primary Examiner* — Jim Ketter
(74) *Attorney, Agent, or Firm* — Kilpatrick Townsend & Stockton LLP

(57) ABSTRACT

Provided herein are methods and compositions for analyzing nucleic acids associated with single cells using nucleic acid barcodes. According to some embodiments, a method for producing one or more polynucleotides of interest comprises: obtaining a plurality of RNAs associated with one or more samples, wherein the samples are obtained from one or more subjects, each RNA is associated with a single sample, and the RNAs associated with each sample are present in a separate reaction volume; adding an adapter molecule to the RNAs associated with each sample, wherein the adapter molecule is generated using an enzymatic reaction and comprises a universal priming sequence, a barcode sequence, and a binding site; and incorporating the barcode sequence into one or more polynucleotides associated with each sample, thereby producing the one or more polynucleotides of interest.

24 Claims, 25 Drawing Sheets

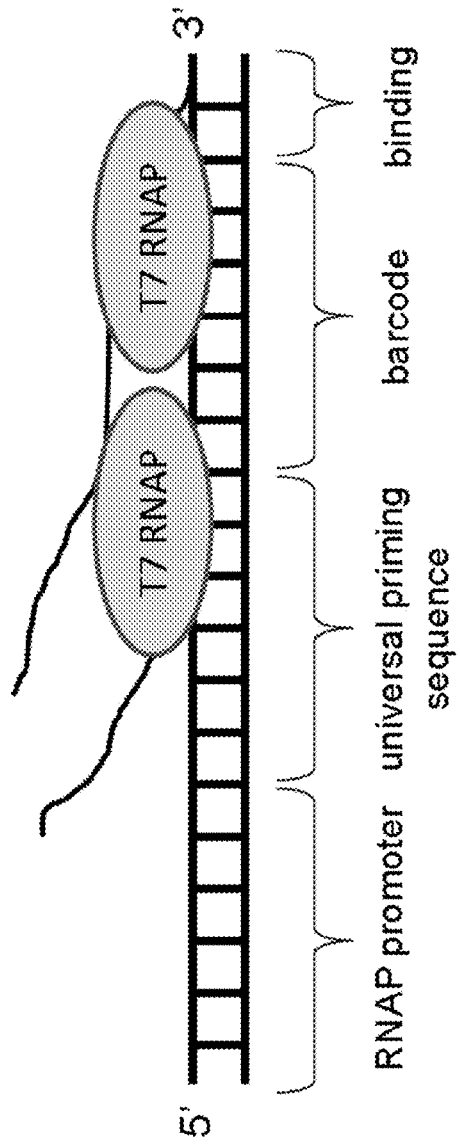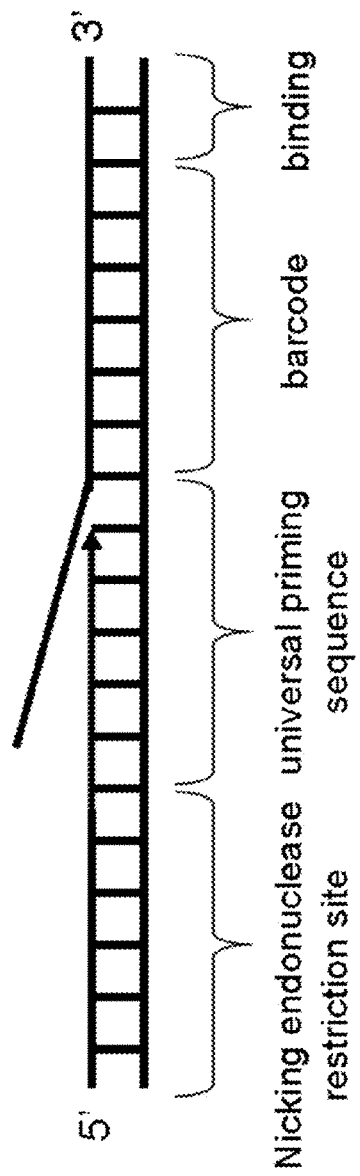
FIG. 2A
FIG. 2B

ANALYSIS OF NUCLEIC ACIDS ASSOCIATED WITH SINGLE CELLS USING NUCLEIC ACID BARCODES

CROSS-REFERENCES TO RELATED APPLICATIONS

This application claims the benefit of U.S. Provisional Application No. 61/922,012, entitled "Analysis of Nucleic Acids Associated with Single Cells using Nucleic Acid Barcodes" and filed Dec. 30, 2013, the entire contents of which are incorporated herein by reference for all purposes.

REFERENCE TO A "SEQUENCE LISTING," A TABLE, OR A COMPUTER PROGRAM LISTING APPENDIX SUBMITTED AS AN ASCII TEXT FILE

The Sequence Listing written in file 97519-920777.txt, created on Dec. 30, 2014, Ser. No. 18/227,200 bytes, machine format IBM-PC, MS-Windows operating system, is hereby incorporated by reference in its entirety for all purposes. Table 18. [barcode_part1] written in file Table 18. [barcode_part1].txt, 2,039,808 bytes; Table 18. [barcode_part2] written in file Table 18. [barcode_part2].txt, 90,112 bytes; Table 22. [i5 index primers] written in file Table 22. [i5 index primers].txt, 4,096 bytes; Table 32. [well-barcode] written in file Table 32. [well-barcode].txt, 4,096 bytes; Table 32. [plate-barcode] written in file Table 32. [plate-barcode].txt, 4,096 bytes, all created on Dec. 24, 2014, machine format IBM-PC, MS-Windows operating system, are hereby incorporated by reference in their entirety for all purposes.

BACKGROUND OF THE INVENTION

Variable genes such as immunoglobulin (Ig) and T cell receptor (TCR) genes are formed from rearrangement of V(D)J gene segments with P/N nucleotide additions between the junctions. A fully functional Ig or TCR protein is formed by association of two genes—heavy and light chain genes for Ig, alpha and beta genes for an αβTCR and gamma and delta genes for a γδTCR. This combinatorial approach results in an extremely large variety of different possible sequences.

This repertoire allows the immune system to be able to respond to novel immunological insults that have not yet been encountered by the organism. Immunoglobulin genes also undergo somatic hypermutation which further increases the repertoire size.

Correspondingly, any nucleic acid analysis of variable genes that allows for expression of the native Ig or TCR protein to investigate its functional properties requires not just sequencing individual B (for Ig genes) or T cells (for TCR genes), but also requires native pairing of the two genes that make up the protein. This can be done by single cell cloning and Sanger sequencing, but is slow and laborious (see, e.g., Wrammert et al., Nature, 2008, 453:667-671).

High-throughput methods have been developed for high-throughput sequencing of natively paired genes, and fall into two approaches. The first approach is to attach a unique nucleic acid barcode identifier to nucleic acids from a cell, and pairing is achieved via bioinformatically linking together genes if they share the same barcode and therefore originate from the same cell (PCT/US2012/000221). The second approach is to physically link nucleic acids from the two genes together (see, e.g., U.S. Pat. No. 7,749,697).

The first approach is superior as it allows pairing for multiple genes (such as B or T cell co-expressed genes that identify specific T cell or B cell subsets), while the second approach is limited to physically linking a few nucleic acids. To date, experimental data exists only for cases in which no more than two nucleic acids have been physically linked.

Associating nucleic acids unambiguously to a single cell (the first approach) rather than associating them with each other via linking (the second approach) has advantages. When nucleic acids are associated with each other, it can be difficult to distinguish PCR and sequencing errors from true biological variation. Assumptions have to be made about the accuracy of the sequencing platform and reads arbitrarily assigned to different sequences based on a percentage similarity cutoff, i.e. all reads with >95% similarity are assigned to a sequence and any differences between them are assumed to be due to sequencing errors. This is unable to distinguish between sequences that are very similar to one another (see Zhu et al., Frontiers in Microbiology, 2012, 3:315).

Furthermore, assumptions about how many cells share an identical sequence are made using the relative frequency of reads assigned to the sequence. This is an approximate measure and is affected by PCR amplification biases, as is well known in the field. Therefore, associating Ig or TCR nucleic acids with each other can only give an approximate, but not true representation of the repertoire sequenced (see Zhu et al., Frontiers in Microbiology, 2012, 3:315).

However, associating nucleic acids to single cells using nucleic acid barcodes allows for unambiguous differentiation between similar or even identical sequences from single B or T cells as each read can be assigned to a cell.

Furthermore, by building a consensus sequence with all reads associated with a cell, very accurate and almost completely error-free sequences can be obtained and an accurate representation of the repertoire sequenced can be obtained. This is also generalizable to analysis of all nucleic acids in a cell.

Still, technical difficulties in delivering unique barcodes to each single cell remain. The current best technology to attach nucleic acid barcodes to variable genes has unique barcodes in aqueous solution and each barcode exists in a separate storage container even before the reaction to attach barcodes to variable gene nucleic acids (PCT/US2012/000221), otherwise the nucleic acid barcodes will be mixed before use. This creates a logistical difficulty of barcoding many thousands of cells, due to the large number of containers required to contain the individual barcodes.

The requirement for a large number of storage containers also makes this approach incompatible with any sort of approach where a unique barcode cannot be individually pipetted into each individual reaction container (which will also contain a single cell). An example is nanoliter-sized reaction containers such as a nanowell approach, where it is impractical to pipette a unique barcode individually to each nanowell as there are thousands to hundreds of thousands of nanowells.

This is also infeasible in a nanodroplet approach, in which droplets are made using a water-in-oil emulsion, as hundreds of thousands of nanodroplets are generated with only a few aqueous streams (see for e.g., products by Dolomite Microfluidics or Raindance Technologies), and it is not possible to have unique barcodes in individual storage containers before delivering to the nanodroplet.

One method to deliver unique barcodes to individual reaction containers is by using limiting dilution to deposit a unique barcode into the majority of reaction containers. One may perform limiting dilution of barcodes attached to manipulable objects, such as beads, each of which has multiple copies of one particular barcode attached, or one may perform limiting dilution of barcodes in solution. Upon diluting such beads, multiple copies of one particular nucleic acid barcode are present in a reaction container, whereas upon diluting barcodes in solution, only a single copy of a particular nucleic acid barcode is present in a reaction container.

Moreover, addition of a nucleic acid barcode to the sample-derived nucleic acids of interest present in a reaction container will be more complete if the introduced barcode is amplified, to ensure that it is present in a sufficient quantity in the reaction chamber. For example, a typical mammalian cell contains roughly 400,000 copies of mRNA. To maximize the efficiency of the overall single-cell analysis, as many of these mRNA copies as possible should be barcoded. Therefore, at a minimum, roughly the same number of copies of a particular nucleic acid barcode as there are mRNA copies need to be present in the reaction container. Limiting dilution of barcodes in solution leads to just a single copy of a particular barcode in the reaction container, while dilution of small (e.g. 1-2 µm in diameter) beads bearing barcodes would be expected to provide maximally tens of thousands of copies. Thus, amplification of the barcode in either case is important to generate sufficient quantities of a particular nucleic acid barcode in a reaction container such that successful addition of the barcode to the greatest number of sample-derived nucleic acids occurs. However, beads are expected to provide significantly more starting material for and therefore significantly better barcode amplification. Also, a sufficiently large bead may contain hundreds of thousands of nucleic acid barcode molecules. In this case, cleavage of nucleic acid barcodes from the bead may be sufficient to generate sufficient quantities of a particular nucleic acid barcode in a reaction container.

Furthermore, if the nucleic acids are attached to a solid surface, they will not be as free to move about in comparison to nucleic acids in solution. Solid phase kinetics are much slower than aqueous phase kinetics for nucleic acid complementary base pairing, and may result in much less efficient addition of barcodes to nucleic acids of interest. Preferably, nucleic acid barcodes should exist in the aqueous phase before participating in the barcoding reaction.

This current invention improves upon a previous invention (PCT/US2012/000221) to attach unique barcodes to each sample, where each sample is usually a single cell, but is generalizable to any type of sample. The current invention enables delivery of unique barcodes to any type of reaction container, and is also suitable for nanoliter-sized reaction containers and does not require keeping unique nucleic acid barcodes in separate storage containers. It is amendable to but does not require manually pipetting a unique barcode into each reaction container. It delivers one or more copies of a unique barcode or unique barcode set into each reaction container and the barcode is attached to nucleic acids of interest in a reaction that occurs in the aqueous phase with rapid aqueous phase kinetics. As the reaction attaches barcodes to all nucleic acids of interest in a cell, i.e. all reverse transcribed RNA in a cell, the current invention enables single cell transcriptomics analysis, and is not limited to associating immunoglobulin variable genes to specific samples. Furthermore, the amplification reaction can occur at a sufficiently low temperature that it is compatible with mesophilic enzymes (that are otherwise inactivated at high temperatures) to add barcodes to nucleic acids of interest.

SUMMARY OF THE INVENTION

Disclosed herein are methods and compositions for analyzing nucleic acids associated with single cells using nucleic acid barcodes. One method disclosed herein for producing one or more polynucleotides of interest comprises obtaining a plurality of nucleic acids associated with one or more samples, wherein the samples are obtained from one or more subjects, and the nucleic acids associated with a sample are present in a separate reaction volume. The nucleic acids can be RNA or DNA molecules (for example, cDNA molecules). In some embodiments, an adapter molecule is added to the nucleic acids associated with the sample. In some embodiments, the adapter molecule is generated using an enzymatic reaction and comprises a universal priming sequence, a barcode sequence, and a binding site. In some embodiments, the barcode sequence is incorporated into one or more polynucleotides associated with the sample, thereby producing the one or more polynucleotides of interest. In some embodiments, the method comprises adding an adapter molecule to the nucleic acids associated with the sample, wherein the adapter molecule is generated using an enzymatic reaction and comprises a universal priming sequence, a barcode sequence, and a binding site; and incorporating the barcode sequence into one or more polynucleotides associated with the sample, thereby producing the one or more polynucleotides of interest.

Disclosed herein is a method for producing one or more polynucleotides of interest. The method comprises obtaining a plurality of RNAs associated with one or more samples, wherein the samples are obtained from one or more subjects, and the RNAs associated with the sample are present in a separate reaction volume; adding an adapter molecule to the RNAs associated with the sample, wherein the adapter molecule is generated using an enzymatic reaction and comprises a universal priming sequence, a barcode sequence, and a binding site; and incorporating the barcode sequence into one or more polynucleotides associated with the sample, thereby producing the one or more polynucleotides of interest. In some embodiments, each RNA, or at least one of the plurality of RNAs, is associated with a single sample from the one or more samples. Some embodiments of the method further comprise generating the adapter molecule using the enzymatic reaction.

In some embodiments, the adapter molecule is generated by contacting a template molecule with one or more enzymes. In some embodiments, the template molecule is a DNA molecule comprising an RNA polymerase (RNAP) promoter, and the one or more enzymes include an RNA polymerase. The RNAP promoter can be selected from the group consisting of T7, T3, and SP6. In some embodiments, the template molecule is a DNA molecule comprising a nicking endonuclease restriction site, and the one or more enzymes include a nicking endonuclease and a strand-displacing DNA polymerase. The nicking endonuclease restriction site can be selected from the group consisting of Nt.BbvCI, Nt.BspQI, Nt.BsmAI, Nt.BstNBI, Nt.AlwI, and Nt.BsmAI. The strand-displacing DNA polymerase can be selected from the group consisting of Klenow exo-, Bst Large Fragment and engineered variants of Bst Large Fragment. The DNA molecule can be a double-stranded molecule or a single-stranded molecule that is useful as a template for generating a double-stranded molecule.

In some embodiments, the template molecule is bound to a solid support, the solid support is contacted with an aqueous solution, and the adapter molecule is released into the aqueous solution as it is generated. In some embodiments, adding the adapter molecule to the RNAs associated with one sample comprises combining the aqueous solution with the reaction volume in which the RNAs are present. In some embodiments, the aqueous solution is present in the same reaction volume as the RNAs associated with one sample. In some embodiments, the template molecule comprises an endonuclease restriction site, the one or more enzymes comprise a restriction endonuclease, and the adapter molecule comprises a portion of the template molecule, said portion being generated and released into the aqueous solution upon contacting the template molecule with the restriction endonuclease. In some embodiments, the solid support is a bead or a surface (e.g., the surface of a microtitre well or tube).

In some embodiments of the method, the adapter molecule is free in solution prior to adding the adapter molecule to the RNAs associated with one sample. In some embodiments, the adapter molecule is generated in a compartment, and adding the adapter molecule to the RNAs associated with one sample comprises combining the compartment with the reaction volume in which the RNAs are present. In some embodiments, the adapter molecule is generated in the reaction volume in which the RNAs to which the adapter molecule is added are present. In some embodiments, the adapter molecule is not generated in the reaction volume in which the RNAs to which the adapter molecule is added are present. In some embodiments, the enzymatic reaction is an isothermal reaction. In some embodiments, the adapter molecule further comprises a unique molecular identifier (UMI) sequence. In some embodiments, the adapter molecule is an RNA molecule. The adapter molecule can be generated using RNAP.

In some embodiments of the method, the adapter molecule is a DNA molecule. The adapter molecule can be generated using DNAP.

In some embodiments, producing the one or more polynucleotides of interest comprises reverse-transcribing the RNAs associated with the sample, thereby synthesizing a plurality of first-strand cDNAs, at least some of the RNAs associated with the sample comprise a sequence region complementary to the binding site of the adapter molecule, and the adapter molecule is used as a primer for reverse transcription, such that the barcode sequence is incorporated into first-strand cDNAs associated with the sample. In these embodiments, the binding site can comprise a poly-T tract or a random tract. The binding site can occur at the 3' end of the adapter molecule. The adapter molecule can be generated in a compartment, and reverse-transcribing the RNAs associated with the sample can occur upon combining the compartment with the reaction volume in which the RNAs are present. Reverse-transcribing the RNAs associated with the sample can occur in the same reaction volume where the adapter molecule added to the RNAs is generated.

Some embodiments of the method further comprise reverse-transcribing the RNAs associated with the sample to obtain a plurality of cDNAs, wherein reverse-transcribing an RNA comprises synthesizing a first strand of cDNA using a reverse transcriptase and a first-strand primer. In these embodiments, the reverse transcriptase can be MMLV H-reverse transcriptase. The adapter molecule can be generated in a compartment, and adding the adapter molecule to the RNAs associated with one sample can comprise combining the compartment with the reaction volume in which the RNAs are present. First stands of cDNA can be synthesized prior to or subsequent to combining the compartment with the reaction volume.

In some embodiments, reverse-transcribing the RNAs associated with the sample occurs in the same reaction volume where the adapter molecule added to the RNAs is generated. In these embodiments, a buffer in the reaction volume can comprise at least one of Tris, potassium ions, chloride ions, sulphate ions, ammonium ions, acetic acid ions, or magnesium ions at a pH range from pH 8.0 to pH 8.8.

In some embodiments, the reverse transcriptase has template switching activity, at least some first strands of cDNA associated with the sample comprise a 3' overhang, the binding site of the adapter molecule comprises a 3' portion complementary to the 3' overhang, and the adapter molecule serves as a template for the reverse transcriptase, such that the barcode sequence is incorporated into first strands of cDNAs associated with the sample. In these embodiments, the 3' overhang can comprises one or more C nucleotides and the 3' portion of the binding site can comprise one or more G nucleotides. The first-strand primer can comprise a poly-T tract or a random sequence.

In some embodiments, producing polynucleotides of interest comprises amplifying the first strands of cDNA for each sample using a first (e.g., forward) primer and a second (e.g., reverse) primer, the second primer having the same sequence as at least a portion of the first-strand primer, wherein the first primer or the second primer is the adapter molecule. In these embodiments, the first primer or the second primer can be the adapter molecule. The first-strand primer can comprise a poly-T tract or a random sequence.

In some embodiments of the method, each sample comprises a cell. The cell can be a blood cell, an immune cell, a tissue cell, or a tumor cell. In some embodiments, the cell is a B cell or T cell. The B cell can be a plasmablast, a memory B cell, or a plasma cell. In some embodiments, the RNAs associated with each sample comprise mRNAs, for example at least 1, 3, 10, 30, 100, 300, 1,000, 3,000, 10,000, 30,000, 100,000, 300,000, or 1,000,000 mRNAs. In some embodiments, the RNAs associated with each sample comprise the transcriptome of a cell or the total RNA of a cell. In some embodiments, at least 10, 30, 100, 300, 1,000, 3,000, 10,000, 30,000, 100,000, 300,000, or 1,000,000 polynucleotides of interest are produced per sample. In some embodiments, the one or more samples comprise at least 10, 30, 100, 300, 1,000, 3,000, 10,000, 30,000, 100,000, 300, 000, or 1,000,000 cells. In some embodiments, the one or more samples are obtained from the same subject. Some embodiments further comprise contacting the samples with a lysis buffer.

Some embodiments further comprise contacting the samples with a nucleic acid marker, thereby allowing the nucleic acid marker to bind to a subset of the samples; and washing the samples, thereby removing the nucleic acid marker from samples to which the nucleic acid marker does not bind, wherein, for samples within the subset, the adapter molecule added to the RNAs associated with the sample is also added to the nucleic acid marker, and one or more polynucleotides of interest are produced using the labeled nucleic acid marker. In these embodiments, the nucleic acid marker can comprise a nucleic acid coupled to a molecular label. The molecular label can be an antibody, antigen, or protein. The molecular label can have affinity for one or more cell surface moieties. In some embodiments, the nucleic acid is an RNA. In some embodiments, the nucleic acid is a DNA and can comprise an RNAP promoter. In some embodiments, the sample is contacted with a first nucleic acid marker and a second nucleic acid marker, wherein the first nucleic acid marker comprises a first nucleic acid coupled to a first molecular label, and the second nucleic acid marker comprises a second nucleic acid coupled to a second molecular label. The first nucleic acid and second nucleic acid can comprise different sequence regions. In some embodiments, the first and second molecular labels are different (e.g., two different antibodies to different cell surface antigens). Thus, the method allows multiplex labeling of samples, such as single cells, with nucleic acid markers comprising adapter molecules, and producing one or more polynucleotides of interest that are associated with the sample.

In some embodiments of the method the one or more samples are obtained from the same subject. In some embodiments, the one or more samples are obtained from at least 3, 10, 30, or 100 different subjects.

Also disclosed herein are barcode adapter constructs. Some such barcode adapter constructs comprise an RNAP promoter, a universal priming sequence, a barcode sequence, and a binding site. The RNAP promoter can be selected from the group consisting of T7, T3, and SP6. Other barcode adapter constructs comprise a nicking endonuclease restriction site, a universal priming sequence, a barcode sequence, and a binding site. The nicking endonuclease restriction site can be selected from the group consisting of Nt.BbvCI, Nt.BspQI, Nt.BsmAI, Nt.BstNBI, Nt.AlwI, and Nt.BsmAI.

Further disclosed herein is a solid support comprising a barcode adapter construct as described above. In some embodiments, the barcode adapter construct is bound to the solid support via a covalent bond. In some embodiments, multiple copies of the barcode adapter construct are bound to the solid support. For example, at least 10, 30, 100, 300, 1,000, 3,000, 10,000, 30,000, 100,000, 300,000, or 1,000, 000 copies of the barcode adapter construct can be bound to the solid support. In some embodiments, each copy of the barcode adapter construct comprises the same barcode sequence. An adapter template library comprising a plurality of solid supports coupled to multiple copies of the adapter construct is also disclosed herein. In some embodiments, the plurality of solid supports comprises at least 10, 30, 100, 300, 1,000, 3,000, 10,000, 30,000, 100,000, 300,000, or 1,000,000 solid supports. In some embodiments, at least two of the solid supports comprise adapter constructs with different barcode sequences or UMI sequences. In some embodiments, every solid support of the plurality of solid supports comprises an adapter construct with a different barcode sequence or a different UMI sequence.

Also disclosed herein is a nucleic acid marker comprising a nucleic acid coupled to a molecular label. In some embodiments, the molecular label is an antibody, antigen, or protein. In some embodiments, the molecular label has an affinity for one or more cell surface moieties. In some embodiments, the nucleic acid is an RNA. In some embodiments, the nucleic acid is a DNA. The DNA can comprise an RNAP promoter sequence. In some embodiments, a plurality of nucleic acid markers are described, where at least one of the plurality comprises a first molecular label (i.e., a first antibody) and at least one of the plurality comprises a second molecular label (i.e., a second antibody). In some embodiments, the first and second molecular labels are different, thus providing compositions useful for multiplex labeling of different cell surface moieties (e.g., different cell surface antigens) with nucleic acid markers described herein.

Further disclosed herein are kits comprising adapter constructs described herein. The kit can comprise a plurality of solid supports coupled to adapter constructs described herein. In some embodiments, the kit comprises an adapter template library comprising a plurality of adapter constructs. In some embodiments, the kit comprises an adapter template library comprising a plurality of adapter constructs coupled to a plurality of solid supports. The kit can further comprise enzymes for generating an adapter molecule described herein from the adapter construct by an enzymatic reaction. In some embodiments, the kit comprises a cell suspension buffer described herein.

Further disclosed herein is a cell suspension buffer comprising an osmoprotectant. In some embodiments, the osmoprotectant is a betaine or a close structural analog thereof. For example, the osmoprotectant can be a glycine betaine. In some embodiments, the osmoprotectant is a sugar or polyol. For example, the osmoprotectant can be trehalose. In some embodiments, the osmoprotectant is an amino acid. For example, the osmoprotectant can be proline. In some embodiments of the cell suspension buffer, the osmolarity of the buffer is about 250-350 mOsm/L. In some embodiments, the osmoprotectant contributes up to 10%, 20%, 30%, 40%, 50%, 60%, 70%, 80%, 90%, or 100% of the osmolarity of the buffer. In some embodiments, the buffer comprises about 230-330 mM betaine and about 10 mM NaCl.

Also disclosed herein is a method of attaching a polynucleotide to a solid support, wherein the polynucleotide contains a barcode sequence. The method comprises the steps of: a) generating a hydrophilic compartment of an inverse emulsion, the hydrophilic compartment containing: a solid support, a barcode oligonucleotide comprising a barcode sequence, and an oligonucleotide bound to a surface of the solid support via a capture moiety, wherein the bound oligonucleotide comprises a 3' sequence complementary to a 3' sequence of the barcode oligonucleotide; and b) performing a polymerase extension reaction to incorporate the barcode sequence into the bound oligonucleotide on the solid support. In some embodiments, the barcode oligonucleotide further comprises a 5' sequence identical or complementary to a PCR reverse primer sequence. These embodiments can further comprise performing a PCR reaction using a fluorophore-labeled reverse primer. In some embodiments, the solid support is a bead. In some embodiments, the capture moiety is streptavidin. In some embodiments, the capture moiety comprises a carboxyl group, epoxy group, or hydroxyl group. In some embodiments, the capture moiety comprises gold to capture thiolyated oligonucleotides.

In some embodiments, the barcode oligonucleotide further comprises a universal priming sequence and a binding site. The barcode oligonucleotide can further comprise an RNAP promoter selected from the group consisting of T7, T3, and SP6. Alternatively or in addition, the barcode oligonucleotide can further comprise a nicking endonuclease restriction site selected from the group consisting of Nt.BbvCI, Nt.BspQI, Nt.BsmAI, Nt.BstNBI, Nt.AlwI, and Nt.BsmAI. The binding site can be one or more G nucleotides.

Another method of attaching a polynucleotide to a solid support, wherein the polynucleotide contains a barcode sequence, is also disclosed. The method comprises the steps of: a) providing: a solid support, a first barcode oligonucleotide comprising a W sequence, and an oligonucleotide bound to a surface of the solid support via a capture moiety, wherein the bound oligonucleotide comprises (i) an S1x sequence and (ii) a sequence complementary to a 3' sequence of the first barcode oligonucleotide; b) performing a polymerase extension reaction or a ligation reaction to incorporate the W sequence into the bound oligonucleotide; c) providing a second barcode oligonucleotide comprising an (i) S2y sequence and (ii) a 3' sequence complementary to the 3' end of the bound oligonucleotide resulting from step b); and d) performing a polymerase extension reaction or ligation reaction to incorporate the S2y sequence into the bound oligonucleotide, thereby attaching a polynucleotide to the solid support, wherein the polynucleotide contains a barcode sequence, and the barcode sequence comprises the S1x, W, and S2y sequences.

In some embodiments of this method, the solid support is a bead. In some embodiments, the capture moiety is streptavidin. In some embodiments, the capture moiety comprises a carboxyl group, epoxy group, or hydroxyl group. In some embodiments, the capture moiety comprises gold to capture thiolyated oligonucleotides. In some embodiments, a chosen barcode oligonucleotide, the chosen barcode oligonucleotide being either the first barcode oligonucleotide or the second barcode oligonucleotide, further comprises a universal priming sequence and a binding site. The chosen barcode oligonucleotide can further comprise an RNAP promoter selected from the group consisting of T7, T3, and SP6. Alternatively or in addition, the chosen barcode oligonucleotide can further comprise a nicking endonuclease restriction site selected from the group consisting of Nt.BbvCI, Nt.BspQI, Nt.BsmAI, Nt.BstNBI, Nt.AlwI, and Nt.BsmAI. The binding site can be one or more G nucleotides.

Further disclosed herein is a solid support prepared by any embodiment of the foregoing methods, wherein the solid support is attached to a polynucleotide and the polynucleotide contains a barcode sequence. Also disclosed is a barcode library comprising a plurality of these solid supports.

In addition, a microfluidic droplet device is disclosed herein for encapsulating cells, barcode adapter templates, and reagents for producing polynucleotides of interest. The device comprises (a) three independently controlled pressure sources, (b) three microfluidic pathways, (c) three flow sensors, (d) two sample loops, (e) a microfluidic droplet chip, and (f) a sample collection container, wherein: each pressure source is coupled to and drives fluid through one of the microfluidic pathways, one of the flow sensors is disposed along each microfluidic pathway downstream of the respective pressure source, a first microfluidic pathway passes through a first sample loop, a second microfluidic pathway passes through a second sample loop, the first and second sample loops being in contact with a thermal cooling unit, the first and second microfluidic pathways merge at a first junction to form a combined pathway, the combined pathway and third microfluidic pathway merge at a second junction to form a sample pathway, the second junction occurring within the microfluidic droplet chip and downstream of the first junction, and the sample pathway passes into the sample collection container downstream of the second junction, such that (a)-(f) are fluidly connected.

In some embodiments of the device, each pressure source comprises a pressure pump. In some embodiments, each pressure source comprises a syringe pump. In some embodiments, the first sample loop is configured to meter the flow of an aqueous solution toward the microfluidic droplet chip, wherein the aqueous solution comprises cells and barcode adapter templates. In some embodiments, the second sample loop is configured to meter the flow of a reaction mixture toward the microfluidic droplet chip, wherein the reaction mixture comprises reagents for cell lysis and reagents for producing polynucleotides of interest. In some embodiments, the third microfluidic pathway is configured to deliver an oil/surfactant mix to the microfluidic droplet chip. In some embodiments, the thermal cooling unit comprises a Peltier device. In some embodiments, the thermal cooling unit comprises an ice bin. In some embodiments, the first junction occurs within the droplet chip. In some embodiments, the third microfluidic pathway is split into two subpathways upstream of the microfluidic droplet chip, the two subpathways merge with the combined pathway at the second junction, and the second junction has flow-focusing geometry. In some embodiments, the second junction has a t-junction geometry. In some embodiments, the first microfluidic pathway is configured to accommodate cells, and the second microfluidic pathway is configured to accommodate barcode adapter templates bound to solid supports.

Disclosed herein is a method for producing one or more polynucleotides of interest, comprising obtaining a cDNA library comprising a plurality of cDNAs associated with one or more samples obtained from one or more subjects, wherein each cDNA is associated with a single sample in the one or more samples, and wherein the cDNAs associated with each sample are present in a separate container or compartment. In some embodiments, an adapter molecule is added to the cDNAs associated with each sample to produce the one or more polynucleotides of interest. In some embodiments, the adapter molecule is generated from an adapter construct comprising a universal priming sequence, a barcode, and a cDNA binding site.

In some aspects, the adapter molecules are generated using an isothermal reaction. In some aspects, the adapter construct further comprises an RNA polymerase (RNAP) promoter. In some aspects, the RNAP promoter is selected from the group consisting of T7, T3, and SP6. In some aspects, the adapter construct further comprises a nicking endonuclease restriction site. In some aspects, the nicking endonuclease restriction site is selected from the group consisting of Nt.BbvCI, Nt.BspQI, Nt.BsmAI, Nt.BstNBI, Nt.AlwI, and Nt.BsmAI. In some aspects, the adapter is an RNA adapter generated by RNAP. In some aspects, the adapter is a DNA adapter generated by a nicking endonuclease and strand displacing DNA polymerase. In some aspects, the strand displacing DNA polymerase is selected from the group consisting of Klenow exo- and Bst Large Fragment and its engineered variants, such as Bst 2.0.

In some aspects, the method further comprises allowing the 3' end of the adapter molecule to attach to the 3' end of each cDNA in the library to produce the one or more polynucleotides of interest.

In some aspects, the adapter is added by annealing the adapter to the '3 tail of a cDNA generated during a reverse transcription reaction. In some aspects, each cDNA comprises at least one C nucleotide, wherein C is located at the 3' end of each cDNA, wherein the adapter region comprises at least one G nucleotide, wherein G is located at the 3' end of the adapter region, and wherein the adapter region is attached to each cDNA via binding between the G and C. In some aspects, the adapter molecule is single-stranded, and further comprising incorporating the complementary of the adapter molecule into each cDNA by allowing an enzyme to make the adapter molecule double-stranded. In some aspects, the complementary of the adapter molecule is incorporated into each cDNA to produce the polynucleotide of interest by an MMLV H-reverse transcriptase.

In some aspects, each sample comprises a cell. In some aspects, the cell is a blood cell, an immune cell, a tissue cell, or a tumor cell. In some embodiments, the cell is a B cell or a T cell. In some aspects, the B cell is a plasmablast, memory B cell, or a plasma cell.

Also disclosed herein is a method of attaching a barcode to a solid support comprising the steps of: a) generating a hydrophilic compartment of an inverse emulsion, the hydrophilic compartment comprising: a solid support contained therein, wherein the solid support comprises an oligonucleotide bound to the surface via a capture moiety, wherein the oligonucleotide comprises a 3' sequence complementary to a 3' sequence on a barcode oligonucleotide; a barcode oligonucleotide comprising a 3' sequence complementary to the 3' end of the bound oligonucleotide, and a barcode sequence; and b) performing a polymerase extension reaction to add the sequence of the barcode to the bound oligonucleotide on the solid support.

In some aspects, the barcode oligonucleotide further comprises a 5' sequence identical or complementary to a reverse PCR primer. In some aspects, the method further comprises performing a PCR reaction using a fluorophore-labeled reverse primer.

In some aspects, the solid support is a bead or a surface. In some aspects, the capture moiety is streptavidin. In some aspects, the barcode oligonucleotide further comprises a RNA polymerase (RNAP) promoter and/or an endonuclease restriction site, a universal priming sequence, a cDNA binding site. In some aspects, the RNAP promoter selected from the group consisting of T7, T3, and SP6. In some aspects, the nicking endonuclease restriction site is selected from the group consisting of Nt.BbvCI, Nt.BspQI, Nt.BsmAI, Nt.BstNBI, Nt.AlwI, and Nt.BsmAI. In some aspects, the cDNA binding site is one or more G nucleotides.

Also disclosed herein is a method of attaching a barcode to a solid support comprising the steps of a) providing a solid support, with an oligonucleotide bound to the solid support via a capture moiety, wherein the oligonucleotide comprises an $S1_x$ sequence, and a sequence complementary to a 3' sequence on a first barcode oligonucleotide; a first barcode oligonucleotide comprising a 3' sequence complementary to a sequence of the bound oligonucleotide, and a W sequence; and b) performing a polymerase extension reaction or ligation reaction to add the W sequence to the $S1_x$ sequence of the bound oligonucleotide on the solid support; c) providing a second barcode oligonucleotide with a $S2_y$ sequence comprising a 3' sequence complementary to the 3' end of the oligonucleotide extended in step b); d) performing a polymerase extension reaction or ligation reaction to add the $S2_y$ sequence to the $S1_x$ and W sequences of the bound oligonucleotide on the solid support, where the barcode sequence comprises the $S1_x$, W, and $S2_y$ sequences.

In some aspects, the solid support is a bead. In some aspects, the capture moiety is streptavidin. In some aspects, the first or second barcode oligonucleotide further comprises a RNA polymerase (RNAP) promoter and/or a nicking endonuclease restriction site, a universal priming sequence, a cDNA binding site. In some aspects, the RNAP promoter selected from the group consisting of T7, T3, and SP6. In some aspects, the endonuclease restriction site is selected from the group consisting of Nt.BbvCI, Nt.BspQI, Nt.BsmAI, Nt.BstNBI, Nt.AlwI, and Nt.BsmAI. In some aspects, the cDNA binding site is one or more G nucleotides.

Also disclosed herein is a solid support with an attached barcode generated by any of the methods disclosed above. Also disclosed herein is a beaded barcode library comprising a plurality of such solid supports with attached barcodes.

Also disclosed herein is a barcode adapter construct comprising a universal priming sequence, a barcode, and a cDNA binding site. In some aspects, the construct further comprises an RNAP promoter. In some aspects, the RNAP promoter is selected from the group consisting of T7, T3, and SP6. In some aspects, the construct further comprises a nicking endonuclease restriction site. In some aspects, the nicking endonuclease restriction site is selected from the group consisting of Nt.BbvCI, Nt.BspQI, Nt.BsmAI, Nt.BstNBI, Nt.AlwI, and Nt.BsmAI.

Also disclosed herein is a barcode adapter template bead comprising a solid support and a barcode adapter molecule bound to the solid support via a capture moiety, wherein the barcode adapter molecule comprises a barcode sequence and a cDNA binding site. In some aspects, the cDNA binding site comprises one or more G nucleotides. In some aspects, the barcode sequence comprises a sequence $S1_x$-W-$S2_y$. Also disclosed herein is a beaded barcode library comprising a plurality of the barcode adapter template beads as disclosed above.

Also disclosed herein is a polynucleotide library comprising a plurality of barcode adapter template beads comprising a solid support and a barcode adapter molecule bound to the solid support via a capture moiety, wherein the barcode adapter molecule comprises a barcode sequence and a cDNA binding site, wherein a cDNA region is coupled to the 3' end of the adapter.

In some aspects, the cDNA binding site comprises one or more G nucleotides. In some aspects, the barcode sequence comprises a sequence $S1_x$-W-$S2_y$.

In some aspects, the cDNA is derived from a B cell. In some aspects, the B cell is a plasmablast, memory B cell, or a plasma cell. In some aspects, the cDNA is a B-cell derived variable immunoglobulin region.

Also disclosed herein is a microfluidic droplet device as shown in FIGS. 17-19.

BRIEF DESCRIPTION OF THE DRAWINGS

These and other features, aspects, and advantages will become better understood with regard to the following description, and accompanying drawings, where:

FIGS. 2A and 2B show methods of amplifying or generating an adapter molecule according to some embodiments of the invention. In FIG. 2A, RNA barcode adapters are synthesized in a linear amplification reaction by an RNAP, such as T7, which binds to a promoter sequence on a DNA template and synthesizes single-stranded barcode adapter RNA. In FIG. 2B, a nicking endonuclease such as Nt.BbvCI (NEB) is used to introduce a nick on the sense strand of a DNA template. DNA barcode adapters are then synthesized in an amplification reaction by a strand-displacing enzyme, such as Klenow exo-, which extends the nick and displaces the single-stranded barcode adapter.

The barcode adapter base-pairs with the tailed dCs (bottom) and the reverse transcriptase continues transcription using the barcode adapter as a template, incorporating the barcode sequence into the $1^{st}$ strand cDNA. All mRNAs in the reaction are therefore barcoded.

Figure 3:
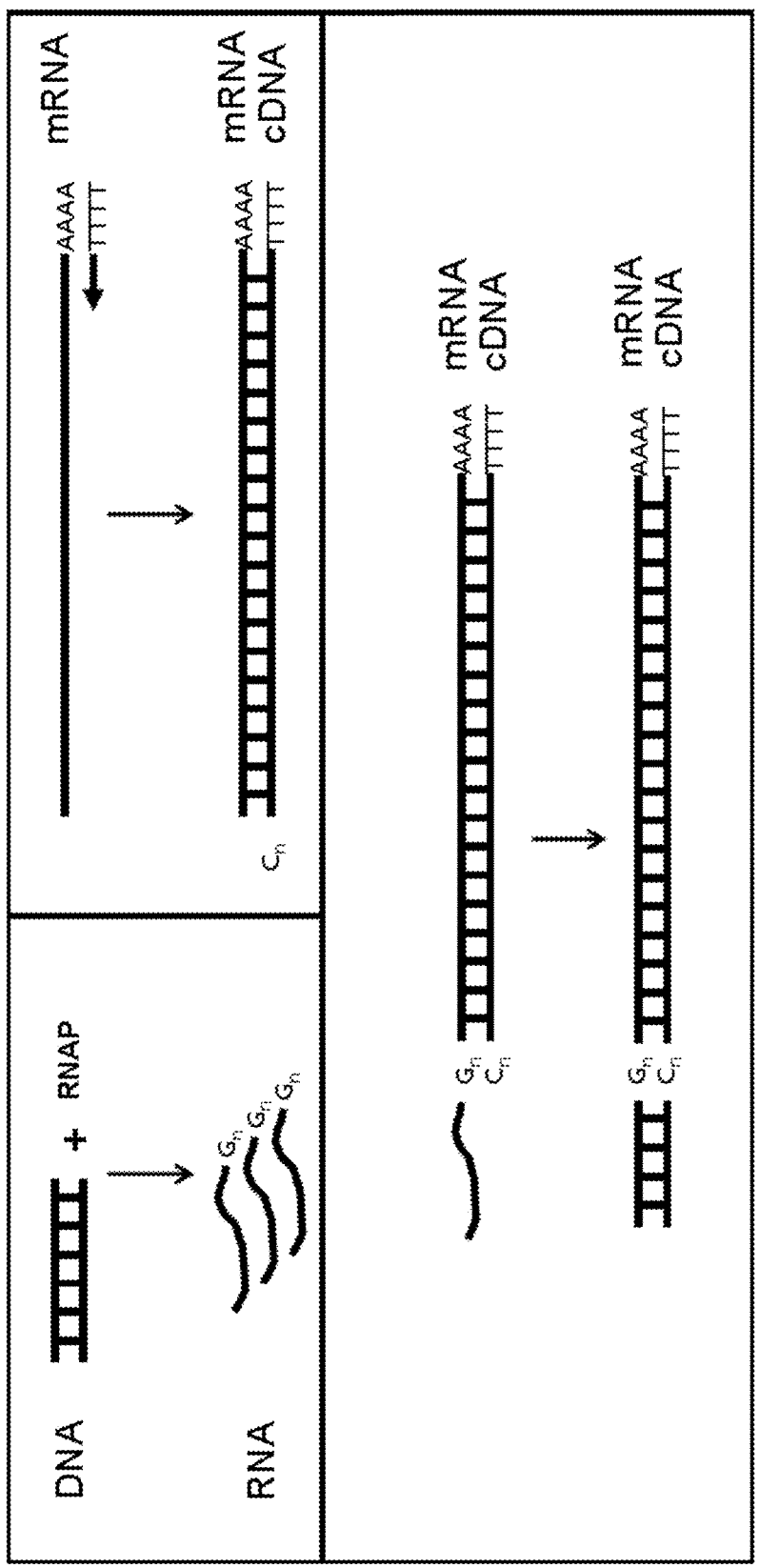
FIG. 3 shows the incorporation of barcode sequences into first strand cDNA according to some embodiments of the invention. Here RNA barcode adapters are synthesized to demonstrate barcoding of cDNA. DNA barcode adapters (synthesized in FIG. 2B) may also be used. An RNAP primes off its promoter and synthesizes RNA barcode adapters (FIG. 3, top left). In the same reaction, reverse transcription occurs and $1^{st}$ strand cDNA is generated (top right). The MMLV-based H-reverse transcriptase has 3' tailing activity and adds several dCs to the 3' end of the $1^{st}$ strand cDNA.
Figure 4:
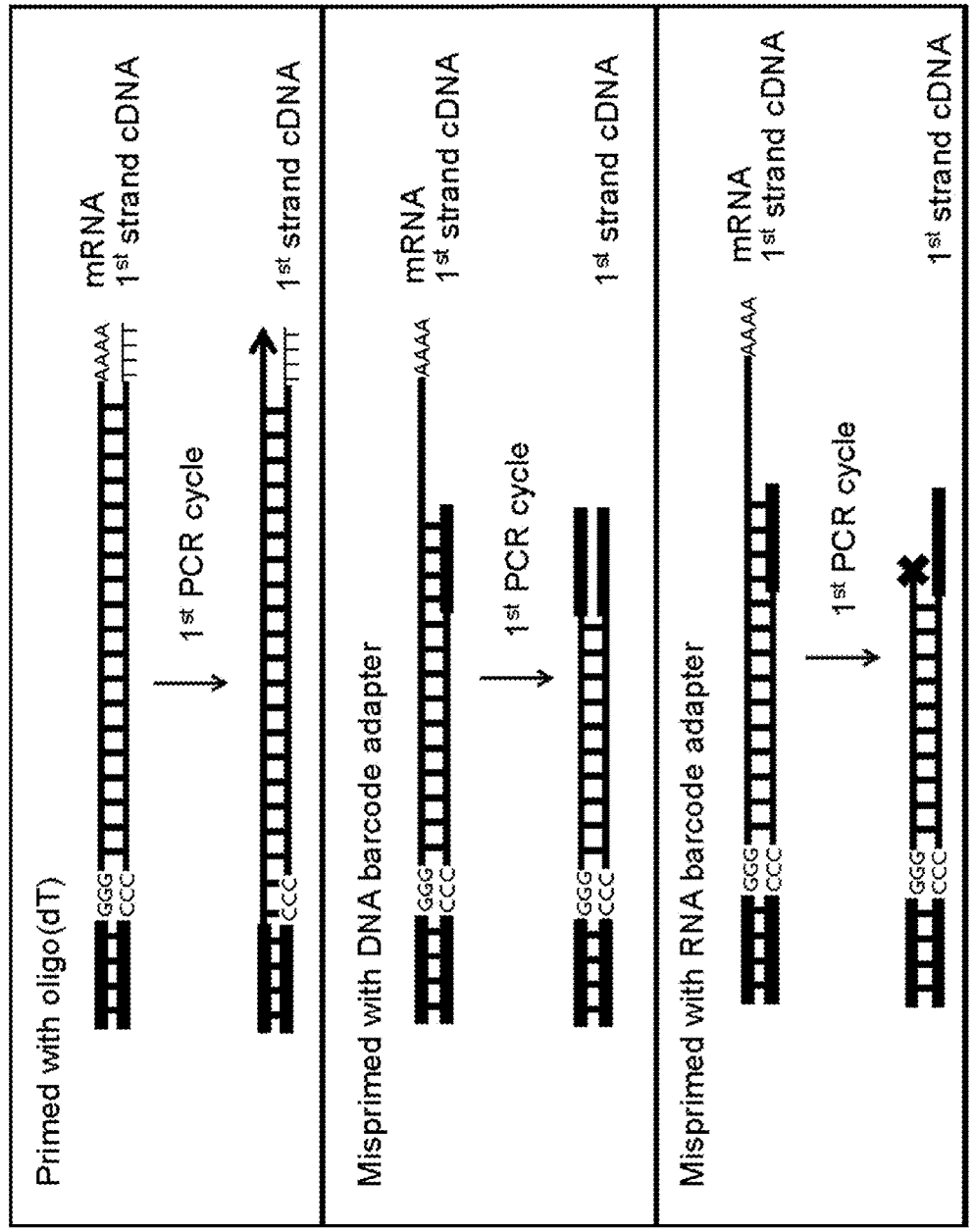

FIG. 4 shows that RNA barcode adapters have less background than DNA barcode adapters in embodiments of the invention. In the barcoding reaction in FIG. 3, both oligo(dT) and barcode adapters are present, and both oligos can prime the reverse transcription reaction. When the reaction is primed with oligo(dT) (FIG. 4, top), the reaction proceeds as normal. When the RT reaction is misprimed with a DNA barcode adapter (middle), during PCR the forward primer can prime off both the sense and anti-sense strands and create amplification of non-desired products. When the RT reaction is primed with RNA barcode adapter (bottom), the growing strand cannot use RNA nucleotides as a template when using a proof-reading DNA polymerase in PCR1, and as a result misprimed cDNAs will not contain barcode adapter sequences on both the sense and anti-sense strands. Therefore non-desired products should not be exponentially amplified, resulting in significantly less background.

Figure 5A:
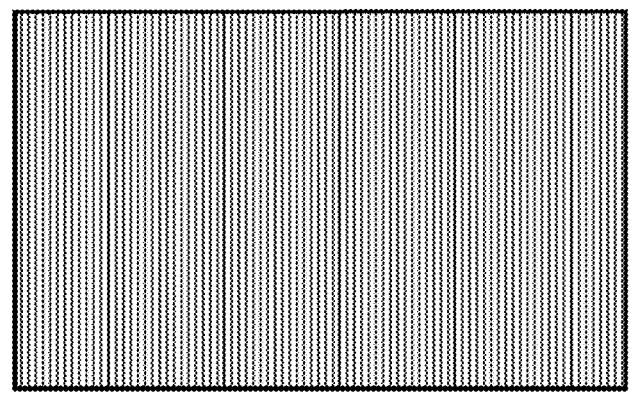
Figure 5B:
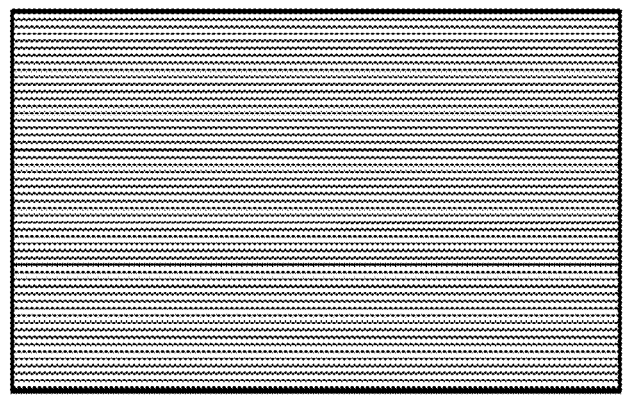
Figure 5C:
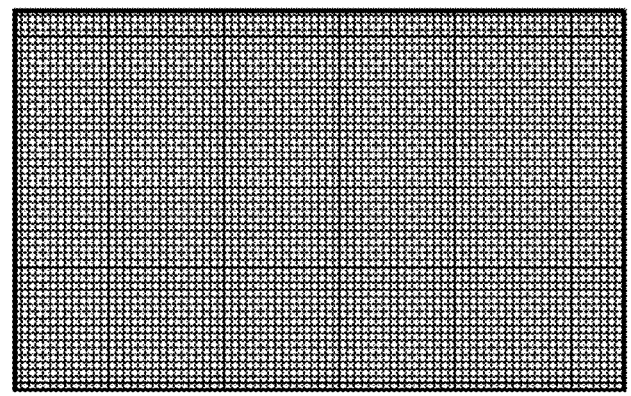

FIGS. 5A-C are cartoons illustrating the segregation of reaction volumes for generating barcode adapters and performing reverse transcription, according to some embodiments of the present invention. Barcode adapter molecules can be enzymatically generated in a plurality of first reaction volumes, such as droplets, which are represented by the vertical lines in FIG. 5A. Each first reaction volume can contain barcode adapter molecules in aqueous solution, all with the same barcode sequence. Separately, RNA molecules can be reverse transcribed in a plurality of second reaction volumes, which are represented by the horizontal lines in FIG. 5B. Each second reaction volume can contain RNA molecules all derived from the same sample. The first and second reaction volumes can then be combined, such as by merging droplets, as represented by the crossed lines in FIG. 5C. The products of the reactions in FIGS. 5A and 5B are mixed together, such that one barcode sequence is introduced into the reaction volume corresponding to each sample. The barcode sequence can be incorporated into first-strand cDNA or PCR products.

Figure 6C:
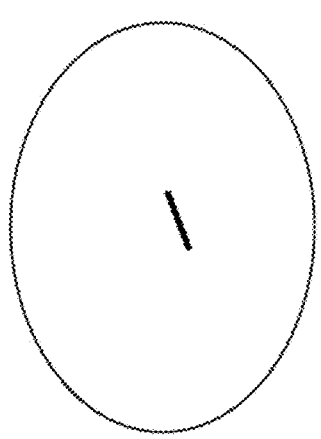
Figure 6D:
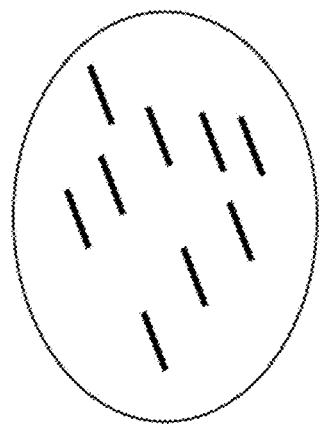
Figure 6A:
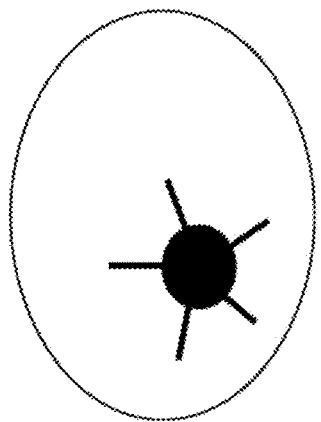
Figure 6B:
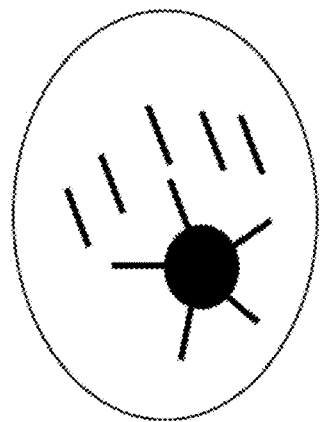

FIGS. 6A-D show the amplification of barcode adapter templates to produce barcode adapter molecules, in various embodiments of the invention. FIG. 6A shows barcode adapter templates attached to a solid surface, such as a bead. FIG. 6B shows barcode adapter molecules in aqueous solution, resulting from amplification of the barcode adapter templates in FIG. 6A. FIG. 6C shows a single barcode adapter template molecule. The molecule is in aqueous solution and is held inside a container. FIG. 6D shows the container of FIG. 6C with multiple barcode adapter molecules, which result from amplification of the single template molecule.

Figure 7A:
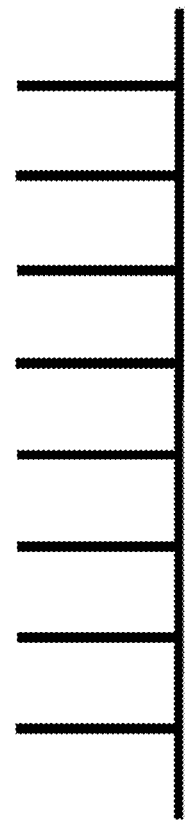
Figure 7B:
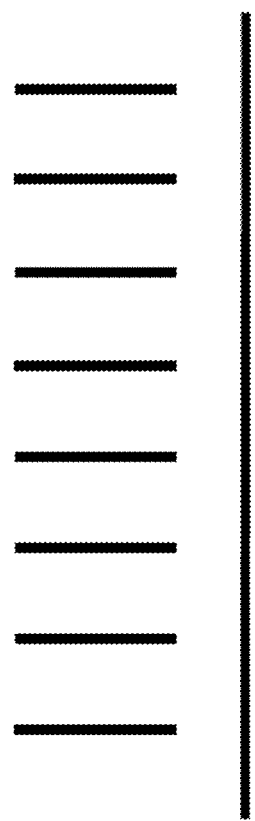
Figure 7C:
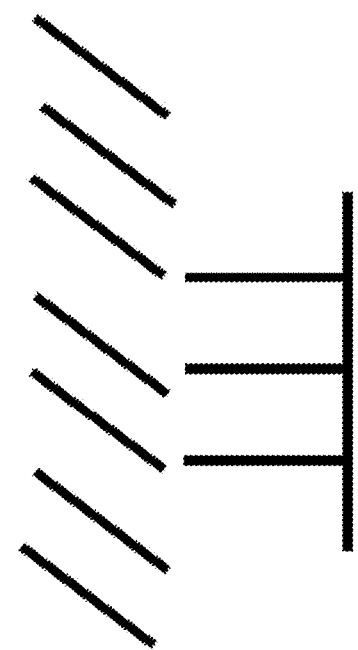
Figure 7D:
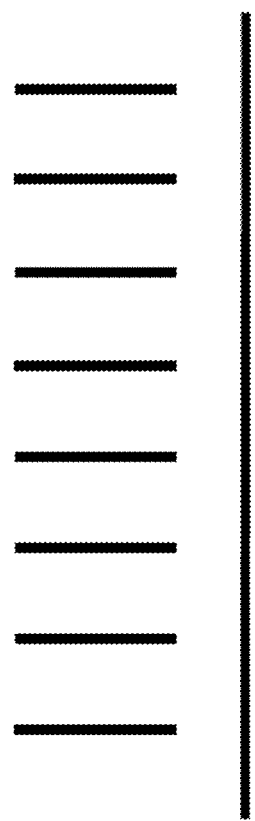

FIGS. 7A-D show the generation of barcode adapter molecules from templates, wherein the templates are attached to solid surfaces. Upon generation, the barcode adapter molecules are in aqueous solution. FIGS. 7A and 7B show barcode adapter templates attached to solid surfaces. FIG. 7C shows barcode adapter molecules amplified enzymatically from the barcode adapter templates in FIG. 7A. FIG. 7D shows barcode adapter molecules released into solution upon the chemical or enzymatic cleavage of the barcode adapter templates in FIG. 7B from the solid surface.

Figure 8:
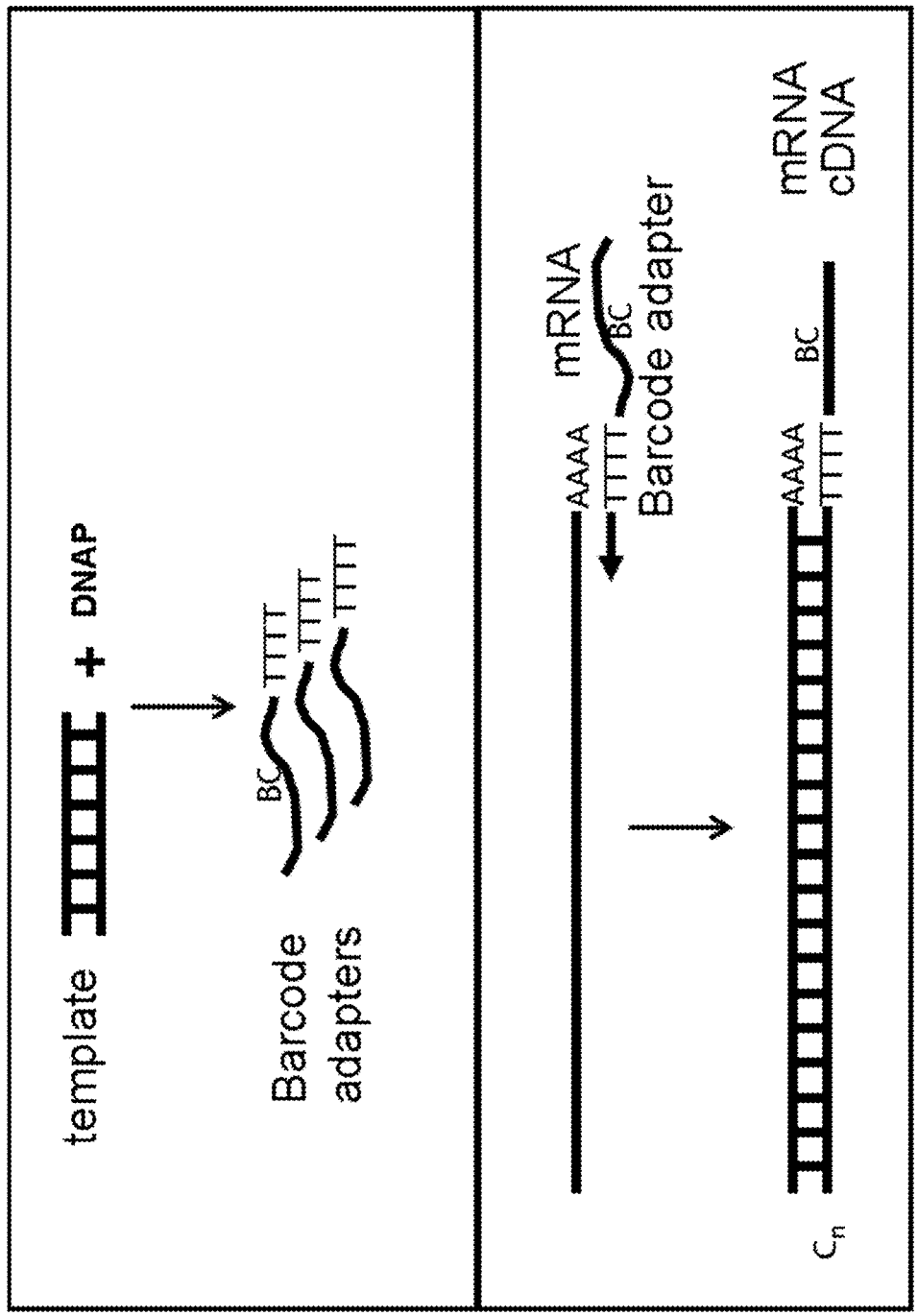

FIG. 8 shows incorporation of a barcode sequence into a first strand of cDNA using a DNA barcode adapter. (Top) The barcode adapter, including a 3' poly-T tract, is generated from a barcode adapter template using a DNA polymerase. Barcode adapter molecules are in aqueous solution. (Bottom) The barcode adapter anneals to the poly-A tail of an mRNA and serves as a primer for reverse transcription. The barcode sequence is incorporated into the 5' end of the first strand of cDNA.

Figure 9:
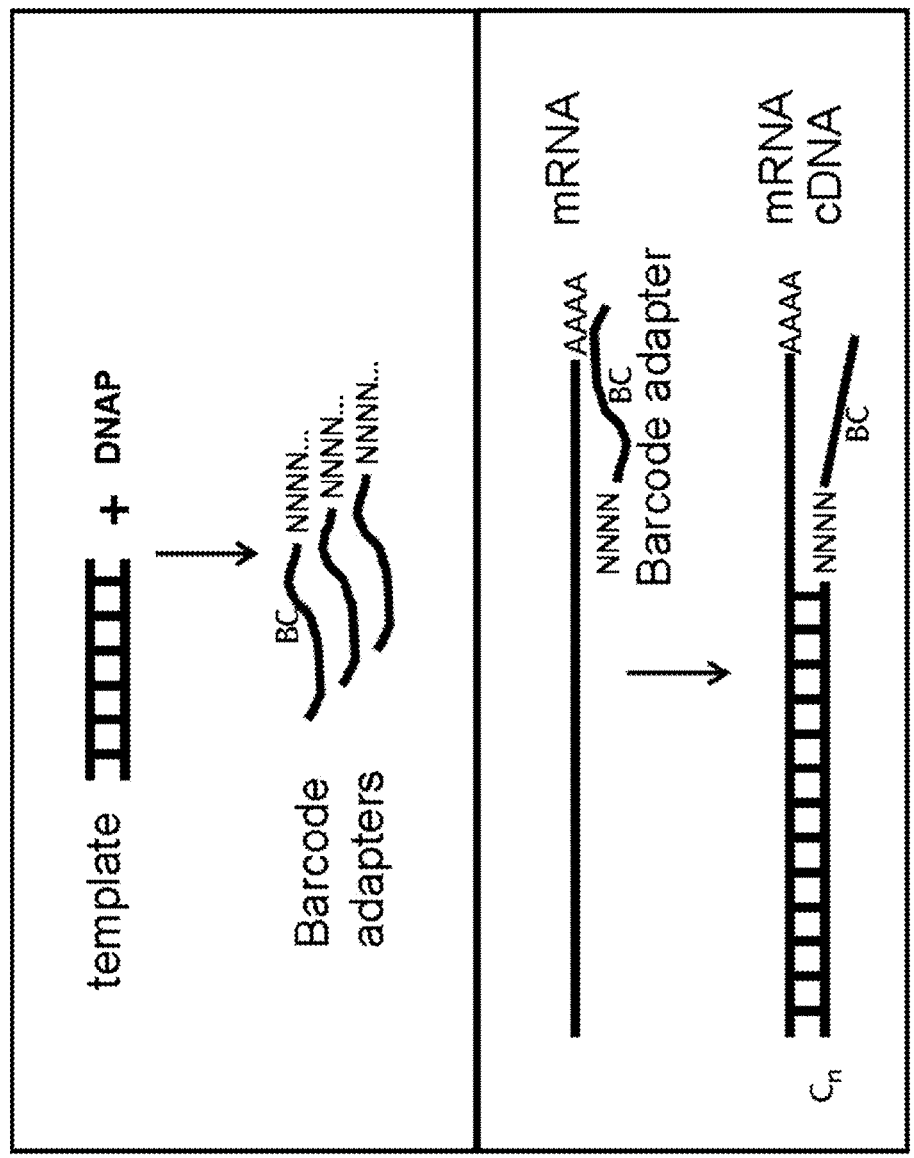

FIG. 9 shows incorporation of a barcode sequence into a first strand of cDNA using a DNA barcode adapter. (Top) The barcode adapter, including a 3' random or semi-random sequence tract, is generated from a barcode adapter template using a DNA polymerase. Barcode adapter molecules are in aqueous solution. (Bottom) The barcode adapter, by annealing to a region of an RNA that is at least partially complementary to the 3' sequence tract, serves as a primer for reverse transcription. The barcode sequence is incorporated into the 5' end of the first strand of cDNA.

Figure 10:
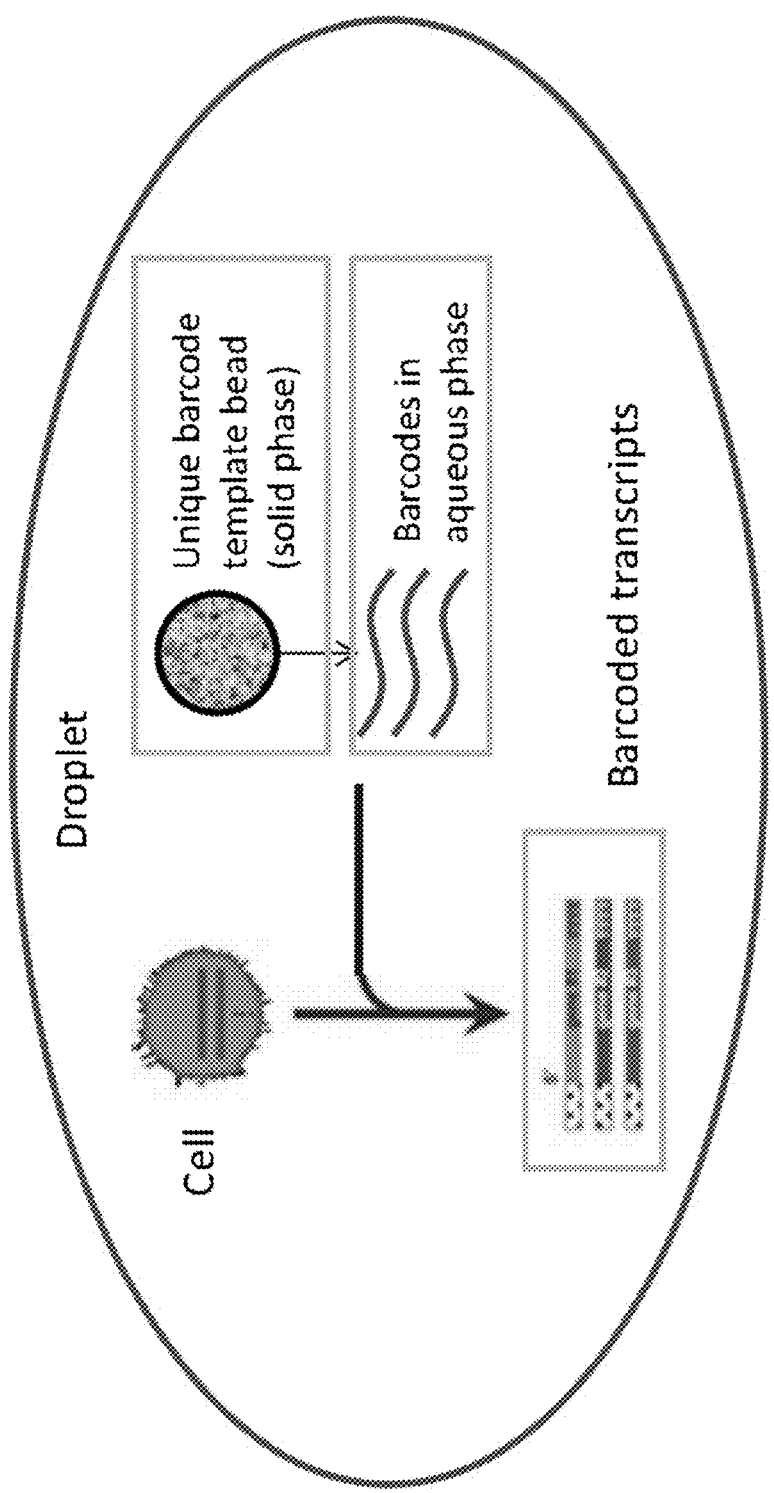

FIG. 10 is a schematic overview of a barcoding workflow that eliminates individual pipetting steps. In brief, barcoding reactions occur in water-in-oil droplets, where cells and beads containing barcode adapters are distributed by a droplet generating device. Barcode adapters are enzymatically amplified or released from a solid surface, such as a bead, and the barcodes are added to all transcripts from a cell.

Figure 11:
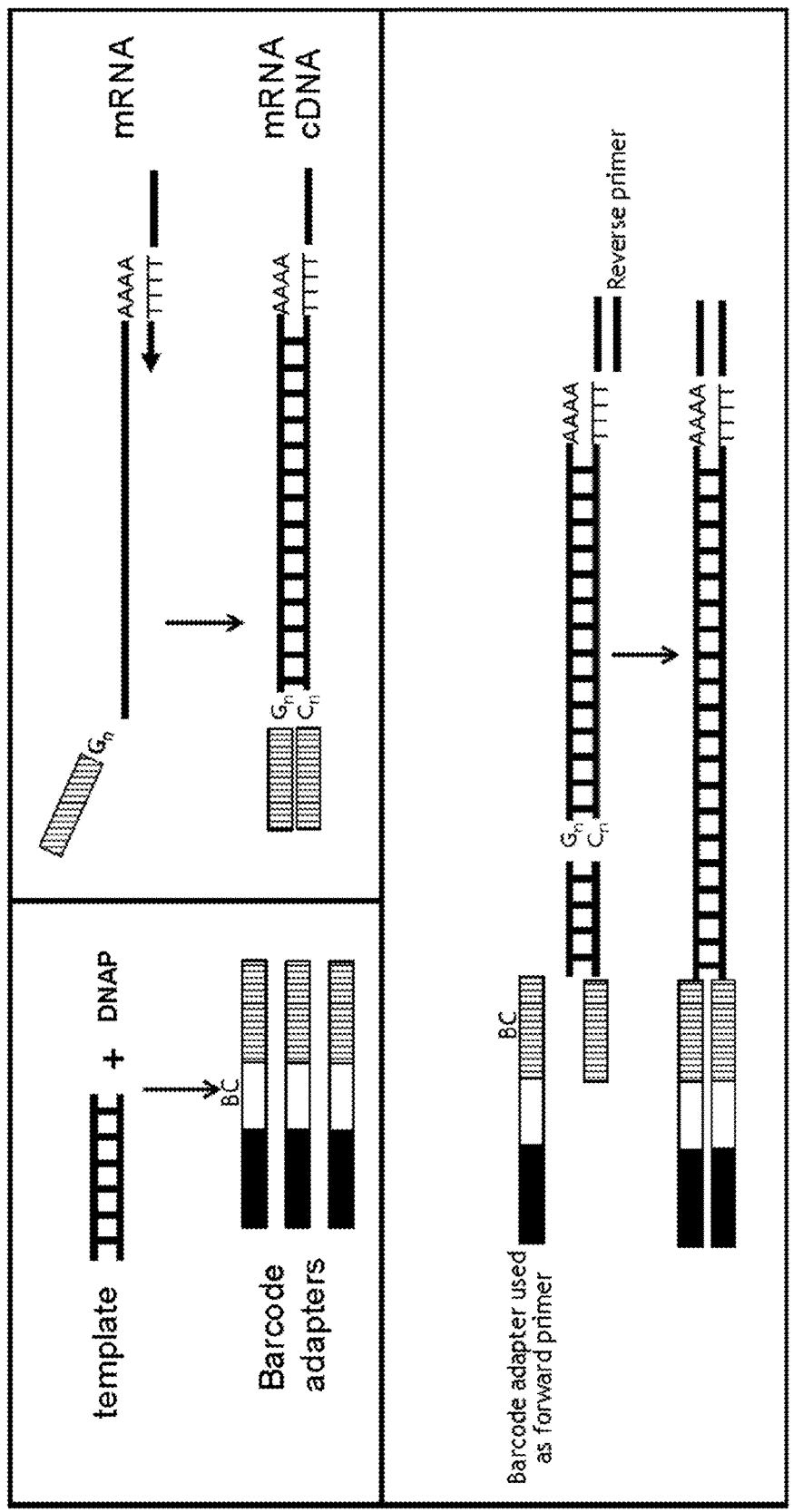

FIG. 11 shows incorporation of a barcode sequence into an amplicon using a DNA barcode adapter that serves as a forward primer for RT-PCR. The barcode adapter is generated enzymatically from a DNA template using a DNA polymerase (upper left). Barcode adapter molecules are in aqueous solution. In a separate reaction volume, or in the same reaction volume, a first strand of cDNA is synthesized (upper right) using an mRNA template, a reverse transcriptase, a primer containing a poly-T tract, and a template-switching oligonucleotide. The template-switching oligonucleotide contains a sequence region complementary to a sequence region in the barcode adapter. The barcode sequence is then incorporated into an amplicon during PCR amplification of the cDNA (bottom). The barcode adapter serves as a forward primer for PCR.

Figure 12:
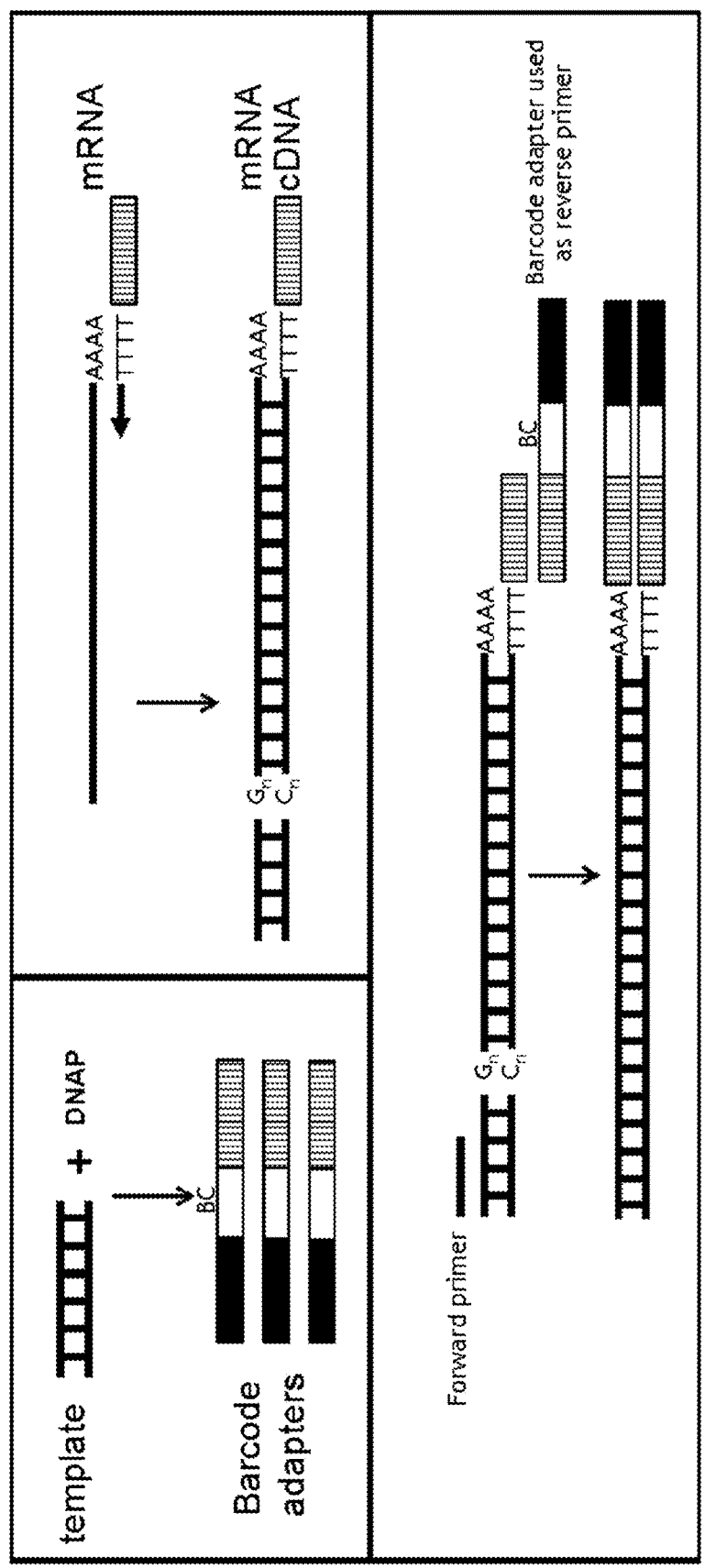

FIG. 12 shows incorporation of a barcode sequence into an amplicon using a DNA barcode adapter that serves as a reverse primer for RT-PCR. The barcode adapter is generated enzymatically from a DNA template using a DNA polymerase (upper left). Barcode adapter molecules are in aqueous solution. In a separate reaction volume, or in the same reaction volume, a first strand of cDNA is synthesized (upper right) using an mRNA template, a reverse transcriptase, a primer containing a poly-T tract, and a template-switching oligonucleotide. The primer contains a 5' sequence region complementary to a 3' sequence region in the barcode adapter. The barcode sequence is then incorporated into an amplicon during PCR amplification of the cDNA (bottom). The barcode adapter serves as a reverse primer for PCR.

Figure 13:
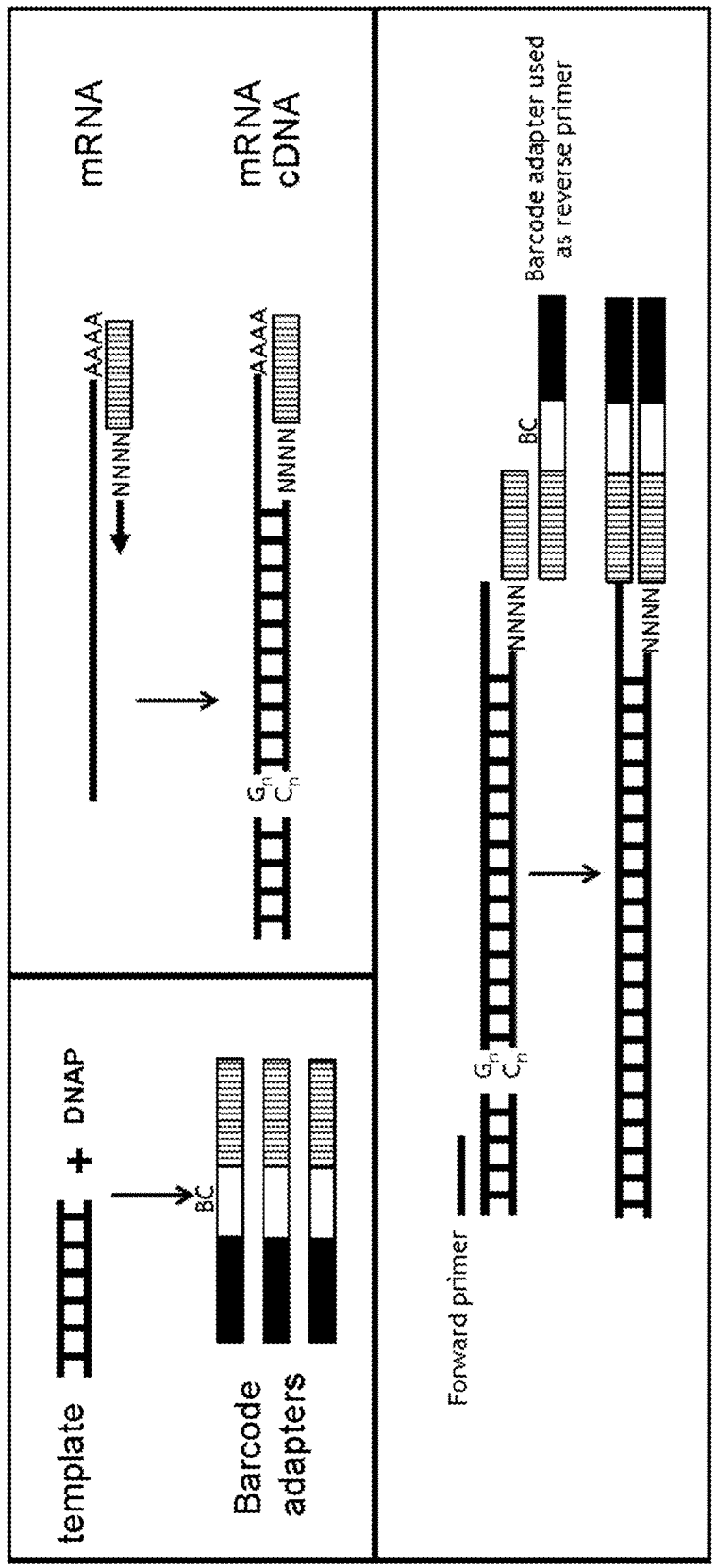

FIG. 13 shows incorporation of a barcode sequence into an amplicon using a DNA barcode adapter that serves as a reverse primer for RT-PCR. The barcode adapter is generated enzymatically from a DNA template using a DNA polymerase (upper left). Barcode adapter molecules are in aqueous solution. In a separate reaction volume, or in the same reaction volume, a first strand of cDNA is synthesized (upper right) using an mRNA template, a reverse transcriptase, a primer containing a 3' random sequence tract, and a template-switching oligonucleotide. The primer can anneal to the mRNA through the random sequence tract, and also contains a 5' sequence region complementary to a 3' sequence region in the barcode adapter. The barcode sequence is then incorporated into an amplicon during PCR amplification of the cDNA (bottom). The barcode adapter serves as a reverse primer for PCR.

Figure 14C:
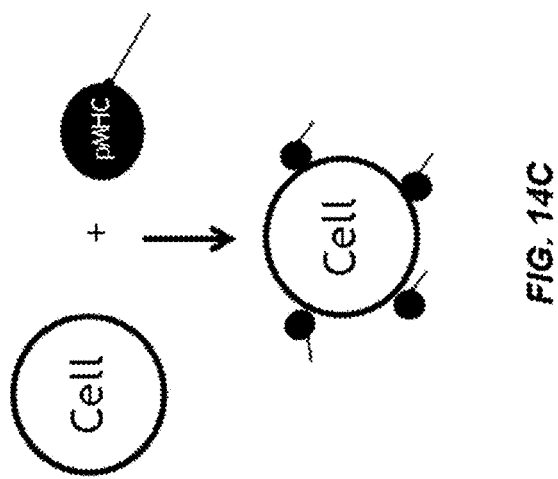
Figure 14B:
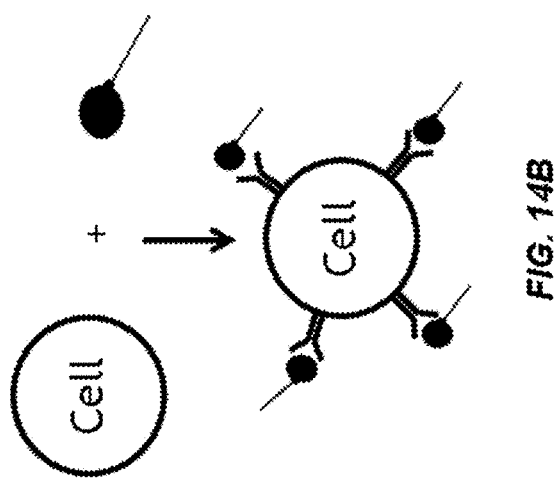
Figure 14A:
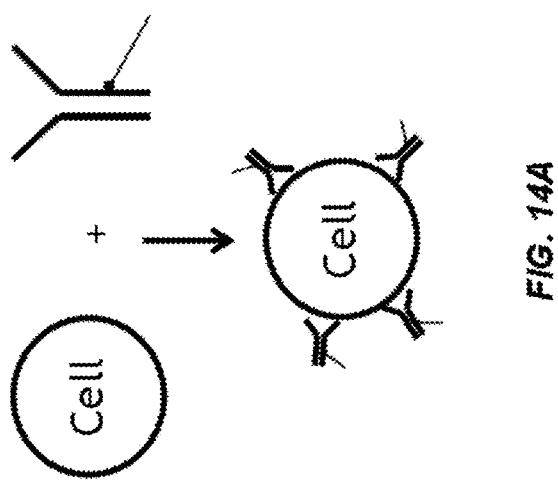

FIG. 14A-C illustrates methods of interrogating a population of cells for a selected phenotype using a nucleic acid marker, according to embodiments of the present invention. In addition to barcoding RNA from cells, any RNA, including RNA from non-cell sources, can be barcoded. Non-cell RNA may be introduced into reaction volumes by any means, such as by labeling cells with a nucleic acid marker. This marker can include a nucleic acid coupled to a molecular label, such as an antibody (FIG. 14A), an antigen (FIG. 14B), or pMHC (FIG. 14C). The nucleic acid marker can bind to some or all cells in the population, depending on the phenotypes of the cells and their affinities for the molecular label. All cells in the population can then be lysed and mRNAs in each cell can be barcoded. For cells that bind the nucleic acid marker, the associated nucleic acid can be barcoded as well. This nucleic acid can be an RNA, or a dsDNA template with an RNAP promoter, such as a T7, T3 or SP6 promoter. Sequencing can then associate non-endogenous RNA sequences with specific cells, thereby detecting which cells bound to the molecular label. Different molecular labels can be coupled to different nucleic acid sequences, enabling identification of multiple cellular phenotypes.

Figure 15:
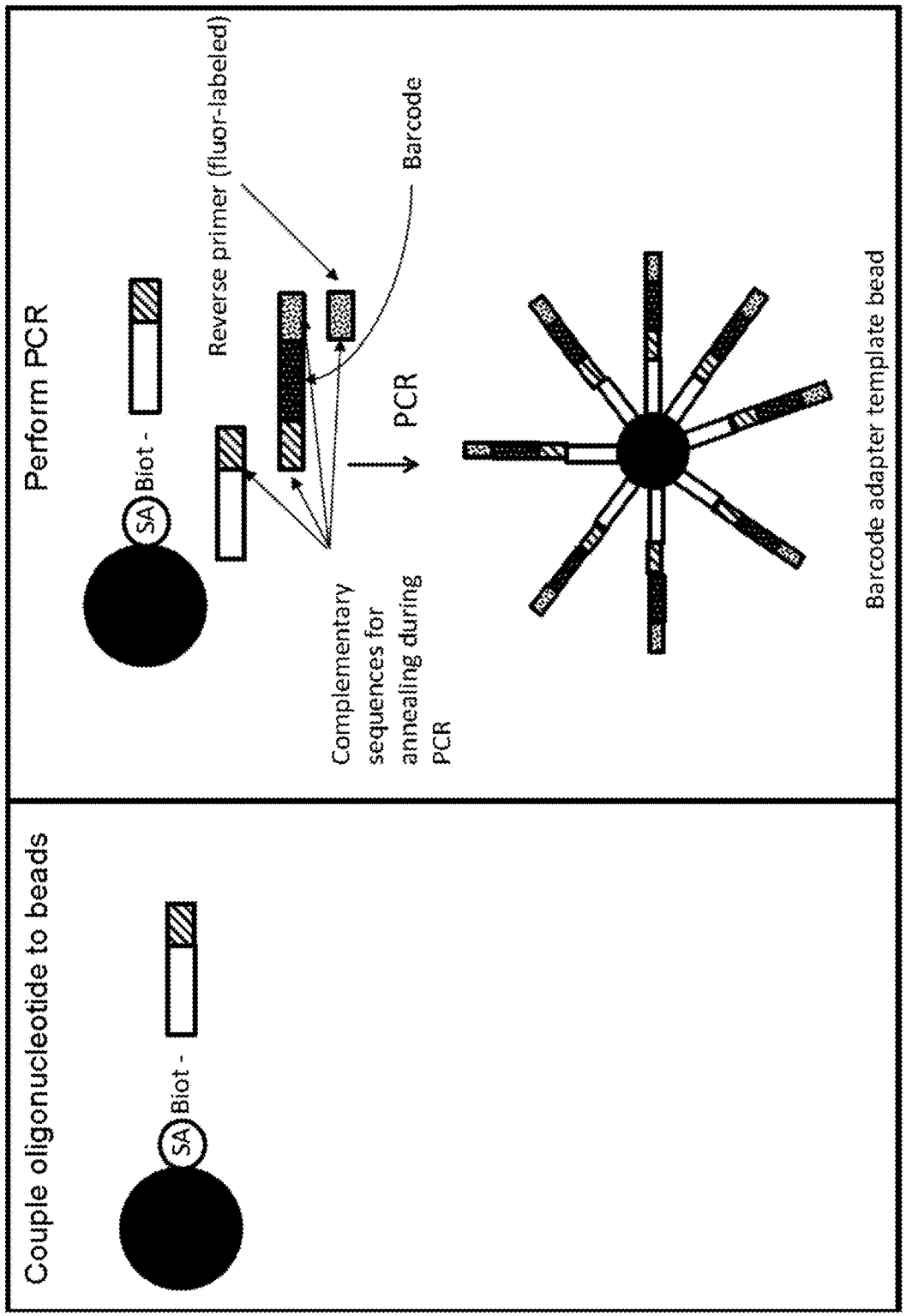

FIG. 15 shows synthesis of barcode adapter template beads in one reaction according to some embodiments of the invention. (Left) Beads are coupled to an oligonucleotide. Coupling may be done by coupling biotinylated oligos onto streptavidin coated beads, and may also be coupled using other means known in the field. (Right) Coupled beads, forward and reverse primers, and a barcode oligo containing a barcode sequence and sequences complementary to the forward and reverse primers are all present in a reaction container, with the barcode oligo preferably present at only a single copy. PCR is then conducted to amplify the barcode sequence and incorporate it into the bead-coupled oligonucleotides to form barcode adapter template beads.

Figure 16:
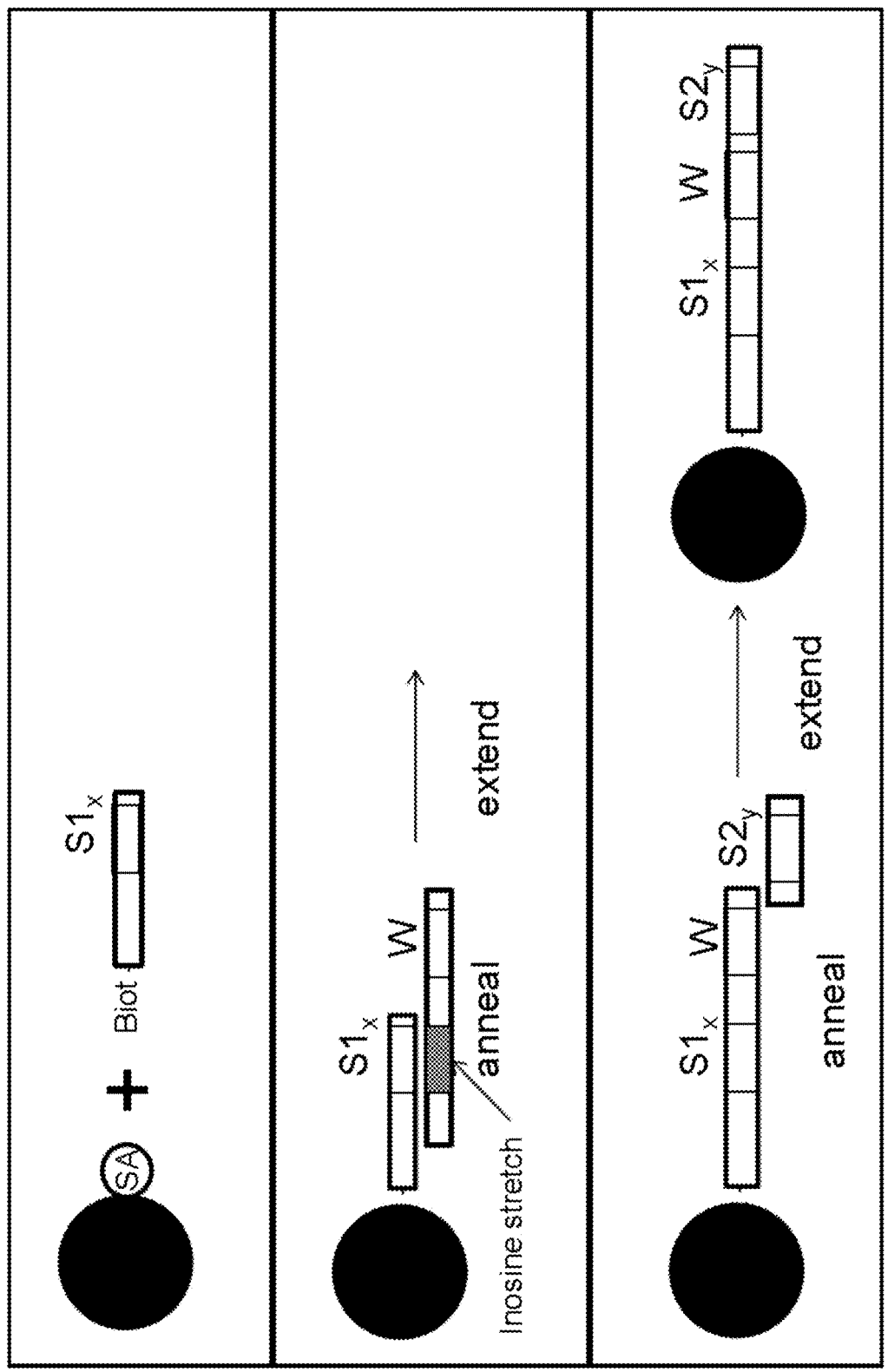

FIG. 16 shows synthesis of barcode adapter template beads in multiple steps according to some embodiments of the invention. (Top) Beads are coupled to (multiple copies of) an oligonucleotide containing a unique S1 sequence. Multiple, separate coupling reactions are performed, with each coupling reaction using an oligonucleotide containing a different unique S1 sequence. Beads, each coupled to an oligonucleotide with a different unique S1 sequence, are then pooled together, forming a library of beads having $S1_x$ sequences. (Middle) These beads are then used in an extension reaction. In each reaction, an oligonucleotide that contains a unique W sequence complementarily base-pairs with the $S1_x$-containing oligonucleotide coupled to the bead, and an extension reaction using a DNA polymerase is performed. Beads from all the extension reactions are pooled, and a library of beads containing a combination of $S1_x$ sequences each with the unique W sequence are formed. (Bottom) The double-stranded DNA from the previous step is denatured and the antisense strand washed off the beads. Additional, separate extension reactions are performed on the beads as before, but the oligonucleotide that complementarily base-pairs with the $S1_x$ and W containing oligonucleotide coupled to the beads contains a different unique S2 sequence in each separate reaction. Beads from all extension reactions are pooled, and a library of beads containing barcode adapter templates is obtained, with a combination of $S1_x$, W, and $S2_y$ sequences forming the barcode sequence. A large number of unique barcode sequences can thus be obtained in this combinatorial approach. Furthermore, multiple unique W sequences can each be combined with the $S1_x$ and $S2_y$ sequences, yielding barcodes of the general format $S1_x$-$W_z$-$S2_y$.

Figure 17:
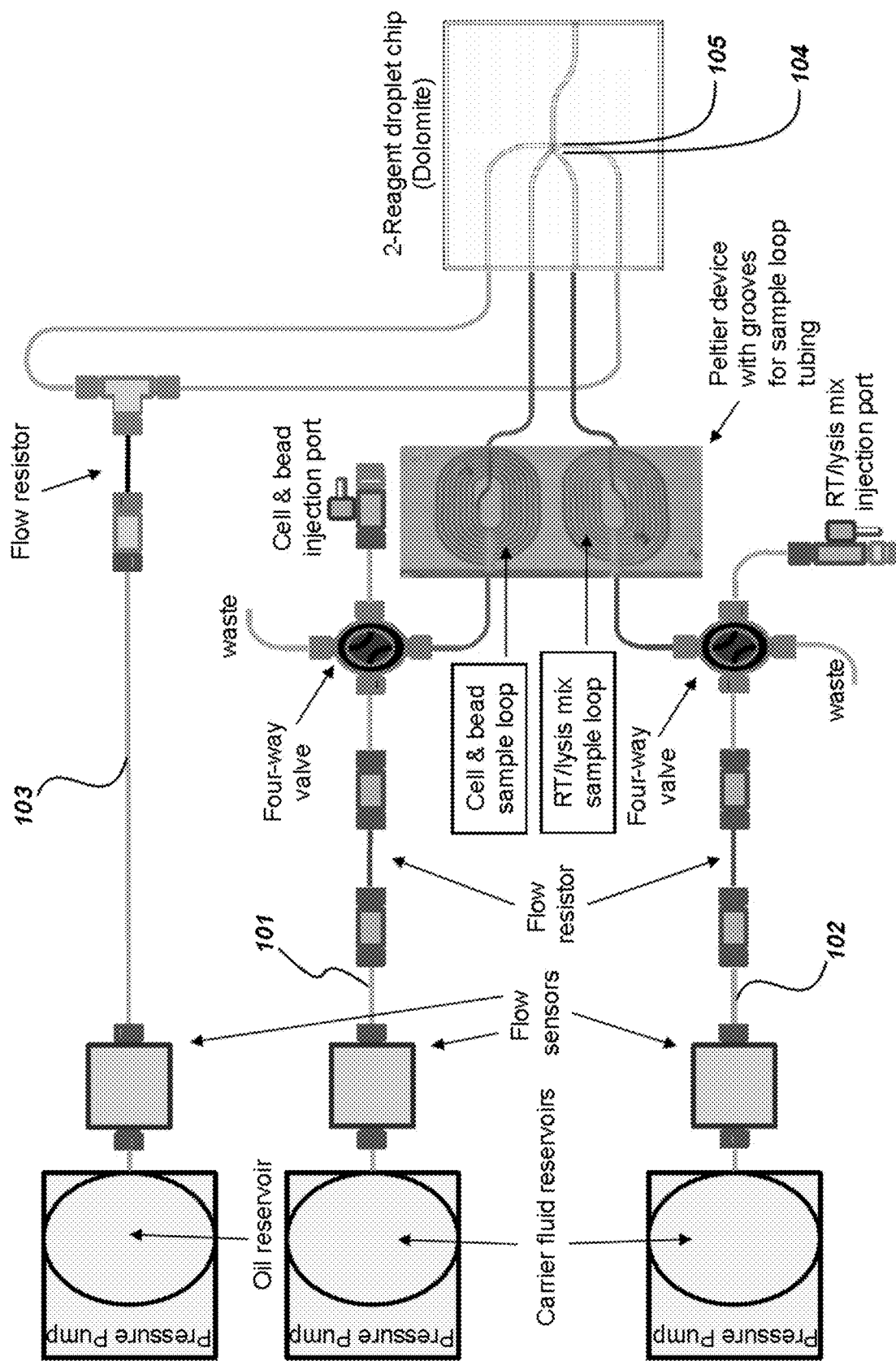

FIG. 17 shows a droplet device according to embodiments of the invention. Three Dolomite P-Pumps are equipped with flow sensors. The first P-Pump is connected directly to a 2-Reagent Droplet Chip via microfluidic tubing that incorporates a T-junction to split the line into two inputs. This is the oil input line. The other two P-Pumps are connected via fluidic tubing to FEP sample loops that fit into the grooves of a Peltier device used to keep samples chilled while the device is operating, and each of these loops is connected to the 2-Reagent Droplet Chip. Each sample loop incorporates a four-way valve at its front end so that sample can be loaded into the loop by means of a syringe. The first sample loop is to be filled with the cell and barcoded bead suspension while the second loop is to be filled with RT/lysis mix. The sample loops can be oriented horizontally and above or level with the droplet chip so as to avoid any uphill sections through which it may be difficult for cells and beads to travel.

Figure 18:
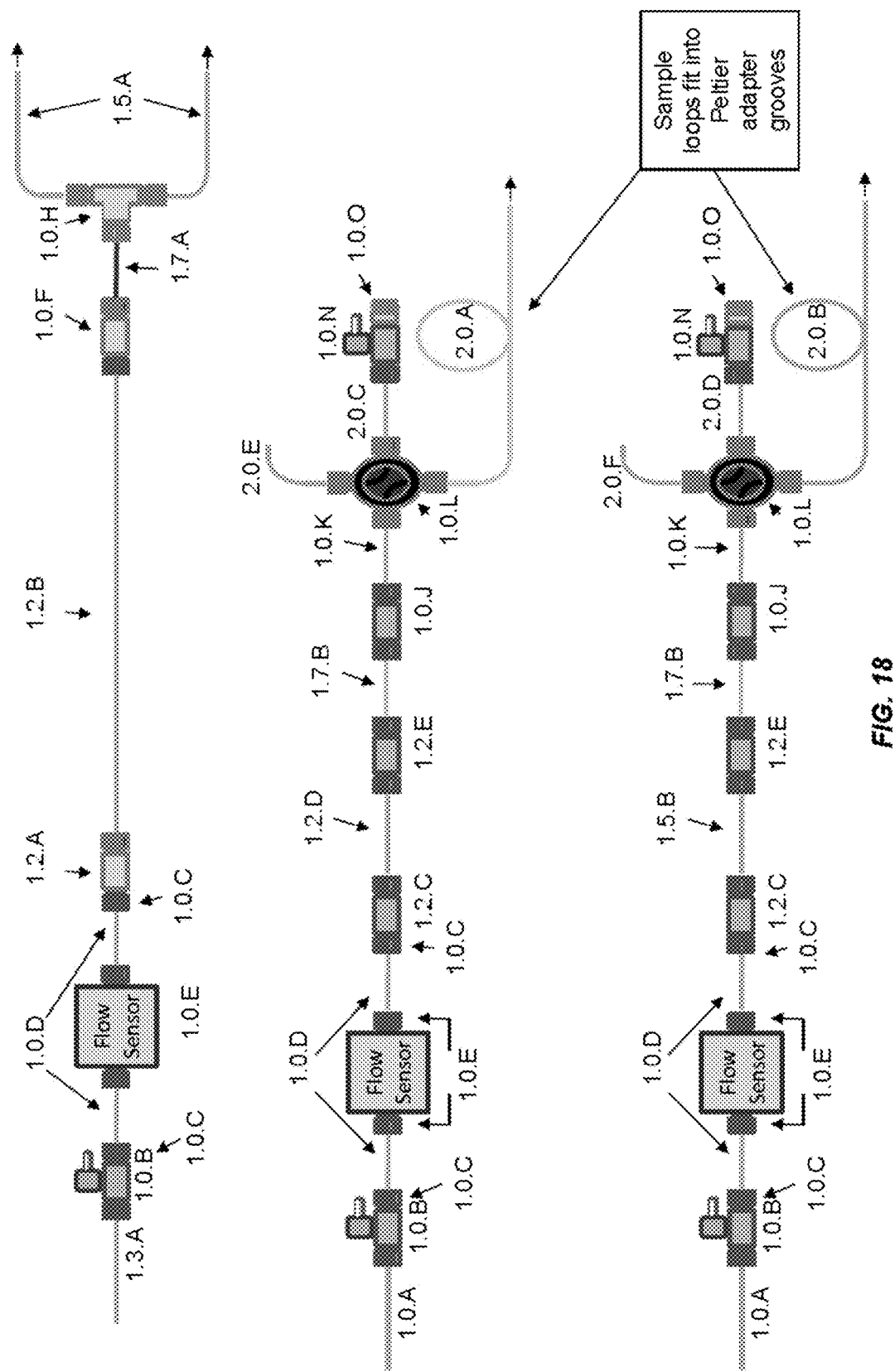

FIG. 18 provides details of the configuration of the droplet device shown in FIG. 17. Parts given by IDEX H&S part number: 1.0.A) 1528 (110 mm); 1.0.B) P-732; 1.0.C) P-232/P-248; 1.0.D) 1688 (300 mm); 1.0.E) M-645; 1.0.F) P-630; 1.0.H) P-632; 1.0.J) P-702; 1.0.K) 1529 (50 mm); 1.0.L) V-101D; 1.0.N) P-732; 1.0.O) P-624; 1.0.T) 1531 (900 mm); 1.2.A) P-630; 1.2.B) 1516 (500 mm); 1.2.C) P-702; 1.2.D) 1529 (150 mm); 1.2.E) P-702; 1.2.G) 1560 (150 mm); 1.3.A) 1528 (135 mm); 1.5.A) 1516 (150 mm); 1.5.B) 1529 (300 mm); 1.7.A) 61005; 1.7.B) 65020; 2.0.A) 1477 (1254 mm); 2.0.B) 1527 (1254 mm); 2.0.C) 1520 (120 mm); 2.0.D) 1520 (600 mm); 2.0.E) 1520 (200 mm); 2.0.F) 1520 (200 mm). Exit tubing (from the chip to the sample collection tube) is 180 mm of 1562.

Figure 19:
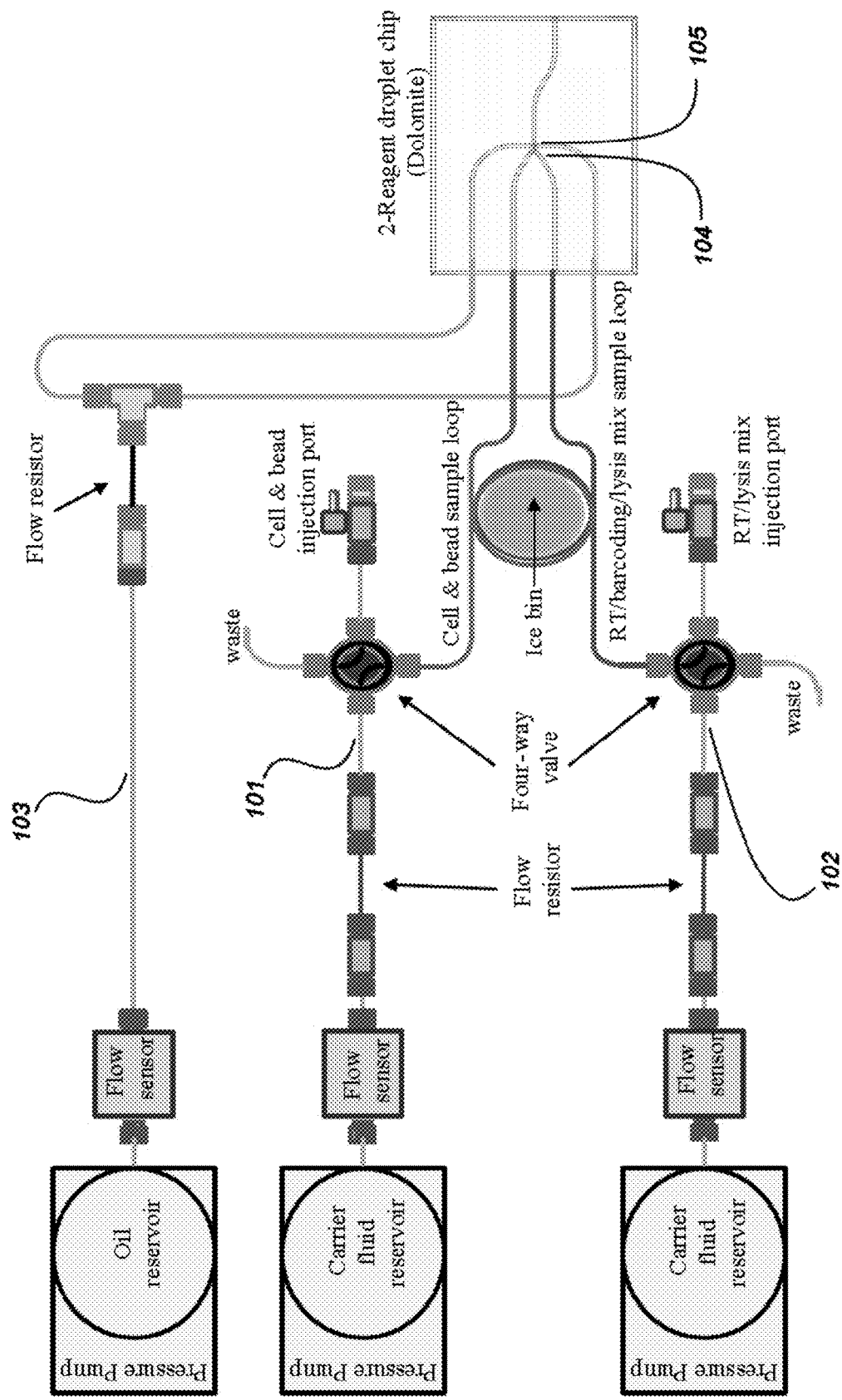

FIG. 19 shows an alternative embodiment of the droplet device described herein. The sample loops are in contact with an ice bin.

Figure 20:
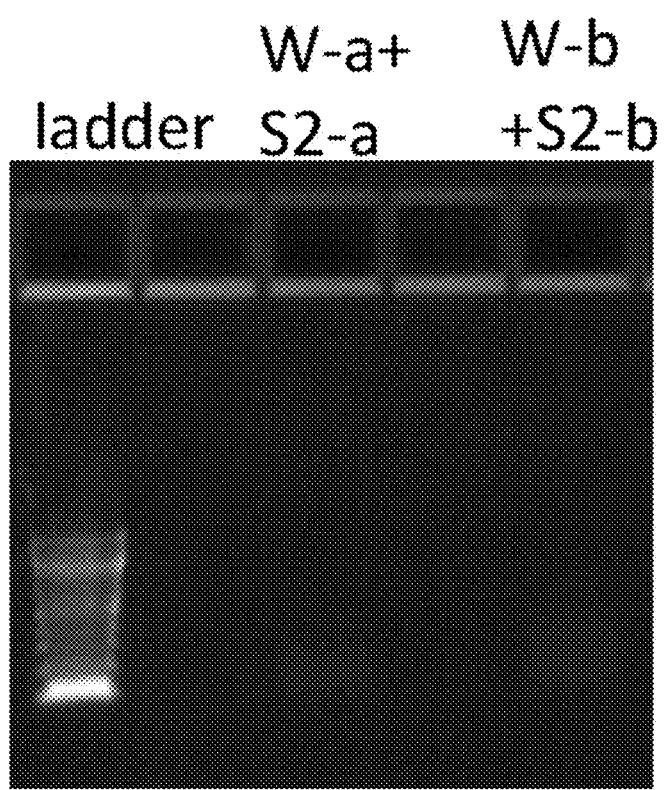

FIG. 20 shows RNA barcode adapters amplified from barcode adapter template beads, which were made using a multi-step approach. Barcode adapter template beads were used in an in vitro transcription reaction. Bands were present from beads made using S1-oligo+W-oligo-a+S2-oligo-a and S1-oligo+w-oligo-b+S2-oligo-b respectively.

Figure 21:
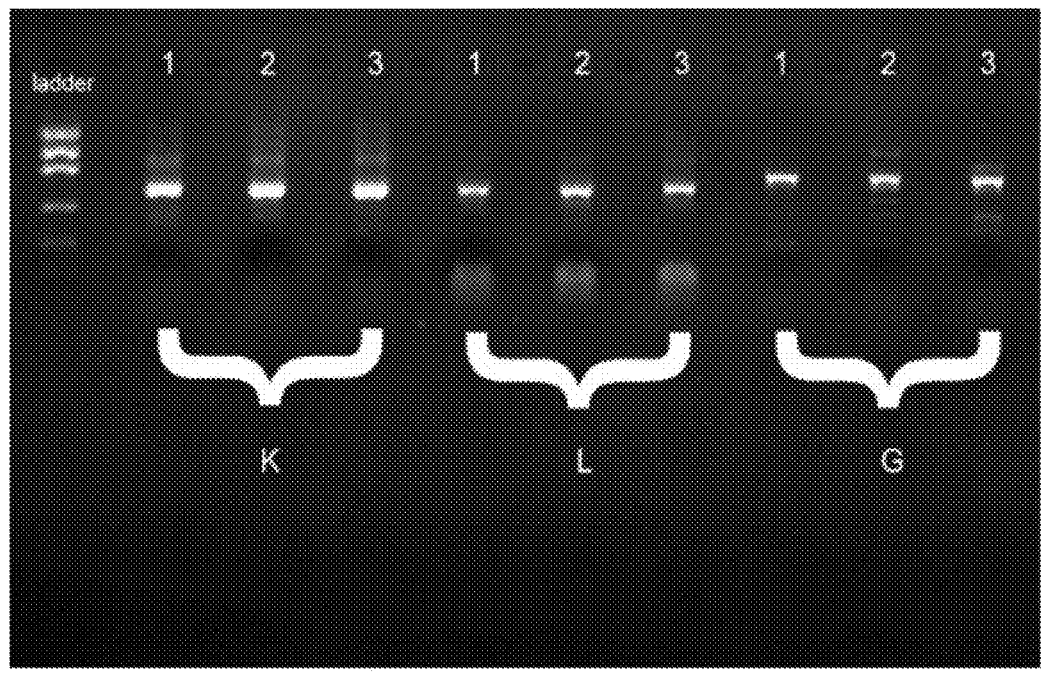

FIG. 21 shows a barcoding reaction performed in a variety of buffers. 1, 2, and 3 refer to three reaction buffers, which were respectively the 0.5×MMLV, 1× Thermopol DF and 0.5×TAE buffers described below. K, L, and G refer to kappa, lambda and gamma immunoglobulin chains. All chains were amplified in the different reaction buffers used.

Figure 22:
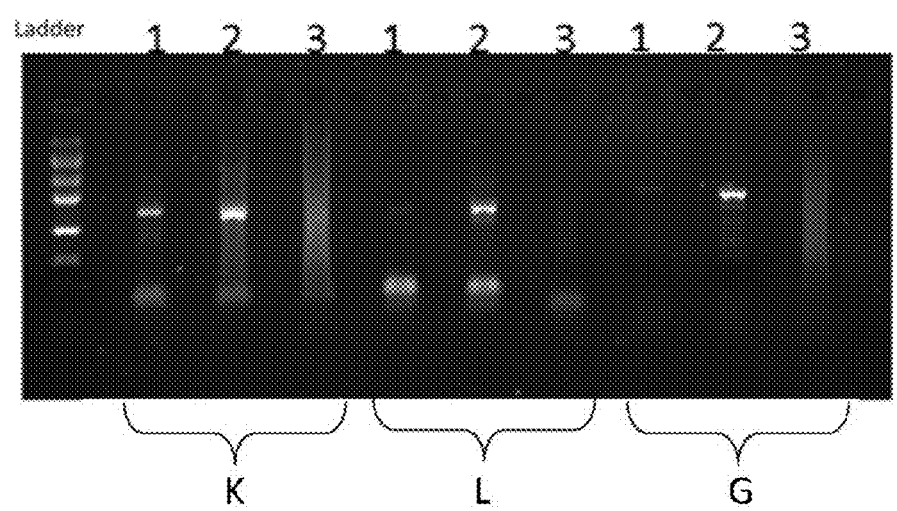

FIG. 22 shows that a barcoding reaction works better using RNA barcodes. 1, 2, and 3 refer to three reaction conditions, which were the 1×MMLV and 0.5×MMLV conditions using RNA barcode adapters, and 1×MMLV using DNA barcode adapters. K, L, and G refer to kappa, lambda and gamma immunoglobulin chains. The bands in the reaction using DNA adapters were obscured due to high background.

Figure 23:
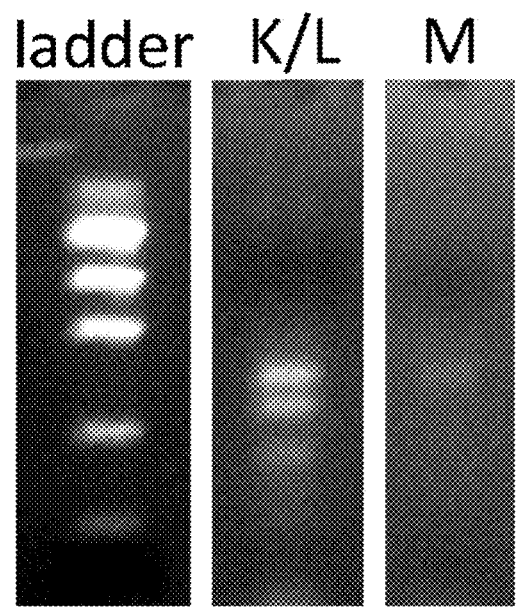

FIG. 23 shows amplified products from barcoding single B cells in droplet reaction containers with barcode adapter templates. The bands corresponding to kappa and lambda light chains ("K/L") and mu heavy chain ("M") can be clearly seen.

Figure 24:
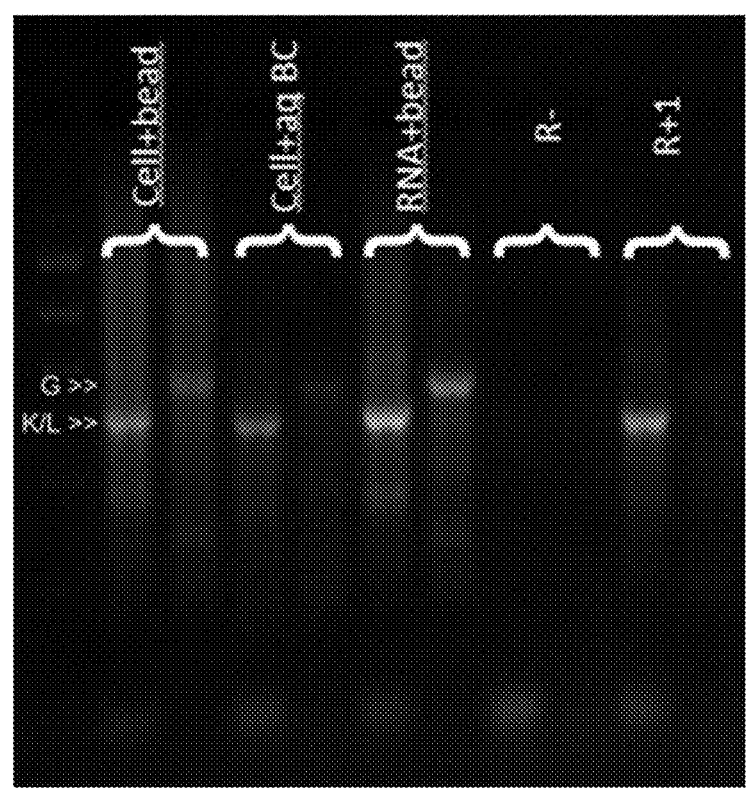

FIG. 24 shows RT/PCR amplification of light-chain (kappa/lambda) and heavy-chain (gamma) targets following co-encapsulation with barcoded beads in an aqueous-in-oil emulsion. Each sample is run in paired lanes—one for kappa/lambda light chain (left) and one for gamma heavy chain (right). Emulsion samples included the cell+bead co-encapsulated experimental sample (Cell+bead), as well as two control samples prepared identically except that in one, barcode template adapter beads were replaced with aqueous barcode adapter templates (Cell+aq BC), and one in which the cells were replaced with purified human PBMC RNA template obtained from AllCells (RNA+bead). Bulk positive and negative controls, which did not enter the emulsion device (R− and R+1 Respectively), were also included. Product bands were visible for the experimental sample and all positive controls, and were absent in the negative control.

Figure 25:
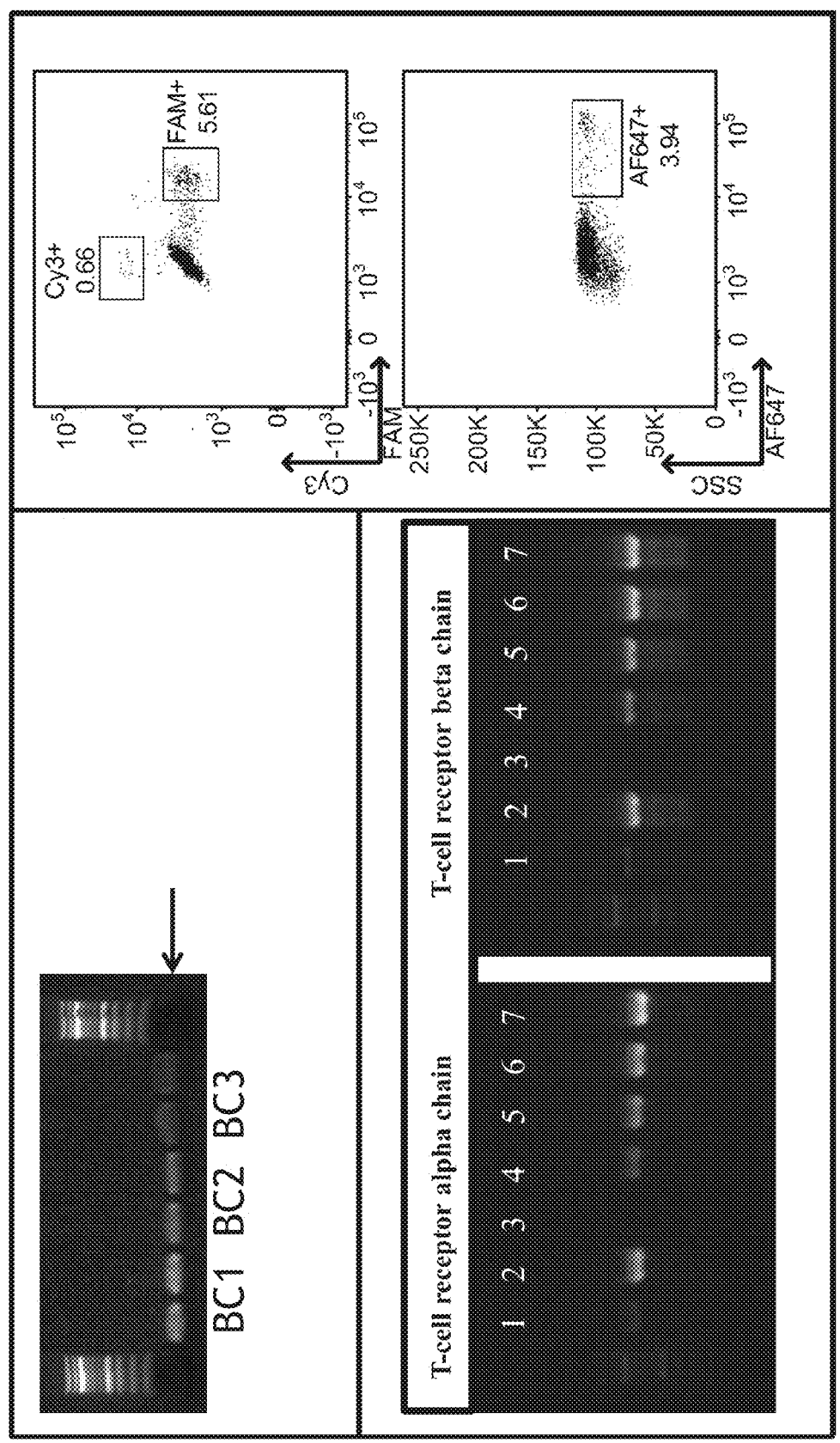

FIG. 25 illustrates methods of making barcode adapter template beads using multiple barcode adapter template types. Barcode-containing oligos were successfully generated with the expected length of 82 bp (upper left). Monocolor barcode adapter template beads were successfully obtained (right). The top graph was first gated on AF647- beads and the bottom graph was first gated on FAM-Cy3- beads so that the gates drawn in both graphs showed only monocolor beads. Beads were successfully used for barcoding RNA (lower left). Here, T cell receptor alpha and beta chains were successfully barcoded and amplified. Previously-generated beads were used as positive controls (lanes 1-2), and mono color barcode adapter template beads (lanes 4-7) were compared with a negative control (lane 3). DNA was analyzed on a 2% agarose gel, with a 100 bp ladder loaded in the left lane.

Figures 26, 27:
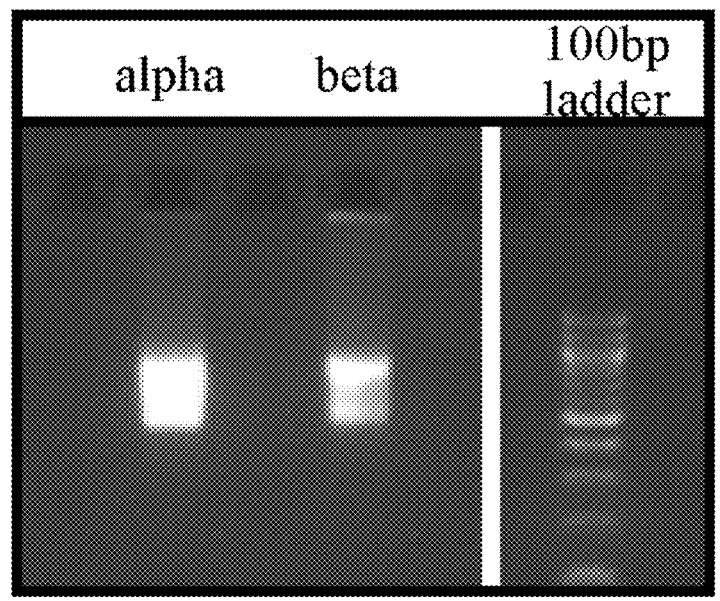

FIG. 26 illustrates efficient barcoding of T cell receptor alpha chain by encapsulating barcode adapter template beads and cells in droplets of varying sizes. Barcoded RNA was amplified after barcoding and analyzed on a 2% agarose gel.

FIG. 27 shows library PCR amplification products of TCR alpha and beta chains. Products were visualized on a 2% agarose gel. A 100 bp ladder was loaded in the right lane.

Figure 28:
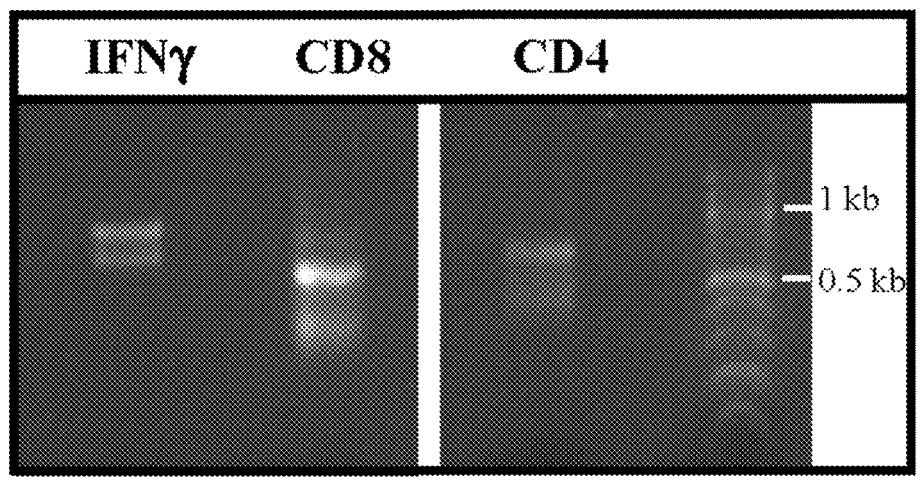

FIG. 28 shows library PCR amplification products of IFNγ, CD8 and CD4 genes. Products were visualized on a 2% agarose gel. A 100 bp ladder was loaded in the right lane.

Figure 29:
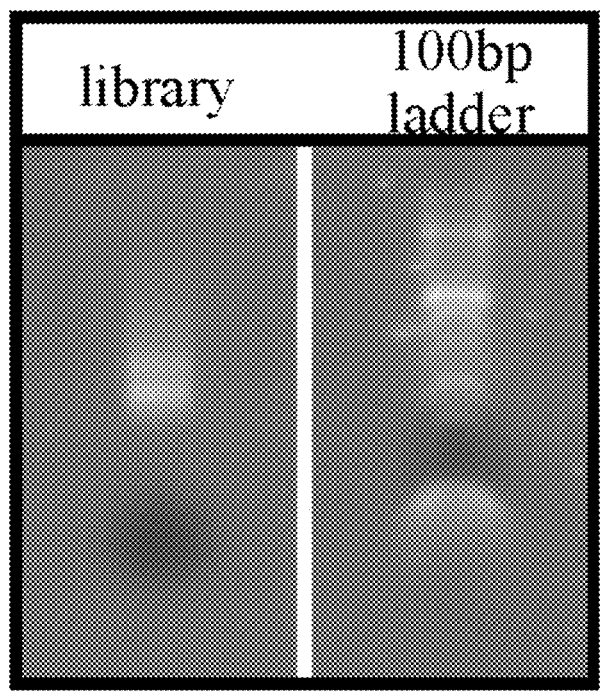

FIG. 29 shows library PCR amplification products of a transcriptomics library. Products were visualized on a 2% agarose gel. A 100 bp ladder was loaded in the right lane.

DEFINITIONS

As the term is used herein, "incorporating" a sequence into a polynucleotide refers to covalently linking a series of nucleotides with the rest of the polynucleotide, for example at the 3' or 5' end of the polynucleotide, by phosphodiester bonds, wherein the nucleotides are linked in the order prescribed by the sequence. A sequence has been "incorporated" into a polynucleotide, or equivalently the polynucleotide "incorporates" the sequence, if the polynucleotide contains the sequence or a complement thereof. Incorporation of a sequence into a polynucleotide can occur enzymatically (e.g., by ligation or polymerization) or using chemical synthesis (e.g., by phosphoramidite chemistry).

As used herein, the terms "amplify" and "amplification" refer to enzymatically copying the sequence of a polynucleotide, in whole or in part, so as to generate more polynucleotides that also contain the sequence or a complement thereof. The sequence being copied is referred to as the template sequence. Examples of amplification include DNA-templated RNA synthesis by RNA polymerase, RNA-templated first-strand cDNA synthesis by reverse transcriptase, and DNA-templated PCR amplification using a thermostable DNA polymerase. Amplification includes all primer-extension reactions.

As used herein, the term "isothermal" refers to a reaction, such as an enzymatic reaction, that is carried out at a constant temperature or range of temperatures.

The term "associated" is used herein to refer to the relationship between a sample and the DNA molecules, RNA molecules, or other polynucleotides originating from or derived from that sample. A polynucleotide is associated with a sample if it is an endogenous polynucleotide, i.e. it occurs in the sample at the time the sample is selected, or is derived from an endogenous polynucleotide. For example, the mRNAs endogenous to a cell are associated with that cell. cDNAs resulting from reverse transcription of these mRNAs, and DNA amplicons resulting from PCR amplification of the cDNAs, contain the sequences of the mRNAs and are also associated with the cell. The polynucleotides associated with a sample need not be located or synthesized in the sample, and are considered associated with the sample even after the sample has been destroyed (for example, after a cell has been lysed). Molecular barcoding or other techniques can be used to determine which polynucleotides in a mixture are associated with a particular sample.

As the term is used herein, a "reaction volume" (or equivalently a "container" or "compartment") is a space where a volume of liquid, for example an aqueous solution, can be held and remain segregated (e.g., isolated) from other such volumes of liquid or the surrounding medium. The segregation between a reaction volume and its surroundings can result from solid barriers around the reaction volume or from phase separation. For example, an aqueous microfluidic droplet suspended in a hydrophobic carrier fluid can constitute a reaction volume because water is immiscible in the carrier fluid. Thus, two droplets that are separated from each other in the carrier fluid remain segregated, and nucleic acids or other hydrophilic species dissolved in one droplet cannot exit the droplet or transit to another droplet. Reaction volumes can also be defined by, for example, flasks, beakers, centrifuge tubes, and wells in a multi-well plate.

"Adding" a barcode adapter to the RNAs associated with a sample involves introducing the adapter molecule into the reaction volume containing these RNAs, such that the RNAs can take part in a barcoding reaction. Once added, the barcode adapter can react directly with one or more RNAs, for example by hybridizing with an RNA, or can take part in a polymerization reaction or series of reactions (for example, reverse transcription or RT-PCR) in which RNA molecules serve as templates.

In some aspects, a composition can include a polynucleotide. The term "polynucleotide(s)" refers to nucleic acids such as DNA molecules and RNA molecules and analogs thereof (e.g., DNA or RNA generated using nucleotide analogs or using nucleic acid chemistry). As desired, the polynucleotides may be made synthetically, e.g., using art-recognized nucleic acid chemistry or enzymatically using, e.g., a polymerase, and, if desired, can be modified. Typical modifications include methylation, biotinylation, and other art-known modifications. In addition, a polynucleotide can be single-stranded or double-stranded and, where desired, linked to a detectable moiety. In some aspects, a polynucleotide can include hybrid molecules, e.g., comprising DNA and RNA.

"G," "C," "A," "T" and "U" each generally stand for a nucleotide that contains guanine, cytosine, adenine, thymidine and uracil as a base, respectively. However, it will be understood that the term "ribonucleotide" or "nucleotide"

can also refer to a modified nucleotide or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in nucleotide sequences by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods described herein.

As used herein, and unless otherwise indicated, the term "complementary," when used to describe a first nucleotide sequence in relation to a second nucleotide sequence, refers to the ability of a polynucleotide comprising the first nucleotide sequence to hybridize and form a duplex structure under certain conditions with a polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

Complementary sequences include base-pairing of a region of a polynucleotide comprising a first nucleotide sequence to a region of a polynucleotide comprising a second nucleotide sequence over the length or a portion of the length of one or both nucleotide sequences. Such sequences can be referred to as "complementary" with respect to each other herein. However, where a first sequence is referred to as "substantially complementary" with respect to a second sequence herein, the two sequences can be complementary, or they may include one or more, but generally not more than about 5, 4, 3, or 2 mismatched base pairs within regions that are base-paired. For two sequences with mismatched base pairs, the sequences will be considered "substantially complementary" as long as the two nucleotide sequences bind to each other via base-pairing.

"Complementary" sequences, as used herein, may also include, or be formed entirely from, non-Watson-Crick base pairs and/or base pairs formed from non-natural and modified nucleotides, in as far as the above embodiments with respect to their ability to hybridize are fulfilled. Such non-Watson-Crick base pairs includes, but are not limited to, G:U Wobble or Hoogstein base pairing.

The term percent "identity," in the context of two or more nucleic acid or polypeptide sequences, refer to two or more sequences or subsequences that have a specified percentage of nucleotides or amino acid residues that are the same, when compared and aligned for maximum correspondence, as measured using one of the sequence comparison algorithms described below (e.g., BLASTP and BLASTN or other algorithms available to persons of skill) or by visual inspection. Depending on the application, the percent "identity" can exist over a region of the sequence being compared, e.g., over a functional domain, or, alternatively, exist over the full length of the two sequences to be compared.

For sequence comparison, typically one sequence acts as a reference sequence to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally Ausubel et al., infra).

One example of an algorithm that is suitable for determining percent sequence identity and sequence similarity is the BLAST algorithm, which is described in Altschul et al., J. Mol. Biol. 215:403-410 (1990). Software for performing BLAST analyses is publicly available through the National Center for Biotechnology Information web-site. The BLAST algorithm parameters W, T, and X determine the sensitivity and speed of the alignment. The BLASTN program (for nucleotide sequences) uses as defaults a wordlength (W) of 11, an expectation (E) or 10, M=5, N=−4 and a comparison of both strands.

Identical sequences include 100% identity of a polynucleotide comprising a first nucleotide sequence to a polynucleotide comprising a second nucleotide sequence over the entire length of one or both nucleotide sequences. Such sequences can be referred to as "fully identical" with respect to each other herein. However, in some aspects, where a first sequence is referred to as "substantially identical" with respect to a second sequence herein, the two sequences can be fully complementary, or they may have one or more, but generally not more than about 5, 4, 3, or 2 mismatched nucleotides upon alignment. In some aspects, where a first sequence is referred to as "substantially identical" with respect to a second sequence herein, the two sequences can be fully complementary, or they may be at least about 50, 60, 70, 80, 81, 82, 83, 84, 85, 86, 87, 88, 89, 90, 91, 92, 93, 94, 95, 96, 97, 98, or 99% identical to each other. To determine the percent identity of two nucleotide sequences described herein, the default settings of BLASTN described above can be used.

Where a first sequence is referred to as "distinct" with respect to the identity of a second sequence herein, the two sequences have at least one or more mismatched nucleotides upon alignment. In some aspects, distinct sequences can have 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more mismatched nucleotides upon alignment. In some aspects, distinct sequences can be about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 81, 82, 83, 84, 85, 86, 87, 88, 89, 90, 91, 92, 93, 94, 95, 96, 97, 98, 99, or less than 100% identical to each other. In some aspects, where a first sequence is referred to as "distinct" with respect to a second sequence herein, the two sequences can have substantially or fully identical sequences, but instead differ from one another based upon differing patterns of modification within the sequences. Such modifications are generally known in the art, e.g., methylation.

In some aspects, a polynucleotide can be present in a library of polynucleotides. In some aspects, a polynucleotide library can include a plurality of polynucleotides. In some aspects, each polynucleotide in the plurality of polynucleotides can be derived from a single sample. In some aspects, a single sample can include a single cell such as a B cell.

Conventional notation is used herein to describe nucleotide sequences: the left-hand end of a single-stranded nucleotide sequence is the 5'-end; the left-hand direction of a double-stranded nucleotide sequence is referred to as the 5'-direction. The direction of 5' to 3' addition of nucleotides to nascent RNA transcripts is referred to as the transcription direction. The DNA strand having the same sequence as an mRNA is referred to as the "coding strand;" sequences on the DNA strand having the same sequence as an mRNA transcribed from that DNA and which are located 5' to the 5'-end of the RNA transcript are referred to as "upstream sequences;" sequences on the DNA strand having the same sequence as the RNA and which are 3' to the 3' end of the coding RNA transcript are referred to as "downstream sequences."

The term "messenger RNA" or "mRNA" refers to an RNA that is without introns and that can be translated into a polypeptide.

The term "cDNA" refers to a DNA that is complementary or identical to an mRNA, in either single stranded or double stranded form.

The term "amplicon" refers to the amplified product of a nucleic acid amplification reaction, e.g., RT-PCR.

The term "hybridize" refers to a sequence specific non-covalent binding interaction with a complementary nucleic acid. Hybridization may occur to all or a portion of a nucleic acid sequence. Those skilled in the art will recognize that the stability of a nucleic acid duplex, or hybrids, can be determined by the Tm. Additional guidance regarding hybridization conditions may be found in: Current Protocols in Molecular Biology, John Wiley & Sons, N.Y., 1989, 6.3.1-6.3.6 and in: Sambrook et al., Molecular Cloning, a Laboratory Manual, Cold Spring Harbor Laboratory Press, 1989, Vol. 3.

As used herein, "region" refers to a contiguous portion of the nucleotide sequence of a polynucleotide. Examples of regions are described herein an include identification regions, sample identification regions, plate identification regions, adapter regions, and the like. In some aspects, a polynucleotide can include one or more regions. In some aspects, a polynucleotide can include less than 2, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more regions. In some aspects, regions can be coupled. In some aspects, regions can be operatively coupled. In some aspects, regions can be physically coupled.

As used herein "variable region" refers to a variable nucleotide sequence that arises from a gene recombination or gene conversion event, such as V(D)J recombination and homologous recombination between upstream VH gene segments and rearranged VDJ genes to produce a final, expressed gene product. Examples are but not limited to immunoglobulin genes and T cell receptor genes. For example, it can include a V, J, and/or D region of an immunoglobulin or T cell receptor sequence isolated from a T cell or B cell of interest, such as an activated T cell or an activated B cell.

As used herein "B cell variable immunoglobulin region" refers to a variable immunoglobulin nucleotide sequence isolated from a B cell. For example, a variable immunoglobulin sequence can include a V, J, and/or D region of an immunoglobulin sequence isolated from a B cell of interest such as a memory B cell, an activated B cell, or plasmablast.

As used herein, "barcode" or "barcode sequence" refers to any unique sequence label that can be coupled to at least one nucleotide sequence for, e.g., later identification of the at least one nucleotide sequence.

As used herein, "barcode set" refers to any unique set of sequences that can be coupled to nucleotide sequences from a sample, where a nucleotide sequence is coupled to one barcode sequence in the set, for, e.g., later identification of the nucleotide sequences.

The terms "barcode adapter", "barcoded adapter", and "barcode adapter molecule" are used interchangeably herein to refer to an oligonucleotide that comprises a unique barcode sequence.

The terms "barcode adapter template", "adapter template", "template molecule", "barcode adapter construct", and "adapter construct" are used interchangeably herein to refer to a nucleic acid molecule comprising a barcode sequence that can be used as a template to amplify and produce single stranded barcode adapter molecules.

As used herein, "barcode adapter template bead" refers to a bead coupled to one or more barcode adapter templates.

As used herein, "barcoding" or "barcoding reaction" refers to a reaction that links a barcode sequence, or the complement of a barcode sequence, with a nucleic acid. The barcode adapter need not necessarily be covalently linked with the nucleic acid, but the barcode sequence information itself is linked with or incorporated into the nucleic acid. "Barcoding nucleic acids", "barcoding cells", "barcoding nucleic acids from cells", "barcoding nucleic acids from reaction containers", and "barcoding reaction containers" are used interchangeably.

As used herein "identification region" refers to a nucleotide sequence label (e.g., a unique barcode sequence) that can be coupled to at least one nucleotide sequence for, e.g., later identification of the at least one nucleotide sequence. In some aspects, a barcode sequence is used as a sample identification region. In some aspects, a barcode set is used as a sample identification region.

As used herein "immunoglobulin region" refers to a contiguous portion of nucleotide sequence from one or both chains (heavy and light) of an antibody.

As used herein "adapter region" or "adapter molecule" refers to a linker that couples a first nucleotide sequence to a second nucleotide sequence. In some aspects, an adapter region can include a contiguous portion of nucleotide sequence that acts as a linker. In some aspects, an adapter region or adapter molecule can include a binding site, such as a cDNA binding site. For example, a binding site can have the sequence GGG and couples a first sequence to a second sequence via binding between GGG and CCC. In some aspects, the adapter region or adapter molecule can comprise elements such as an RNA polymerase promoter, a nicking endonuclease restriction site, a universal priming sequence, a barcode, and a cDNA binding site.

The term "sample" can include RNA, DNA, a single cell or multiple cells or fragments of cells or an aliquot of body fluid, taken from a subject (e.g., a mammalian subject, an animal subject, a human subject, or a non-human animal subject). Samples can be selected by one of skill in the art using any means now known or later discovered including centrifugation, venipuncture, blood draw, excretion, swabbing, ejaculation, massage, biopsy, needle aspirate, lavage sample, scraping, surgical incision, laser capture microdissection, gradient separation, or intervention or other means known in the art. Samples can also be selected by one of skill in the art using one or more markers known to be associated with a sample of interest. Samples can also be selected using methods known in the art such as cell sorting and FACS.

DETAILED DESCRIPTION OF THE INVENTION

Embodiments of the invention provide a method to generate unique nucleic acid barcoded adapters in each reaction container such that the nucleic acid barcoded adapters are in aqueous phase but the template from which they were generated can either be attached to a solid surface (such as attached to beads) or be free in solution. Nucleic acid barcoded adapters are any polynucleotide sequence that comprise a unique barcode sequence and may or may not have modifications (for example, biotinylated or contain C18 spacers) or contain modified polynucleotides (such as 2'-O-methyl RNA bases).

Also provided are compositions generated using the methods disclosed herein. Accordingly, the present invention provides compositions of RNA and DNA adapters and constructs for their generation. Also provided are barcode adapter template bead libraries, emulsion droplet libraries loaded with RNA barcode adapters, emulsions containing barcode libraries with cells, barcoded cDNA libraries, and microfluidic droplet generating devices, among others.

Figure 1:
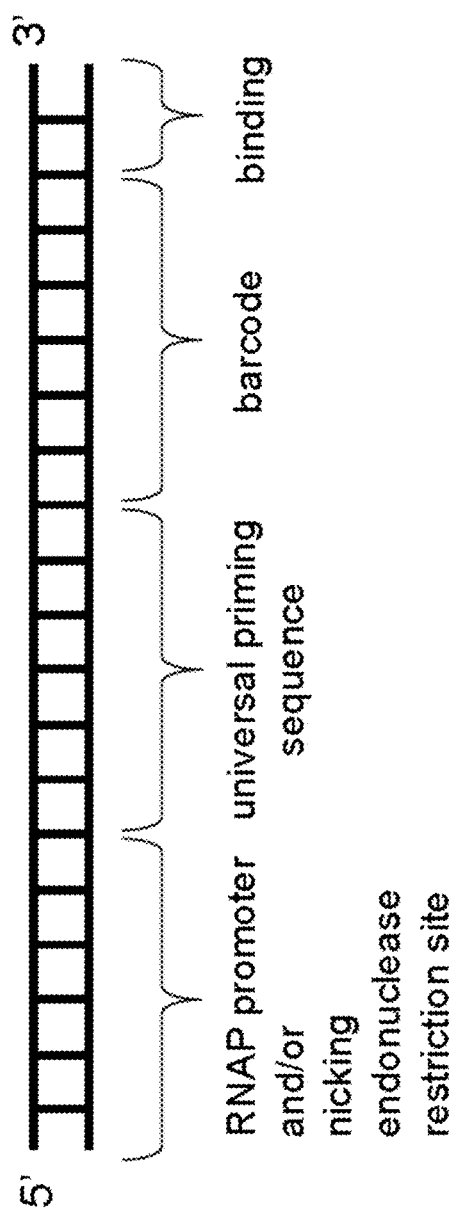
FIG. 1 is a map of an adapter molecule, or a template molecule for generating an adapter molecule, according to some embodiments of the invention. The sequence of an adapter molecule can include an RNA polymerase promoter and/or a nicking endonuclease site, followed by a universal priming sequence (used in subsequent PCR steps for annealing primers) followed by a barcode sequence and a nucleic acid binding sequence.

In some embodiments, the barcoded adapter template is a double-stranded DNA (dsDNA) template which comprises the following sequence: 5'-T7 promoter—universal priming sequence—barcode sequence—binding sequence-3'. The T7 promoter sequence allows for synthesis of an RNA barcoded adapter from the template by T7 RNA polymerase. The universal priming sequence is used for complementarity to PCR primers that are used downstream. The binding sequence consists of 1 or more guanine bases (G's) and allows for complementary base-pairing of the barcoded adapter to the 3' end of $1^{st}$ strand cDNA (FIG. 1).

Other promoter sequences can be used, such as but not limited to T3 and SP6 promoter sequences, which allows for synthesis of an RNA barcoded adapter by T3 and SP6 RNA polymerases respectively. Other RNA polymerases which do not have a specific promoter sequence may also be used, as long as a full length or near full length barcoded adapter is synthesized in a large fraction of cases (FIG. 2A). Isothermal amplification may also be used, typically using DNA polymerases with strand-displacement activity such as Bst large fragment and Klenow 3'→5'exo- as long as full length or near full length barcoded adapters are synthesized in a large fraction of cases. Specific primer or nicking endonuclease sequences may be used instead of a promoter sequence, depending on the isothermal amplification method used (FIG. 2B). Barcoded adapters thus generated will comprise DNA nucleotides instead of RNA nucleotides. Both RNA or DNA barcoded adapters can be attached to polynucleotides of interest.

Attaching barcoded adapters to 3' end of $1^{st}$ strand cDNA has been previously described (PCT/US2012/000221). Briefly, H-MMLV reverse transcriptases have a 3' dC tailing activity and add non-templated dCs to $1^{st}$ strand cDNA. If a barcoded adapter ending in at least 1 G is also present, the adapter can base-pair with the 3' dC of the $1^{st}$ strand cDNA and the reverse transcriptase undergoes template switching and continues transcription using the barcoded adapter as a template. The reverse transcriptase thus covalently adds the barcode sequence to the 3' end of the $1^{st}$ strand cDNA via phosphodiester bonds (FIG. 3).

In some embodiments, barcoded adapters are linearly amplified from double-stranded DNA (dsDNA) containing a 5' T7 promoter using a T7 RNA polymerase. In some embodiments, the barcoded adapters are linearly amplified in the same reaction as the reverse transcription reaction. Amplifying barcoded adapters from a dsDNA template provides at least the following advantages:
1. Barcoded adapter templates can be attached to beads (a unique barcode per bead) and stored in the same storage container
2. Multiple copies of a unique barcoded adapter can be delivered into a reaction container without use of an individual pipetting step
3. Barcoded adapters are amplified, overcoming the limited amount of polynucleotides that can be attached to each bead
4. Amplified barcodes are in aqueous phase and utilize much more rapid liquid phase rather than solid phase kinetics There are also advantages involved in using an RNA barcoded adapter rather than a DNA barcoded adapter:
1. An RNA barcoded adapter may be more efficient in the template switching reaction which attaches the barcode sequence to polynucleotides of interest as reverse transcriptases typically use RNA rather than DNA as a template and template switching is used by the reverse transcriptase in vivo to switch to an RNA template in the replication of retroviruses.
2. Using an entirely RNA transcript as an adapter results in less background when using proof-reading DNA polymerases in downstream PCR reactions. Background occurs when the barcode adapter misprimes and initiates reverse transcription, resulting in barcode adapter sequences added at both the 5' and 3' end of $1^{st}$ strand cDNA. These can be amplified in PCR by just one primer complementary to the barcode adapter. However, if proof-reading DNA polymerases are used during PCR, they will not transcribe the RNA primer (FIG. 4), eliminating background from barcode adapter mispriming.

Due to the large number of barcoding reactions involved, NextGen sequencing is best suited to sequencing the barcoded nucleic acids to bioinformatically associate nucleic acids from the same reaction container with one another. Additional barcodes may be associated with a set of samples that are distinct from another set of samples and can be associated using PCR primers with unique barcode sequences. These additional barcodes are also refered to as plate-IDs. Plate-IDs confer advantages such as distinguishing between different sets of samples in the same sequencing run, or bioinformatically tracking and eliminating any potential contaminations between different sets of samples.

As PCR and NextGen sequencing errors are unavoidable, the barcodes described herein can be designed to be a reasonable distance (e.g., Hamming or edit distance) apart in sequence space, so that the sequences of any two barcodes will differ from each other by at least several nucleotides. Thus, the majority of barcode sequencing reads can be correctly assigned, with a small percentage of unassigned and misassigned barcodes.

In some embodiments, pre-determined barcode sequences are designed with a minimum Hamming or edit distance apart. In some embodiments, barcodes comprise random nucleotides, such as $(N)_{15}$, which results in a total possible space of $4^{15}$, or ~1 billion unique barcode sequences. If the number of samples to be barcoded is much fewer than this total space, e.g. 1 million, or 0.1% of the total barcode space, we expect the barcodes should be of sufficient distance apart from one another that the majority of barcodes should be correctly assigned.

As long as the misassignment rate is sufficiently low, misassigned sequencing reads can be detected and discarded simply because the nucleic acids linked to the misassigned barcode sequence are different from the consensus sequence. We would expect the consensus sequence for each gene (e.g. gamma heavy chain, TCR alpha chain) associated to a barcode sequence to be assembled from correctly assigned reads as the barcode sequences were designed to be of a sufficient distance apart.

Samples in reaction containers can be barcoded with either a unique barcode, or a unique barcode set. A unique barcode set can be used by, e.g., delivering two or more barcode adapter template beads per reaction container, and each nucleic acid of a sample is barcoded with one of the barcodes in the unique barcode set. Nucleic acids are then associated to a sample by use of a unique barcode set.

One method to distinguish which barcode sets are used for which samples is by examining reads from NextGen sequencing. Each barcode sequence is expected to be associated with assembled contigs from different samples as barcode sequences are reused in unique barcode sets. But contigs from the same sample are expected to be identical. For example, identical immunoglobulin gamma heavy chain contigs may be observed to be using barcode sequences a, b and c. And barcode sequences a, b and d may be observed to be associated with another immunoglobulin gamma heavy chain contig. From this, we can then conclude that a, b and c comprise barcode set1, and a, b and d barcode set2.

In some embodiments, a library of barcode adapter template beads of N unique barcode sequences is sufficiently diverse to barcode n samples that such the majority of samples are barcoded with either a unique barcode or a unique barcode set. If the number of barcode adapter template beads greatly exceed N, sampling with replacement can be approximated, and the number of samples barcoded with a unique barcode, U follows the binomial distribution and is given by:

$$U = N * \binom{n}{k} p^k (1-p)^{n-k}$$

Where k=1, and p=1/N.

The fraction of samples that are not barcoded with a unique barcode (and thus have two or more samples associated with one another) is given by $$1 - U/n$$

The relationship between N, n and the fraction of samples not barcoded with a unique barcode is given in Table 1.

TABLE 1

Fraction of samples not barcoded with a unique barcode

| # unique barcodes (N) | # samples barcoded (n) | | | | |
|---|---|---|---|---|---|
| | 1,000 | 10,000 | 100,000 | 1,000,000 | 10,000,000 |
| 1,000 | 63.19% | 100.00% | 100.00% | 100.00% | 100.00% |
| 5,000 | 18.11% | 86.47% | 100.00% | 100.00% | 100.00% |

TABLE 1-continued

Fraction of samples not barcoded with a unique barcode

| # unique barcodes (N) | # samples barcoded (n) | | | | |
|---|---|---|---|---|---|
| | 1,000 | 10,000 | 100,000 | 1,000,000 | 10,000,000 |
| 10,000 | 9.51% | 63.21% | 100.00% | 100.00% | 100.00% |
| 50,000 | 1.98% | 18.13% | 86.47% | 100.00% | 100.00% |
| 100,000 | 0.99% | 9.52% | 63.21% | 100.00% | 100.00% |
| 500,000 | 0.20% | 1.98% | 18.13% | 86.47% | 100.00% |
| 1,000,000 | 0.10% | 0.99% | 9.52% | 63.21% | 100.00% |
| 5,000,000 | 0.02% | 0.20% | 1.98% | 18.13% | 86.47% |
| 10,000,000 | 0.01% | 0.10% | 1.00% | 9.52% | 63.21% |
| 50,000,000 | 0.00% | 0.02% | 0.20% | 1.98% | 18.13% |
| 100,000,000 | 0.00% | 0.01% | 0.10% | 1.00% | 9.52% |

As can be seen, if N=10n, >90% of the samples will be barcoded with a unique barcode.

The number of samples barcoded with a unique barcode set, $U_{SET}$, with x barcodes in a set also follows the binomial distribution, and can be thought of as a barcode library with $\binom{N}{x}$ unique barcode combinations (N is assumed to be sufficiently large that combination is essentially without repetition), with nx barcodes used to barcode n samples and is given by:

$$U_{SET} = \binom{N}{x} * \binom{n}{k} p^k (1-p)^{n-k}$$

Where k=1, and $$p = 1 \bigg/ \binom{N}{x}.$$

The fraction of samples that are not barcoded with a unique barcode (and thus have two or more samples associated with one another) is given by $$1 - U_{SET}/n$$

The relationship between N, n, x and the fraction of samples not barcoded with a unique barcode is given in Tables 2 and 3.

TABLE 2

Fraction of samples not barcoded with a unique barcode set when x = 2

| # unique barcodes (N) when using barcode set with x = 2 | # samples barcoded (n) | | | | |
|---|---|---|---|---|---|
| | 1,000 | 10,000 | 100,000 | 1,000,000 | 10,000,000 |
| 100 | 18.28% | 86.74% | 100.00% | 100.00% | 100.00% |
| 500 | 0.80% | 7.70% | 55.14% | 99.97% | 100.00% |
| 1,000 | 0.20% | 1.98% | 18.14% | 86.49% | 100.00% |
| 5,000 | 0.01% | 0.08% | 0.80% | 7.69% | 55.07% |
| 10,000 | 0.00% | 0.02% | 0.20% | 1.98% | 18.13% |
| 50,000 | 0.00% | 0.00% | 0.01% | 0.08% | 0.80% |
| 100,000 | 0.00% | 0.00% | 0.00% | 0.02% | 0.20% |

TABLE 3

Fraction of samples not barcoded with a unique barcode set when x = 3

| # unique barcodes (N) when using barcode set with | # samples barcoded (n) | | | | |
|---|---|---|---|---|---|
| x = 3 | 1,000 | 10,000 | 100,000 | 1,000,000 | 10,000,000 |
| 100 | 0.62% | 6.00% | 46.12% | 99.79% | 100.00% |
| 500 | 0.00% | 0.05% | 0.48% | 4.71% | 38.30% |
| 1,000 | 0.00% | 0.01% | 0.06% | 0.60% | 5.84% |
| 5,000 | 0.00% | 0.00% | 0.00% | 0.00% | 0.05% |
| 10,000 | 0.00% | 0.00% | 0.00% | 0.00% | 0.01% |
| 50,000 | 0.00% | 0.00% | 0.00% | 0.00% | 0.00% |
| 100,000 | 0.00% | 0.00% | 0.00% | 0.00% | 0.00% |

As can be seen, when using unique barcode sets instead of unique barcodes, a much smaller number of unique barcodes in the barcode adapter library is required to barcode a similar number of samples such that the majority of samples can be identified with a unique barcode set.

I. METHODS

A. Producing Polynucleotides of Interest

In some aspects, the present invention provides methods for producing one or more polynucleotides of interest. Such polynucleotides can be barcoded nucleic acids, for example cDNAs or DNA amplicons containing barcodes, wherein a common barcode or barcode set indicates that a group of polynucleotides are derived from the same sample. According to the methods, a plurality of RNAs associated with one or more samples is obtained as described below. The RNAs associated with each sample are present in a separate reaction volume. An adapter molecule is then added to the RNAs associated with each sample to incorporate a barcode sequence into one or more polynucleotides derived from the RNAs.

To maximize barcoding reaction kinetics, the barcode adapter is preferably free in solution prior to or at the time it is added to the RNAs. Adding the barcode adapter can be achieved by pipetting, by pouring one reaction volume into another, or by merging two or more reaction volumes. For example, the barcode adapter can be generated and/or encapsulated in one reaction volume, which can then be combined with another reaction volume containing RNAs associated with one sample (FIG. 5A-C). In some embodiments, the barcode adapter added to the RNAs from a sample is generated in situ in the reaction volume where the RNAs are present.

In some embodiments, barcode adapters are generated enzymatically from barcode adapter templates. A barcode adapter template can be a double-stranded DNA molecule containing a barcode sequence, as well as other sequence regions to facilitate generation of the barcode adapter and the subsequent barcoding of nucleic acids (FIG. 1). Barcode adapter templates can be prepared using standard molecular cloning techniques. In some embodiments, a barcode adapter template includes a promoter for RNA polymerase (RNAP), such as a T7, T3, or SP6 promoter. An RNA barcode adapter can then be generated by contacting the template molecule with an appropriate RNAP and allowing in vitro transcription to occur (FIG. 2A). In some embodiments, a barcode adapter template includes a nicking endonuclease restriction site, such as a Nt.BbvCI, Nt.BspQI, Nt.BsmAI, Nt.BstNBI, Nt.AlwI, or Nt.BsmAI site. DNA barcode adapters can be generated from such a template by contacting the template with a nicking endonuclease specific for the restriction site, and then exposing the template to a strand-displacing DNA polymerase (FIG. 2B). Examples of suitable strand-displacing DNA polymerases include Klenow exo-fragment, Bst Large Fragment, and engineered variants thereof. In general, barcode adapters are generated from barcode adapter templates by contacting the templates with one or more enzymes. In some embodiments, the enzymatic reactions are isothermal reactions.

A barcode adapter template can be free in solution when it is used to generate barcode adapters, or it can be bound to a solid support. Examples of solid supports that can be used in embodiments of the present methods and compositions include beads, chromatographic resins, multi-well plates, microcentrifuge tubes, or other objects having solid surfaces. A barcode adapter template can be bound to a solid support using any desired mechanism or capture chemistry, for example a biotin-avidin, biotin-streptavidin, or gold-thiol interaction. In some embodiments, any solid support to which a barcode adapter template is attached is contacted with an aqueous solution, and barcode adapter molecules generated from the template are released into this solution as they are generated (FIGS. 6A, 6B, 7A-D). The aqueous solution can be in the same reaction volume as the RNA molecules associated with the sample to which the barcode adapter molecule is to be added. That is, the barcode adapter molecule can be generated in situ for the barcoding reaction. Alternatively, the aqueous solution contacting the solid support for a barcode adapter template can be held in a different reaction volume from the target RNAs, and barcode adapters generated from the template can be added to these RNAs upon combining the two reaction volumes.

In some embodiments, barcode adapters are generated by cleaving barcode adapter templates from a solid support (FIGS. 7B and 7D). Template molecules can contain endonuclease restriction sites that facilitate cleavage of the template molecules upon exposure to an appropriate enzyme (e.g., a restriction endonuclease). The nucleic acid molecule that is released into solution upon such cleavage can serve as a barcode adapter and take part directly in a barcoding reaction, or can be subjected to further enzymatic reactions (e.g., in vitro transcription) to generate adapter molecules.

Regardless of how barcode adapter molecules are generated, libraries of these molecules can be prepared to barcode nucleic acids from many samples. Adapter molecules can be segregated into different reaction volumes, such that each reaction volume contains, for example, one adapter molecule on average. Alternatively, each reaction volume can contain multiple copies of an adapter molecule, wherein each copy contains the same barcode sequence. The reaction volumes can be microfluidic droplets or can be enclosed in microcentrifuge tubes or other containers.

A barcode adapter molecule can include, in addition to a barcode sequence, a universal priming sequence or universal priming region, and a binding site, as described below under "Compositions". The adapter molecule can also include a unique molecular identifier (UMI) sequence. In some embodiments, a UMI sequence contains randomized nucleotides and is incorporated into the barcode adapter (or the barcode adapter template from which the adapter is generated) independently of the barcode sequence. Thus, a set of barcode adapter molecules containing the same barcode sequence can contain different UMI sequences. In embodiments where the set of barcode adapter molecules containing the same barcode sequence but different UMI sequences is added to the RNAs associated with one sample, every RNA sequence can be linked to a different UMI sequence during barcoding. Methods of preparing barcode adapter template beads with UMI sequences, wherein the template molecules on each bead contain the same barcode sequence and a library of different UMI sequences, are disclosed below in Examples 12 and 13.

Barcode adapters can be RNA or DNA molecules, or RNA-DNA hybrids. For example, an adapter can include RNA nucleotides covalently linked to DNA nucleotides in a common oligonucleotide strand. A barcode adapter can also be single-stranded or double stranded. If double-stranded, the barcode adapter can have one or more blunt ends or ends with single-stranded overhangs.

In some embodiments, the barcode adapter is a single-stranded DNA molecule and serves as a primer for reverse transcription. The barcode adapter can be generated using a DNA polymerase (DNAP). Here, the binding site of the barcode adapter is an RNA binding site (e.g., an mRNA binding site) and contains a sequence region complementary to a sequence region in one or more RNAs. In some embodiments, the binding site is complementary to a sequence region common to all RNAs in the sample to which the barcode adapter is added. For example, the binding site can be a poly-T tract, which is complementary to the poly-A tails of eukaryotic mRNAs (FIG. 8). Alternatively or in addition, the binding site can include a random sequence tract (FIG. 9). Upon adding the barcode adapter to the RNAs associated with a sample, reverse transcription can occur and first strands of cDNA can be synthesized, such that the barcode sequence is incorporated into the first strands of cDNA. It will be recognized that reverse transcription requires appropriate conditions, for example the presence of an appropriate buffer and reverse transcriptase enzyme, and temperatures appropriate for annealing of the barcode adapter to RNAs and the activity of the enzyme. It will also be recognized that reverse transcription, involving a DNA primer and an RNA template, is most efficient when the 3' end of the primer is complementary to the template and can anneal directly to the template. Accordingly, the barcode adapter can be designed so that the binding site occurs at the 3' end of the adapter molecule.

When the barcode adapter is used as a primer for first strand cDNA synthesis in reverse transcription, and in other embodiments of the present methods involving reverse transcription (described below), the reverse transcription reaction can occur in the same reaction volume where the barcode adapter is generated. Thus, the barcode adapter can be added to a sample, or the RNAs associated with the sample, at the time the barcode adapter is generated. For example, a microfluidic droplet can contain a bead to which barcode adapter templates are bound, and a cell (FIG. 10). Barcode adapter molecules can be generated if one or more enzymes, such as a nicking endonuclease, strand-displacing DNA polymerase, or RNA polymerase, are also present in the droplet. Reverse transcription can then occur if lysis reagents are present in the droplet to release RNAs from the cell, and if reverse transcriptase, primers, and other appropriate reagents are present. Enzymes and reagents for generating barcode adapters and facilitating lysis and reverse transcription can be added to the droplet all at once, for example by merging a droplet containing the enzymes and reagents with the droplet containing the bead and cell, or can be added in steps.

In some embodiments of the present methods, the RNAs associated with each sample are reverse-transcribed but the barcode adapter does not prime first strand cDNA synthesis. Instead, a standard DNA primer containing a poly-T tract, random sequence, or other RNA binding site is used. In these embodiments, the barcode adapter can be generated in the same compartment or reaction volume where first-strand cDNA synthesis occurs. In this case, it can be beneficial to include a buffer in the reaction volume with Tris, potassium ions, chloride ions, sulphate ions, ammonium ions, acetic acid ions, and/or magnesium ions at a pH of about 8.0 to 8.8. Alternatively, the barcode adapter can be generated and first strand cDNA synthesis can occur in different compartments, in which case the compartments can be combined before or after first strand cDNA synthesis, as desired. The compartments can also be combined before or after the barcode adapter is generated. The different possibilities for carrying out enzymatic reactions and combining compartments provide flexibility for optimizing reaction conditions. Regardless of how the barcode adapter is added to the RNAs associated with a sample, however, the barcode adapter can take part in enzymatic barcoding reactions during or immediately after first strand cDNA synthesis.

As described above, the present methods can employ a reverse transcriptase enzyme (for example MMLV H⁻ reverse transcriptase) that adds one or more non-templated nucleotides (such as Cs) to the end of a nascent cDNA strand upon reaching the 5' end of the template RNA. These nucleotides form a 3' DNA overhang at one end of the RNA/DNA duplex. If a second RNA molecule contains a sequence region, for example a poly-G tract at its 3' end, that is complementary to the non-templated nucleotides, and binds to the non-templated nucleotides, the reverse transcriptase can switch templates and continue extending the cDNA, now using the second RNA molecule as a template. Such a second RNA molecule is referred to herein and known in the art as a template-switching oligonucleotide.

In embodiments of the present methods, the barcode adapter serves as a template-switching oligonucleotide for reverse transcription (FIG. 3). Thus, the barcode sequence is incorporated into the first strand of cDNA after template switching, and is present in DNA molecules resulting from amplification (for example, by PCR) of the first strand of cDNA. In these embodiments, any reverse transcriptase that has template switching activity can be used. The binding site of the barcode adapter is a cDNA binding site and preferably occurs at the 3' end of the adapter molecule. The binding site can include a G-tract (comprising one or more G nucleotides), or any other sequence that is at least partially complementary to that of the 3' overhang generated by the reverse transcriptase. It will be recognized that the overhang sequence, and thus an appropriate sequence for the binding site of the barcode adapter, may depend on the choice of reverse transcriptase used in the method.

In other embodiments, the RNAs associated with each sample are reverse-transcribed, but a barcode sequence is not incorporated into the first strand of cDNA at all. That is, the barcode adapter does not serve as a primer for first strand cDNA synthesis or as a strand-switching oligonucleotide. Rather, the barcode adapter serves as a primer for PCR amplification of the first strand of cDNA or its complement. In these embodiments, the cDNA is amplified using a forward primer and a reverse primer, where the reverse primer has the same sequence as at least a portion of the primer for first-strand cDNA synthesis. The barcode adapter can be either the forward primer or the reverse primer, and is a single-stranded DNA oligonucleotide. When the barcode adapter is the forward primer, it can anneal to a part of the first-strand cDNA (or its complement) resulting from extension of the cDNA following strand-switching (FIG. 11). Alternatively, the barcode adapter can anneal to a part of the first-strand cDNA templated on an RNA from the sample. Thus, template switching, and the addition of a template-switching oligonucleotide to the reaction volume for the sample, need not occur to carry out these embodiments of the invention. When the barcode adapter is the reverse primer, it can be used in conjunction with any primer for first-strand cDNA synthesis, including a primer that includes a random sequence (FIGS. 12 and 13).

The methods of the present invention can be practiced with any desired samples. In some embodiments, each sample includes a cell, and can be for example a single cell. A cell can be enclosed in a reaction volume such as a microfluidic droplet, and if desired can be lysed to release RNA molecules into the reaction volume. For this purpose, the cell can be contacted with a lysis buffer at any convenient time. The cell can be a B cell, for example, a plasmablast, memory B cell, or plasma cell, or any other kind of cell.

The inventors have found that cells can be advantageously suspended in a cell suspension buffer comprising an osmoprotectant prior to lysis. The osmoprotectant can protect the cells from osmotic stress and ensure that cellular physiology remains stable or unperturbed prior to barcoding. In some embodiments, cells are suspended in the cell suspension buffer along with barcode adapter molecules and/or barcode adapter templates. In some embodiments, cells are suspended in the cell suspension buffer before being contacted with reagents for reverse transcription, PCR, and/or lysis. The cell suspension buffer can be included in any reaction volume and is compatible with the methods described herein for forming and combining aqueous reaction volumes.

In some embodiments, the osmoprotectant in the cell suspension buffer is a betaine or a close structural analog thereof. Examples of betaines and close structural analogs include glycine betaine (also called N,N,N-trimethylglycine), proline betaine (also called stachydrine), beta-alanine betaine, ectoine, choline-O-sulfate, trigonelline, dimethylsulfoniopropionate (DMSP), and dimethylthetin. In some embodiments, the osmoprotectant is glycine betaine. In addition to serving as osmoprotectants, betaines have been shown to reduce the formation of secondary structure in PCR and improve the specificity of amplification. Betaines can therefore can be generally beneficial to include in the present methods.

In some embodiments, the osmoprotectant is a sugar or polyol, such as trehalose. Other useful sugars or polyols include sucrose, fructose, raffinose, mannitol, and myo-inositol. In some embodiments, the osmoprotectant is an amino acid such as proline. A single osmoprotectant can be included in the cell suspension buffer, or multiple osmoprotectants can be included in combination. Each osmoprotectant can be present at any useful concentration. In some embodiments, the osmolarity of the cell suspension buffer is about 250-350 mOsm/L. In some embodiments, the osmoprotectant contributes up to 10%, 20%, 30%, 40%, 50%, 60%, 70%, 80%, 90%, or 100% of the osmolarity of the buffer. An exemplary cell suspension buffer used herein (see, e.g., Examples 7-9, 11, and 14) includes about 230-330 mM betaine and about 10 mM NaCl.

In embodiments where each sample includes at least one cell, the RNAs associated with the sample can include mRNAs. The sample can include, for example, at least 1, 3, 10, 30, 100, 300, 1,000, 3,000, 10,000, 30,000, 100,000, 300,000, or 1,000,000 mRNA molecules, which can represent any number of genes, alleles, reading frames, or distinct sequences. In some embodiments, the RNAs associated with the sample include all mRNAs from the sample, a full or partial transcriptome of the cell, or the total RNA from the cell.

It will be recognized that more RNAs per sample can be barcoded and more polynucleotides of interest can be produced if larger numbers of barcode adapter molecules can be delivered to the reaction volume for each sample. However, without being bound by any theory, the present methods place no limits on the number of RNAs that can be barcoded per sample, Accordingly, the number of polynucleotides of interest produced per sample can be at least 10, 30, 100, 300, 1,000, 3,000, 10,000, 30,000, 100,000, 300,000, or 1,000, 000. Each polynucleotide of interest can be present in multiple copies. Furthermore, the number of cells or samples that can be barcoded in one execution of the method is limited only by the challenges (discussed above) of preparing many barcode adapter templates with unique barcode sequences. In some embodiments, the one or more samples include at least 10, 30, 100, 300, 1,000, 3,000, 10,000, 30,000, 100,000, 300,000, or 1,000,000 cells. Samples (for example, each being a single cell) can be obtained from the same subject or different subjects. For example, at least 2, 3, 4, 5, 6, 7, 8, 9, 10, 20, 30, 40, 50, 60, 70, 80, 90 or 100 different subjects can provide samples.

The present methods can also be used to interrogate a population of cells for a phenotype of interest using a nucleic acid marker. The nucleic acid marker includes a nucleic acid linked to a binder, which can specifically bind to a subset of cells from the population that do or do not present the phenotype. For example, the binder can bind to certain proteins, glycoproteins, glycolipids, or other moieties present on the surfaces of some cells. In some embodiments, the binder is a molecular label such as an antibody, antigen, or protein (FIGS. 14A-C). In some embodiments, the binder is a peptide-MHC complex. The nucleic acid can be linked to the binder covalently, using a non-covalent capture moiety, or otherwise as desired.

To interrogate cells for the phenotype, cells are contacted with the nucleic acid marker and then washed. Thus, the nucleic acid marker is retained only on the cells to which the binder binds. The cells can then be enclosed in reaction volumes and lysed as described above, so that RNAs in the cells can be barcoded. During the barcoding reaction, the nucleic acid of the nucleic acid marker is also barcoded, so that the marker sequence appears in RNA or amplicon sequencing data for a cell that retains the marker. In some embodiments, the nucleic acid of the nucleic acid marker is an RNA molecule with a sequence not endogenous to cells of the population. In some embodiments, the nucleic acid is a double-stranded DNA molecule comprising an RNAP promoter. Thus, the nucleic acid can be transcribed while in the same reaction volume as the cell (or a lysate thereof), and the resulting RNA molecules can be barcoded along with RNAs from the cell.

Cells can be interrogated for multiple phenotypes using multiple nucleic acid markers, each including a different binder linked to a different nucleic acid sequence. For example, cells can be contacted with a first nucleic acid marker and a second nucleic acid marker, wherein each nucleic acid marker includes a molecular label linked to a nucleic acid. The molecular labels of the two nucleic acid markers can be different from each other (for example, be different proteins or have affinities for different cell surface moieties). The nucleic acids linked to these molecular labels can contain sequences that differ from each other in whole or in part. Cells can be contacted with two or more nucleic acid markers simultaneously or sequentially.

As a further example, three antibodies can be linked to different non-endogenous RNA sequences, and barcoded sequencing data for cells treated with these antibodies can reveal whether each cell presents targets for none, some, or all of the antibodies. The copy number of barcoded amplicons may also reveal phenotypes by degree, for example the relative abundances of a cell surface moiety on different cells, where the moiety is targeted by the nucleic acid marker.

B. Attaching Polynucleotides to Solid Supports

Another aspect of the present invention provides methods for attaching a polynucleotide to a solid support, wherein the polynucleotide contains a barcode sequence. The polynucleotide can be a barcode adapter template or a precursor to such a template. The polynucleotide can thus be used as described above to enzymatically generate barcode adapters and incorporate the barcode sequences into amplicons derived from RNAs.

In some embodiments, the methods involve generating a hydrophilic compartment (i.e., an aqueous droplet) of an inverse emulsion. The compartment can be generated as desired, for example by mixing an aqueous solution in a hydrophobic carrier fluid and optionally agitating the mixture. The aqueous solution can have a solid support, oligonucleotides, and reagents suspended therein, so that each compartment contains all necessary components for attaching the polynucleotide to the solid support when the compartment is formed. In these embodiments, prior to adding the solid support to the compartment, an oligonucleotide is bound to the surface of the solid support via a capture moiety. This oligonucleotide is referred to herein as the "bound oligonucleotide" and contains a 3' sequence complementary to a 3' sequence of a barcode oligonucleotide. The polynucleotide is thus formed on the solid support through a polymerase extension reaction involving the bound oligonucleotide and barcode oligonucleotide, and this reaction takes place within the compartment.

In preferred embodiments, when the hydrophilic compartment is formed, the barcode oligonucleotide is present at a low or limiting concentration (for example, one molecule per compartment). This concentration is convenient when a library of barcode oligonucleotides having randomized sequences is used to prepare a plurality of barcode template beads. If every barcode oligonucleotide is assumed to have a different barcode sequence, and the solid support in each compartment is desired to have only one barcode sequence, then one barcode oligonucleotide (at most or on average) can be present per compartment. Once this condition is met, multiple solid supports (e.g., multiple beads) can be present in a compartment, or multiple copies of the bound oligonucleotide can be bound to each solid support, but all polynucleotides resulting from the polymerase extension reaction in the compartment will contain the same barcode sequence.

Preferred solid supports for use in the present methods are beads, for example spherical beads made of metals and/or polymeric materials and having diameters in the range of ~0.1 to 10 micrometers. Beads having other characteristics can be used instead or in addition. The solid support can be functionalized with a capture moiety to attach the bound oligonucleotide to the surface (FIG. 15, left). Examples of capture moieties include avidin, streptavidin, biotin, carboxyl groups, epoxy groups, hydroxyl groups, thiol groups, and gold. Some capture moieties have binding partners to which they bind specifically and non-covalently. For example, streptavidin takes biotin as its binding partner. Such a capture moiety can be coupled directly (e.g., covalently) to the solid support, and the binding partner can be coupled to the bound oligonucleotide, or vice versa, so that the bound oligonucleotide is bound to the solid support through a non-covalent interaction. Other capture moieties provide a direct covalent linkage between the bound oligonucleotide and solid support.

The bound oligonucleotide is preferably a single-stranded DNA molecule that is bound to the solid support at its 5' end. Thus, 3' end of the bound oligonucleotide is free in solution and, when hybridized to the barcode oligonucleotide, can be extended by an enzyme such as DNA polymerase. The extension reaction is templated using the barcode oligonucleotide, so that the barcode sequence gets incorporated into the DNA strand bound to the bead. If desired, the bound oligonucleotide and/or the barcode oligonucleotide can have sequences designed to minimize intramolecular secondary structure.

The barcode oligonucleotide can contain sequence regions discussed above, such as a universal priming sequence and/or a binding site. Upon performing a primer extension reaction with the bound oligonucleotide and the barcode oligonucleotide, these sequence regions will be incorporated into the polynucleotide bound to the solid support. If the polynucleotide is subsequently used as a barcode adapter template, the sequence regions will also be present in barcode adapter molecules generated from the template. Other sequences, such as an RNAP promoter and/or a nicking endonuclease restriction site, can be included in the barcode oligonucleotide to facilitate the enzymatic production of barcode adapter molecules. The RNAP promoter can be selected from the group consisting of T7, T3, and SP6 promoters. The nicking endonuclease restriction site can be selected from the group consisting of Nt.BbvCI, Nt.BspQI, Nt.BsmAI, Nt.BstNBI, Nt.AlwI, and Nt.BsmAI sites. The binding site within the barcode oligonucleotide can contain one or more G nucleotides.

In some embodiments, the barcode sequence and other sequence regions are incorporated into the bound oligonucleotide and/or the polynucleotide attached to solid support using PCR (FIG. 15, right). In these embodiments, the barcode oligonucleotide serves as a template for PCR, and the bound oligonucleotide serves as a primer, with enzymatic extension of the bound oligonucleotide proceeding from its 3' end. The barcode oligonucleotide also includes a 5' sequence identical or complementary to a PCR reverse primer sequence. Thus, a reverse primer can anneal to the 5' end of the barcode oligonucleotide (or its complement) and prime extension in a direction opposite that of the bound oligonucleotide. If desired, this reverse primer can be fluorophore-labeled, so that polynucleotides generated by PCR and attached to the solid support are fluorescent. The label can be used to determine whether a solid support (for example, a bead) has been successfully attached to a polynucleotide that includes the barcode sequence.

The above methods can be performed in a single step. In other embodiments of the present methods, a polynucleotide containing a barcode sequence is attached to a solid support in multiple steps. In these embodiments, the barcode sequence is made up of several sequence regions, for example $S1_x$, W, and $S2_y$ regions. These sequence regions can be introduced into the polynucleotide as part of two or more barcode oligonucleotides, with each barcode oligonucleotide being used in a separate step or enzymatic reaction. In the polynucleotide resulting from the separate steps, the $S1_x$, W, and $S2_y$ regions are not necessarily contiguous. Various $S1_x$, W, and $S2_y$ sequences can be combined on different solid supports to form different barcodes sequences or libraries of barcode sequences.

To attach a polynucleotide to a solid support in multiple steps, wherein the polynucleotide contains a barcode sequence, a solid support and oligonucleotide bound to the solid support are provided as described above. The solid support and bound oligonucleotide can be provided in a hydrophilic compartment of an emulsion, or in any other desired reaction volume. Also provided is a first barcode oligonucleotide (FIG. 16, top and middle). The bound oligonucleotide comprises an $S1_x$ sequence and a sequence complementary to a 3' sequence of the first barcode oligonucleotide. The first barcode oligonucleotide comprises a W sequence. In the first step of the multistep procedure, a polymerase extension reaction or a ligation reaction is performed to incorporate the W sequence into the bound oligonucleotide. Thus, after this step, the $S1_x$ sequence and W sequence are present in the same nucleic acid strand bound to the solid support. If an extension reaction is used, the bound oligonucleotide can serve as a primer and the first barcode oligonucleotide can serve as a template, as discussed above for the single-step procedure, so that the bound oligonucleotide is extended from its 3' end. In some embodiments, a portion of the first barcode oligonucleotide that is complementary to the $S1_x$ sequence in the bound oligonucleotide contains an inosine tract.

Subsequently, a second barcode oligonucleotide is provided to incorporate a $S2_y$ sequence into the bound oligonucleotide (FIG. 16, bottom). The second barcode oligonucleotide comprises the $S2_y$ sequence, as well as a 3' sequence complementary to the 3' end of the bound oligonucleotide resulting from the first step of the multistep procedure. Thus, the second barcode oligonucleotide may include a sequence region complementary or identical to a portion of the first barcode oligonucleotide. The second barcode oligonucleotide is reacted with the bound oligonucleotide (now extended to include both the $S1_x$ sequence and the W sequence) through a polymerase extension reaction or ligation reaction. After this step, the $S1_x$, W, and $S2_y$ sequences are all present in the same nucleic acid strand bound to the solid support.

As desired, the same or different reaction conditions can be used for the first and second steps of a multistep procedure to attach a polynucleotide to a solid support. For example, the same enzyme (e.g., a DNA polymerase) or different enzymes (e.g., a DNA polymerase and a ligase) can be used for reactions of the first barcode oligonucleotide and second barcode oligonucleotide, although using the same enzyme can be more convenient. To mix reagents and the solid support for consecutive steps, reagents can be apportioned into reaction volumes, and reaction volumes can be split, combined, or otherwise handled, all as desired. For example, the solid support and bound oligonucleotide can be distributed into many reaction volumes, and different first barcode oligonucleotides can be added to each reaction volume, so that different W sequences are coupled to the same $S1_x$ sequence. Each of these reaction volumes can in turn be split into many more volumes for the addition of the second barcode oligonucleotide, so that many $S2_y$ sequences are coupled to each W sequence. In some embodiments, solid supports are washed to remove unbound oligonucleotides. In some embodiments, solid supports are heated after incorporating the W sequence into the bound oligonucleotide, to melt the duplex of the bound oligonucleotide and first barcode oligonucleotide, and allow the bound oligonucleotide and second barcode oligonucleotide to anneal.

Sequence regions that can be included in barcode adapter molecules and/or barcode adapter templates, such as a universal priming sequence, binding site, RNAP promoter, or nicking endonuclease restriction site, can be distributed between the first barcode oligonucleotide and the second barcode oligonucleotide as desired. For example, all such sequences can be included in one barcode oligonucleotide, or some can be included in one barcode oligonucleotide and some can be included in the other. In some embodiments, a chosen barcode oligonucleotide, being either the first barcode oligonucleotide or the second barcode oligonucleotide, further comprises a universal priming sequence and a binding site. In some embodiments, this chosen barcode oligonucleotide also comprises an RNAP promoter or a nicking endonuclease restriction site. It will be recognized that the present methods provide many options for incorporating different sequence regions into barcode adapter templates. The optimal designs of these templates and the oligonucleotides used to prepare them may depend on what mechanisms are used for enzymatically generating barcode adapter molecules and barcoding RNAs.

Any of the methods described herein for attaching polynucleotides to solid supports can be used to prepare one or more solid supports for use in barcoding samples, cells, or RNAs. The polynucleotide(s) attached to each solid support includes barcode sequences and can serve as a barcode adapter template. The present methods can also be used to prepare a barcode library, which includes a plurality of solid supports, each associated with a barcode sequence. Any two solid supports (for example, beads) can have barcode sequences that differ from each other in whole or in part. In some embodiments, every solid support in the barcode library is associated with a different barcode sequence.

A barcode adapter template bead prepared according to the present methods includes a bead bound to a barcode adapter template. The bead can be bound to multiple copies of the template molecule, for example at least 10, 30, 100, 300, 1,000, 3,000, 10,000, 30,000, 100,000, 300,000, or 1,000,000 copies. In some embodiments, each copy of the template molecule bound to one bead includes the same barcode sequence. In embodiments where the template molecule has a barcode sequence of the form $S1_x$-W-$S2_y$, each copy of the template molecule bound to one bead includes the same $S1_x$, W, and/or $S2_y$ sequence. The present methods also allow preparation of a beaded barcode library comprising a plurality of barcode adapter template beads. Every bead in the library can be associated with a different barcode sequence, and copies of barcode adapter templates on each bead can comprise the same barcode sequence.

In some embodiments, the present methods can be used to prepare a polynucleotide library by physically capturing cDNAs prepared from or obtained from one or more samples (e.g., cells) on barcode adapter template beads. Each bead includes a template molecule with a cDNA binding site at the 3' end. The bead can be contacted with an enzyme to render the binding site single-stranded (for example, leaving a 3' overhang at the end of the template molecule free in solution). The bead is then contacted with one or more cDNAs from a sample such that the cDNAs bind to copies of the template molecule through the binding sites. In preferred embodiments, the binding site includes one or more G nucleotides, for example a poly-G tract, and is complementary to the non-templated poly-C tract added to the end of cDNAs by reverse transcriptase.

The beads in a polynucleotide library can be used as desired, for example to sequence the cDNAs from a plurality of samples or separate the cDNAs from different samples. In the latter case, beads corresponding to different samples can be pelleted using centrifugation or magnetism, and then resuspended and separated using standard methods. If desired, following the binding of cDNAs to template molecules on a bead, the template molecules can be enzymatically extended, thereby incorporating the cDNA sequences into DNA duplexes bound the bead and associating these sequences with a barcode sequence. If the number of copies of cDNA molecules from a sample is comparable to the number of copies of the barcode adapter template on a bead, then these cDNA molecules can be captured on a small number of beads (for example, at most about 1, 3, 10, 30, 100, 300, or 1000 beads per sample). RNAs from samples can be reverse transcribed using standard methods or as discussed above to generate cDNA. B cells (e.g., plasmablasts, memory B cells, and plasma cells) can be used as samples, and in some embodiments the cDNA is a B-cell derived variable immunoglobulin region.

II. COMPOSITIONS

A. Polynucleotides

In some aspects, a polynucleotide can include a cDNA region. In some aspects, a polynucleotide can include a sample identification (barcode)-adapter region. In some aspects, a polynucleotide can include a sample identification (barcode) region. In some aspects, a polynucleotide can include an adapter region. In some aspects, a polynucleotide can include a universal primer region. In some aspects, a polynucleotide can include an amplicon region. In some aspects, a polynucleotide can include a plate identification region. In some aspects, a polynucleotide can include a first plate identification region. In some aspects, a polynucleotide can include a second plate identification region. In some aspects, a polynucleotide can include a restriction site region. In some aspects, a polynucleotide can include a first restriction site region. In some aspects, a polynucleotide can include a second restriction site region. In some aspects, a polynucleotide can include a sequencing region. In some aspects, a polynucleotide can include a first sequencing region. In some aspects, a polynucleotide can include a second sequencing region.

In some aspects, a polynucleotide can include a plurality of any region described herein. For example, a polynucleotide can include a first sample identification (barcode) region and a second sample identification (barcode) region. In some aspects, the first sample identification (barcode) region and the second sample identification (barcode) region are identical or substantially identical. In some aspects, the first sample identification (barcode) region and the second sample (barcode) identification region are distinct. In some aspects, an identification (barcode) region is coupled to a variable immunoglobulin region.

In some aspects the sequence of a region will be at least long enough to serve as a target sequence for a primer or a probe in a PCR reaction. In some aspects, a region can be 1 to greater than 5000 base pairs in length. For example, a region can be from 1-10,000 nucleotides in length, e.g., 2-30 nucleotides in length, including all sub-ranges therebetween. As non-limiting examples, a region can be from 1-30 nucleotides, 1-26 nucleotides, 1-23 nucleotides, 1-22 nucleotides, 1-21 nucleotides, 1-20 nucleotides, 1-19 nucleotides, 1-18 nucleotides, 1-17 nucleotides, 18-30 nucleotides, 18-26 nucleotides, 18-23 nucleotides, 18-22 nucleotides, 18-21 nucleotides, 18-20 nucleotides, 19-30 nucleotides, 19-26 nucleotides, 19-23 nucleotides, 19-22 nucleotides, 19-21 nucleotides, 19-20 nucleotides, 20-30 nucleotides, 20-26 nucleotides, 20-25 nucleotides, 20-24 nucleotides, 20-23 nucleotides, 20-22 nucleotides, 20-21 nucleotides, 21-30 nucleotides, 21-26 nucleotides, 21-25 nucleotides, 21-24 nucleotides, 21-23 nucleotides, or 21-22 nucleotides. In some aspects, a region can be about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more nucleotides in length. In some aspects, a region can be less than 50, 50-100, 100-200, 200-300, 300-400, 400-500, 500-600, 600-700, 700-800, 800-900, 900-1000, or greater than 1000 nucleotides in length. In some aspects, a region can be less than 1000, 1000-2000, 2000-3000, 3000-4000, 4000-5000, 5000-6000, 6000-7000, 7000-8000, 8000-9000, 9000-10000, or greater than 10000 nucleotides in length. In some aspects, a region can include at least two nucleotides, at least 3, at least 4, at least 5, at least 6, at least 7, at least 8, at least 9, at least 10, at least 15, at least 20 or more nucleotides of a polynucleotide disclosed herein.

In some aspects a polynucleotide can be derived from or associated with a single sample. In some aspects a region can be derived from or associated with a single sample. In some aspects, a cDNA region can be derived from or associated with a single sample. In some aspects, an amplicon region can be derived from or associated with a single sample. A "single sample" includes a sample comprising polynucleotides that is taken from a single source. In some aspects, a single source includes a sample taken at a particular time point or at a particular location, e.g., in a subject or flask of cells or plate of cells. In some aspects, a first single sample is taken from a first subject at a first time point and a second single sample is taken from the first subject at a second time point that is distinct from the first time point. In some aspects, a first single sample is taken from a first subject at a first location and a second sample is taken from the first subject at a second location that is distinct from the first location. In some aspects, a first single sample is taken from a first subject at a time point and a second single sample is taken from a second subject at a time point. In some aspects, a first single sample is taken from a first subject at a location and a second sample is taken from a second subject at a location. In one embodiment, a sample comprises polynucleotides that include mRNA derived from one or more B cells. In another embodiment, a sample comprises polynucleotides including cDNA derived from one or more B cells. In another embodiment, a single sample comprises mRNA derived from one or more B cells sorted into a single well of a 96-well or 384-well plate. Samples are generally derived from a prokaryotic cell(s) (e.g., a bacterial cell(s)), a eukaryotic cell(s) (e.g., a mammalian and yeast cell(s)), or other sources of genetic material such as a virus or phage. The term "mammal" or "mammalian" as used herein includes both humans and non-humans and include but is not limited to humans, non-human primates, canines, felines, murines, bovines, equines, and porcines. In some aspects, the methods of the invention are applied to single samples in a plate with at least 96 wells, at least 384 wells, at least 1536 wells, or more wells. In further aspects, the methods of the invention are applied to single samples in at least one, two, three, four, five, six, seven, eight, ten, fifteen, twenty, thirty or more plates with at least 96 wells each.

In some aspects a 5' adapter region sequence and/or a sample identification region are added to all cDNAs from a single sample, e.g., during RT and not just to Ig genes. In some aspects, 3' gene specific primers (GSPs) can be used to amplify any expressed gene in the single sample. In some aspects, genes are amplified that have a 5' variable region, e.g., T cell receptors and B cell receptors without needing multiple degenerate 5' primers to amplify the gene(s) of interest. GSPs can include primers specific for IgG, IgM, IgD, IgA, IgE, TCR chains, and other genes of interest.

In some aspects, multiple rounds of PCR can also be performed, e.g., using nested GSPs. For such nested GSPs, the GSP for the second round of PCR hybridizes to its target gene sequence at a position 5' along that sequence relative to the position hybridized to by the GSP used in the first round of PCR.

In some aspects, cDNA region or an amplicon region can include a DNA polynucleotide. In some aspects, cDNA region or an amplicon region can include a cDNA polynucleotide. In some aspects, cDNA region or an amplicon region can include an RNA polynucleotide hybridized to a DNA polynucleotide. In some aspects, cDNA region or an amplicon region can include an mRNA polynucleotide hybridized to a cDNA polynucleotide.

In some aspects, a universal primer region is not fully complementary to any human exon. In some aspects, a universal primer region is not fully complementary to any expressed human gene. In some aspects, a universal primer region has minimal secondary structure.

In some aspects, an amplicon region comprises an immunoglobulin heavy chain amplicon sequence. In some aspects, an amplicon region comprises an immunoglobulin light chain amplicon sequence. In some aspects, an amplicon region comprises a T cell receptor alpha amplicon sequence. In some aspects, an amplicon region comprises a T cell receptor beta amplicon sequence.

In some aspects, a polynucleotide is present in a library of polynucleotides and can be differentiated from other polynucleotides present in the library based on a region of the polynucleotide.

In some aspects, the sequence of the sample identification region of each polynucleotide in a library derived from a first single sample is distinct from the sequence of the sample identification region of the other polynucleotides in the library derived from one or more samples distinct from the first single sample. In some aspects, the sequence of the sample identification region of each polynucleotide in a library derived from a first single sample differs by at least 1 nucleotide from the sequence of the sample identification region of the other polynucleotides in the library derived from one or more samples distinct from the first single sample. In some aspects, the sequence of the sample identification region of each polynucleotide in a library derived from a first single sample differs by at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more nucleotides from the sequence of the sample identification region of the other polynucleotides in the library derived from one or more samples distinct from the first single sample. In some aspects, the sequence of the sample identification region of each polynucleotide in a library derived from a first single sample can be about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 81, 82, 83, 84, 85, 86, 87, 88, 89, 90, 91, 92, 93, 94, 95, 96, 97, 98, 99, or less than 100% identical to the sequence of the sample identification region of the other polynucleotides in the library derived from one or more samples distinct from the first single sample. In some aspects, the sequence of the sample identification region of each polynucleotide in a library derived from a first single sample is less than 100% identical to the sequence of the sample identification region of the other polynucleotides in the library derived from one or more samples distinct from the first single sample. In some aspects, a sample-identification region acts as a digital barcode on all $1^{st}$ strand cDNA reverse transcribed from a single sample. In some aspects, the sample identification region is at least 1 nucleotide in length. In some aspects, a sample-identification region can comprise at least 3 nucleotides, and sample-identification regions can differ from each other by at least 1 nucleotide. In one embodiment, sample-identification regions are 3-15 nucleotides in length and differ from each other by at least 1 nucleotide. In some aspects, sample-identification regions can comprise at least 64 variants (using sample-identification regions 3 nucleotides in length with each sample-ID differing from each other by at least 1 nucleotide), or in some aspects larger numbers of variants. In some aspects, the sequence attached 3' to the sample-identification region can be an adapter region comprising at least 1 G. In a preferred embodiment, the sequence attached 3' to the sample-identification region can be an adapter region comprising at least 2 G's. In one embodiment, a sequence attached to the 5' end of a sample-identification region is a universal primer sequence that can be used during PCR amplification to avoid the need for the subsequent addition of a 5' universal primer sequence (by ligation or another method) or the use of multiple degenerate 5' primers to amplify genes with variable 5' regions. In some aspects, the sequence of the first plate identification region of each polynucleotide in a library derived from a first set of single samples is distinct from the sequence of the first plate identification region of the other polynucleotides in the library derived from one or more single sample sets distinct from the first set of single samples. In some aspects, the sequence of the first plate identification region of each polynucleotide in a library derived from the first set of single samples differs by at least 1 nucleotide from the sequence of the first plate identification region of the other polynucleotides in the library derived from one or more single sample sets distinct from the first set of single samples. In some aspects, the sequence of the first plate identification region of each polynucleotide in a library derived from the first set of single samples differs by at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more nucleotides from the sequence of the first plate identification region of the other polynucleotides in the library derived from one or more single sample sets distinct from the first set of single samples. In some aspects, the sequence of the first plate identification region of each polynucleotide in a library derived from the first set of single samples can be about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 81, 82, 83, 84, 85, 86, 87, 88, 89, 90, 91, 92, 93, 94, 95, 96, 97, 98, 99, or less than 100% identical to sequence of the first plate identification region of the other polynucleotides in the library derived from one or more single sample sets distinct from the first set of single samples. In some aspects, the sequence of the first plate identification region of each polynucleotide in a library derived from the first set of single samples is less than 100% identical to sequence of the first plate identification region of the other polynucleotides in the library derived from one or more single sample sets distinct from the first set of single samples. In some aspects, the sequence of the second plate identification region of each polynucleotide in a library derived from a first set of single samples is distinct from the sequence of the second plate identification region of the other polynucleotides in the library derived from one or more single sample sets distinct from the first set of single samples. In some aspects, the sequence of the second plate identification region of each polynucleotide in a library derived from the first set of single samples differs by at least 1 nucleotide from the sequence of the second plate identification region of the other polynucleotides in the library derived from one or more single sample sets distinct from the first set of single samples. In some aspects, the sequence of the second plate identification region of each polynucleotide in a library derived from the first set of single samples differs by at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more nucleotides from the sequence of the second plate identification region of the other polynucleotides in the library derived from one or more single sample sets distinct from the first set of single samples. In some aspects, the sequence of the second plate identification region is identical to the sequence of the first plate identification region on a polynucleotide. In some aspects, the sequence of the second plate identification region of each polynucleotide in a library derived from the first set of single samples can be about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 81, 82, 83, 84, 85, 86, 87, 88, 89, 90, 91, 92, 93, 94, 95, 96, 97, 98, 99, or less than 100% identical to sequence of the second plate identification region of the other polynucleotides in the library derived from one or more single sample sets distinct from the first set of single samples. In some aspects, the sequence of the second plate identification region of each polynucleotide in a library derived from the first set of single samples is less than 100% identical to sequence of the second plate identification region of the other polynucleotides in the library derived from one or more single sample sets distinct from the first set of single samples. In some aspects, a plate-identification region (e.g., a first plate identification region or a second plate identification region) can comprise at least 2 nucleotides, and plate-identification regions differ from each other by at least 1 nucleotide. In one embodiment, plate-identification regions are 2-10 nucleotides in length and differ from each other by at least 1 nucleotide. In some aspects, use of plate-identification regions is found in only some embodiments, as the use of a larger number of different sample-identification regions (one per single sample to be analyzed) can eliminate the need for plate-identification regions. In some aspects, plate-identification regions are used to reduce the number of unique oligonucleotides containing a sample-identification region that need to be synthesized.

In some aspects, a polynucleotide includes one or more adapter regions. In some aspects, an adapter region includes one or more G's. In some aspects, an adapter region includes 2, 3, 4, 5, 6, 7, 8, 9, 10 or more G's. In some aspects, adapter regions are attached to the 3' ends of cDNAs using the template switching property of MMLV H⁻ reverse transcriptases. Different methods to attach adapter regions exist, including but not limited to, doing PCR with primers with 5' flanking adapter region sequences, sticky and blunt end ligations, template-switching-mediated addition of nucleotides, or other methods to covalently attach nucleotides to the 5' end, to the 3' end, or to the 5' and 3' ends of the polynucleotides. These methods can employ properties of enzymes commonly used in molecular biology. PCR can use, e.g., thermophilic DNA polymerase. Sticky ends that are complementary or substantially complementary are created through either cutting dsDNA with restriction enzymes that leave overhanging ends or through 3' tailing activities of enzymes such as TdT (terminal transferase). Sticky and blunt ends can then be ligated with a complementary adapter region using ligases such as T4 ligase. Template-switching utilizes the 3' tailing activity of MMLV H⁻ reverse transcriptase to add one or more cytosines (C's) to the 3' end of cDNAs and its ability to switch template from mRNA to an adapter region with complementary G's. In some aspects, a cDNA includes 1, 2, 3, 4, 5, 6, 7, 8, 9, 10 or more C's on its 3' end.

In some aspects, a polynucleotide includes one or more restriction site regions. Restriction site regions include one or more restriction sites. Restrictions sites can include: NheI, XhoI, BstBI, EcoRI, SacII, BbvCI, PspXI, AgeI, ApaI, KpnI, Acc65I, XmaI, BstEII, DraIII, PacI, FseI, AsiSI, and AscI. In some aspects, any rare 8-cutter enzyme restriction site can be used.

In some aspects, one or more regions of a polynucleotide described herein can be operatively coupled to one or more other regions of the polynucleotide. In some aspects, two or more distinct regions of a single polynucleotide can be operatively coupled. For example, a universal primer region can be operatively coupled to an adapter region. In some aspects two or more regions can be operatively coupled together that are substantially identical to each other in sequence or identical in description. For example, a first sample identification region can be operatively coupled to a second sample identification region. In some aspects, the sequences of the first sample identification region and the second sample identification region are identical or substantially identical. In some aspects, the sequences of the first sample identification region and the second sample identification region are different or distinct.

In some aspects, one or more regions of a polynucleotide described herein can be coupled to one or more other regions of the polynucleotide. In some aspects, two or more distinct regions of a single polynucleotide can be coupled. For example, a universal primer region can be coupled to an adapter region. In some aspects two or more regions can be coupled together that are substantially identical to each other in sequence or identical in description. For example, a first sample identification region can be coupled to a second sample identification region. In some aspects, the sequences of the first sample identification region and the second sample identification region are identical or substantially identical. In some aspects, the sequences of the first sample identification region and the second sample identification region are different or distinct.

In some aspects, a polynucleotide includes the sequence 5'-A-B-3', wherein A is a sample identification region, and wherein B is an adapter region. In some aspects, a polynucleotide includes the sequence 5'-A-B-C-3', wherein A is a universal primer region, wherein B is a sample identification region, and wherein C is an adapter region. In some aspects, a polynucleotide includes the sequence 5'-A-B-C-3', wherein A is a sample identification region, wherein B is an adapter region, and wherein C is an amplicon region derived from a single sample. In some aspects, a polynucleotide includes the sequence 5'-A-B-C-D-3', wherein A is a universal primer region, wherein B is a sample identification region, wherein C is an adapter region, and wherein D is an amplicon region derived from a single sample. In some aspects, a polynucleotide includes the sequence 5'-A-B-C-

D-E-3', wherein A is a plate identification region, wherein B is a universal primer region, wherein C is a sample identification region, wherein D is an adapter region, and wherein E is an amplicon region derived from a single sample. In some aspects, a polynucleotide includes the sequence 5'-A-B-C-D-E-F-3', wherein A is a first restriction site region, wherein B is a universal primer region, wherein C is a sample identification region, wherein D is an adapter region, wherein E is an amplicon region derived from a single sample, and wherein F is a second restriction site region.

In some aspects, the regions of each of the above sequences can be rearranged in a different order, e.g., 5'-C-A-D-B-3' or 5'-E-A-C-B-D-F-3' or 5'-B-A-3'. In some aspects, one or more regions of the above sequences can be deleted, e.g., 5'-A-D-3' or 5'-B-C-3'. In some aspects, one or more additional regions can be added to the above sequences, e.g., 5'-A-A$_2$-B-3' or 5'-A-B-C-D-E-F-G-3'. In such examples the one or more additional regions can be any region disclosed herein or equivalents thereof. In some aspects, one or more regions of the sequences above can be modified, e.g., methylated.

In some aspects, a polynucleotide can include an adapter molecule. In some aspects, a polynucleotide adapter molecule can include a universal primer region, a sample identification region, and an adapter region, wherein the 3' end of the universal primer region is coupled to the 5' end of the sample identification region, and wherein the 3' end of the sample identification region is coupled to the 5' end of the adapter region. In some aspects, an adapter molecule includes a polynucleotide comprising at least 2 nucleotides that bind to C's added by a reverse transcriptase at the 3' end of a 1st strand cDNA. In some aspects, an adapter molecule includes a deoxyribose polynucleotide comprising 3-6 G's (DNA G's). In another embodiment, an adapter molecule includes a ribose polynucleotide consisting of 3-6 G's (RNA G's). In other embodiments, the adapter molecule can utilize nucleotide analogues, such locked nucleic acids (LNAs), e.g., LNA G's. In other embodiments, the nucleotide base may also be a universal or degenerate base such as 5-nitroindole and 3-nitropyrrole that can base-pair to C's as well as other nucleotides, in any combination.

In some aspects, a polynucleotide can include a primer or a probe. In some aspects, a primer can include a universal primer region and a plate identification region, and wherein the 3' end of the plate identification region is coupled to the 5' end of the universal primer region.

In some aspects, a composition can include a polynucleotide composition library. In some aspects, a polynucleotide composition library includes a plurality of polynucleotide compositions. In some aspects each composition is present in a separate container. In some aspects, a container can be a test tube. In some aspects, a container can be a well in a plate. In some aspects, a container can be a well in a 96-well plate. In some aspects, a container can be a well in a 384-well plate. In some aspects, each composition comprises a cDNA region derived from a single sample. In some aspects, each composition comprises a sample identification-adapter region comprising a sample identification region coupled to an adapter region. In some aspects the sequence of the sample identification region of each sample identification-adapter region in a library is distinct from the nucleotide sequence of the sample identification region of the other sample identification-adapter regions present in each separate container in the library. In some aspects the sample identification-adapter region is attached to the cDNA region. In some aspects the sample identification-adapter region is attached to the cDNA region by binding between their 3' regions. In some aspects the sample identification-adapter region is attached to the cDNA region by G:C binding. In some aspects, the cDNA region comprises an RNA polynucleotide hybridized to a DNA polynucleotide. In some aspects, the cDNA region comprises an mRNA polynucleotide hybridized to a cDNA polynucleotide.

In some aspects, the plurality of polynucleotide compositions in a polynucleotide library can comprise at least 2, at least 3, at least 10, at least 30, at least 100, at least 300, at least 1000, at least 3000, at least 10,000, at least 30,000, at least 100,000, at least 300,000, at least 1,000,000, at least 3,000,000, at least 10,000,000, at least 30,000,000, or more members. In other aspects, the plurality of polynucleotide compositions in a polynucleotide library can comprise at least 2, at least 3, at least 10, at least 30, at least 100, at least 300, at least 1000, at least 3000, at least 10,000, at least 30,000, or more genes of a cell sample's whole transcriptome. In other aspects, the plurality of polynucleotide compositions in a polynucleotide library comprises at least 1, at least 2, at least 3, at least 10, at least 30, at least 100, at least 300, at least 1000, at least 10,000, at least 100,000, at least 1,000,000, at least 10,000,000, at least 1,000,000,000 or more of the different antibody species present in the blood of an individual. These the antibody species can be expressed by plasmablasts, plasma cells, memory B cells, long-lived plasma cells, naïve B cells, other B lineage cells, or combinations thereof.

B. Vectors

In some aspects, a composition can include a vector. The term "vector" is used to refer to a carrier nucleic acid molecule into which a nucleic acid sequence can be inserted for introduction into a cell where it can be replicated. Vectors can be used in the transformation of a host cell with a nucleic acid sequence. In some aspects, a vector can include one or more polynucleotides described herein. In one embodiment, a library of nucleic acid sequences encoding target polypeptides may be introduced into a population of cells, thereby allowing screening of a library. A nucleic acid sequence can be "exogenous" or "heterologous" which means that it is foreign to the cell into which the vector is being introduced or that the sequence is homologous to a sequence in the cell but in a position within the host cell nucleic acid in which the sequence is ordinarily not found. Vectors include plasmids, cosmids, and viruses (e.g., bacteriophage). One of skill in the art may construct a vector through standard recombinant techniques, which are described in Maniatis et al., 1988 and Ausubel et al., 1994, both of which references are incorporated herein by reference. In some aspects, a vector can be a vector with the constant regions of an antibody pre-engineered in. In this way, one of skill can clone just the VDJ regions of an antibody of interest and clone those regions into the pre-engineered vector.

The term "expression vector" refers to a vector containing a nucleic acid sequence coding for at least part of a gene product capable of being transcribed. In some cases, RNA molecules are then translated into a protein, polypeptide, or peptide. Expression vectors can contain a variety of "control sequences," which refer to nucleic acid sequences for the transcription and possibly translation of an operably linked coding sequence in a particular host organism. In addition to control sequences that govern transcription and translation, vectors and expression vectors may contain nucleic acid sequences that serve other functions as well.

In some aspects, a vector can include a promoter. In some aspects, a vector can include an enhancer. A "promoter" is a control sequence that is a region of a nucleic acid sequence at which initiation and rate of transcription are controlled. It may contain genetic elements at which regulatory proteins and molecules may bind such as RNA polymerase and other transcription factors. The phrases "operatively positioned," "operatively linked," "under control," and "under transcriptional control" mean that a promoter is in a correct functional location and/or orientation in relation to a nucleic acid sequence to control transcriptional initiation and/or expression of that sequence. A promoter may or may not be used in conjunction with an "enhancer," which refers to a cis-acting regulatory sequence involved in the transcriptional activation of a nucleic acid sequence.

A promoter may be one naturally associated with a gene or sequence, as may be obtained by isolating the 5' non-coding sequences located upstream of the coding segment and/or exon. Such a promoter can be referred to as "endogenous." Similarly, an enhancer may be one naturally associated with a nucleic acid sequence, located either downstream or upstream of that sequence. Alternatively, certain advantages will be gained by positioning the coding nucleic acid segment under the control of a recombinant or heterologous promoter, which refers to a promoter that is not normally associated with a nucleic acid sequence in its natural environment. A recombinant or heterologous enhancer refers also to an enhancer not normally associated with a nucleic acid sequence in its natural environment. Such promoters or enhancers may include promoters or enhancers of other genes, and promoters or enhancers isolated from any other prokaryotic cell, and promoters or enhancers not "naturally occurring," i.e., containing different elements of different transcriptional regulatory regions, and/or mutations that alter expression. In addition to producing nucleic acid sequences of promoters and enhancers synthetically, sequences may be produced using recombinant cloning and/or nucleic acid amplification technology, including PCR, in connection with the compositions disclosed herein (see U.S. Pat. No. 4,683,202, U.S. Pat. No. 5,928,906, each incorporated herein by reference).

In some aspects, a promoter and/or enhancer that effectively directs the expression of the DNA segment in the cell type chosen for expression. One example of such promoter that may be used is the E. coli arabinose or T7 promoter. Those of skill in the art of molecular biology generally are familiar with the use of promoters, enhancers, and cell type combinations for protein expression, for example, see Sambrook et al. (1989), incorporated herein by reference. The promoters employed may be constitutive, tissue-specific, inducible, and/or useful under the appropriate conditions to direct high level expression of the introduced DNA segment, such as is advantageous in the large-scale production of recombinant proteins and/or peptides. The promoter may be heterologous or endogenous.

In some aspects, vectors can include initiation signals and/or internal ribosome binding sites. A specific initiation signal also may be included for efficient translation of coding sequences. These signals include the ATG initiation codon or adjacent sequences. Exogenous translational control signals, including the ATG initiation codon, may need to be provided. One of ordinary skill in the art would readily be capable of determining this and providing the necessary signals. It is well known that the initiation codon must be "in-frame" with the reading frame of the desired coding sequence to ensure translation of the entire insert. The exogenous translational control signals and initiation codons can be either natural or synthetic. The efficiency of expression may be enhanced by the inclusion of appropriate transcription enhancer elements.

In some aspects, a vector can include sequences that increase or optimize the expression level of the DNA segment encoding the gene of interest. An example of such sequences includes addition of introns in the expressed mRNA (Brinster, R. L. et al. (1988) Introns increase transcriptional efficiency in transgenic mice. Proc. Natl. Acad. Sci. USA 85, 836-40; Choi, T. et al. (1991) A generic intron increases gene expression in transgenic mice. Mol. Cell. Biol. 11, 3070-4). Another example of a method for optimizing expression of the DNA segment is "codon optimization". Codon optimization involves insertion of silent mutations in the DNA segment to reduce the use of rare codons to optimize protein translation (Codon engineering for improved antibody expression in mammalian cells. Carton J M, Sauerwald T, Hawley-Nelson P, Morse B, Peffer N, Beck H, Lu J, Cotty A, Amegadzie B, Sweet R. Protein Expr Purif. 2007 October; 55(2):279-86. Epub 2007 Jun. 16.).

In some aspects, a vector can include multiple cloning sites. Vectors can include a multiple cloning site (MCS), which is a nucleic acid region that contains multiple restriction enzyme sites, any of which can be used in conjunction with standard recombinant technology to digest the vector (see Carbonelli et al., 1999, Levenson et al., 1998, and Cocea, 1997, incorporated herein by reference.) "Restriction enzyme digestion" refers to catalytic cleavage of a nucleic acid molecule with an enzyme that functions only at specific locations in a nucleic acid molecule. Many of these restriction enzymes are commercially available. Use of such enzymes is understood by those of skill in the art. Frequently, a vector is linearized or fragmented using a restriction enzyme that cuts within the MCS to enable exogenous sequences to be ligated to the vector. "Ligation" refers to the process of forming phosphodiester bonds between two nucleic acid fragments, which may or may not be contiguous with each other. Techniques involving restriction enzymes and ligation reactions are well known to those of skill in the art of recombinant technology.

In some aspects, a vector can include a termination signal. The vectors or constructs will generally comprise at least one termination signal. A "termination signal" or "terminator" is comprised of the DNA sequences involved in specific termination of an RNA transcript by an RNA polymerase. Thus, in certain embodiments, a termination signal that ends the production of an RNA transcript is contemplated. A terminator may be necessary in vivo to achieve desirable message levels.

Terminators contemplated for use include any known terminator of transcription described herein or known to one of ordinary skill in the art, including but not limited to, for example, rho dependent or rho independent terminators. In certain embodiments, the termination signal may be a lack of transcribable or translatable sequence, such as due to a sequence truncation.

In some aspects, a vector can include an origin of replication.

In order to propagate a vector in a host cell, it may contain one or more origins of replication sites (often termed "ori"), which is a specific nucleic acid sequence at which replication is initiated.

In some aspects, a vector can include one or more selectable and/or screenable markers. In certain embodiments, cells containing a nucleic acid construct may be identified in vitro or in vivo by including a marker in the expression vector. Such markers would confer an identifiable change to the cell permitting easy identification of cells containing the expression vector. Generally, a selectable marker is one that confers a property that allows for selection. A positive selectable marker is one in which the presence of the marker allows for its selection, while a negative selectable marker is one in which its presence prevents its selection. An example of a positive selectable marker is a drug resistance marker.

Usually the inclusion of a drug selection marker aids in the cloning and identification of transformants, for example, genes that confer resistance to neomycin, puromycin, hygromycin, DHFR, GPT, zeocin and histidinol are useful selectable markers. In addition to markers conferring a phenotype that allows for the discrimination of transformants based on the implementation of conditions, other types of markers including screenable markers such as GFP, whose basis is colorimetric analysis, are also contemplated. Alternatively, screenable enzymes such as chloramphenicol acetyltransferase (CAT) may be utilized. One of skill in the art would also know how to employ immunologic markers, possibly in conjunction with FACS analysis. The marker used is not believed to be important, so long as it is capable of being expressed simultaneously with the nucleic acid encoding a gene product. Further examples of selectable and screenable markers are well known to one of skill in the art.

In one aspect, the vector can express DNA segments encoding multiple polypeptides of interest. For example, DNA segments encoding both the immunoglobulin heavy chain and light chain can be encoded and expressed by a single vector. In one aspect, both DNA segments can be included on the same expressed RNA and internal ribosome binding site (IRES) sequences used to enable expression of the DNA segments as separate polypeptides (Pinkstaff J K, Chappell S A, Mauro V P, Edelman G M, Krushel L A., Internal initiation of translation of five dendritically localized neuronal mRNAs., Proc Natl Acad Sci USA. 2001 Feb. 27; 98(5):2770-5. Epub 2001 Feb. 20.). In another aspect, each DNA segment has its own promoter region resulting in expression of separate mRNAs (Andersen C R, Nielsen L S, Baer A, Tolstrup A B, Weilguny D. Efficient Expression from One CMV Enhancer Controlling Two Core Promoters. Mol Biotechnol. 2010 Nov. 27. [Epub ahead of print]).

C. Host Cells and Expression Systems

In some aspects, a composition can include a host cell. In some aspects, a host cell can include a polynucleotide or vector described herein. In some aspects, a host cell can include a eukaryotic cell (e.g., insect, yeast, or mammalian) or a prokaryotic cell (e.g., bacteria). In the context of expressing a heterologous nucleic acid sequence, "host cell" can refer to a prokaryotic cell, and it includes any transformable organism that is capable of replicating a vector and/or expressing a heterologous gene encoded by a vector. A host cell can, and has been, used as a recipient for vectors. A host cell may be "transfected" or "transformed," which refers to a process by which exogenous nucleic acid is transferred or introduced into the host cell. A transformed cell includes the primary subject cell and its progeny.

In particular embodiments, a host cell is a Gram negative bacterial cell. These bacteria are suited for use in that they possess a periplasmic space between the inner and outer membrane and, particularly, the aforementioned inner membrane between the periplasm and cytoplasm, which is also known as the cytoplasmic membrane. As such, any other cell with such a periplasmic space could be used. Examples of Gram negative bacteria include, but are not limited to, *E. coli, Pseudomonas aeruginosa, Vibrio cholera, Salmonella typhimurium, Shigella flexneri, Haemophilus influenza, Bordotella pertussi, Erwinia amylovora, Rhizobium* sp. The Gram negative bacterial cell may be still further defined as bacterial cell which has been transformed with the coding sequence of a fusion polypeptide comprising a candidate binding polypeptide capable of binding a selected ligand. The polypeptide is anchored to the outer face of the cytoplasmic membrane, facing the periplasmic space, and may comprise an antibody coding sequence or another sequence. One means for expression of the polypeptide is by attaching a leader sequence to the polypeptide capable of causing such directing.

Numerous prokaryotic cell lines and cultures are available for use as a host cell, and they can be obtained through the American Type Culture Collection (ATCC), which is an organization that serves as an archive for living cultures and genetic materials. An appropriate host can be determined by one of skill in the art based on the vector backbone and the desired result. A plasmid or cosmid, for example, can be introduced into a prokaryote host cell for replication of many vectors. Bacterial cells used as host cells for vector replication and/or expression include DH5-alpha, JM109, and KC8, as well as a number of commercially available bacterial hosts such as SURE™ Competent Cells and SOLOPACK™ Gold Cells (STRATAGENE™, La Jolla). In some aspects, other bacterial cells such as *E. coli* LE392 are contemplated for use as host cells.

Many host cells from various cell types and organisms are available and would be known to one of skill in the art. Similarly, a viral vector may be used in conjunction with a prokaryotic host cell, particularly one that is permissive for replication or expression of the vector. Some vectors may employ control sequences that allow it to be replicated and/or expressed in both prokaryotic and eukaryotic cells. One of skill in the art would further understand the conditions under which to incubate all of the above described host cells to maintain them and to permit replication of a vector. Also understood and known are techniques and conditions that would allow large-scale production of vectors, as well as production of the nucleic acids encoded by vectors and their cognate polypeptides, proteins, or peptides.

In some aspects, a host cell is mammalian. Examples include CHO cells, CHO-K1 cells, or CHO-S cells. Other mammalian host cells include NS0 cells and CHO cells that are dhfr−, e.g., CHO-dhfr−, DUKX-B11 CHO cells, and DG44 CHO cells.

Numerous expression systems exist that can comprise at least a part or all of the compositions disclosed herein. Expression systems can include eukaryotic expression systems and prokaryotic expression systems. Such systems could be used, for example, for the production of a polypeptide product identified as capable of binding a particular ligand. Prokaryote-based systems can be employed to produce nucleic acid sequences, or their cognate polypeptides, proteins and peptides. Many such systems are commercially and widely available. Other examples of expression systems comprise of vectors containing a strong prokaryotic promoter such as T7, Tac, Trc, BAD, lambda pL, Tetracycline or Lac promoters, the pET Expression System and an *E. coli* expression system.

D. Polypeptides

In some aspects, a composition can include a polypeptide. In some aspects, a polypeptide encoded by a polynucleotide described herein can be expressed, e.g., from a host cell. The terms "polypeptide" or "protein" include a macromolecule having the amino acid sequence of a native protein, that is, a protein produced by a naturally-occurring and non-recombinant cell; or it is produced by a genetically-engineered or recombinant cell, and comprise molecules having the amino acid sequence of the native protein, or molecules having deletions from, additions to, and/or substitutions of one or more amino acids of the native sequence. The term also includes amino acid polymers in which one or more amino acids are chemical analogs of a corresponding naturally-occurring amino acid and polymers. The terms "polypeptide" and "protein" encompass antigen binding proteins, antibodies, or sequences that have deletions from, additions to, and/or substitutions of one or more amino acids of antigen-binding protein. The term "polypeptide fragment" refers to a polypeptide that has an amino-terminal deletion, a carboxyl-terminal deletion, and/or an internal deletion as compared with the full-length native protein. Such fragments can also contain modified amino acids as compared with the native protein. In certain embodiments, fragments are about five to 500 amino acids long. For example, fragments can be at least 5, 6, 8, 10, 14, 20, 50, 70, 100, 110, 150, 200, 250, 300, 350, 400, or 450 amino acids long. Useful polypeptide fragments include immunologically functional fragments of antibodies, including binding domains. In the case of a binding antibody, useful fragments include but are not limited to a CDR region, a variable domain of a heavy and/or light chain, a portion of an antibody chain or just its variable region including two CDRs, and the like.

The term "isolated protein" means that a subject protein (1) is free of at least some other proteins with which it would normally be found, (2) is essentially free of other proteins from the same source, e.g., from the same species, (3) is expressed by a cell from a different species, (4) has been separated from at least about 50 percent of polynucleotides, lipids, carbohydrates, or other materials with which it is associated in nature, (5) is operably associated (by covalent or noncovalent interaction) with a polypeptide with which it is not associated in nature, or (6) does not occur in nature. Typically, an "isolated protein" constitutes at least about 5%, at least about 10%, at least about 25%, or at least about 50% of a given sample. Genomic DNA, cDNA, mRNA or other RNA, nucleic acids of synthetic origin, or any combination thereof can encode such an isolated protein. Preferably, the isolated protein is substantially free from proteins or polypeptides or other contaminants that are found in its natural environment that would interfere with its therapeutic, diagnostic, prophylactic, research or other use.

In some aspects, a polypeptide can include an antigen binding protein (ABP). An "antigen binding protein" ("ABP") as used herein means any protein that binds a specified target antigen. "Antigen binding protein" includes but is not limited to antibodies and binding parts thereof, such as immunologically functional fragments. Peptibodies are another example of antigen binding proteins. The term "immunologically functional fragment" (or simply "fragment") of an antibody or immunoglobulin chain (heavy or light chain) antigen binding protein, as used herein, is a species of antigen binding protein comprising a portion (regardless of how that portion is obtained or synthesized) of an antibody that lacks at least some of the amino acids present in a full-length chain but which is still capable of specifically binding to an antigen. Such fragments are biologically active in that they bind to the target antigen and can compete with other antigen binding proteins, including intact antibodies, for binding to a given epitope. In some embodiments, the fragments are neutralizing fragments. These biologically active fragments can be produced by recombinant DNA techniques, or can be produced by enzymatic or chemical cleavage of antigen binding proteins, including intact antibodies. Immunologically functional immunoglobulin fragments include, but are not limited to, Fab, a diabody (heavy chain variable domain on the same polypeptide as a light chain variable domain, connected via a short peptide linker that is too short to permit pairing between the two domains on the same chain), Fab', F(ab')2, Fv, domain antibodies and single-chain antibodies, and can be derived from any mammalian source, including but not limited to human, mouse, rat, camelid or rabbit. It is further contemplated that a functional portion of the antigen binding proteins disclosed herein, for example, one or more CDRs, could be covalently bound to a second protein or to a small molecule to create a therapeutic agent directed to a particular target in the body, possessing bifunctional therapeutic properties, or having a prolonged serum half-life. As will be appreciated by one of skill in the art, an antigen binding protein can include nonprotein components. Additional details about antigen binding proteins and antibodies such as modifications, variants, methods of making, and methods of screening can be found in U.S. Pat. Pub. 20110027287, herein incorporated by reference in its entirety for all purposes.

In some aspects, a polypeptide can include an antibody. The term "antibody" refers to an intact immunoglobulin of any isotype, or a fragment thereof that can compete with the intact antibody for specific binding to the target antigen, and includes, for instance, chimeric, humanized, fully human, and bispecific antibodies. An "antibody" is a species of an antigen binding protein. An intact antibody will generally comprise at least two full-length heavy chains and two full-length light chains, but in some instances can include fewer chains such as antibodies naturally occurring in camelids which can comprise only heavy chains. Antibodies can be derived solely from a single source, or can be "chimeric," that is, different portions of the antibody can be derived from two different antibodies. The antigen binding proteins, antibodies, or binding fragments can be produced in hybridomas, by recombinant DNA techniques, or by enzymatic or chemical cleavage of intact antibodies. Unless otherwise indicated, the term "antibody" includes, in addition to antibodies comprising two full-length heavy chains and two full-length light chains, derivatives, variants, fragments, and muteins thereof. Furthermore, unless explicitly excluded, antibodies include monoclonal antibodies, bispecific antibodies, minibodies, domain antibodies, synthetic antibodies (sometimes referred to herein as "antibody mimetics"), chimeric antibodies, humanized antibodies, human antibodies, antibody fusions (sometimes referred to herein as "antibody conjugates"), and fragments thereof, respectively. In some embodiments, the term also encompasses peptibodies.

A therapeutically effective amount of an ABP can be administered to a subject in need thereof. ABPs can be formulated in pharmaceutical compositions. These compositions can comprise, in addition to one or more of the ABPs, a pharmaceutically acceptable excipient, carrier, buffer, stabilizer or other materials well known to those skilled in the art. Such materials should be non-toxic and should not interfere with the efficacy of the active ingredient. The precise nature of the carrier or other material can depend on the route of administration, e.g. oral, intravenous, cutaneous or subcutaneous, nasal, intramuscular, intraperitoneal routes.

Pharmaceutical compositions for oral administration can be in tablet, capsule, powder or liquid form. A tablet can include a solid carrier such as gelatin or an adjuvant. Liquid pharmaceutical compositions generally include a liquid carrier such as water, petroleum, animal or vegetable oils, mineral oil or synthetic oil. Physiological saline solution, dextrose or other saccharide solution or glycols such as ethylene glycol, propylene glycol or polyethylene glycol can be included.

For intravenous, cutaneous or subcutaneous injection, or injection at the site of affliction, the active ingredient will be in the form of a parenterally acceptable aqueous solution which is pyrogen-free and has suitable pH, isotonicity and stability. Those of relevant skill in the art are well able to prepare suitable solutions using, for example, isotonic vehicles such as Sodium Chloride Injection, Ringer's Injection, Lactated Ringer's Injection. Preservatives, stabilizers, buffers, antioxidants and/or other additives can be included, as required.

ABP administration is preferably in a "therapeutically effective amount" or "prophylactically effective amount" (as the case can be, although prophylaxis can be considered therapy), this being sufficient to show benefit to the individual. The actual amount administered, and rate and timecourse of administration, will depend on the nature and severity of disease being treated. Prescription of treatment, e.g. decisions on dosage etc., is within the responsibility of general practitioners and other medical doctors, and typically takes account of the disorder to be treated, the condition of the individual patient, the site of delivery, the method of administration and other factors known to practitioners. Examples of the techniques and protocols mentioned above can be found in Remington's Pharmaceutical Sciences, 16th edition, Osol, A. (ed), 1980.

A composition can be administered alone or in combination with other treatments, either simultaneously or sequentially dependent upon the condition to be treated.

III. IMMUNE CELLS

A sample can include immune cells. The immune cells can include T cells and B cells. T-cells (T lymphocytes) include, for example, cells that express T cell receptors. B-cells include, for example, activated B cells, blasting B cells, plasma cells, plasmablasts, memory B cells, B1 cells, B2 cells, marginal-zone B cells, and follicular B cells. T cells include activated T cells, blasting T cells, Helper T cells (effector T cells or Th cells), cytotoxic T cells (CTLs), memory T cells, central memory T cells, effector memory T cells and regulatory T cells. A sample can include a single cell (e.g., a single T or B cell) or at least 1,000, at least 10,000, at least 100,000, at least 250,000, at least 500,000, at least 750,000, or at least 1,000,000 cells.

A. B Cells

As used herein a "B cell" refers to any cell that has at least one rearranged immunoglobulin gene locus. A B cell can include at least one rearranged immunoglobulin heavy chain locus or at least one rearranged immunoglobulin light chain locus. A B cell can include at least one rearranged immunoglobulin heavy chain locus and at least one rearranged immunoglobulin light chain locus. B cells are lymphocytes that are part of the adaptive immune system. B cells can include any cells that express antibodies either in the membrane-bound form as the B-cell receptor (BCR) on the cell surface or as secreted antibodies. B cells can express immunoglobulins (antibodies, B cell receptor). Antibodies can include heterodimers formed from the heavy and light immunoglobulin chains. The heavy chain is formed from gene rearrangements of the variable, diversity, and junctional (VDJ) genes to form the variable region, which is joined to the constant region. The light chain is formed from gene rearrangements of the variable and junctional (VJ) genes to form the variable region, which is then joined to the constant region. Owing to a large possible number of junctional combinations, the variable regions of the antibody gene (which is also the BCR) have huge diversity, enabling B cells to recognize any foreign antigen and mount a response against it.

B. B-Cell Activation and Differentiation

B cells are activated and differentiate when they recognize an antigen in the context of an inflammatory immune response. They usually include 2 signals to become activated, one signal delivered through BCR (a membrane-bound form of the rearranged immunoglobulin), and another delivered through CD40 or another co-stimulatory molecule. This second signal can be provided through interaction with helper T cells, which express the ligand for CD40 (CD40L) on their surface. B cells then proliferate and may undergo somatic hypermutation, where random changes in the nucleotide sequences of the antibody genes are made, and B cells whose antibodies have a higher affinity B cells are selected. They may also undergo "class-switching", in which the constant region of the heavy chain encoding the IgM isotype is switched to the constant region encoding the IgG, IgA, or IgE isotype. Differentiating B cells may end up as memory B cells, which are usually of higher affinity and classed switched, though some memory B cells are still of the IgM isotype. Memory B cells can also become activated and differentiate into plasmablasts and ultimately, into plasma cells. Differentiating B cells may also first become plasmablasts, which then differentiate to become plasma cells.

C. Affinity Maturation and Clonal Families

A clonal family is generally defined by the use of related immunoglobulin heavy chain and/or light chain V(D)J sequences by 2 or more samples. Related immunoglobulin heavy chain V(D)J sequences can be identified by their shared usage of V(D)J gene segments encoded in the genome. Within a clonal family there are generally subfamilies that vary based on shared mutations within their V(D)J segments, that can arise during B cell gene recombination and somatic hypermutation.

Activated B cells migrate and form germinal centers within lymphoid or other tissues, where they undergo affinity maturation. B cells may also undergo affinity maturation outside of germinal centers. During affinity maturation, B cells undergo random mutations in their antibody genes, concentrated in the complementary determining regions (CDRs) of the genes, which encode the parts of the antibody that directly bind to and recognize the target antigen against which the B cell was activated. This creates sub-clones from the original proliferating B cell that express immunoglobulins that are slightly different from the original clone and from each other. Clones compete for antigen and the higher-affinity clones are selected, while the lower-affinity clones die by apoptosis. This process results in the "affinity maturation" of B cells and consequently in the generation of B cells expressing immunoglobulins that bind to the antigen with higher affinity. All the B cells that originate from the same 'parent' B cell form clonal families, and these clonal families include B cells that recognize the same or similar antigenic epitopes. In some aspects, we expect that clones present at higher frequencies represent clones that bind to antigen with higher affinity, because the highest-affinity clones are selected during affinity maturation. In some aspects, clones with different V(D)J segment usage exhibit different binding characteristics. In some aspects, clones with the same V(D)J segment usage but different mutations exhibit different binding characteristics.

D. Memory B Cells

Memory B cells are usually affinity-matured B cells, and may be class-switched. These are cells that can respond more rapidly to a subsequent antigenic challenge, significantly reducing the time included for affinity-matured antibody secretion against the antigen from ~14 days in a naive organism to ~7 days.

E. Plasmablasts and Plasma Cells

Plasma cells can be either long-lived or short-lived. Long-lived plasma cells may survive for the lifetime of the organism, whereas short-lived plasma cells can last for 3-4 days. Long-lived plasma cells reside either in areas of inflammation, in the mucosal areas (in the case of IgA-secreting plasma cells), in secondary lymphoid tissues (such as the spleen or lymph nodes), or in the bone marrow. To reach these divergent areas, plasmablasts fated to become long-lived plasma cells may first travel through the bloodstream before utilizing various chemokine gradients to traffic to the appropriate areas. Plasmablasts are cells that are affinity matured, are typically classed-switched, and usually secrete antibodies, though generally in lower quantities than the quantity of antibody produced by plasma cells. Plasma cells are dedicated antibody secretors.

F. Characteristics of TCR and BCR Genes

Since identifying recombinations are present in the DNA of each individual adaptive immune cell as well as their associated RNA transcripts, either RNA or DNA can be sequenced. A recombined sequence from a T-cell or B-cell can also be referred to as a clonotype. The DNA or RNA can correspond to sequences from T-cell receptor (TCR) genes or immunoglobulin (Ig) genes that encode antibodies. For example, the DNA and RNA can correspond to sequences encoding alpha, beta, gamma, or delta chains of a TCR. In a majority of T-cells, the TCR is a heterodimer consisting of an alpha-chain and beta-chain. The TCR-alpha chain is generated by VJ recombination, and the beta chain receptor is generated by V(D)J recombination. For the TCR-beta chain, in humans there are 48 V segments, 2 D segments, and 13 J segments. Several bases may be deleted and others added (called N and P nucleotides) at each of the two junctions. In a minority of T-cells, the TCRs consist of gamma and delta chains. The TCR gamma chain is generated by VJ recombination, and the TCR delta chain is generated by V(D)J recombination (Kenneth Murphy, Paul Travers, and Mark Walport, Janeway's Immunology 7th edition, Garland Science, 2007, which is herein incorporated by reference in its entirety).

The DNA and RNA analyzed in the methods can correspond to sequences encoding heavy chain immunoglobulins (IgH) with constant regions (alpha, delta, gamma, epsilon, or mu) or light chain immunoglobulins (IgK or IgL) with constant regions lambda or kappa. Each antibody can have two identical light chains and two identical heavy chains. Each chain is composed of a constant (C) and a variable region. For the heavy chain, the variable region is composed of a variable (V), diversity (D), and joining (J) segments. Several distinct sequences coding for each type of these segments are present in the genome. A specific VDJ recombination event occurs during the development of a B-cell, marking that cell to generate a specific heavy chain. Diversity in the light chain is generated in a similar fashion except that there is no D region so there is only VJ recombination. Somatic mutation often occurs close to the site of the recombination, causing the addition or deletion of several nucleotides, further increasing the diversity of heavy and light chains generated by B-cells. The possible diversity of the antibodies generated by a B-cell is then the product of the different heavy and light chains. The variable regions of the heavy and light chains contribute to form the antigen recognition (or binding) region or site. Added to this diversity is a process of somatic hypermutation which can occur after a specific response is mounted against some epitope. In this process mutations occur in those B-cells that are able to recognize the specific epitope leading to greater diversity in antibodies that may be able to bind the specific epitope more strongly. All these factors contribute to great diversity of antibodies generated by the B-cells. Many billions and maybe more than a trillion distinct antibodies may be generated. The basic premise for generating T-cell diversity is similar to that for generating antibodies by B-cells. An element of T-cell and B-cell activation is their binding to epitopes. The activation of a specific cell leads to the production of more of the same type of cells leading to a clonal expansion.

Complementarity determining regions (CDR), or hypervariable regions, are sequences in the variable domains of antigen receptors (e.g., T cell receptor and immunoglobulin) that can bind an antigen. The chain of each antigen receptor contains three CDRs (CDR1, CDR2, and CDR3). The two polypeptides making T cells (alpha and beta) and immunoglobulin (IgH and IgK or IgL) contribute to the formation of the three CDRs.

The part of CDR1 and CDR2 that is coded for by TCR-beta lies within one of 47 functional V segments. Most of the diversity of CDRs is found in CDR3, with the diversity being generated by somatic recombination events during the development of T lymphocytes.

A great diversity of BCR is present inter and intra-individuals. The BCR is composed of two genes IgH and IgK (or IgL) coding for antibody heavy and light chains. Three Complementarity Determining Region (CDR) sequences that bind antigens and MHC molecules have the most diversity in IgH and IgK (or IgL). The part of CDR1 and CDR2 coded for by IgH lies within one of 44 functional V segments. Most of the diversity in naive B cells emerges in the generation of CDR3 through somatic recombination events during the development of B lymphocytes. The recombination can generate a molecule with one of each of the V, D, and J segments. In humans, there are 44 V, 27 D, and 6 J segments; thus, there is a theoretical possibility of more than 7,000 combinations. In a small fraction of BCRs (about 5%) two D segments are found. Furthermore, several bases may be deleted and others added (called N and P nucleotides) at each of the two junctions generating a great degree of diversity. After B cell activation a process of affinity maturation through somatic hypermutation occurs. In this process progeny cells of the activated B cells accumulate distinct somatic mutations throughout the gene with higher mutation concentration in the CDR regions leading to generating antibodies with higher affinity to the antigens. In addition to somatic hypermutation activated B cells undergo the process of isotype switching. Antibodies with the same variable segments can have different forms (isotypes) depending on the constant segment. Whereas all naive B cells express IgM (or IgD), activated B cells mostly express IgG but also IgM, IgA and IgE. This expression switching from IgM (and/or IgD) to IgG, IgA, or IgE occurs through a recombination event causing one cell to specialize in producing a specific isotype. There is one segment for each IgM, IgD, and IgE, two segments for IgA, and four segments for IgG.

IV. COMPUTER IMPLEMENTATIONS

In some aspects, one or more methods described herein can be implemented on a computer. In one embodiment, a computer comprises at least one processor coupled to a chipset. In some embodiments, the chipset is coupled to a memory, a storage device, a keyboard, a graphics adapter, a pointing device, and/or a network adapter. A display is typically coupled to the graphics adapter. In one embodiment, the functionality of the chipset is provided by a memory controller hub and an I/O controller hub. In another embodiment, the memory is coupled directly to the processor instead of the chipset.

The storage device is any device capable of holding data, like a hard drive, compact disk read-only memory (CD-ROM), DVD, or a solid-state memory device. The memory holds instructions and data used by the processor. The pointing device may be a mouse, track ball, or other type of pointing device, and is used in combination with the keyboard to input data into the computer system. The graphics adapter displays images and other information on the display. The network adapter couples the computer system to a local or wide area network.

As is known in the art, a computer can have different and/or other components than those described previously. In addition, the computer can lack certain components. Moreover, the storage device can be local and/or remote from the computer (such as embodied within a storage area network (SAN)).

As is known in the art, the computer is adapted to execute computer program modules for providing functionality described herein. As used herein, the term "module" refers to computer program logic utilized to provide the specified functionality. Thus, a module can be implemented in hardware, firmware, and/or software. In one embodiment, program modules are stored on the storage device, loaded into the memory, and executed by the processor.

Embodiments of the entities described herein can include other and/or different modules than the ones described here. In addition, the functionality attributed to the modules can be performed by other or different modules in other embodiments. Moreover, this description occasionally omits the term "module" for purposes of clarity and convenience.

V. KITS

Further disclosed herein are kits comprising adapter constructs described herein. A kit can comprise a plurality of solid supports coupled to adapter constructs described herein. In some embodiments, the kit comprises an adapter template library comprising a plurality of adapter templates. In some embodiments, the kit comprises an adapter template library comprising a plurality of adapter templates coupled to a plurality of solid supports. The kit can further comprise enzymes for generating an adapter molecule (e.g., a barcode adapter molecule) described herein from the adapter template construct by an enzymatic reaction. In some embodiments, the kit comprises a cell suspension buffer described herein.

A kit can include a polynucleotide, a polynucleotide library, a vector, and/or a host cell disclosed herein and instructions for use. The kits may comprise, in a suitable container, a polynucleotide, a polynucleotide library, a vector, and/or a host cell disclosed herein, one or more controls, and various buffers, reagents, enzymes and other standard ingredients well known in the art.

The container can include at least one well on a plate comprising one or more wells. The container can include at least one vial, test tube, flask, bottle, syringe, or other container means, into which a polynucleotide, a polynucleotide library, a vector, and/or a host cell may be placed, and in some instances, suitably aliquoted. Where an additional component is provided, the kit can contain additional containers into which this component may be placed. The kits can also include a means for containing the polynucleotide, a polynucleotide library, a vector, and/or a host cell and any other reagent containers in close confinement for commercial sale. Such containers may include injection or blow-molded plastic containers into which the desired vials are retained. Containers can include labeling with instructions for use and/or warnings.

VI. DEVICES

Embodiments of the present invention include devices for generating and transporting reaction volumes. These volumes can occur on a microfluidic scale and can be phase-separated from a carrier fluid. Examples of reaction volumes that can be handled by the devices include aqueous droplets in an inverse emulsion (i.e., a water/oil emulsion). The devices allow barcode adapter templates, barcode adapter molecules, samples (e.g., cells), and/or RNAs obtained from these samples to be encapsulated in droplets, separately or together. The devices also allow reagents to be introduced into droplets, so that barcode adapter molecules can be enzymatically generated and the RNAs from individual samples can be barcoded.

Non-limiting examples of devices as used and claimed herein are depicted in FIGS. 17-19. A skilled artisan will recognize that variations of these devices can also be constructed and used in the present methods. A device generally includes three microfluidic pathways, each coupled to a pressure source and a flow sensor. The pressure source for a microfluidic pathway drives fluid through the pathway, and the flow sensor, which occurs downstream of the pressure source, can be used to measure the rate of flow through the pathway. In some embodiments, the first pathway 101 and second pathway 102 merge at a first junction 104 to form a combined pathway, which then merges with the third pathway 103 at a second junction 105. The second junction occurs in a microfluidic droplet chip and can be a site where microfluidic droplets are generated.

Devices as described herein can be assembled from tubing and fluidics components available from IDEX Corporation (Lake Forest, Ill., U.S.A.), and using a microfluidic droplet chip available from Dolomite Microfluidics (Charlestown, Mass., U.S.A.). Some features of the microfluidic droplet chip are described in U.S. Pat. Nos. 7,268,167, 7,375,140, 7,717,615, 7,772,287, 8,741,192, and 8,883,864, which are incorporated herein by reference. Suitable pressure sources include syringe pumps and pressure pumps. Pressure pumps are available from Dolomite Microfluidics. The pressure sources can be controlled independently.

In some embodiments, the first and second microfluidic pathways transport aqueous solutions. Each pathway can include an injection port and a valve (e.g., a four-way valve) to bring a solution introduced in the injection port in-line with the pathway. In some embodiments, a reservoir holding an aqueous carrier fluid is disposed upstream of each four-way valve. The aqueous carrier fluid can mix with an aqueous solution in the four-way valve as the carrier fluid is driven downstream, or push a plug of the aqueous solution downstream toward the first junction. In some embodiments, a flow resistor is disposed in each microfluidic pathway.

Once an aqueous solution is introduced into the first or second microfluidic pathway, it can pass through a sample loop that meters the flow of the solution toward the first junction. Metering can be achieved as desired, for example using fluidic resistance or valves disposed along the sample loop. In some embodiments, one sample loop is associated with each of the first and second microfluidic pathways, and the sample loops are in contact with a thermal cooling unit. The thermal cooling unit can be included to prevent thermal denaturation of enzymes, nucleic acids, or other biological components in the aqueous solutions, or to establish optimal temperatures for enzymatic reactions. Portions of the thermal cooling unit in contact with the sample loops for the first and second microfluidic pathways can be controlled independently or jointly. Any substance or apparatus can be used as a thermal cooling unit provided that it can cause the temperatures of aqueous solutions passing through the sample loops to deviate from the ambient temperature. Examples of suitable thermal cooling devices are Peltier devices and ice bins.

In some embodiments, the aqueous solution transported through the first microfluidic pathway contains cells and barcode adapter template beads. In some embodiments, the aqueous solution transported through the second microfluidic pathway contains reagents for cell lysis and reagents for producing polynucleotides of interest (e.g., enzymes for generating barcode adapter molecules). The injection port, valve, and/or sample loop associated with each microfluidic pathway can be configured or customized to accommodate the contents of the aqueous solution passing through that pathway. For example, the sample loop associated with the first microfluidic pathway can have an enlarged interior diameter to accommodate cells and beads. It will be recognized many other options exist for allocating cells, beads, and reagents between the first and second microfluidic pathways, so that all of these components are combined at the first junction. For example, cells can be transported through the first microfluidic pathway and beads can be transported through the second microfluidic pathway. Each pathway can be configured as desired, in view of the contents of the aqueous solution it carries.

The combined pathway resulting from the merger of the first microfluidic pathway and the second microfluidic pathway is in turn merged with the third microfluidic pathway in the microfluidic droplet chip. This occurs at the second junction, which is downstream from the first junction. Any desired distance can be established between the first junction and second junction. In some embodiments, the first junction is also located within the microfluidic droplet chip. In some embodiments, the first junction is immediately upstream of the second junction, so that fluid in the combined pathway travels a negligible distance (for example, less than 10, 3, 1, 0.3, or 0.1 cm) before being combined with fluid from the third microfluidic pathway. This arrangement can reduce the mixing of components in the combined pathway. In some embodiments, the dimensions of the microfluidic pathways in the device, inside and/or outside the microfluidic droplet chip, are such that the movement of fluids is governed by laminar flow.

The third microfluidic pathway can be configured to deliver an oil/surfactant mixture to the microfluidic droplet chip. Thus, at the second junction in the device, aqueous and hydrophobic phases can mix and microfluidic droplets can form. The geometry of the second junction can be selected to ensure that these droplets have desired characteristics. For example, a geometry can be selected to facilitate the formation of monodisperse droplets, having desired sizes and spaced apart from each other by desired distances, at suitable flow rates in the microfluidic pathways. In some embodiments, the third microfluidic pathway is split into two subpathways upstream of the microfluidic droplet chip, which then merge together along with the combined (aqueous) pathway at the second junction. The two subpathways can approach each other at an large angle (for example, approximately or at least 30, 60, 90, 120, 150, or 180 degrees), so that the oil/surfactant mixture forms a sheath around the aqueous mixture as it enters the second junction. With this geometry, aqueous droplets are 'pinched off' from the aqueous mixture and flow in approximately the same direction as the aqueous mixture as they exit the junction. This approach to generating droplets is known in the art as flow focusing. In other embodiments, the combined aqueous pathway intersects the third microfluidic pathway at a right angle, thus giving the second junction a t-junction geometry. In these embodiments, an oil/surfactant mixture flows straight through the junction. The aqueous mixture approaches the junction in a direction perpendicular to that at which droplets formed from this mixture get carried away from the junction. The physics of droplet formation in various microfluidic geometries is described in Thorsen et al., *Phys. Rev. Lett.* 86, 4163-4166, 2001, and elsewhere.

The fluid pathway containing droplets, which results from the merger of the combined pathway containing an aqueous mixture and the third microfluidic pathway containing an oil/surfactant mixture, constitutes a sample pathway. The sample pathway is delivered to a sample collection container, which occurs downstream of the second junction. In the sample collection container, droplets can be subjected to thermal cycling. The droplets can also be broken open and barcoded nucleic acids can be harvested.

In operation, the device described herein can be used to encapsulate barcode adapter template beads and cells into aqueous microfluidic droplets, so that each droplet contains approximately one bead and one cell on average. The number of beads and cells in each droplet can be tuned as desired, for example by adjusting the concentrations of beads or cells in solutions loaded into the device, or by adjusting the flow rates in the three microfluidic pathways. The reagents included in each droplet allow barcode adapter molecules to be enzymatically generated from the one bead in the droplet. These reagents also allow the one cell to be lysed and RNAs from the cell to undergo barcoding reactions. Thus, the RNAs from the cell can be barcoded within the droplet, and nucleic acids derived from these RNAs (and containing a barcode sequence) can be later traced to one cell when the nucleic acids from multiple cells are mixed.

VII. EXAMPLES

A. Example 1

Making Barcode Adapter Template Bead Library in a Single Reaction

The method described below was used to create a barcode adapter template bead library using emulsion PCR, where polymerase chain reaction (PCR) was performed to attach unique barcode adapter templates to each bead (see FIG. 15).

TABLE 4

Oligos used to make barcode adapter template bead library in a single reaction

| Primer name | Sequence (SEQ ID NO:) |
|---|---|
| emB-T7bridge2 | dual-biotin-C18spacer-C18spacer-TAA TAC GAC TCA CTA TAG GAT AAA GCG GCC GCA AAT (1) |
| emB-BCbridge2 | mCmCC CCT GTT TAA ACC THH HTH HHH THH HHT HHH THH HHA TTT GCG GCC GCT TTA T (2) (random combination of HH HTH HHH THH HHT HHH THH HH (3), has $3^{18}$ or $387 \times 10^6$ possibilities, giving 387 million unique barcodes) |
| emB-T7bridgefree | TAA TAC GAC TCA CTA TAG GAT AAA GCG GCC GCA AAT (4) |
| emB-Rv3 | AlexaFluor647-C18spacer-mCmCC CCT GTT TAA ACC T (5) |

Streptavidin-coated M-270 Dynabeads® (Life Technologies) were coupled with biotinylated oligonucleotide ("emB_T7bridge2"):

1. Beads were resuspended by gently swirling
2. 1 mL of M270 beads (approx. $6.7 \times 10^8$ beads) were placed into each of three 1.5 mL microfuge tubes, for a total of 3 mL
3. Placed on magnet for 3 minutes.
4. Supernatant was removed from each tube and resuspended in 1 mL (1× vol) Bind/Wash Buffer (BWB; 1M NaCl, 5 mM Tris, 0.5 mM EDTA)
5. Step 4 was repeated twice more followed by final resuspension in 540 μL volume BWB
6. 60 μL of 100 μM emB_T7bridge2 was added to beads and incubated for 15 minutes with gentle rotation
7. Following incubation, beads were washed 3× with 1 mL BWB buffer, and combined into a single tube
8. Beads were stored at 4° C. with 0.01% sodium azide
9. Beads were washed 3× with 10 mM Tris before use Barcode oligonucleotides and forward and reverse primers were added to the coupled beads from above in an emulsion-based PCR:

1. The following PCR mix (3 mL total volume) was prepared in three 1.5 mL microcentrifuge tubes (VWR Cat. No. 20170-650):

| | |
|---|---|
| ddH₂O | 715.9 μL |
| 10X HiFi PCR buffer | 100 μL |
| 50 mM MgSO₄ | 50 μL |
| 10 mM dNTP mix | 20 μL |
| emB_T7bridge2-labeled Dynabeads (1.2 × 10⁷ beads/μL) | 50 μL |
| emB_T7bridgefree (10 μM) | 4 μL |
| emB_BCandbridge2 (1 pM) | 16.6 μL |
| emB_Rv3 (100 μM) | 30 μL |
| Thermostable inorganic pyrophosphatase (NEB 2,000 units/mL) | 1.5 μL |
| Platinum Taq Hifi (Life Technologies, 5 units/μL) | 12 μL |
| Total volume | 1000 μL |

2. An oil-surfactant mix was prepared (1 mL total volume):

| | | |
|---|---|---|
| a. | Mineral oil (Sigma) | 900 μL |
| b. | EM90 (Evonik) | 100 uL |

3. 800 μL of oil-surfactant mix and 200 μL of PCR mix were combined into each of 15 Axygen 2.0 mL Maxymum Recovery conical-bottom microcentrifuge tubes (MCT-200-L-C). Tubes were sealed and shaken for 3 seconds
4. Tubes were placed into a Qiagen TissueLyzer II, and shaken for 5 minutes at 14 Hz
5. The emulsion was divided among the wells of a VWR 96-well PCR plate (83007-374), with 160 μL of emulsion added per well
6. Tubes were thermocycled using the following program:

| Initial: | |
|---|---|
| 94° C. | 2' |
| 35 Cycles: | |
| 94° C. | 20" |
| 42° C. | 30" |
| 68° C. | 15" |
| 50 Cycles: | |
| 55° C. | 5.5' |
| 72° C. | 30" |
| Final extension: | |
| 68° C. | 5' |
| Hold: | |
| 10° C. | hold |

The emulsion was broken and beads were recovered:

1. The contents of the PCR plate was transferred into 1.5 mL microcentrifuge tubes (VWR 20170-650), with no more than 0.5 mL of emulsion volume per tube
2. 100 uL of 1 uM emB_T7bridgefree primer was added to each tube 3. Tubes were topped off with isobutanol, sealed and shaken to mix thoroughly
4. Tubes were centrifuged for 1 min at 14,000 rpm
5. Tubes were placed on a magnetic strip to draw the beads to the side of the tubes, then as much of the supernatant as possible was aspirated as possible while leaving the pelleted beads behind
6. 1 mL of isobutanol was added, mixed well by pipetting up and down until the remaining oil/emulsion volume had dispersed into the isobutanol
7. Tubes were placed on a magnetic strip to draw the beads to the side of the tubes, then the isobutanol was aspirated. Beads from all of the tubes were combined into a single tube by first aspirating the supernatant from the tube into which the beads will be combined and then transferring the full volume from another tube, allowing time for the beads to collect at the magnet, then aspirating the supernatant and repeating
8. 1 mL of fresh isobutanol was added, mixed well and let rest for 60 seconds
9. Isobutanol was aspirated
10. 1 mL of 100% ethanol was added, mixed well and let rest for 60 seconds
11. Ethanol was aspirated
12. Steps 10 and 11 were repeated
13. 1 mL of 70% ethanol was added, mixed well and let rest for 60 seconds
14. Ethanol was aspirated
15. Steps 13 and 14 were repeated
16. 1 mL PBS was added, mixed well and let rest for 60 seconds.
17. PBS was aspirated
18. Steps 16 and 17 were repeated Beads that incorporated barcode adapter templates were then sorted from non-barcoded beads using a Becton Dickenson FACS Aria III, utilizing the fluorescence from the Alexa Fluor 647 dye incorporated into the emB_Rv3 reverse primer.

Beads were stored in 0.01% sodium azide at 4° C. for storage.

Note that this example makes barcode adapter template beads with a T7 RNAP promoter sequence for amplification of barcode adapters by T7 RNAP. By replacing the T7 RNAP promoter sequence "TAA TAC GAC TCA CTA TAG G" (SEQ ID NO:6) in emB-T7bridge2 with other RNAP promoter sequences, barcode adapters can be amplified using other RNAPs. Also by replacing the promoter sequence with a nicking endonuclease site, such as Nt.BbvCI's "CCT CAG C", barcode adapters can be amplified using a nicking endonuclease (e.g. Nt.BbvCI) and a stranddisplacing DNAP such as Klenow exo-.

Also, "HH HTH HHH THH HHT HHH THH HH" (SEQ ID NO:3) in emB-BCbridge2 gives ~387 million unique barcodes. When this barcode library is used to barcode even, for example, 10 million cells, only 2.5% of the unique barcodes are used. It is expected that the majority of the barcodes are of sufficient distance from one another that the majority of barcode sequence reads from NextGen sequencing are easily distinguishable from one another (with a proportion of reads being discarded), regardless of PCR and sequencing errors.

The emulsion can be made using a variety of methods known to the field, and in this case was made using a shaking method and the resulting droplets were polydisperse with an average droplet diameter of ~25 µm. Barcode oligonucleotides were amplified with forward and reverse primers and the reverse primer was labeled with a fluorescent tag, which in this example was Alexa Fluor 647—so that beads that incorporated barcode adapter template were distinguishable from unlabeled beads. Bright fluorescent beads that incorporated barcode adapter template were then FACS sorted from dim unlabeled beads.

At the specified concentrations of beads and barcode oligonucleotide in this example, by Poisson distribution beads were loaded into droplets at an average of ~7 beads per droplet, and we observed that roughly 28% of droplets contained one or more copies of a unique barcode oligonucleotide, while the rest of the droplets contained no barcode oligonucleotide at all. Of the droplets that contained at least one barcode oligonucleotide, ~70% should contain exactly one barcode oligonucleotide while the remaining ~30% should contain two or more barcodes. Therefore ~70% of the barcode template adapter bead library was monoclonal (one unique barcode sequence per bead) and ~30% was polyclonal.

The end yield of the method described below was roughly 12 million barcode adapter template beads of which ~8.4 million are monoclonal barcode adapter template beads. And although droplets were filled with ~7 beads per droplet on average, after breaking the emulsion the yield of beads was ~2%. Based on a binomial distribution, ~7.7 million unique barcode sequences were present in this barcode adapter template bead library.

The concentrations of beads and barcode oligonucleotide can be adjusted to obtain a barcode adapter template bead library with differing proportions of monoclonal and polyclonal beads and a different number of unique barcode sequences present. This will allow for barcoding nucleic acids from single cells to achieve differing proportions of nucleic acids associated to a single cell via a unique barcode, or a set of unique barcodes, and also to change the percentage of barcoded nucleic acids discarded from further analysis.

This barcode adapter template bead making process can be optimized to achieve a ratio of monoclonal:polyclonal beads of, e.g., 90%:10%, 99%:1%, or any other ratio. This improvement over the current ~70%:30% ratio can be achieved by several different methods, including further diluting the oligo containing the barcode sequence (emB-BCbridge2 in this case) so that fewer copies are divided among the droplets in the emulsion, resulting in a reduced incidence of multiple barcode sequences being encapsulated in any given droplet.

B. Example 2

Making Barcode Adapter Template Bead Library in a Single Reaction II

The method described below was used to create a barcode adapter template bead library using emulsion PCR, where polymerase chain reaction (PCR) was performed to attach unique barcode adapter templates to each bead (see FIG. 15).

TABLE 5

Oligos used to make barcode adapter template bead library in a single reaction II

| Primer name | Sequence (SEQ ID NO:) |
|---|---|
| emB-T7bridgeIsceI | dual-biotin-C18spacer-C18spacer-TAA TAC GAC TCA CTA TAG GAT AGG GAT AAC AGG GTA ATA GGA (7) |
| emB_BCbridgeIScel_2 | mCmCC CCA GTT TAA ACT CCTH HHT HHH HTH HHH THH HTH HHH TCC TAT TAC CCT GTT ATC CC (8) (random combination of HH HTH HHH THH HHT HHH THH HH (3), has $3^{18}$ or 387 × $10^6$ possibilities, giving 387 million unique barcodes) |
| emB-T7bridgefreeIscel_2 | TAA TAC GAC TCA CTA TAG GAT AG GGATAACAGGGTAATAGGA (9) |
| emB_IsceI_RV | AlexaFluor647-C18spacer-mCmCC CCA GTT TAA ACT CCT (10) |

Streptavidin-coated M-270 Dynabeads® (Life Technologies) were coupled with biotinylated oligonucleotide ("emB_T7bridgeIsceI"):
1. Beads were resuspended by gently swirling
2. 1 mL of M270 beads (approx. $6.7 \times 10^8$ beads) were placed into each of three 1.5 mL microfuge tubes, for a total of 3 mL
3. Placed on magnet for 3 minutes.
4. Supernatant was removed from each tube and resuspended in 1 mL (1× vol) Bind/Wash Buffer (BWB; 1M NaCl, 5 mM Tris, 0.5 mM EDTA)
5. Step 4 was repeated twice more followed by final resuspension in 540 µL volume BWB
6. 60 µL of 100 µM emB_T7bridgeIsceI was added to beads and incubated for 15 minutes with gentle rotation
7. Following incubation, beads were washed 3× with 1 mL BWB buffer, and combined into a single tube
8. Beads were stored at 4° C. with 0.01% sodium azide
9. Beads were washed 3× with 10 mM Tris before use Barcode oligonucleotides and forward and reverse primers were added to the coupled beads from above in an emulsion-based PCR:
1. The following PCR mix (3 mL total volume) was prepared in three 1.5 mL microcentrifuge tubes (VWR Cat. No. 20170-650):

| | |
|---|---|
| ddH2O | 715.9 µL |
| 10X HiFi PCR buffer | 100 µL |
| 50 mM MgSO4 | 50 µL |
| 10 mM dNTP mix | 20 µL |
| emB_T7bridgeIsceI-labeled Dynabeads ($1.2 \times 10^7$ beads/µL) | 50 µL |
| emB_T7bridgefreeIscel_2 (10 µM) | 4 µL |
| emB_BCbridgeIScel_2 (1 pM) | 16.6 µL |
| emB_IsceI_RV (100 µM) | 30 µL |
| Thermostable inorganic pyrophosphatase (NEB 2,000 units/mL) | 1.5 µL |
| Platinum Taq Hifi (Life Technologies, 5 units/µL) | 12 µL |
| Total volume | 1000 µL |

2. An oil-surfactant mix was prepared (1 mL total volume):

| | | |
|---|---|---|
| a. | Mineral oil (Sigma) | 900 µL |
| b. | EM90 (Evonik) | 100 µL |

3. 800 µL of oil-surfactant mix and 200 µL of PCR mix were combined into each of 15 Axygen 2.0 mL Maxymum Recovery conical-bottom microcentrifuge tubes (MCT-200-L-C). Tubes were sealed and shaken for 3 seconds
4. Tubes were placed into a Qiagen TissueLyzer II, and shaken for 5 minutes at 14 Hz
5. The emulsion was divided among the wells of a VWR 96-well PCR plate (83007-374), with 160 µL of emulsion added per well
6. Tubes were thermocycled using the following program:

| Initial: | |
|---|---|
| 94° C. | 2' |
| 35 Cycles: | |
| 94° C. | 20" |
| 42° C. | 30" |
| 68° C. | 15" |
| 50 Cycles: | |
| 55° C. | 5.5' |
| 72° C. | 30" |
| Final extension: | |
| 68° C. | 5' |
| Hold: | |
| 10° C. | hold |

The emulsion was broken and beads were recovered:
1. The contents of the PCR plate was transferred into 1.5 mL microcentrifuge tubes (VWR 20170-650), with no more than 0.5 mL of emulsion volume per tube
2. 100 uL of 1 uM emB_T7bridgefreeIscel_2 primer was added to each tube
3. Tubes were topped off with isobutanol, sealed and shaken to mix thoroughly
4. Tubes were centrifuged for 1 min at 14,000 rpm
5. Tubes were placed on a magnetic strip to draw the beads to the side of the tubes, then as much of the supernatant as possible was aspirated as possible while leaving the pelleted beads behind
6. 1 mL of isobutanol was added, mixed well by pipetting up and down until the remaining oil/emulsion volume had dispersed into the isobutanol
7. Tubes were placed on a magnetic strip to draw the beads to the side of the tubes, then the isobutanol was aspirated. Beads from all of the tubes were combined into a single tube by first aspirating the supernatant from the tube into which the beads will be combined and then transferring the full volume from another tube, allowing time for the beads to collect at the magnet, then aspirating the supernatant and repeating
8. 1 mL of fresh isobutanol was added, mixed well and let rest for 60 seconds 9. Isobutanol was aspirated
10. 1 mL of 100% ethanol was added, mixed well and let rest for 60 seconds
11. Ethanol was aspirated
12. Steps 10 and 11 were repeated
13. 1 mL of 70% ethanol was added, mixed well and let rest for 60 seconds
14. Ethanol was aspirated
15. Steps 13 and 14 were repeated
16. 1 mL PBS was added, mixed well and let rest for 60 seconds.
17. PBS was aspirated
18. Steps 16 and 17 were repeated Beads that incorporated barcode adapter templates were then sorted from non-barcoded beads using a Becton Dickenson FACS Aria III, utilizing the fluorescence from the Alexa Fluor 647 dye incorporated into the emB_IsceI_RV reverse primer.

Beads were stored in 0.01% sodium azide at 4° C. for storage.

Note that this example makes barcode adapter template beads with a T7 RNAP promoter sequence for amplification of barcode adapters by T7 RNAP. By replacing the T7 RNAP promoter sequence "TAA TAC GAC TCA CTA TAG G" (SEQ ID NO:6) in emB-T7bridgeIsceI with other RNAP promoter sequences, barcode adapters can be amplified using other RNAPs. Also by replacing the promoter sequence with a nicking endonuclease site, such as Nt.BbvCI's "CCT CAG C", barcode adapters can be amplified using a nicking endonuclease (e.g. Nt.BbvCI) and a strand-displacing DNAP such as Klenow exo-.

Also, "HH HTH HHH THH HHT HHH THH HH" (SEQ ID NO:3) in emB-BCbridgeIsceI_2 gives ~387 million unique barcodes. When this barcode library is used to barcode even, for e.g., 10 million cells, only 2.5% of the unique barcodes are used. It is expected that the majority of the barcodes are of sufficient distance from one another that the majority of barcode sequence reads from NextGen sequencing are easily distinguishable from one another (with a proportion of reads being discarded), regardless of PCR and sequencing errors.

At the specified concentrations of beads and barcode oligonucleotide in this example, by Poisson distribution beads were loaded into droplets at an average of ~7 beads per droplet, and we observed that roughly 25% of droplets contained one or more copies of a unique barcode oligonucleotide, while the rest of the droplets contained no barcode oligonucleotide at all. Of the droplets that contained at least one barcode oligonucleotide, ~75% contained exactly one barcode oligonucleotide while the remaining ~25% contained two or more barcodes. Therefore ~75% of the barcode template adapter bead library was monoclonal (one unique barcode sequence per bead) and ~25% was polyclonal.

The end yield of the method described below was roughly 50 million barcode adapter template beads of which ~37.5 million were monoclonal beads. Although droplets were filled with ~7 beads per droplet on average, after breaking the emulsion the yield of beads was ~11%. Based on binomial distribution, ~28 million monoclonal beads with unique barcode sequences were present.

The concentrations of beads and barcode oligonucleotide can be adjusted to obtain a barcode adapter template bead library with differing proportions of monoclonal and polyclonal beads and a different number of unique barcode sequences present. This will allow for barcoding nucleic acids from single cells to achieve differing proportions of nucleic acids associated to a single cell via a unique barcode, or a set of unique barcodes, and also to change the percentage of barcoded nucleic acids discarded from further analysis.

C. Example 3

Making Barcode Adapter Template Bead Library in Multi-Steps

In this example reactions as per FIG. 16 were done, except that only one S1, one W, and one S2 barcode sequence used. Therefore, pooling of beads coupled to different S1 sequences did not occur, and similarly, beads were not pooled after the polymerase extension reaction to add W sequences to the S1 oligo.

This example can be easily extended to be done as per FIG. 16 simply by having multiple S1-oligo, W-oligo and S2-oligo with unique barcode sequences.

TABLE 6

Oligos used to make barcode adapter template bead library in a single reaction

| Primer name | Sequence (SEQ ID NO:) |
|---|---|
| S1-oligo | Desthiobiotin-C18spacer-ATA TTA ATA CGA CTC ACT ATA GGC ATA GGG ATA ACA GGG TAA TGA [S1] AG (11), where S1 = GATGGAT |
| W-oligo-a | CCT CCT CCT CCT CCC [W] CTI III III TCA TTA CCC TGT TAT CCC TAT GCC (12), where W = AGTGAGCTGCGT |
| W-oligo-b | CT CCT CCT CCC [W] CTI III III TCA TTA CCC TGT TAT CCC TAT GCC (13), where W = AGTGAGCTGCGT |
| S2-oligo-a | mCmCC CT [S2] TCC TCC TCC TCC TCC C (14), where S2 = CCTAACC |
| S2-oligo-b | mCmCC CT [S2] CTC CTC CTC CC (15), where S2 = CCTAACC |

Streptavidin-coated M-270 Dynabeads® (Life Technologies) were coupled with biotinylated oligonucleotides containing S1 sequence in individual reactions:
1. Beads were resuspended by gently swirling
2. M270 beads (Life Technologies) were placed on magnet for 3 minutes.
3. Supernatant was removed from each tube and resuspended in (1× vol) 0.5× Bind/Wash Buffer (BWB; 1M NaCl, 5 mM Tris, 0.5 mM EDTA)
4. Step 4 was repeated twice more followed by final resuspension in BWB buffer
5. 10 µM S1-oligo was added to beads and incubated for 15 minutes with gentle rotation 6. Following incubation, beads were washed 3× with BWB buffer
7. Beads were stored at 4° C. with 0.01% sodium azide
8. Beads were washed 3× with 10 mM Tris before use Coupled beads were then pooled together, and an extension reaction using w-oligo was performed.

For w extension reaction:

| | |
|---|---|
| ddH₂O | 26.1 μL |
| 10× Taq buffer | 5 μL |
| 100 mM MgCl₂ | 4.25 μL |
| 20% Tween 20 | 0.125 μL |
| 100× BSA | 5 μL |
| S1-coupled beads (1 mg in 20 μL) | 5 μL |
| dNTP | 1 μL |
| Taq (NEB) | 0.5 μL |
| TIPP (NEB) | 0.025 μL |
| 100 μM W-oligo-a OR W-oligo-b | 3 μL |

Incubated at 55° C. overnight in an shaking incubator, shaking at 800 rpm.

Beads were pooled and washed thrice with 1×BWB buffer. The anti-sense strand was then melted in 70° C. melt buffer (50 mM NaCl, 10 mM Tris pH 8.0). Beads were pelleted with a magnet and supernatant removed entirely, then beads are washed thrice in 1 mL TE0.1 and then resuspended in TE0.1 at 1 mg/20 uL.

For s2 extension reaction (per 250 μg beads):

| | |
|---|---|
| ddH₂O | 24.5 μL |
| 10× Taq buffer | 5 μL |
| 100 mM MgCl₂ | 4.25 μL |
| 20% Tween 20 | 0.125 μL |
| 100× BSA | 5 μL |
| S1 + w-a or S1 + w-b Beads | 5 μL |
| dNTP | 1 μL |
| 100 μM S2-oligo-a OR S2-oligo-b | 3 μL |

S2-oligo-a was used with S1+w-a beads, and S2-oligo-b was used with S1+w-b beads. Incubated at 60° C. for 10 min then slowly cooled to 37° C. Incubated at 37° C. for 2 hours, shaken at 800 rpm. Reaction was then allowed to cool to room temperature.
Then the following was added:

| | |
|---|---|
| dNTP (NEB) | 1 μL |
| *Ecoli* pyrophosphatase (NEB) | 0.1 μL |
| Klenow fragment (NEB) | 1 μL |

Reaction was incubated at 25° C. for 3 hours, shaking at 800 rpm. Every hour reaction was refreshed with 1 μL dNTP.

Beads were pooled and washed thrice with 1×BWB buffer. Beads were stored at 4° C. with 0.01% sodium azide and were washed 3× with 10 mM Tris before use.

A small aliquot of barcode adapter template beads were also used in an in vitro transcription reaction using T7 RNAP to determine if making of the beads was successful. If successful, T7 RNAP would be able to transcribe RNA off the double stranded T7 promoter present in the s1-oligo sequence. Megascript T7 kit (Life Technologies) was used and manufacturer's instructions were followed. 5 μL of reaction was run on an RNA Flashgel (Lonza). See FIG. 20.

The number of unique barcode sequences as formed from the combination of S1, W, and S2 sequences can be increased or decreased as desired. For example, as can be seen in Table 1, if the number of unique barcodes is ~10× greater than the number of cells to be barcoded, as determined by the binomial distribution, we can expect ~10% of cells to share identical barcodes and thus discarded during bioinformatic linking of nucleic acids to one another (this is detectable as more than one variable gene nucleic acid, such as two immunoglobulin heavy chains or two TCR alpha chains being associated with each other) Therefore, from such a library we can expect ~90% of barcoded cells to be successfully barcoded with a unique sequence enabling proper informatics linkage of nucleic acids to one another.

Therefore, the number of $S1_x$, W, and $S2_y$ sequences required is dependent on the desired number of cells to be barcoded. In Table 7, the W-extension reaction is envisioned to occur in 96-well plates, and an identical number of $S1_x$ and $S2_y$ sequences are used. As can be seen, to barcode 10 million cells, at most 323 $S1_x$ and $S2_y$ oligos and 960 $W_z$ oligos are required. These are manageable numbers, especially if the reactions are done in 96-well plates, necessitating a total of only 18 96-well plates to perform the reactions to make a barcode adapter template bead library of the desired size.

TABLE 7

Number of $S1_x$, $W_z$, and $S2_y$ sequences required to obtain a barcode adapter template library of sufficient size to barcode nucleic acids from a desired number of cells

| | # cells to be barcoded | | | | |
|---|---|---|---|---|---|
| | 1,000 | 10,000 | 100,000 | 1,000,000 | 10,000,000 |
| # unique beads required | 10,000 | 100,000 | 1,000,000 | 10,000,000 | 100,000,000 |
| # S1/S2 required if 96 w | 11 | 33 | 103 | 323 | 1021 |
| # S1/S2 required if 960 w | 4 | 11 | 33 | 103 | 323 |
| # S1/S2 required if 9600 w | 2 | 4 | 11 | 33 | 103 |

Also, it is desirable for the barcodes in $S1_x$, $S2_y$, and $W_z$ to be designed to be a minimum Hamming distance apart, with this minimum being 2. With this minimum, only barcode sequence reads from NextGen sequencing with an exact match to the barcode sequence are used; barcode sequence reads with errors are discarded. If the Hamming distance or edit distance used is increased to a minimum of 3, then error-correction is possible.

Note that this example makes barcode adapter template beads with a T7 RNAP promoter sequence for amplification of barcode adapters by T7 RNAP. By replacing the T7 RNAP promoter sequence "TAA TAC GAC TCA CTA TAG G" (SEQ ID NO:6) in emB-T7bridge2 with other RNAP promoter sequences, barcode adapters can be amplified using other RNAPs. Also by replacing the promoter sequence with a nicking endonuclease site, such as Nt.B-bvCI's "CCT CAG C", barcode adapters can be amplified using a nicking endonuclease (e.g. Nt.BbvCI) and a strand-displacing DNAP such as Klenow exo-.

D. Example 4

Making Aqueous Barcode Adapter Template

In this example, aqueous barcode adapter templates that were not coupled to beads were synthesized to demonstrate the broad applicability of the present methods.

A reaction mix was prepared as described below:

| | |
|---|---|
| ddH2O | 353 µL |
| 10x HiFi Buffer | 50 µL |
| 50 mM MgSO₄ | 20 µL |
| 10 mM dNTP mix | 10 µL |
| 10 µM emB_T7bridge2 (Refer to Table 4) | 25 µL |
| 1 pM emB_BCbridge2 (Refer to Table 4) | 13 µL |
| 10 µM emB_RV3 (Refer to Table 4) | 25 µL |
| Platinum Taq HiFi (Life Technologies) | 4 µL |
| Total Volume | 500 µL |

The reaction mix was then aliquoted into a 96-well PCR plate at 25 µL per well and thermocycled as follows:

| Initial: | |
|---|---|
| 95° C. | 1' |
| 22 Cycles: | |
| 95° C. | 20" |
| 46° C. | 30" |
| 68° C. | 30" |
| Final extension: | |
| 68° C. | 5' |
| Hold: | |
| 10° C. | hold |

The resulting PCR product, which is the barcode adapter template, was then blunted to remove A overhangs:

| | |
|---|---|
| NEBuffer 2 | 162 µL |
| 10 mM dNTPs | 30 µL |
| T4 DNA polymerase (New England Biolabs) | 2 µL |

2.5 µL of the blunting mix was added to each 25 µL reaction volume, and incubated at 12° C. for 15 minutes. 1 µL of 250 mM EDTA was then added to each 25 µL reaction volume and heated to 75° C. for 20 minutes to inactivate the enzyme.

The reaction was cleaned up and quantitated:
1. Reactions were then pooled and cleaned up using Zymo Research RNA Clean and Concentrator kit following manufacturer instructions
2. Picogreen quantitation kit (Life Technologies) was used to quantify the DNA and barcode adapter template concentration adjusted to 55 ng/uL Note that this example makes barcode adapter template beads with a T7 RNAP promoter sequence for amplification of barcode adapters by T7 RNAP. By replacing the T7 RNAP promoter sequence "TAA TAC GAC TCA CTA TAG G" (SEQ ID NO:6) in emB-T7bridge2 with other RNAP promoter sequences, barcode adapters can be amplified using other RNAPs. Also by replacing the promoter sequence with a nicking endonuclease site, such as Nt.B-bvCI's "CCT CAG C", barcode adapters can be amplified using a nicking endonuclease (e.g. Nt.BbvCI) and a strand-displacing DNAP such as Klenow exo-.

E. Example 5

Adding Barcodes from Barcode Adapter Templates to mRNA in Different Reaction Buffers This example shows that the present methods are useable in a variety of different buffers. Barcode adapter templates were made as described above in Example 4.

TABLE 8

| Composition of reaction buffers | |
|---|---|
| Buffer name | Composition |
| 1x MMLV | 50 mM Tris-HCl |
| | 75 mM KCl |
| | 3 mM MgCl2 |
| | 10 mM DTT |
| | pH 8.3 @ 25° C. |
| 1x Thermopol DF | 20 mM Tris-HCl |
| | 10 mM (NH4)2SO4 |
| | 10 mM KCl |
| | 2 mM MgSO4 |
| | pH 8.8@25° C. |
| 1x TAE | 40 mM Tris |
| | 20 mM acetic acid |
| | 1 mM EDTA |

The following reactions were set up:

| Using 0.5x MMLV buffer | |
|---|---|
| ddH2O | 4.8 µL |
| 10x MMLV buffer (NEB) | 1.25 µL |
| 100X BSA (NEB) | 1.25 µL |
| 100 mM MgCl2 | 1.75 µL |
| 50 µM oligo(dT)₂₀VN (SEQ ID NO: 16) | 0.5 µL |
| NTP mix (from Life Technologies Megascript SP6 kit) | 2 µL |
| dNTP (NEB) | 1.25 µL |
| barcode adapter template (55 ng/µL) | 0.6 µL |
| Ribolock (Thermo Scientific) | 0.6 µL |
| Total PBMC RNA (50 ng/ul) | 4 µL |

The above was heated to 55° C. for 3 minutes, then the following was added:

| | |
|---|---|
| Ribolock (Thermo Scientific) | 0.4 µL |
| E. coli inorganic pyrophosphatase (NEB) | 2 µL |
| T7 RNAP (NEB) | 1 µL |
| T4gp32 (NEB) | 0.6 µL |
| Maxima H- RTase (Thermo Scientific) | 3 µL |

T7 RNAP linear amplification of barcode adapters from barcode adapter template, reverse transcription and addition of barcodes to $1^{st}$ strand cDNA was performed at 42° C. for 2 hours.

| Using Thermopol buffer: | |
|---|---|
| ddH2O | 3.3 µL |
| 10x Thermopol DF (NEB) | 2.5 µL |
| 1M DTT | 0.25 µL |
| 100X BSA (NEB) | 1.25 µL |
| 100 mM MgCl2 | 1.75 µL |
| 50 µM oligo(dT)₂₀VN (SEQ ID NO: 16) | 0.5 µL |
| NTP mix (from Life Technologies Megascript SP6 kit) | 2 µL |
| dNTP (NEB) | 1.25 µL |
| barcode adapter template (55 ng/µL) | 0.6 µL |
| Ribolock (Thermo Scientific) | 0.6 µL |
| Total PBMC RNA (50 ng/µL) | 4 µL |

The above was heated to 55° C. for 3 minutes, then the following was added:

| | |
|---|---|
| Ribolock (Thermo Scientific) | 0.4 µL |
| E. coli inorganic pyrophosphatase (NEB) | 2 µL |
| T7 RNAP (NEB) | 1 µL |
| T4gp32 (NEB) | 0.6 µL |
| Maxima H- RTase (Thermo Scientific) | 3 µL |

T7 RNAP linear amplification of barcode adapters from barcode adapter template, reverse transcription and addition of barcodes to 1$^{st}$ strand cDNA was performed at 42° C. for 2 hours.

| USING TAE BUFFER: | |
|---|---|
| ddH2O | 4.55 μL |
| 5x TAE | 1.25 μL |
| 1M DTT | 0.25 μL |
| 100X BSA (NEB) | 1.25 μL |
| 100 mM MgCl2 | 1.75 μL |
| 50 nM oligo(dT)$_{20}$VN (SEQ ID NO: 16) | 0.5 μL |
| NTP mix (from Life Technologies Megascript SP6 kit) | 2 μL |
| dNTP (NEB) | 1.25 μL |
| barcode adapter template (55 ng/μL) | 0.6 μL |
| Ribolock (Thermo Scientific) | 0.6 μL |
| Total PBMC RNA (50 ng/μL) | 4 μL |

The above was heated to 55° C. for 3 minutes, then the following was added:

| Ribolock (Thermo Scientific) | 0.4 μL |
|---|---|
| E. coli inorganic pyrophosphatase (NEB) | 2 μL |
| T7 RNAP (NEB) | 1 μL |
| T4gp32 (NEB) | 0.6 μL |
| Maxima H- RTase (Thermo Scientific) | 3 μL |

T7 RNAP linear amplification of barcode adapters from barcode adapter template, reverse transcription, and addition of barcodes to 1$^{st}$ strand cDNA was performed at 42° C. for 2 hours.

The reaction was then cleaned up using a modified traditional phenol/chloroform method:

1. 200 μL of TE0.1 (10 mM Tris pH 8.0, 0.1 mM EDTA) was added to each reaction mix
2. 200 μL of Phenol/chloroform/isoamyl alcohol (Sigma) was added to each reaction mix and shaken vigorously in pre-spun Gel Phase Lock tubes (5Prime)
3. Gel Phase Lock tubes were centrifuged at 14,000 g for 3 minutes and the top aqueous fraction was pipetted into Amicon 100 kDa columns (Millipore) and spun at 14,000 g for 3 minutes
4. 450 μL TE (10 mM Tris, pH 8.0, 1 mM EDTA) was then pipetted into the Amicon column, and spun at 14,000 g for 3 minutes
5. 450 μL of 10 mM Tris (pH8.0) was then pipetted into the Amicon column and spun at 14,000 g for 5 minutes
6. The Amicon column was inverted into a new collection tube and spun at 1000 g for 2 minutes to collect the elute which contained the purified mRNA/1st strand cDNA duplex Two rounds of PCR (PCR1 and PCR2) were then performed:

TABLE 9

PCR1 and PCR2 primer sequences

| Primer name | Sequence (SEQ ID NO:) |
|---|---|
| L_GSP1 | TYT GTG GGA CTT CCA CTG CTC (17) |
| G_GSP1 | TCT TGT CCA CCT TGG TGT TGC TG (18) |
| K_GSP1 | CGA TTG GAG GGC GTT ATC CAC (19) |
| K_GSP2 | CTA TGC GCC TTG CCA GCC CGC TCA GTC AGA TGG CGG GAA GAT GAA GAC (20) |
| L_GSP2 | CTA TGC GCC TTG CCA GCC CGC TCA GGA GGA GGG YGG GAA CAG AGT GAC (21) |
| G_GSP2 | CTA TGC GCC TTG CCA GCC CGC TCA GGG GAA GTA GTC CTT GAC CAG GCA G (22) |
| BC_Long | GAG AGA CTG ACA GCG TAT CGC CTC CCT CGC GCC ATC AGA CGA GTG CGT GGA TAA AGC GGC CGC AAA T (23) |
| FW_1short | GAG AGA CTG ACA GCG TAT CGC CTC (24) |
| 2FR | CGT ATC GCC TCC CTC GCG (25) and CTA TGC GCC TTG CCA GCC C (26) mixed 1:1 |

The following PCR1 Phusion (Thermo Scientific) reaction mix was set up per RT reaction:

| H2O | 11.28 μL |
|---|---|
| 5x GC buffer | 5 μL |
| MgCl2 | 0.15 μL |
| DMSO | 1 μL |
| dNTP | 0.5 μL |
| 10 μM FW1-short | 1 μL |
| 10 μM BC-Long | 1 μL |
| 10 μM K-GSP1 | 0.56 μL |
| 10 μM L-GSP1 | 1.25 μL |
| 10 μM G-GSP1 | 0.56 μL |
| ET-SSB (NEB) | 0.25 μL |
| BSA | 0.25 μL |
| Phusion | 0.2 μL |
| cDNA template | 2 μL |

Initial:

| | |
|---|---|
| 95° C. | 5' |

18 Cycles:

| | |
|---|---|
| 98° C. | 30" |
| 62° C. | 30" |
| 72° C. | 45" |

Final extension:

| | |
|---|---|
| 72° C. | 5' |

Hold:

| | |
|---|---|
| 10° C. | hold |

The reactions from PCR1 were then diluted 50× and used as a template in 3 separate PCR2 reactions, one for kappa light chain, one for lambda light chain and one for gamma heavy chain.

The following PCR2 Phusion (Thermo Scientific) reaction mixes were set up per RT reaction:

| | |
|---|---|
| H2O | 17.82 µL |
| 5x GC buffer | 6 µL |
| MgCl2 | 0.18 µL |
| DMSO | 1 µL |
| dNTP | 0.6 µL |
| 10 µM 2FW | 1.2 µL |
| 10 µM K or L or G-GSP2 | 0.6 µL |
| BSA | 0.3 µL |
| Phusion | 0.3 µL |
| Dil. PCR1 template | 2 µL |

Initial:

| | |
|---|---|
| 95° C. | 5' |

28 cycles:

| | |
|---|---|
| 98° C. | 30" |
| 65° C. | 30" |
| 72° C. | 45" |

Final extension:

| | |
|---|---|
| 72° C. | 5' |

Hold:

| | |
|---|---|
| 10° C. | hold |

5 µL of product was run on a gel (FIG. 21). As can be seen, the barcoding reaction works well in a variety of different buffers that contain a variety of different ions such as potassium, ammonium, chloride, sulphate, and acetate ions.

F. Example 6

RNA Barcode Adapters Amplified from Barcode Adapter Templates Work Better than Unamplified DNA Barcode Adapters This example shows that the present methods are useable in a variety of different buffers with different salt concentrations. Also, using amplified RNA barcode adapters generated from barcode adapter templates works better (i.e., produces the desired amplified reaction product) than just adding DNA barcode adapters into the reaction, presumably because the reaction with RNA barcode adapters results in lower background (see FIG. 4). Barcode adapter templates were made as described above in Example 4.

TABLE 10

Additional oligo sequences

| Primer name | Sequence (SEQ ID NO:) |
|---|---|
| DNA barcode adapter w24 | TYT GTG GGA CTT CCA CTG CTC (17) |
| FW1_Long | GAG AGA CTG ACA GCG TAT CGC CTC CCT CGC GCC ATC AGA CGA GTG CGT CAC GAC CGG TGC TCG ATT TAG (27) |

The following reactions were set up and buffer compositions are as in Table 8:

| Using 1x MMLV buffer | |
|---|---|
| ddH$_2$O | 3.55 µL |
| 10x MMLV buffer (NEB) | 2.5 µL |
| 100X BSA (NEB) | 1.25 µL |
| 100 mM MgCl$_2$ | 1.75 µL |
| 50 µM oligo(dT)$_{20}$ VN (SEQ ID NO: 16) | 0.5 µL |
| NTP mix (from Life Technologies Megascript SP6 kit) | 2 µL |
| dNTP (NEB) | 1.25 µL |
| barcode adapter template (55 ng/µL) | 0.6 µL |
| Ribolock (Thermo Scientific) | 0.6 µL |
| Total PBMC RNA (50 ng/ul) | 4 µL |

The above was heated to 55° C. for 3 minutes, then the following was added:

| | |
|---|---|
| Ribolock (Thermo Scientific) | 0.4 µL |
| E. coli inorganic pyrophosphatase (NEB) | 2 µL |
| T7 RNAP (NEB) | 1 µL |
| T4gp32 (NEB) | 0.6 µL |
| Maxima H-RTase (Thermo Scientific) | 3 µL |

T7 RNAP linear amplification of barcode adapters from barcode adapter template, reverse transcription, and addition of barcodes to 1st strand cDNA was performed at 42° C. for 2 hours.

| Using 0.5x MMLV buffer | |
|---|---|
| ddH$_2$O | 4.8 µL |
| 10x MMLV buffer (NEB) | 1.25 µL |
| 100X BSA(NEB) | 1.25 µL |
| 100 mM MgCl$_2$ | 1.75 µL |
| 50 µM oligo(dT)$_{20}$ VN (SEQ ID NO: 16) | 0.5 µL |
| NTP mix (from Life Technologies Megascript SP6 kit) | 2 µL |
| dNTP (NEB) | 1.25 µL |
| barcode adapter template (55 ng/µL) | 0.6 µL |
| Ribolock (Thermo Scientific) | 0.6 µL |
| Total PBMC RNA (50 ng/ul) | 4 µL |

The above was heated to 55° C. for 3 minutes, then the following was added:

| | |
|---|---|
| Ribolock (Thermo Scientific) | 0.4 µL |
| E. coli inorganic pyrophosphatase (NEB) | 2 µL |
| T7 RNAP (NEB) | 1 µL |
| T4gp32 (NEB) | 0.6 µL |
| Maxima H-RTase (Thermo Scientific) | 3 µL |

T7 RNAP linear amplification of barcode adapters from barcode adapter template, reverse transcription, and addition of barcodes to 1st strand cDNA was performed at 42° C. for 2 hours.

| Using DNA barcode adapter | |
|---|---|
| ddH₂O | 13 µL |
| 10x MMLV buffer (NEB) | 2.5 µL |
| 100X BSA (NEB) | 0.25 µL |
| 100 mM MgCl₂ | 0.75 µL |
| 50 µM oligo(dT)₂₀ VN (SEQ ID NO: 16) | 1 µL |
| 10 µM DNA barcode adapter w24 | 2.5 µL |
| Ribolock (Thermo Scientific) | 0.6 |
| Total PBMC RNA (50 ng/ul) | 2 µL |

The above was heated to 55° C. for 3 minutes, then the following was added:

| Ribolock (Thermo Scientific) | 0.4 µL |
|---|---|
| T4gp32 (NEB) | 1 µL |
| Maxima H-RTase (Thermo Scientific) | 1 µL |

Reverse transcription and addition of barcodes to 1st strand cDNA was performed at 42° C. for 2 hours.

The reaction was then cleaned up using a modified traditional phenol/chloroform method:

1. 200 µL of TE0.1 (10 mM Tris pH 8.0, 0.1 mM EDTA) was added to each reaction mix
2. 200 µL of Phenol/chloroform/isoamyl alcohol (Sigma) was added to each reaction mix and shaken vigorously in pre-spun Gel Phase Lock tubes (5Prime)
3. Gel Phase Lock tubes were centrifuged at 14,000 g for 3 minutes and the top aqueous fraction was pipetted into Amicon 100 kDa columns (Millipore) and spun at 14,000 g for 3 minutes
4. 450 µL TE (10 mM Tris, pH 8.0, 1 mM EDTA) was then pipetted into the Amicon column, and spun at 14,000 g for 3 minutes
5. 450 µL of 10 mM Tris (pH8.0) was then pipetted into the Amicon column and spun at 14,000 g for 5 minutes
6. The Amicon column was inverted into a new collection tube and spun at 1000 g for 2 minutes to collect the elute which contained the purified mRNA/1ˢᵗ strand cDNA duplex Two rounds of PCR (PCR1 and PCR2) were then performed:

The following PCR1 Phusion (Thermo Scientific) reaction mix was set up per RT reaction that used a barcode adapter template:

| H₂O | 11.28 µL |
|---|---|
| 5x GC buffer | 5 µL |
| MgCl₂ | 0.15 µL |
| DMSO | 1 µL |
| dNTP | 0.5 µL |
| 10 µM FW1-short | 1 µL |
| 10 µM BC-Long | 1 µL |
| 10 µM K-GSP1 | 0.56 µL |
| 10 µM L-GSP1 | 1.25 µL |
| 10 µM G-GSP1 | 0.56 µL |
| ET-SSB (NEB) | 0.25 µL |
| BSA | 0.25 µL |
| Phusion | 0.2 µL |
| cDNA template | 2 µL |

The following PCR1 Phusion (Thermo Scientific) reaction mix was set up per RT reaction that used a DNA barcode adapter:

| H₂O | 11.28 µL |
|---|---|
| 5x GC buffer | 5 µL |
| MgCl₂ | 0.15 µL |
| DMSO | 1 µL |
| dNTP | 0.5 µL |
| 10 µM FW1-short | 1 µL |
| 10 µM FW-Long | 1 µL |
| 10 µM K-GSP1 | 0.56 µL |
| 10 µM L-GSP1 | 1.25 µL |
| 10 µM G-GSP1 | 0.56 µL |
| ET-SSB (NEB) | 0.25 µL |
| BSA | 0.25 µL |
| Phusion | 0.2 µL |
| cDNA template | 2 µL |

| Initial: | |
|---|---|
| 95° C. | 5' |
| 18 Cycles: | |
| 98° C. | 30" |
| 62° C. | 30" |
| 72° C. | 45" |
| Final extension: | |
| 72° C. | 5' |
| Hold: | |
| 10° C. | hold |

The reactions from PCR1 were then diluted 50x and used as a template in 3 separate PCR2 reactions, one for kappa light chain, one for lambda light chain, and one for gamma heavy chain.

The following PCR2 Phusion (Thermo Scientific) reaction mixes were set up per PCR1 reaction:

| H₂O | 17.82 µL |
|---|---|
| 5x GC buffer | 6 µL |
| MgCl₂ | 0.18 µL |
| DMSO | 1 µL |
| dNTP | 0.6 µL |
| 10 µM 2FW | 1.2 µL |
| 10 µM K or L or G-GSP2 | 0.6 µL |
| BSA | 0.3 µL |
| Phusion | 0.3 µL |
| Dil. PCR1 template | 2 µL |

| Initial: | |
|---|---|
| 95° C. | 5' |
| 28 cycles: | |
| 98° C. | 30" |
| 65° C. | 30" |
| 72° C. | 45" |
| Final extension: | |
| 72° C. | 5" |
| Hold: | |
| 10° C. | hold |

5 µL of product was run on a gel (FIG. 22). As can be seen, the barcoding reaction works well in buffers with differing salt concentrations. While the reaction works better in a low salt buffer (0.5xMMLV) due to the salt sensitivity of the T7 RNAP, it also works in a higher salt buffer (1xMMLV). Note that due to non-specific priming during the RT step when using DNA barcode adapters (refer to FIG. 4), there was exceptionally high background and the desired bands were obscured.

G. Example 7

Barcoding Nucleic Acids from Cells Using Aqueous Barcode Adapter Templates in Droplets Made Using a Microfluidic Droplet Device A device for creating monodisperse emulsions was used to encapsulate single cells along with barcoded beads and other reagents necessary for the barcoding assay. Three Dolomite P-Pumps were equipped with flow sensors (Dolomite 3200016, 3200095, and 3200098). The first P-Pump was connected directly to a 2-Reagent Droplet Chip (Dolomite 3200287) via microfluidic tubing that incorporated a T-junction to split the line into two inputs. This was the oil input line. The other two P-Pumps were connected via fluidic tubing to PEEK sample loops that coiled around an ice bin that served to keep samples chilled while the device was operating, and each of these loops were connected to the 2-Reagent Droplet Chip. Each sample loop incorporated a four-way valve at its front end so that sample could be loaded into the loop by means of a syringe. The first sample loop was filled with cells while the second loop was filled with RT/barcoding/lysis mix. An example of the device configuration is as shown in FIGS. 17-19. The ice bin was filled with ice prior to use.

A murine B220+ B cell population was FACS sorted and a cell suspension was prepared using 300 mM betaine with 10 mM NaCl and 0.5 mg/ml BSA as a suspension buffer. Cells were used at a concentration of 4,500 cells/µL. An RT/aqueous barcode mix was prepared as follows:

| | |
|---|---|
| 10X Thermopol DF | 30 µL |
| 1M DTT | 3 µL |
| 1M MgCl$_2$ | 3.6 µL |
| 50 µM oligo(dT)$_{20}$ VN (SEQ ID NO: 16) | 6 µL |
| NTP mix (from Life Technologies Megascript SP6 kit) | 48 µL |
| dNTP (NEB) | 15 µL |
| barcode adapter template (55 ng/µL) | 7.2 µL |
| 10% Tween-20 | 1 µL |
| Ribolock (Thermo Scientific) | 12 µL |
| E. coli inorganic pyrophosphatase (NEB) | 24 µL |
| T7 RNAP (NEB) | 12 µL |

-continued

| | |
|---|---|
| T4gp32 (NEB) | 7.2 µL |
| Maxima H-RTase (Thermo Scientific) | 36 µL |
| Total volume | 205 µL |

The cell suspension was loaded into one sample loop and the RT/barcoding/lysis mix was loaded into the other sample loop using syringes. Cell and barcode concentrations were chosen in such a way as to minimize the occurrence of multiple cells or barcodes in a single droplet, while keeping those concentrations high enough so that a large enough number of cells were encapsulated with barcodes. The 4-way valves were switched so that the sample loops were in line with the pump, and all three pumps were activated. The two aqueous inputs were flowed at rates so that they mixed at a 1:2 (cell suspension:RT/barcoding/lysis mix) ratio. The aqueous and oil inputs were flowed at rates so that droplets that were ~50 µm in diameter are formed, and at a high enough flow rate so that cells flowed through the device. The emulsion was collected in a Sorenson Bioscience 0.2 mL PCR tube. After the sample had been created, it was first given a pre-heat step (3 minutes at 55° C.) and then incubated for 2 hours at 42° C. to allow the reaction to proceed. Following the reaction, the emulsion was broken using the "breaking non-bead emulsion" process described below. This produced a purified sample of cDNA for subsequent PCR amplification and sequencing.

Non-bead emulsions were broken as follows:
1. 200 µL TE, 400 µL phenol/chloroform/isoamyl alcohol, 800 µL chloroform were pipetted into pre-spun Gel Phase Lock tubes
2. Each sample was pipetted into a corresponding Gel Phase Lock tube
3. Tubes were spun down for 3 minutes at 14,000 g
4. The aqueous layers were pipetted into 100 kDa Amicon tubes (Millipore).
5. Tubes were spun down for 3 minutes at 14,000 g
6. 450 µL of TE was pipetted into the Amicon tubes
7. Tubes were spun down for 3 minutes at 14,000 g
8. 450 µL of 10 mM Tris was added to the Amicon tubes
9. Tubes were spun down for 5 minutes at 14,000 g
10. Amicon tubes were placed inverted into fresh collection tubes
11. Tubes were spun down for 2 minutes at 1,000 g Two rounds of PCR (PCR1 and PCR2) were then performed, using the following primers in addition to some primer sequences listed in Table 9.

TABLE 11

Additional primers for PCR of murine immunoglobulin genes

| Primer name | Sequence (SEQ ID NO:) |
|---|---|
| L_GSP1_murine | ACT CTT CTC CAC AGT GTC CCC TTC ATG (28) and<br>ACT CTT CTC CAC AGT GTG ACC TTC ATG (29) mixed 50:50 |
| G_GSP1_murine | CTG GAC AGG GAT CCA GAG TTC C (30) and<br>CTG GAC AGG GCT CCA TAG TTC C (31) mixed 50:50 |
| K_GSP1_murine | CCA TTT TGT CGT TCA CTG CCA TC (32) |
| M_GSP1_murine | CCA GAG AAG CCA TCC CGT GGT (33) |
| K_GSP2_murine | CTA TGC GCC TTG CCA GCC CGC TCA GCA CTG GAT GGT GGG AAG ATG GA (34) |
| L_GSP2_murine | CTA TGC GCC TTG CCA GCC CGC TCA GGG CCT TGT AGT CT CGA GCT CTT C (35) and |

TABLE 11-continued

Additional primers for PCR of murine immunoglobulin genes

| Primer name | Sequence (SEQ ID NO:) |
|---|---|
| | CTA TGC GCC TTG CCA GCC CGC TCA GGG CTT TGT TTT CCT KGA GCT CCT C (36) mixed 50:50 |
| G_GSP2_murine | CTA TGC GCC TTG CCA GCC CGC TCA GGG GGC CAG TGG ATA GAC HGA TG (37) and CTA TGC GCC TTG CCA GCC CGC TCA GCA GGG ACC AAG GGA TAG ACA GAT G (38) mixed 50:50 |
| M_GSP2 murine | CTA TGC GCC TTG CCA GCC CGC TCA GGR AAG ACA TTT GGG RAG GAC TGA CTC (39) |

The following PCR1 Phusion (Thermo Scientific) reaction mix was set up per RT reaction that used a barcode adapter template:

| | |
|---|---|
| H$_2$O | 10.53 μL |
| 5x GC buffer | 5 μL |
| MgCl$_2$ | 0.15 μL |
| DMSO | 1 μL |
| dNTP | 0.5 μL |
| 10 μM FW1-short | 1 μL |
| 10 μM BC-Long | 1 μL |
| 10 μM mK-GSP1 | 0.5 μL |
| 10 μM mL-GSP1 | 0.5 μL |
| 10 μM mG-GSP1 | 0.56 μL |
| 10 μM mM-GSP1 | 0.56 μL |
| ET-SSB (NEB) | 0.25 μL |
| BSA | 0.25 μL |
| Phusion | 0.2 μL |
| cDNA template | 2 μL |

| Initial: | |
|---|---|
| 95° C. | 5' |
| 18 Cycles: | |
| 98° C. | 30" |
| 62° C. | 30" |
| 72° C. | 45" |
| Final extension: | |
| 72° C. | 5' |
| Hold: | |
| 10° C. | hold |

The reactions from PCR1 were then diluted 50× and used as a template in 3 separate PCR2 reactions, one for kappa and lambda light chains, one for mu heavy chain, and one for gamma heavy chain.

The following PCR2 Phusion (Thermo Scientific) reaction mixes were set up per PCR1 reaction:

| | |
|---|---|
| H$_2$O | to 30 μL |
| 5x GC buffer | 6 μL |
| MgCl$_2$ | 0.18 μL |
| DMSO | 1 μL |
| dNTP | 0.6 μL |
| 10 μM 2FW | 1.2 μL |
| 10 μM mK and mL or mM-GSP2 | 0.6 μL |
| BSA | 0.3 μL |
| Phusion | 0.3 μL |
| Dil. PCR1 template | 2 μL |

| Initial: | |
|---|---|
| 95° C. | 5' |
| 28 cycles: | |
| 98° C. | 30" |
| 65° C. | 30" |
| 72° C. | 45" |
| Final extension: | |
| 72° C. | 5' |
| Hold: | |
| 10° C. | hold |

5 μL of PCR product was run on a gel (FIG. 23). Bands corresponding to kappa and lambda light chain, and to mu heavy chain were clearly seen. Only the mu heavy chain was amplified as the majority of B220+ B cells were expected to be naïve B cells which are IgM+.

The immunoglobulin heavy and light chains thus amplified can be purified and prepared for next generation sequencing, such as, but not limited to, 454 sequencing. As this example used barcode adapter templates at concentrations of >1 copy per reaction container, a unique set of barcodes are incorporated into the nucleic acids in each reaction container rather than a unique barcode. Paired immunoglobulin heavy and light chains can be associated with each other by them sharing a unique set of barcodes, rather than by a unique barcode.

Barcode adapter templates can also be used at a concentration such that by limiting dilution the majority of reaction containers that contain a barcode adapter template will contain it at 1 copy per reaction container. In this case, paired immunoglobulin heavy and light chains can be associated with each other by them sharing a unique barcode sequence.

H. Example 8

Barcoding Nucleic Acids from Cells Using Barcode Adapter Template Beads in Droplets Made Using a Microfluidic Droplet Device This example describes an embodiment of the invention based on predicted results rather than results actually achieved. A microfluidic device to generate droplets as described in Example 7 is used, with the only difference being that the first sample loop contained both cells and barcode adapter template beads as made in Examples 1, 2 or 3.

A murine B220+ B cell population is FACS sorted and a cell and barcode adapter template bead suspension is prepared using 300 mM betaine with 10 mM NaCl and 0.5 mg/ml BSA as a suspension buffer. Cells are included at a concentration of 4,500 cells/µL and beads are used at a concentration of 60,000 beads/µL.

An RT mix is prepared as follows:

| | |
|---|---|
| ddH$_2$O | 7.4 µL |
| 10X Thermopol DF | 36 µL |
| 1M DTT | 3.6 µL |
| 1M MgCl$_2$ | 4.3 µL |
| 50 µM oligo(dT) | 7.2 µL |
| NTP mix (from Life Technologies Megascript SP6 kit) | 57.6 µL |
| dNTP (NEB) | 18 µL |
| 10% Tween-20 | 1.2 µL |
| Ribolock (Thermo Scientific) | 14.4 µL |
| E. coli inorganic pyrophosphatase (NEB) | 28.8 µL |
| T7 RNAP (NEB) | 14.4 µL |
| T4gp32 (NEB) | 8.6 µL |
| Maxima H- RTase (Thermo Scientific) | 43.2 µL |
| Total volume | 244.8 µL |

The cell and barcoded bead suspension is loaded into one sample loop and the RT/barcoding/lysis mix is loaded into the other sample loop using syringes. The 4-way valves are switched so that the sample loops are in line with the pump, and all three pumps are activated. The two aqueous inputs are flowed at rates so that they mix at a 1:2 (cell and bead suspension:RT/barcoding/lysis mix) ratio. The aqueous and oil inputs are flowed at rates so that droplets that are ~50 um in diameter are formed, and at a high enough flow rate so that cells and beads flow through the device. The emulsion is collected in a Sorenson Bioscience 0.2 mL PCR tube. After the sample has been created, it is first given a heat step (3 minutes at 55° C.) and then incubated for 2 hours at 42° C. to allow the RT/barcoding reaction to proceed. Following the barcoding reaction, the emulsion is broken using the "breaking non-bead emulsion" process described in Example 7. Subsequent PCR reactions are performed as in Example 7.

The immunoglobulin heavy and light chains thus amplified are purified and prepared for next generation sequencing, such as, but not limited to, 454 sequencing. As this example uses barcode adapter templates beads at ~1 bead per reaction container, paired immunoglobulin heavy and light chains are paired by their shared use of a unique barcode sequence.

I. Example 9

Barcoding Nucleic Acids from Cells Using Barcode Adapters Amplified from Barcode Adapter Templates Beads with a DNA Polymerase This example describes an embodiment of the invention based on predicted results rather than results actually achieved. A microfluidic device to generate droplets as described in Example 7 is used, with the only difference being that the first sample loop contained both cells and barcode adapter template beads as made in Examples 1, 2 or 3. In this example, the barcode adapter template beads comprise a 5' Nt.BbvCI nicking endonuclease sequence rather than a T7 RNAP promoter sequence to allow for amplification of barcode adapters by a DNA polymerase.

A murine B220+ B cell population was FACS sorted and a cell and barcode adapter template bead suspension was prepared using 300 mM betaine with 10 mM NaCl and 0.5 mg/ml BSA as a suspension buffer. Cells are included at a concentration of 4,500 cells/uL and beads are used at a concentration of 60,000 beads/µL.

An RT mix is prepared as follows:

| | |
|---|---|
| ddH$_2$O | 32.7 µL |
| 10X Thermopol DF | 36 µL |
| 1M DTT | 3.6 µL |
| 1M MgCl$_2$ | 4.3 µL |
| 50 µM oligo(dT) | 7.2 µL |
| dNTP (NEB) | 36 µL |
| 10% Tween-20 | 1.2 µL |
| Ribolock (Thermo Scientific) | 14.4 µL |
| E. coli inorganic pyrophosphatase (NEB) | 28.8 µL |
| Nt.BbvCI (NEB) | 14.4 µL |
| Klenow exo- (NEB) | 14.4 µL |
| T4gp32 (NEB) | 8.6 µL |
| Maxima H- RTase (Thermo Scientific) | 43.2 µL |
| Total volume | 244.8 µL |

The cell and barcoded bead suspension is loaded into one sample loop and the RT/barcoding/lysis mix is loaded into the other sample loop using syringes. The 4-way valves are switched so that the sample loops are in line with the pump, and all three pumps are activated. The two aqueous inputs are flowed at rates so that they mix at a 1:2 (cell and bead suspension:RT/barcoding/lysis mix) ratio. The aqueous and oil inputs are flowed at rates so that droplets that are ~50 um in diameter are formed, and at a high enough flow rate so that cells and beads flow through the device. The emulsion is collected in a Sorenson Bioscience 0.2 mL PCR tube. After the sample has been created, it is first given a heat step (3 minutes at 55° C.) and then incubated for 2 hours at 42° C. to allow the RT/barcoding reaction to proceed. Following the barcoding reaction, the emulsion is broken using the "breaking non-bead emulsion" process described in Example 7. Subsequent PCR reactions are performed as in Example 7.

The immunoglobulin heavy and light chains thus amplified are purified and prepared for next generation sequencing, such as, but not limited to, 454 sequencing. As this example uses barcode adapter templates beads at ~1 bead per reaction container, paired immunoglobulin heavy and light chains are paired by their shared use of a unique barcode sequence.

J. Example 10

Barcoding Nucleic Acids from Cells Using Barcode Adapter Templates in Multi-Well Reaction Containers This example describes an embodiment of the invention based on predicted results rather than results actually achieved. Barcode adapter templates with a composition as in FIG. 1 are synthesized as duplex oligos from a vendor such as IDT. Each unique barcode adapter template is kept in a different storage container such that there is no mixing or cross-contamination of barcode sequences. Activated B cells (plasmablasts) are single cell sorted using a FACS Aria II (Becton Dickenson) into 10 µL of a lysis buffer into all wells of a 96-well plate. The composition of the buffer in each well is:

| | |
|---|---|
| 10 mM Tris pH 8.0 | to 10 µL |
| 10x MMLV buffer | 1 µL |
| 100 mM MgCl$_2$ | 0.3 µL |

| | |
|---|---|
| 1M DTT | 0.015 μL |
| 100x BSA (NEB) | 0.075 μL |
| dNTP | 0.5 μL |
| 10 μM oligo(dT)$_{25}$ (SEQ ID NO: 40) | 0.5 μL |
| 20% IGEPAL-630 (Sigma) | 0.15 μL |
| 1 μM barcode adapter template | 0.25 μL |
| Ribolock (Thermo Scientific) | 0.4 μL |
| Maxima H- RTase (Thermo Scientific) | 0.25 μL |

The plate is then incubated at 55° C. for 3 minutes, then incubated at 42° C. for 2 hours for the RT/barcoding reaction to occur. The reactions in all wells of a 96-well plate were then pooled together and cleanup is performed using a modified traditional phenol/chloroform method:

1. 400 μL of Phenol/chloroform/isoamyl alcohol (Sigma) is added to and shaken vigorously in pre-spun Gel Phase Lock tubes (5Prime)
2. Gel Phase Lock tubes are centrifuged at 14,000 g for 3 minutes and the top aqueous fraction is pipetted into Amicon 100 kDa columns (Millipore) and spun at 14,000 g for 3 minutes
3. Step 2 is repeated as necessary to get the entire aqueous volume spun through the Amicon column
4. 450 μL TE (10 mM Tris, pH 8.0, 1 mM EDTA) is then pipetted into the Amicon column, and spun at 14,000 g for 3 minutes
5. 450 μL of 10 mM Tris (pH8.0) is then pipetted into the Amicon column and spun at 14,000 g for 5 minutes
6. The Amicon column is inverted into a new collection tube and spun at 1000 g for 2 minutes to collect the elute which contained the purified mRNA/1$^{st}$ strand cDNA duplex The following PCR1 Phusion (Thermo Scientific) reaction mix is set up:

| | |
|---|---|
| H2O | 11.28 μL |
| 5x GC buffer | 5 μL |
| MgCl$_2$ | 0.15 μL |
| DMSO | 1 μL |
| dNTP | 0.5 μL |
| 10 μM FW1-short | 1 μL |
| 10 μM FW-Long | 1 μL |
| 10 μM K-GSP1 | 0.56 μL |
| 10 μM L-GSP1 | 1.25 μL |
| 10 μM G-GSP1 | 0.56 μL |
| ET-SSB (NEB) | 0.25 μL |
| BSA | 0.25 μL |
| Phusion | 0.2 μL |
| cDNA template | 2 μL |

| Initial: | |
|---|---|
| 95° C. | 5' |
| 18 Cycles: | |
| 98° C. | 30" |
| 62° C. | 30" |
| 72° C. | 45" |

| Final extension: | |
|---|---|
| 72° C. | 5' |
| Hold: | |
| 10° C. | hold |

The reaction from PCR1 is then diluted 50× and used as a template in 3 separate PCR2 reactions, one for kappa light chain, one for lambda light chain and one for gamma heavy chain.

The following PCR2 Phusion (Thermo Scientific) reaction mixes are set up:

| | |
|---|---|
| H2O | 17.82 μL |
| 5x GC buffer | 6 μL |
| MgCl$_2$ | 0.18 μL |
| DMSO | 1 μL |
| dNTP | 0.6 μL |
| 10 μM 2FW | 1.2 μL |
| 10 μM K or L or G-GSP2 | 0.6 μL |
| BSA | 0.3 μL |
| Phusion | 0.3 μL |
| Dil. PCR1 template | 2 μL |

| Initial: | |
|---|---|
| 95° C. | 5' |
| 23 or 28 cycles: | |
| 98° C. | 30" |
| 65° C. | 30" |
| 72° C. | 45" |
| Final extension: | |
| 72° C. | 5' |
| Hold: | |
| 10° C. | hold |

The immunoglobulin heavy and light chains thus amplified are purified and prepared for next generation sequencing, such as, but not limited to, 454 sequencing. As this example uses a unique barcode adapter templates individually pipetted into each reaction container (in this case wells of a 96-well plate), paired immunoglobulin heavy and light chains are bioinformatically paired by their shared use of a unique barcode sequence.

K. Example 11

Barcoding Nucleic Acids from Cells Using Barcode Adapter Template Beads in Droplets Made Using a Microfluidic Droplet Device The method described below was used to create a barcode adapter template bead library using emulsion PCR, where polymerase chain reaction (PCR) was performed to attach unique barcode adapter templates to each bead (see FIG. 15).

TABLE 12

Oligos used to make barcode adapter template bead library in a single reaction

| Primer name | Sequence (SEQ ID NO:) |
|---|---|
| emB-T7bridgeIsceI | dual-biotin-C18spacer-C18spacer- TAA TAC GAC TCA CTA TAG GAT AGG GAT AAC AGG GTA ATA GGA (7) |
| emB-BCbridgeIsceI2 | mCmCC CCA GTT TAA ACT CCTH HHT HHH HTH HHH THH HTH HHH TCC TAT TAC CCT GTT ATC CC (8) (random combination of HH HTH HHH THH HHT HHH THH HH (3), has $3^{18}$ or 387 × $10^6$ possibilities, giving 387 million unique barcodes) |
| emB-T7bridgefreeIsceI_2 | TAA TAC GAC TCA CTA TAG GAT AGG GAT AAC AGG GTA ATA GGA (9) |
| emB_Iscel_RV | AlexaFluor647-C18spacer-mCmCC CCA GTT TAA ACT CCT (10) |

Streptavidin-coated M-270 Dynabeads® (Life Technologies) were coupled with biotinylated oligonucleotide ("emB_T7bridgeIsceI"):
1. Beads were resuspended by gently swirling
2. 1 ml of M270 beads (approx. 2×$10^9$ beads) were placed into each of three 1.5 mL microfuge tubes, for a total of 3 mL
3. Placed on magnet for 3 minutes.
4. Supernatant was removed from each tube and resuspended in 1 mL (1× vol) Bind/Wash Buffer (BWB; 1M NaCl, 5 mM Tris, 0.5 mM EDTA)
5. Step 4 was repeated twice more followed by final resuspension in 540 µL volume BWB
6. 60 µL of 100 µM emB_T7bridge2 was added to beads and incubated for 15 minutes with gentle rotation
7. Following incubation, beads were washed 3× with 1 mL BWB buffer, and combined into a single tube
8. Beads were stored at 4° C. with 0.01% sodium azide
9. Beads were washed 3× with 10 mM Tris before use Added barcode oligonucleotides and forward and reverse primers to the coupled beads from above in an emulsion-based PCR:
1. The following PCR mix (3 mL total volume) was prepared in three 1.5 mL microcentrifuge tubes (VWR Cat. No. 20170-650):

| | |
|---|---|
| ddH$_2$O | 572.7 µL |
| 10X HiFi PCR buffer | 80 µL |
| 50 mM MgSO$_4$ | 40 µL |
| 10 mM dNTP mix | 16 µL |
| emB_T7bridgeIsceI-labeled Dynabeads (2 × $10^5$ beads/µL) | 40 µL |
| emB_T7bridgefreeIsceI_2 (10 µM) | 3.2 µL |
| emB_BCbridgeIsceI_2 (1 pM) | 13.3 µL |
| emB_IsceI_RV (100 µM) | 24 µL |
| Thermostable inorganic pyrophosphatase (NEB 2,000 units/mL) | 1.2 µL |
| Platinum Taq Hifi (Life Technologies, 5 units/µL) | 9.6 µL |
| Total volume | 800 µL |

2. An oil-surfactant mix was prepared (20 mL total volume):

| | |
|---|---|
| a. Mineral oil (Sigma) | 18.4 mL |
| b. EM90 (Evonik) | 1.6 mL |

3. 800 µL of oil-surfactant mix and 200 µL of PCR mix were combined into each of 12 Axygen 2.0 mL Maxymum Recovery conical-bottom microcentrifuge tubes (MCT-200-L-C). Tubes were sealed and shaken for 3 seconds 4. Tubes were placed into a Qiagen TissueLyzer II, and shaken for 5 minutes at 14 Hz
5. The emulsion was divided among the wells of a VWR 96-well PCR plate (83007-374), with 160 µL of emulsion added per well
6. Tubes were thermocycled using the following program:

| Initial: | |
|---|---|
| 94° C. | 2' |
| 35 Cycles: | |
| 94° C. | 20" |
| 42° C. | 30" |
| 68° C. | 15" |
| 50 Cycles: | |
| 55° C. | 5.5' |
| 72° C. | 30" |
| Final extension: | |
| 68° C. | 5' |
| Hold: | |
| 10° C. | hold |

The emulsion was broken and beads recovered:
1. The contents of the PCR plate was transferred into 1.5 mL microcentrifuge tubes (VWR 20170-650), with no more than 0.5 mL of emulsion volume per tube
2. 100 uL of 1 uM emB_T7bridgefreeIsceI_2 primer was added to each tube
3. Tubes were topped off with isobutanol, sealed and shaken to mix thoroughly
4. Tubes were centrifuged for 1 min at 14,000 rpm
5. Tubes were placed on a magnetic strip to draw the beads to the side of the tubes, then as much of the supernatant as possible was aspirated as possible while leaving the pelleted beads behind
6. 1 mL of isobutanol was added, mixed well by pipetting up and down until the remaining oil/emulsion volume had dispersed into the isobutanol
7. Tubes were placed on a magnetic strip to draw the beads to the side of the tubes, then the isobutanol was aspirated. Beads from all of the tubes were combined into a single tube by first aspirating the supernatant from the tube into which the beads will be combined and then transferring the full volume from another tube, allowing time for the beads to collect at the magnet, then aspirating the supernatant and repeating
8. 1 mL of fresh isobutanol was added, mixed well and let rest for 60 seconds 9. Isobutanol was aspirated
10. 1 mL of 100% ethanol was added, mixed well and let rest for 60 seconds
11. Ethanol was aspirated
12. Steps 10 and 11 were repeated
13. 1 mL of 70% ethanol was added, mixed well and let rest for 60 seconds
14. Ethanol was aspirated
15. Steps 13 and 14 were repeated
16. 1 mL PBS was added, mixed well and let rest for 60 seconds.
17. PBS was aspirated
18. Steps 16 and 17 were repeated.

Beads that incorporated barcode adapter templates were then sorted from non-barcoded beads using a Becton Dickenson FACS Aria III, utilizing the fluorescence from the Alexa Fluor 647 dye incorporated into the emB_IsceI_RV reverse primer.

Beads were stored in 0.01% sodium azide at 4° C. for storage. The microfluidic device shown in FIGS. 17-19 and described in Example 7 was used encapsulate single cells along with barcoded beads and the other reagents necessary for the barcoding assay. A CD19+IgG+ memory B cell population was FACS sorted and cultured for 6 days in complete IMDM medium (IMDM+10% FBS+100 U/mL IL-2, 50 ng/mL IL-21, 50 ng/mL CD40L, 5 µg/mL anti-CD40L mAb and 1× Normocin) before a cell suspension was prepared using 300 mM betaine with 10 mM NaCl and 0.5 mg/ml BSA as a suspension buffer. Cells were used at a concentration of 2,500 cells/µL and barcoded beads at a concentration of 100,000 beads/uL.

An RT/aqueous barcode mix was prepared as follows:

| | |
|---|---|
| 10X Thermopol DF | 24 µL |
| H$_2$O | 10.6 µL |
| 200X BSA | 4 µL |
| 1M DTT | 2.4 µL |
| 1M MgCl$_2$ | 2.9 µL |
| 50 µM oligo(dT) | 4.8 µL |
| NTP mix (from Life Technologies Megascript T7 kit) | 25.4 µL |
| dNTP (NEB) | 11.9 µL |
| 10% Tween-20 | 0.8 µL |
| Ribolock (Thermo Scientific) | 9.5 µL |
| E. coli inorganic pyrophosphatase (NEB) | 19.1 µL |
| T7 RNAP (NEB) | 9.5 µL |
| T4gp32 (NEB) | 5.7 µL |
| Maxima H- RTase (Thermo Scientific) | 28.6 µL |
| Total volume | 159.1 µL |

The cell and bead suspension was loaded into one sample loop and the RT/barcoding/lysis mix was loaded into the other sample loop using syringes. Cell and bead concentrations were chosen in such a way as to minimize the occurrence of multiple cells or barcodes in a single droplet, while keeping those concentrations high enough so that a large enough number of cells were encapsulated with beads, keeping in mind that cells and beads do not migrate through the tubing at the same rate as the suspension fluid, effectively leading to a dilution. The 4-way valves were switched so that the sample loops were in line with the pump, and all three pumps were activated. The two aqueous inputs were flowed at rates so that they mixed at a 1:2 (cell suspension: RT/barcoding/lysis mix) ratio. The aqueous and oil inputs were flowed at rates so that droplets that were ~150 µm in diameter are formed, specifically 1 µL/min (cell/bead suspension line), 2 µL/min (RT mix line), 3 µL/min (oil line). The emulsion was collected in a Sorenson Bioscience 0.2 mL PCR tube. After the sample had been created, it was first given a pre-heat step (3 minutes at 50° C.) and then incubated for 2 hours at 42° C. to allow the reaction to proceed. Following the reaction, the emulsion was broken using the protocol described below. This produced a purified sample of cDNA for subsequent PCR amplification and sequencing.

The following procedure was used to break the emulsion and recover the product:
1. Phase lock tubes (5Prime) were spun down to push the gel to the bottom.
2. Samples and 200 µL TE buffer, 400 µL phenol chloroform mix, 800 µL chloroform were added to each phase lock tube.
3. Tubes were spun down for 3 minutes at 14,000 g
4. The aqueous layer was transferred to a second pre-spun phase lock tube and an equal volume of phenol chloroform was added
5. Tubes were spun down for 3 minutes at 14,000 g
6. 450 µL of TE was added to the Amicon filter
7. Steps 5 and 6 were repeated
8. 450 µL of 10 mM Tris was added to the Amicon filter
9. Step 5 was repeated
10. Each filter unit was then placed inverted into a new collection tube
11. Tubes were spun at 1000 g for 2 minutes, and the cleaned up sample was spun into the collection tube Two rounds of PCR (PCR1 and PCR2) were then performed, using the following primers in addition to some primer sequences listed in Table 13.

TABLE 13

| Primer name | Sequence (SEQ ID NO:) |
|---|---|
| bc_fwlong_ISceI | GAG AGA CTG ACA GCG TAT CGC CTC CCT CGC GCC ATC AGA CGA GTG CGT GGA TAG GGA TAA CAG GGT AAT AGG A (41) |
| FW_1short | GAG AGA CTG ACA GCG TAT CGC CTC (24) |
| L_GSP1 | TYT GTG GGA CTT CCA CTG CTC (17) |
| G_GSP1 | TCT TGT CCA CCT TGG TGT TGC TG (18) |
| K_GSP1 | CGA TTG GAG GGC GTT ATC CAC (19) |
| 2FR | 50:50 mix of: CGT ATC GCC TCC CTC GCG (25) and CTA TGC GCC TTG CCA GCC C (26) |

TABLE 13-continued

| Primer name | Sequence (SEQ ID NO:) |
|---|---|
| K_GSP2s | CTA TGC GCC TTG CCA GCC CGC TCA GTC AGA TGG CGG GAA GAT GAA GAC (20) |
| L_GSP2s | CTA TGC GCC TTG CCA GCC CGC TCA GGA GGA GGG YGG GAA CAG AGT GAC (21) |
| G_GSP2s | CTA TGC GCC TTG CCA GCC CGC TCA GGG GAA GTA GTC CTT GAC CAG GCA G (22) |

The following PCR1 Q5 (NEB) reaction mix was set up per RT reaction that used a barcode adapter template:

| | |
|---|---|
| H₂O | 11 μL |
| 5x Q5 buffer | 5 μL |
| 50 mM MgCl₂ | 0.15 μL |
| DMSO | 1 μL |
| dNTP | 0.5 μL |
| 10 μM FW1-short | 1 μL |
| 2.5 μM BCfw_longIsceI | 1 μL |
| 10 μM K-GSP1 | 0.56 μL |
| 10 μM L-GSP1 | 0.5 μL |
| 10 μM G-GSP1 | 0.56 μL |
| ET-SSB (NEB) | 0.25 μL |
| 100X BSA | 0.25 μL |
| Q5 enzyme | 0.2 μL |
| cDNA template | 2 μL |

| Initial: | |
|---|---|
| 95° C. | 5' |
| 18 Cycles: | |
| 98° C. | 30" |
| 56° C. | 30" |
| 72° C. | 45" |
| Final extension: | |
| 72° C. | 5' |
| Hold: | |
| 10° C. | hold |

The reactions from PCR1 were then diluted 25× in 10 mM Tris-HCl (pH 8.0) and used as a template in two separate PCR2 reactions, one for kappa and lambda light chains and one for gamma heavy chain.

The following PCR2 Q5 (NEB) reaction mixes were set up per PCR1 reaction:

| | |
|---|---|
| H2O | to 20 μL |
| 5x Q5 buffer | 4 μL |
| 50 mM MgCl₂ | 0.12 μL |
| DMSO | 0.67 μL |
| dNTP | 0.4 μL |
| 10 μM 2FW | 0.8 μL |
| 10 μM K- and L- or G-GSP2 | 0.4 μL |
| BSA | 0.2 μL |
| Phusion | 0.2 μL |
| Dil. PCR1 template | 1.33 μL |

| Initial: | |
|---|---|
| 95° C. | 5' |
| 25 cycles: | |
| 98° C. | 30" |
| 65° C. | 30" |
| 72° C. | 45" |
| Final extension: | |
| 72° C. | 5' |
| Hold: | |
| 10° C. | hold |

10 μL of PCR product was run on a gel (FIG. 24). Bands corresponding to kappa and lambda light chain, and to gamma heavy chain were clearly seen.

Two 4-cycle PCR reactions were performed separately on the heavy and the light chain amplicons to add 454 LibA sequencing adapters. In LibPCR1, "A" adapter was added to the 5' end of the amplicons, and "B" adapter added to the 3' end; and vice versa in LibPCR2. The LibPCR details were as follows, with Lib1-FR primer mix used in LibPCR1 and Lib2-FR mix used in LibPCR2, and the primers are listed in Table 14.

| | |
|---|---|
| H2O | to 20 μL |
| 5x Q5 buffer | 6 μL |
| 50 mM MgCl₂ | 0.18 μL |
| DMSO | 1.2 μL |
| dNTP | 0.6 μL |
| 10 μM Lib1-FR or Lib2-FR mix | 1.2 μL |
| BSA | 0.3 μL |
| Q5 | 0.3 μL |
| Template | 2 μL |

| Initial: | |
|---|---|
| 95° C. | 5' |
| 25 cycles: | |
| 98° C. | 30" |
| 65° C. | 30" |
| 72° C. | 45" |
| Final extension: | |
| 72° C. | 5' |
| Hold: | |
| 10° C. | hold |

TABLE 14

| Primer mix name | Sequence (SEQ ID NO:) |
|---|---|
| Lib1-FR | CCA TCT CAT CCC TGC GTG TCT CCG ACT CAG NNNN CGT ATC GCC TCC CTC GCG CCA T (42) and CCT ATC CCC TGT GTG CCT TGG CAG TCT CAG NNNN CTA TGC GCC TTG CCA GCC CGC TCA (43) mixed 1:1 |
| Lib2-FR | CCT ATC CCC TGT GTG CCT TGG CAG TCT CAG NNNN CGT ATC GCC TCC CTC GCG CCA T (44) and CCA TCT CAT CCC TGC GTG TCT CCG ACT CAG NNNN CTA TGC GCC TTG CCA GCC CGC TCA (45) mixed 1:1 |

Amplicons were then purified using both Ampure (Beckman Coulter) beads cleanup according to manufacturer's instructions using a bead:DNA ratio of 0.68:1 and gel purification using Flashgel Recovery gel (Lonza) according to the manufacturer's instructions.

Amplicons were then quantified using Kapa qPCR library quantification (KAPA) according to the manufacturer's instructions, and the appropriate amounts of the heavy and light chain amplicon libraries were then used in 454 emulsion PCR, and the emulsions broken and clonally amplified 454 beads loaded onto the 454 sequencer for sequencing as per manufacturer's instructions. As both A and B adapters are added to both the 5' and 3' ends of the amplicons, we were able to sequence from both directions and obtain both forward and reverse reads.

Sequences were generated from a standard 454 run, and the resulting sequences were analyzed, though other next generation sequencing platforms could have been used as well.

Sequences were analyzed by writing a computer program. The computer program performed the following steps on the sequence reads from the regions of the 454 pico titer plate. Region 1 sequences were derived from the heavy chain library created as described above. Region 2 sequences were derived from the light chain library created as described above. For each read, two global-local alignments were computed to determine the strand having subsequence matching to the sequences T2' and T1 from Table 15. The global-local alignment scored a match as 0, a mismatch as −1 and used a gap open penalty and gap extension penalty of −1. Scores were required to be greater than −4 or the read was discarded. For the heavy chain region, 611×10³ reads of 841×10³ reads satisfied the alignment score constraint. For the light chain region, 617×10³ reads of 856×10³ reads satisfied the alignment score constraint. Based on the global-local alignments, the sequence of the DNA barcode was extracted from the read. For the heavy chain region reads satisfying the alignment score constraint, 397×10³ reads had a barcode sequence consistent with the expected pattern and were assigned to have the observed barcode. For the light chain region reads satisfying the alignment score constraint, 437×10³ reads had a barcode sequence consistent with the expected pattern and were assigned to have the observed barcode.

Reads with identical DNA barcode sequences were grouped together for assembly. The groups of reads with identical barcodes were assembled using newbler, the 454 assembler. The assembly consensus sequences for region 1 sequences which had identical barcode sequences to region 2 sequences were grouped into heavy and light chain pair sets.

The heavy and light chain pair sets contained heavy and light chain sequences derived from the B cell or B cells present in the emulsion RT bubble.

Among the heavy and light chain read pair sets, 2,551 had at least 10 reads from the heavy chain region and at least 10 reads from the light chain region. Of the 2,551 such pairs, 1,820 had assembled to exactly one heavy chain and exactly one light chain. 61 of those pairs were found to have a heavy and light chain which were unique across the entire data set of sequences produced.

An example of paired heavy and light chain sequences produced from barcoded heavy and light chain reads having shared barcode "GCCGACCACGGCACAAGCGC-CGAAAAT" (SEQ ID NO:124) is (SEQ ID NO: 125)
"MEFGLSWLFLVAILKGVQCGVQLLESGGGLVQPGGSLRLSCAGSQFTFS

TYAMNWVRQAPGKGLEWVSGISGDGYRIQYADSVEGRFSISRDNSNNMVY

LQMTSLRAEDTAVYFCAKDLFPRTIGYFDYWGQGTRVTVSS" (heavy chain amino acid sequence)
and (SEQ ID NO: 126)
"MEAPAQLLFLLLLWLPDTTGKIVMTQSPATLSVSPGERATLSCRASQSI

SINLAWYQHKPGQAPRLLIYGASTRATAIPARFSGSVSGTEFTLTISSLQ

SEDFAVYYCQQYDDWPRTFGQGTKVEI" (light chain amino acid sequence).

The analysis demonstrates the ability to associate the heavy chain sequence from a B cell with the corresponding light chain sequence from a B cell.

TABLE 15

Sequences used to identify DNA barcodes in reads from B cells

| Sequence name | Sequence (SEQ ID NO:) |
|---|---|
| T2' | GGGATAACAGGGTAATAGGA (46) |
| T1 | AGGAGTTTAAACTGGGGG (47) |

L. Example 12

Barcoding Nucleic Acids from Cells Using Barcode Adapter Template Beads in Droplets Made Using a Microfluidic Droplet Device This example describes an embodiment of the invention based on predicted results rather than results actually achieved. A barcode adapter template bead library is prepared as in Example 11, except that emB_BCbridgeISceI_2 is replaced with emB_BCbridgeISceI_N and emB_IsceI_RV is replaced with emB_IScel_RV_n. emB_IS-ceI_RV_n contains unique molecular identifiers (UMI), such that when prepared, the barcode adapter template bead library will comprise beads each with a unique sample barcode and a random H (A,C,T nucleotides) octomer UMI to barcode individual mRNA molecules with different UMIs.

TABLE 16

Additional oligos used to make barcode adapter template bead library with sample barcodes and UMIs in a single reaction

| Primer name | Sequence (SEQ ID NO:) |
| --- | --- |
| emB_BCbridgeIScel_N | ACC CAG TTT AAA CCT CCT HHH THH HHT HHH HTH HHT HHH HTC CTA TTA CCC TGT TAT CCC (48) |
| emB_IScel_RV_n | AlexaFluor647-C18spacer-mCmCC CHH HHH HHH ACC AGT TTA AAC CTC CT (49) |

Cells along with beads are encapsulated in droplets for the barcoding reaction as described in Example 11, with the only difference being PBMCs are used rather than activated memory B cells, and the oligo(dT) used is oligodT_n, with the sequence being CAC GAC CGG TGC TCG ATT TAG TTT TTT TTT TTT TTT TTT TTT TTT T (SEQ ID NO:50). The emulsion is then broken as described in Example 11.

One round of PCR is then performed, using the following primers:

TABLE 17

| Primer name | Sequence |
| --- | --- |
| bc_fwlong_IScel | GAG AGA CTG ACA GCG TAT CGC CTC CCT CGC GCC ATC AGA CGA GTG CGT GGA TAG GGA TAA CAG GGT AAT AGG A (41) |
| FW_1short | GAG AGA CTG ACA GCG TAT CGC CTC (24) |
| RV_1 | CAC GAC CGG TGC TCG ATT TAG (51) |

The following PCR Q5 (NEB) reaction mix is used per reaction, and multiple reactions are set up, and each reaction is cycled for a different number of cycles from 15-26 cycles to find the optimal cycle number to use:

| | |
| --- | --- |
| H$_2$O | 9.65 µL |
| 5x Q5 buffer | 5 µL |
| 50 mM MgCl$_2$ | 0.15 µL |
| DMSO | 1 µL |
| dNTP | 0.5 µL |
| 10 µM FW1-short | 1 µL |
| 2.5 µM BCfw_longIscel | 1 µL |
| 10 µM RV_1 | 1 µL |
| ET-SSB (NEB) | 0.25 µL |
| 100X BSA | 0.25 µL |
| Q5 enzyme | 0.2 µL |
| cDNA template | 5 µL |

| Initial: | |
| --- | --- |
| 95° C. | 5' |
| 15-25 Cycles, in 2 cycle increments: | |
| 98° C. | 30" |
| 56° C. | 30" |
| 72° C. | 45" |
| Final extension: | |
| 72° C. | 5' |
| Hold: | |
| 10° C. | hold |

5 µL of PCR product is run on a gel and the cycle number that gives a good amount of product but is not over cycled is used in subsequent downstream steps.

Product is then prepared according to Illumina's paired end sequencing kit and the forward end sequenced on an Illumina high-throughput sequencer, though other sequencing platforms could have been used as well. Sequences are generated and analyzed. Sample barcodes are then used to assign reads to individual cells, and UMIs are then used to perform single-cell RNA sequencing analysis using methods well established in the field (Nat Methods. 2014 February; 11(2):163-6. doi: 10.1038/nmeth.2772. Epub 2013 Dec. 22).

M. Example 13

Barcode Adapter Template Synthesis Using Combinatorial-Generated Barcodes

A barcode adapter template bead library was synthesized in this example.

Barcode-containing oligos (as in FIG. 15) were combinatorially generated from two oligos, BC_part1_sense and BC_part2 type(1, 2, or 3)_antisense. Each BC_part1_sense and BC_part2_type(1, 2, or 3)_antisense oligos contains a unique sequence, "barcode part1" and "barcode part2", respectively. These sequences combined create a unique barcode sequence. "Barcode part1" and "barcode part2" are (16,11) and (12,7) Hamming codes respectively, following the method of *Generalized DNA barcode design based on Hamming codes, Bystrykh* 2012 *PLoS One.* 2012 7: e36852. Therefore, the barcodes thus designed are error-correcting.

BC_part2 oligos are also divided into three types, BC_part2_type1_antisense, BC_part2_type2_antisense and BC_part2 type3_antisense. This allows for amplification to generate barcode adapter templates with 3 different non-mispriming reverse primers (Rv_type1, Rv_type2 and Rv_type3). When each of those reverse primers is covalently coupled to a different fluorophore, generated barcode adapter template beads can be identified via fluorescence in different colors. In addition, barcode adapter template beads that have more than one type of barcode type will fluoresce in more than one color. As barcode adapter template beads in this example are made in emPCR utilizing limiting dilution to put beads with one barcode-containing oligo with the required primers in a droplet. Poisson statistics indicate that a small percentage of droplets will contain more than one barcode-containing oligo, in effect generating a non-monocode barcode adapter template bead. By having different types of barcode adapter template beads fluorescing in different colors, followed by FACS sorting of monocolor beads will greatly increase the percentage of monocode beads obtained via emPCR generation of barcode adapter template beads.

TABLE 18

Combinatorially generated barcodes - sequences

| Name | Sequence (SEQ ID NO:) |
|---|---|
| Barcode adapter template | Dual-biotin-C18spacer-C18spacer-<br>ATATTAATACGACTCACTATAGGAAGATAGGGATAACAGGGTAATG<br>[barcode part1]*GCTGAGACATGTGAAGAGG*[barcode part2][X]<br>*GAGGGA* DDDD DDDD GCGGG<br>Where [X] = GCTCTTCG (52), TCGTCTCG (53) or ACCTCAGC,<br>(54), the italicized portions are called "fixed sequence 1" and "fixed sequence 2", respectively, and the underlined portion is the molecular barcode, also known as the UMI. |
| | Barcode adapter template sequence is generated from: |
| SAV_bead_linker | Dual-biotin-C18spacer-C18spacer-<br>ATATTAATACGACTCACTATAGGAAGATAGGGATAACAGGGTAATG<br>(55) |
| Linker_free | ATATTAATACGACTCACTATAGGAAGATAGGGATAACAGGGTAATG<br>(56) |
| Barcode-containing oligo | ATATTAATACGACTCACTATAGGAAGATAGGGATAACAGGGTAATG<br>[barcode part1]GCTGAGACATGTGAAGAGG[barcode part2][X]<br>GAGGGA<br>Where [X] = GCTCTTCG (57), TCGTCTCG (58) or ACCTCAGC<br>(59) |
| Rv_type1 | 6-FAM-mCmCCGC HHHH HHHH TCCCTC CGAAGAGC (60) |
| Rv_type2 | Cy3-mCmCCGC HHHH HHHH TCCCTC CGAGACGA (61) |
| Rv_type3 | AlexaFluor647-mCmCCGC HHHH HHHH TCCCTC GCTGAGGT (62) |
| | Barcode-containing oligo is generated from: |
| Make_longbc_fw | GATAGGGATAACAGGGTAATG (63) |
| BC_part1_sense | GATAGGGATAACAGGGTAATG[barcode part1]<br>GCTGAGACATGTGAAGAGG (64) |
| BC_part2_type1_antisense | TCCCTC CGAAGAGC[barcode part2]CCTCTTCACATGTCTCAGC<br>(65) |
| Make_longbc_rv1 | TCCCTC CGAAGAGC (66) |
| BC_part2_type2_antisense | TCCCTC CGAGACGA[barcode part2]CCTCTTCACATGTCTCAGC<br>(67) |
| Make_longbc_rv2 | TCCCTC CGAGACGA (68) |
| BCpart2_type3_antisense | TCCCTC GCTGAGGT[barcode part2]CCTCTTCACATGTCTCAGC<br>(69) |
| Make_longbc_rv3 | TCCCTC GCTGAGGT (70) |

[barcode part1] = SEQ ID NOS: 127-45126;
[barcode part2] = SEQ ID NOS: 45127-47561.

Barcode-containing oligo was PCR generated using the conditions in Table 19 and the following thermocycling conditions: 94° C. for 2 min, followed by 53° C. for 2 hours, 7 cycles of 94° C. for 15 s, 53° C. for 30 s and 68° C. for 20 s, which is then followed by 68° C. for 1 min and a 10° C. hold. The reaction was cleaned up using Zymo DNA cleanup and concentration kit and concentrations quantified with Qubit (Life Technologies).

TABLE 19

Mastermix for making barcode-containing oligos

| | |
|---|---|
| H$_2$O | 14.675 μL |
| 10x buffer | 2.5 μL |
| 50 mM MgSO4 | 0.25 μL |
| 10 mM dNTP | 0.5 μL |

TABLE 19-continued

Mastermix for making barcode-containing oligos

| | |
|---|---|
| BC_part1 (50 nM) | 2 μL |
| BC_part2_type1, 2 or 3_antisense (50 nM) | 2 μL |
| Make_longbc_fw (10 μM) | 1.25 μL |
| Make_longbc_rv_1, 2 or 3 (10 μM) | 1.25 μL |
| Taq polymerase DNA (5 U/μL) | 0.2 μL |
| 3x BSA (0.3 ug/ul) | 0.375 μL |

The size of 82 bp for barcode-containing oligos was confirmed on a gel (FIG. 25, upper left).

9.8 μm SuperAvidin microsphere beads (Bang's Lab) were coupled with biotinylated SAV-bead-linker oligo. 15 million beads were incubated with 60 μL of 10 μM oligo for 1 hour, and then washed 3× with BWB buffer (1M NaCl in TE), followed by 3 washes in 10 mM Tris to generate coupled SAV_ beads_ linker beads.

An emPCR to generate barcode adapter template beads proceeded as follows:

TABLE 20

Mastermix for making barcode adapter template beads

| | |
|---|---|
| $H_2O$ | to 50 µL |
| One Taq 5x buffer | 10 µL |
| SAV-bead-linker coupled beads (50 K/µL) | 10 µL |
| 10 mM dNTP | 1 µL |
| Barcode-containing oligo type1 (10 fg/µL) | 0.3 µL |
| Barcode-containing oligo type2 (10 fg/µL) | 0.3 µL |
| Barcode-containing oligo type3 (10 fg/µL) | 0.3 µL |
| Linker_free (10 µM) | 1 µL |
| Rv_type 1 (100 µM) | 0.6 µL |
| Rv_type2 (100 µM) | 0 µL |
| Rv_type3 (100 µM) | 0.6 µL |
| One Taq 5 U/µL | 0.6 µL |
| TIPP 2 U/µL | 0.075 µL |
| 3x BSA (0.3 µg/µL) | 0.75 µL |

The emulsion was creating by shaking emulsion oil with the mastermix in Table 20. The emulsion oil formulation was 10 mL AR20 silicone oil (Sigma), 7.5 mL 7225C Formulation Aid (Dow Corning), 7.5 mL 0749 Resin (Dow Corning) and 0.1% Triton X-100 (Sigma). 12 mL of emulsion oil was shaken with 4 mL of mock mix (without oligos, primers and enzymes of the mastermix in Table 20) at 30 Hz for 5 min in TissueLyser (Qiagen), and then shaken at 12 Hz for 5 min after adding 4 mL of mastermix. This gave the majority of larger droplets between 30-80 um in diameter. The thermocycling conditions were:

| Initial: | |
|---|---|
| 94° C. | 2' |
| 35 cycles: | |
| 94° C. | 30" |
| 53° C. | 60" |
| 68° C. | 90" |
| 50 cycles: | |
| 94° C. | 30" |
| 59° C. | 6' |
| Hold | |
| 10° C. | |

Emulsion were broken by washing with breaking mix 1 followed by breaking mix 2, followed by 70% ethanol washes, and TE washes. Beads were resuspended in TE with 0.001% Tween 20.

| Breaking Mix 1 | µL |
|---|---|
| Isobutanol | 1200 |
| Isopropanol | 800 |
| AR-20 | 500 |
| TE | 187.8 |
| Linker_free (100 µM) | 12.2 |
| Total volume | 2700 |

| Breaking Mix 2 | µL |
|---|---|
| Isobutanol | 9000 |
| Isopropanol | 9000 |
| TE | 1800 |
| 10% Tween 20 in TE | 200 |
| Total volume | 20000 |

Beads were run on a BD FACS Jazz and bright, monocolor beads were sorted (FIG. 25, right). A barcoding reaction performed as in Example 14 was done to verify that the beads were useable as barcode adapters for barcoding RNA, except that the reaction was done in open PCR with multiple beads in a PCR tube and with purified PBMC RNA. As in FIG. 25, lower left, bands were obtained showing that beads were indeed useable as barcode adapter templates for barcoding RNA.

N. Example 14

Barcoding Nucleic Acids from T Cells Using Barcode Adapter Template Beads in Droplets of Varying Volumes Cryopreserved PBMCs were thawed and incubated in AIM V media (Life Technology) overnight at a density of 3 million cells per mL. T cells were then isolated with magnetic-activated cell sorting (MACS) using CD3 microbeads (Miltenyi Biotec) according to manufacturer' instructions. In brief, T cells were centrifuged at 300 g for 10 minutes, and suspended in MACS buffer (2% fetal bovine serum and 2 mM EDTA in 1xPBS) containing 20% CD3 microbeads for 15 minutes at 4° C. Magnetically labeled T cells were then separated using magnetic separation column, followed by co-stimulation with 1x ionomycin, and 1x phorbol 12-myristate 13-acetate (PMA) for 3 hours. After removing the media containing both stimuli, cells were incubated with 1x of DNAse (Sigma) as anti-clumping agent for 15 minutes.

Cells were centrifuged to remove the supernatant containing DNAse, and washed 3 times with cell suspension buffer (CSB) containing 5% of 1M NaCl, 1.5% of 500 mM EDTA, 33.8% of 4M Betaine, and 7.5% of 20 mg/ml bovine serum albumin (BSA). Cells were also filtered with 40 µm cell strainer (BD Falcon) to remove cell clumps after resuspending in 1mL CSB. Cell suspensions were then run on a droplet generator device as in Example 8 to encapsulate cells and barcode adapter template beads into droplets, where the beads were generated as in Example 13. In this example, cells and beads were encapsulated into droplets of different sizes: 1.4, 3.1 and 5.6 nL.

Droplets containing both cells and barcodes underwent reverse transcription by incubating at 50° C. for 3 minutes followed by 42° C. for 3 hours in the following final reaction buffer composition:

| RT reaction mix | |
|---|---|
| Tris-HCl pH 8 | 20 mM |
| NaCl | 3.33 mM |
| KCl | 10 mM |
| $(NH_4)_2SO_4$ | 10 mM |
| $MgSO_4$ | 15 mM |
| EDTA | 0.5 mM |
| Betaine | 90 mM |
| BSA | 0.4 mg/ml |

-continued

| RT reaction mix | |
|---|---|
| DTT | 4 mM |
| Tween 20 | 0.30% |
| dNTPs | 2 mM mM |
| NTPs | 8 mM mM |
| Ribolock | 1.6 U/μL |
| T7 RNAP | 4 U/μL |
| *E. coli* IPP | 0.001 U/μL |
| T4gp32 | 0.25 μg/μL |
| Maxima H- | 3 U/μL |
| Oligo(dT) | 0.1 μM |
| Random hexamer and octomers | 25 nM |
| Random pentadecamer | 6.25 nM |

The emulsion was then broken with a phenol/chloroform mixture and concentrated in an Amicon 100 kDa column (Millipore) as in Example 8. cDNA were subjected to 18 cycles of PCR1, followed by PCR2 using the reaction mix per RT reaction listed below and thermocycling conditions listed in Table 21. Primers used are in Table 22.

| Reaction mix for PCR1 | | Reaction mix for PCR2 | |
|---|---|---|---|
| H$_2$O | 15.64 μL | H$_2$O | 17.82 μL |
| 5X Q5 Buffer | 6.00 μL | 5X Q5 Buffer | 6.00 μL |
| MgCl$_2$ | 0.19 μL | MgCl$_2$ | 0.18 μL |
| DMSO | 1.20 μL | DMSO | 1.00 μL |
| dNTP | 0.63 μL | dNTP | 0.60 μL |
| Index_sID | 0.63 μL | FW2-N-V2 | 0.60 μL |
| PCR1_short_n_v2 | 0.63 μL | RV2-n | 0.60 μL |
| TRAC 53-78/ TRBC 37-60 | 0.63 μL | TRAC GSP2/ TRBC GSP2 | 0.60 μL |
| ET-SSB | 0.31 μL | BSA | 0.30 μL |
| BSA | 0.31 μL | Q5 Enzyme | 0.30 μL |
| Tipp | 0.60 μL | Template | 2.00 μL |
| Q5 Enzyme | 0.25 μL | Total | 30.00 μL |
| Template | 3.00 μL | | |
| Total | 30.00 μL | | |

TABLE 21

Thermocycling condition of PCR1 and PCR2

| PCR1 | | | PCR2 | | |
|---|---|---|---|---|---|
| 95° C. | 5 minutes | | 95° C. | 5 minutes | |
| 98° C. | 30 seconds | 18 cycles | 98° C. | 30 seconds | 24 cycles |
| 62° C. | 30 seconds | | 65° C. | 30 seconds | |
| 72° C. | 45 seconds | | 72° C. | 35 seconds | |
| 72° C. | 5 minutes | | 72° C. | 5 minutes | |
| 10° C. | Hold | | 10° C. | Hold | |

TABLE 22

Primer sequences for PCR 1 and PCR2

| Name | Sequence (SEQ ID NO:) |
|---|---|
| FW2-N-V2 | CTATGCGCCTTGCCAG AATGATACGGCGACC CCGAGATCTACA (71) |
| Index_sID | GGCGACCACCGAGATCTACAC[i5 index primers]TCG TCG GCA GC GGAAGATAGGGATAACAGGGTAATG (72) |
| PCR1_short_n_v2 | GGCGACCACCGAGATCT ACA (73) |
| PCR1-RV-N v2 | ATTAGGAGACACAATAGGGAGGCA (74) |

TABLE 22-continued

Primer sequences for PCR 1 and PCR2

| Name | Sequence (SEQ ID NO:) |
|---|---|
| RV2-n | GTGGGCTCGGAGATGTGTATAAGAGA (75) |
| TRAC 53-78 | GGTGAATAGGCAGACAGACTTGTCAC (76) |
| TRAC GSP2 | GTGGGCTCGGAGATGTGTATAAGAGACAG N TACACGGCAGGGTCAGGGT (77) and GTGGGCTCGGAGATGTGTATAAGAGACAG NN TACACGGCAGGGTCAGGGT (78) and GTGGGCTCGGAGATGTGTATAAGAGACAG NNN TACACGGCAGGGTCAGGGT (79) and GTGGGCTCGGAGATGTGTATAAGAGACAG NNNN TACACGGCAGGGTCAGGGT (80) (2.5 μM each, pooled and mixed to yield 10 μM) |
| TRBC 37-60 | CTCTGCTTCTGATGGCTCAAACAC (81) |
| TRBC GSP2 | GTGGGCTCGGAGATGTGTATAAGAGACAG N ATGGCTCAAACACAGCGACCTC (82) and GTGGGCTCGGAGATGTGTATAAGAGACAG NN ATGGCTCAAACACAGCGACCTC (83) and GTGGGCTCGGAGATGTGTATAAGAGACAG NNN ATGGCTCAAACACAGCGACCTC (84) and GTGGGCTCGGAGATGTGTATAAGAGACAG NNNN ATGGCTCAAACACAGCGACCTC (85) (2.5 μM each, pooled and mixed to yield 10 μM) |

[i5 index primers] = SEQ ID NOS: 47562-47605.

As can be seen from FIG. 26, at the 3 droplet volumes tested, the reaction was successfully completed.

O. Example 15

Amplifying and Sequencing TCR Alpha and Beta Genes from Barcoded Nucleic Acids

Barcoded T cells cDNA were generated as described in Example 14. In brief, PBMCs were co-stimulated with 1× of ionomycin and PMA in AIM V media for 3 hours. CD3, CD4 or CD8-expressing T cells were magnetically labeled and isolated separately using MACS kits (Miltenyi Biotec) and ran through a droplet device to encapsulate cells with barcode adapter template beads, which were generated as in Example 13. Emulsion containing both cells and barcodes were reverse transcribed at 50° C. for 3 minutes and 42° C. for 3 hours. The emulsion was then broken with a phenol/chloroform mixture and concentrated using an Amicon 100 kDa column (Millipore).

Reverse transcription and PCR1 and PCR2 were performed as in Example 14, with different index_sID primers, each with a unique index ID barcode, used for each sample. This allows for pooling and multiplexing of samples in the same next-gen sequencing run, where different samples are distinguished from one another via the index ID barcode.

PCR2 products were then concentrated with AMPure magnetic beads (Roche) according to manufacturer instruction at a ratio of 1 μl PCR 2 products to 1.8 μl magnetic beads. Samples were then prepared for Illumina sequencing using an additional library PCR to add adapters for Illumina sequencing. Primers used are listed in Table 23.

| H$_2$O | 16.22 μL |
|---|---|
| 5X GC Buffer | 6.00 μL |
| MgCl$_2$ | 0.18 μL |
| DMSO | 1.20 μL |

-continued

| | |
|---|---|
| dNTP | 0.60 μL |
| 10 μM Next i5 n | 0.60 μL |
| 10 μM Next i7 FULL n | 0.60 μL |
| BSA | 0.30 μL |
| Phusion DNA Polymerase | 0.30 μL |
| Template | 4.00 μL |
| Total | 30.00 μL |

Thermocycling Condition for Library PCR

| | | |
|---|---|---|
| 95° C. | 5 minutes | |
| 98° C. | 30 seconds | 4 cycles |
| 65° C. | 30 seconds | |
| 72° C. | 35 seconds | |
| 72° C. | 5 minutes | |
| 10° C. | Hold | |

TABLE 23

Primer sequence used in library PCR Amplification

| Name | Sequence (SEQ ID NO:) |
|---|---|
| Next_i5_n | AATGATACGGCGACCACCGAGATCTA (86) |
| Next i7_FULL_n | CAAGCAGAAGACGGCATACGAGAT TCGCCTTA GTCTCGTGGGCTCGGAGATGTGTATAAG (87) |

Amplified product were cleaned with Pippin Prep and DNA Purification and Concentrator kit (Zymo Research) to remove small fragments and analyzed with agarose gel electrophoresis (FIG. 27), and sequenced using Illumina sequencing.

Paired end reads from Illumina sequencing were analyzed to determine T cell receptor (TCR) germline, TCR CDR3, and infer full length sequence. Sequencing generated 21,207,225 filtered, paired end reads. The DNA barcodes were used to assign paired reads to the transcript of a TCR within individual T cells on the basis of the forward read sequence. The identification of the DNA barcodes within the forward reads was done using a python script. For each forward read, the edit distance to fixed sequence 1 was computed using a global/local alignment. An edit distance of 2 or less was required or the read pair was discarded. From the location of fixed sequence 1 and the known lengths of barcode part1 (BC1) and barcode part2 (BC2), candidate BC1 and BC2 sequences were extracted from the forward read. BC1 and BC2 were checked to verify that they satisfied the Hamming condition for a Hamming(16, 11) or Hamming (12, 7) DNA barcode, respectively (see Table 18 for the sequence and relative positions of the named sequences to one another). On the basis of BC1 and BC2 a paired read was assigned to a specific T cell. As a result 3,712,013 read pairs were assigned to T cells.

Paired reads assigned to T cells were then compared to known variants of V, J and constant germline TCR sequences using the program blastn with an e-value cutoff of $10^{-5}$. If either read of the pair was scored as a hit to a germline by blast, the count of that germline and associated allele was incremented by one for the corresponding TCR alpha or beta chain (of the cell identified by BC1, BC2). In addition for each germline allele combination and specific cell a list of sequences that had a hit to it was stored.

For each cell identified by a unique combination of BC1 and BC2, the v, j and/or constant germline allele composition for alpha and beta chains was then assigned based on the majority of the counts indicated above, and for each germline the sequence that had the longest HSP associated with it was selected as a representative portion of the transcript for that germline.

Next the composition of the CDR3 region was determined using the following steps. For each j germline the location of the sequence of 4 amino acids (AA) satisfying the pattern FG*G was determined when possible, and the list of v germlines that had the combination of CA in the last 10 AA of its sequence was identified. For each cell, the 4 AA pattern of the j germline and the CA combination were sought in all three frames of the translated representative sequence for j. The CDR3 was determined to be the sequence of AA between CA and the 4 AA pattern. The putative AA sequence of the TCR was obtained by combining the AA sequence of the v germline up to CA followed by the CDR3 sequence followed by the AA sequence of the j germline beginning with the 4 AA pattern. Using a similar approach the nucleotide sequence of the CDR3 and the putative full length nucleotide sequence of the TCR were determined.

The D germline and D allele were assessed by evaluating the edit distance based on a global-local alignment between the D germlines and the nucleotide sequence of the CDR3. A D germline/allele was assigned to the TCR provided the edit distance to the closest germline sequence was less than or equal to 2.

Table 24 shows summary statistics for the samples that were processed, including estimated number of cells barcoded, cells with a TCR alpha or beta chain assigned, cells with both a TCR alpha and beta assigned, and number of inferred full length alpha or beta chains.

TABLE 24

TCR alpha and beta chains

| Subject | Estimated number of cells | Cells detected (unique BC1/BC2) | Cells with TCR alpha and/ or beta detected | Cells with beta detected | Cells with alpha detected | Cells with both alpha and beta detected |
|---|---|---|---|---|---|---|
| SBJCT3 | 20800 | 6682 | 6226 | 5159 | 1172 | 105 |
| SBJCT4 | 24046 | 3988 | 3722 | 2772 | 998 | 48 |
| SBJCT5 | 22652 | 3664 | 3435 | 2726 | 751 | 42 |

P. Example 16

Amplifying and Sequencing Cell Subtypes-Specific Genes from Barcoded Nucleic Acids Barcoded T cells cDNA were generated as described in Example 15. In brief, PBMCs were co-stimulated with 1× of ionomycin and PMA in AIM V media for 3 hours. CD3, CD4 or CD8-expressing T cells were magnetically labeled and isolated separately using MACS kits (Miltenyi Biotec) and ran through a droplet device. Emulsion containing both cells and barcodes were reverse transcribed at 50° C. for 3 minutes and 42° C. for 3 hours as in Example 14. The emulsion was then broken with a phenol/chloroform mixture and concentrated using an Amicon 100 kDa column (Millipore). PCR1 and PCR2 at different cycles were then performed using the thermocycling conditions in Table 21, along with the specific primers for T cells targeted subset genes, e.g. CD4, CD8, and interferon gamma (IFNγ) as listed in Table 25. Reaction mixes were prepared as follows:

| Reaction mix for PCR1 | | Reaction mix for PCR2 | |
|---|---|---|---|
| H₂O | 10.61 µL | H₂O | 12.42 µL |
| 5X Q5 Buffer | 6.00 µL | 5X Q5 Buffer | 6.00 µL |
| MgCl₂ | 0.19 µL | MgCl₂ | 0.18 µL |
| DMSO | 1.20 µL | DMSO | 1.00 µL |
| dNTP | 0.63 µL | dNTP | 0.60 µL |
| 2.5 µM index sample ID | 0.63 µL | 10 µM FW2-N-V2 | 0.60 µL |
| 10 µM PCR1_short_n_v2 | 0.63 µL | 1 µM Gene specific primer | 6.00 µL |
| 1 µM Gene specific primer | 6.30 µL | BSA | 0.30 µL |
| ET-SSB | 0.31 µL | Q5 Enzyme | 0.30 µL |
| BSA | 0.31 µL | Template | 2.00 µL |
| Tipp | 0.60 µL | Total | 30.00 µL |
| Q5 Enzyme | 0.25 µL | | |
| Template | 3.00 µL | | |
| Total | 30.00 µL | | |

TABLE 25

T cells targeted gene reverse primer sequence for PCR1 and PCR2 in addition to the sequence used in PCR 1 and PCR 2.

| Name | Sequence (SEQ ID NO:) |
|---|---|
| IFNγ (PCR1) | GCTTCCCTGTTTTAGCTGCTGG (88) |
| IFNγ (PCR2) | GTGGGCTCGGAGATGTGTATAAGAGACAG N CGACAGTTCAGCCATCACTTGG (89) and GTGGGCTCGGAGATGTGTATAAGAGACAG NN CGACAGTTCAGCCATCACTTGG (90) and GTGGGCTCGGAGATGTGTATAAGAGACAG NNN CGACAGTTCAGCCATCACTTGG (91) and GTGGGCTCGGAGATGTGTATAAGAGACAG NNNN CGACAGTTCAGCCATCACTTGG (92) (2.5 µM each, pooled and mixed to yield 10 µM) |
| CD4 (PCR1) | GCTGAGACACGGAGAGGGTC (93) |
| CD4 (PCR2) | GTGGGCTCGGAGATGTGTATAAGAGACAG N AGCAGGTGGGTGTCAGAGTT (94) and GTGGGCTCGGAGATGTGTATAAGAGACAG NN AGCAGGTGGGTGTCAGAGTT (95) and GTGGGCTCGGAGATGTGTATAAGAGACAG NNN AGCAGGTGGGTGTCAGAGTT (96) and GTGGGCTCGGAGATGTGTATAAGAGACAG NNNN AGCAGGTGGGTGTCAGAGTT (97) (2.5 µM each, pooled and mixed to yield 10 µM) |
| CD8 (PCR1) | GTGAGGGCGAGAGTAGGCAG (98) |
| CD8 (PCR2) | GTGGGCTCGGAGATGTGTATAAGAGACAG N TCACCGAGGAAGGACCCTCT (99) and GTGGGCTCGGAGATGTGTATAAGAGACAG NN TCACCGAGGAAGGACCCTCT (100) and GTGGGCTCGGAGATGTGTATAAGAGACAG NNN TCACCGAGGAAGGACCCTCT (101) and GTGGGCTCGGAGATGTGTATAAGAGACAG NNNN TCACCGAGGAAGGACCCTCT (102) (2.5 µM each, pooled and mixed to yield 10 µM) |

PCR2 products were then prepared for Illumina sequencing as in Example 15, and the products were analyzed with agarose gel electrophoresis (FIG. 27) before Illumina sequencing.

Paired end reads from Illumina sequencing were analyzed to determine T cell subtype based on the gene specific markers. Sequencing generated 19,205,611 filtered, paired end reads. The DNA barcodes were used to assign paired reads to transcripts within individual T cells on the basis of the forward read sequence. The identification of the DNA barcodes within the forward reads was done using a python script. For each forward read, the edit distance to fixed sequence 1 was computed using a global/local alignment. An edit distance of 2 or less was required or the read pair was discarded. From the location of fixed sequence 1 and the known lengths of barcode part1 (BC1) and barcode part 2 (BC2), candidate BC1 and BC2 sequences were extracted from the forward read. BC1 and BC2 were checked to verify that they satisfied the Hamming condition for a Hamming (16, 11) or Hamming(12, 7) DNA barcode, respectively. For forward reads satisfying the Hamming condition, a candidate molecular barcode was extracted based on the known lengths of X, fixed sequence 2 and the molecular barcode (see Table 18 for the sequence and relative positions of the named sequences to one another). If the molecular barcode sequence had no "C" nucleotides, the paired reads were assigned to a T cell (on the basis of BC1 and BC2) and a specific transcript within the T cell (on the basis of the molecular barcode). 3,902,569 read pairs were assigned to transcripts within individual T cells.

Paired reads assigned to T cell transcripts were then compared to known splice variants of the marker genes using the program blastn with an e-value cutoff of $10^{-6}$ and setting perc_identity to 98. If either read of the pair was scored as a hit by blast, the corresponding transcript from the T cell (identified by BC1, BC2 and the molecular barcode) was associated with the marker gene.

For each cell identified by a unique combination of BC1 and BC2, the number of distinct times a transcript from a given marker gene was seen was determined by counting the number of distinct molecular barcodes observed from read pairs associated with the given marker gene.

The number of each type of T cell detected was determined on the basis of the marker genes. T cells where it was determined that at least one CD4 transcript and one IFNγ transcript were assigned were counted as Th1 cells. T cells where it was determined that at least one CD4 transcript was assigned and no IFNγ transcript was assigned were counted as non-Th1 CD4 samples. T cells where it was determined that at least one CD8 transcript and one IFNγ transcript were identified were counted as IFNγ+ cytotoxic T cells. T cells where it was determined that at least one CD8 transcript and no IFNγ transcript was assigned were counted as IFNγ cytotoxic T cells.

Table 26 shows the total number of CD4 T cells detected, the number of Th1 CD4 T cells, total cytotoxic T cells and IFNγ+ cytotoxic T cells resulting from processing three different samples using the procedure described here.

TABLE 26

Subset summary.

| Subject | CD4 | CD4 Th1 | IFNγ– CD8 | IFNγ+ CD8 |
|---|---|---|---|---|
| SBJCT3 | 19 | 0 | 31 | 0 |
| SBJCT4 | 26 | 1 | 43 | 1 |
| SBJCT5 | 28 | 0 | 26 | 2 |

Q. Example 17

Performing Single Cell Transcriptomics

Barcoded T cells cDNA were generated as described in Example 15. In brief, PBMCs were co-stimulated with 1× of ionomycin and PMA in AIM V media for 3 hours. CD3, CD4 or CD8-expressing T cells were magnetically labeled and isolated separately using MACS kits (Miltenyi Biotec) and ran through a droplet device. Emulsion containing both cells and barcodes were reverse transcribed at 50° C. for 3 minutes and 42° C. for 3 hours as in Example 14. The emulsion was then broken with a phenol/chloroform mixture and concentrated using an Amicon 100 kDa column (Millipore). A single round of PCR was performed to amplify the entire transcriptome, conditions shown below:

| Whole transcriptome PCR conditions | |
|---|---|
| H$_2$O | 28.525 µL |
| 5X Q5 buffer | 12 µL |
| Mg++ | 0.375 µL |
| DMSO | 2.4 µL |
| dNTP | 1.25 µL |
| index sID (2.5 µM) | 5.00 µL |
| PCR1_short_n_v2 (10 µM) | 1.25 µL |
| PCR1-RV-N-v2 (10 µM) | 1.25 µL |
| ET-SSB | 0.625 µL |
| BSA | 0.625 µL |
| Tipp | 1.2 µL |
| Q5 enzyme | 0.5 µL |
| Template | 5 µL |
| total | 60 µL |

| Thermocycling conditions | | |
|---|---|---|
| 95° C. | 5 minutes | |
| 98° C. | 30 seconds | 15 cycles |
| 62° C. | 30 seconds | |
| 72° C. | 10 minutes | |
| 72° C. | 5 minutes | |
| 10° C. | Hold | |

An adapter was added to the library using 5 cycles of PCR, with the same PCR conditions and thermocycling conditions as above, but using FW2-n-V2 as the forward primer instead. Samples were then pooled, cleaned using Ampure beads and prepared for Illumina sequencing using Nextera XT DNA Preparation kit (Illumina), which tagmented DNA into smaller fragments, using manufacturer's instructions, except that 5 ng of DNA template was used, and custom in-house primers were used instead during the amplification step. The house primers used, Next_i5_n_v2 and Next_i7_n ensured that only tagmented fragments containing the barcode would be amplified. A gel was run, and shown in FIG. 29.

TABLE 27

| Additional primers used for whole transcriptomic amplification and library prep | |
|---|---|
| Name | Sequence (SEQ ID NO:) |
| v2_PCR1_RV_n | ATTAGGAGACACAATAGGGAGGCA (103) |
| Next_i5_n_v2 | CTATGCGCCTTGCCAG AATGATAC (104) |
| Next_i7_n | CAAGCAGAAGACGGCATACGAGAT TCGCCTTA GTCTCGTGGGCTCGG (105) |

The barcoded amplicon library was sequenced using an Illumina NextSeq instrument. Paired end reads were analyzed to associate paired reads with individual cells, and to identify the genes that were expressed in those cells. Sequencing generated 371,918,220 filtered, paired end reads. The DNA barcodes were used to assign paired reads to transcripts within individual cells on the basis of the forward read sequence. The identification of the DNA barcodes within the forward reads was done using a python script. For each forward read, the edit distance to fixed sequence 1 was computed using a global/local alignment. An edit distance of 2 or less was required or the read pair was discarded. From the location of fixed sequence 1 and the known lengths of BC1 and BC2, candidate BC1 and BC2 sequences were extracted from the forward read. BC1 and BC2 were checked to verify that they satisfied the Hamming condition for a Hamming(16, 11) or Hamming(12, 7) DNA barcode, respectively. For forward reads satisfying the Hamming condition, a candidate molecular barcode was extracted based on the known lengths of X, fixed sequence 2 and the molecular barcode. If the molecular barcode sequence had no "C" nucleotides, the paired reads were assigned to a cell (on the basis of BC1 and BC2) and a specific transcript within the cell (on the basis of the molecular barcode). 37,110.172 read pairs were assigned to transcripts within individual cells.

Paired reads assigned to cellular transcripts were then compared to known splice variants of genes as reported in release 78 of Ensembl (www.ensembl.org) using the program blastn with an e-value cutoff of $10^{-6}$ and setting perc_identity to 98. If either read of the pair was scored as a hit by blast, the corresponding transcript from the cell (identified by BC1, BC2 and the molecular barcode) was associated with gene If there was more than one blast hit, the best match was selected by finding the gene having the largest sum of lengths of HSPs for forward and reverse reads. In case of a tie between two different genes, assignment of the read pair to a gene was considered ambiguous and not considered further.

For each cell identified by a unique combination of BC1 and BC2, the number of distinct times a transcript from a given gene was seen was determined by counting the number of distinct molecular barcodes observed from read pairs associated with the given gene.

Table 33 show the genes most frequently detected after processing four samples using this procedure. The table shows the Ensembl gene ID, the Ensembl description of the gene and the number of cells the gene was detected in.

R. Example 18

Incorporating Barcode Adapter into 5' End of 1st Strand cDNA

This example describes an embodiment of the invention based on predicted results rather than results actually achieved. Cells and barcode adapter template are put together in reaction containers whereby the majority of reaction containers have only one cell and one template molecule, or one cell and one barcode adapter template bead, for example, by a droplet generator device and the reaction containers are water-in-oil droplets, such as in example 14. The barcode adapter sequence comprises a fixed sequence, a barcode sequence, optionally a UMI, and either oligo(dT) or a random or semi-random sequence (Barcode_adapter_5c_oligodT and Barcode_adapter_5c_randomer respectively in Table 28), or in combination. The template switching oligo (TSO) comprises a fixed sequence, optionally a UMI, and a 1$^{st}$ strand cDNA complementary sequence (5'adapter in Table 28).

The reverse transcription reaction is performed at 50° C. for 3 minutes, followed by 42° C. for 3 hours, in the following reaction conditions:

| RT reaction mix | |
|---|---|
| Tris-HCl pH 8 | 20 mM |
| NaCl | 3.33 mM |
| KCl | 10 mM |
| $(NH_4)_2SO_4$ | 10 mM |
| $MgSO_4$ | 15 mM |
| EDTA | 0.5 mM |
| Betaine | 90 mM |
| BSA | 0.4 mg/ml |
| DTT | 4 mM |
| Tween 20 | 0.30% |
| dNTPs | 2 mM mM |
| NTPs | 8 mM mM |
| Ribolock | 1.6 U/μL |
| T7 RNAP | 4 U/μL |
| E.coli IPP | 0.001 U/μL |
| T4gp32 | 0.25 μg/μL |
| Maxima H- | 3 U/μL |
| Oligo(dT) or random primer | 0.1 μM |

Barcoding occurs during the RT reaction as the barcode adapter primes the reaction and is incorporated into the 5' end of 1$^{st}$ strand cDNA. Barcode adapters are generated off either an RNAP or DNAP (with the appropriate RNA promoter or strand-displacing DNAP recognition site, such as a nick created by a nicking enzyme, on the barcode adapter template) as reverse transcription is able to utilize both DNA and RNA as primers (FIGS. 8 and 9).

The emulsion is broken as in Example 14, and the resulting barcoded nucleic acid library is then pooled and amplified using forward and reverses primers that comprise sequences complementary to the fixed sequences added by 5'adapter and barcode_adapter_5c_oligodT or barcode_adapter_5c_randomer in the barcoding reaction respectively, such as in Example 17. The reaction conditions are shown below:

| | | |
|---|---|---|
| $H_2O$ | 28.525 | μL |
| 5x Q5 buffer | 12 | μL |
| Mg++ | 0.375 | μL |
| DMSO | 2.4 | μL |
| dNTP | 1.25 | μL |
| index sID (2.5 μM) | 5.00 | μL |
| PCR1_short_n_v2 (10 μM) | 1.25 | μL |
| PCR1-RV-N-v2 (10 μM) | 1.25 | μL |
| ET-SSB | 0.625 | μL |
| BSA | 0.625 | μL |
| Tipp | 1.2 | μL |

| -continued | |
|---|---|
| Q5 enzyme | 0.5 μL |
| Template | 5 μL |
| total | 60 μL |

| Thermo cycling conditions | | |
|---|---|---|
| 95° C. | 5 minutes | |
| 98° C. | 30 seconds | 15 cycles |
| 62° C. | 30 seconds | |
| 72° C. | 10 minutes | |
| 72° C. | 5 minutes | |
| 10° C. | Hold | |

Target genes of interest can also be amplified by performing amplification using forward primers comprising gene-specific sequences and using a reverse primer comprising sequences complementary to the fixed sequence added by barcode_adapter_5c_oligodT or barcode_adapter_5c_randomer in the barcoding reaction, such as in Examples 14 and 16. The reaction conditions for amplifying TCR alpha and beta chains in two successive PCR reactions are shown below, where the products of PCR1 were diluted 50× before being used in PCR2:

| Reaction mix for PCR1 | | Reaction mix for PCR2 | |
|---|---|---|---|
| $H_2O$ | 15.64 μL | $H_2O$ | 17.82 μL |
| 5X Q5 Buffer | 6.00 μL | 5X Q5 Buffer | 6.00 μL |
| $MgCl_2$ | 0.19 μL | $MgCl_2$ | 0.18 μL |
| DMSO | 1.20 μL | DMSO | 1.00 μL |
| dNTP | 0.63 μL | dNTP | 0.60 μL |
| PCR1_i5_new | 0.63 μL | FW2-N-V2 | 0.60 μL |
| PCR1_short_n_v2 | 0.63 μL | RV2-n | 0.60 μL |
| TRAC 53-78/TRBC 37-60 | 0.63 μL | TRAC GSP2/TRBC GSP2 | 0.60 μL |
| ET-SSB | 0.31 μL | BSA | 0.30 μL |
| BSA | 0.31 μL | Q5 Enzyme | 0.30 μL |
| Tipp | 0.60 μL | Template | 2.00 μL |
| Q5 Enzyme | 0.25 μL | Total | 30.00 μL |
| Template | 3.00 μL | | |
| Total | 30.00 μL | | |

| Thermocycling condition of PCR1 and PCR2 | | | | | |
|---|---|---|---|---|---|
| PCR1 | | | PCR2 | | |
| 95° C. | 5 minutes | | 95° C. | 5 minutes | |
| 98° C. | 30 seconds | 18 cycles | 98° C. | 30 seconds | 24 cycles |
| 62° C. | 30 seconds | | 65° C. | 30 seconds | |
| 72° C. | 45 seconds | | 72° C. | 35 seconds | |
| 72° C. | 5 minutes | | 72° C. | 5 minutes | |
| 10° C. | Hold | | 10° C. | Hold | |

The library is then prepared for next-gen sequencing, such as on the Illumina or Ion Torrent platform.

TABLE 28

| Primer sequences | |
|---|---|
| Primers | Sequence (SEQ ID NO:) |
| 5' adapter | GGAAGATAGGGATAACAGGGTAATG [UMI] GCGGG (106 ) |
| Barcode_adapter_5c_oligodT | ATTAGGAGACACAATAGGGAGGCA [barcode part1] GCTGAGACATGTGAAGAGG [barcode part2][X] GAGGGA [UMI] TTTTT TTTTT TTTTT TTTTT TTTTT, |

TABLE 28-continued

Primer sequences

| Primers | Sequence (SEQ ID NO:) |
|---|---|
| | Where [X] = GCTCTTCG (107), TCGTCTCG (108) or ACCTCAGC, (109) and the barcode comprises [barcode part1] and [barcode part2] |
| Barcode_adapter_5c_randomer | ATTAGGAGACACAATAGGGAGGCA [barcode part1] GCTGAGACATGTGAAGAGG [barcode part2][X]GAGGGA [UMI] N$_x$, Where x ranges from 6 to 15, [X] = GCTCTTCG (110), TCGTCTCG (111) or ACCTCAGC, (112), and the barcode comprises [barcode part1] and [barcode part2] |

S. Example 19

Incorporating Barcode_Adapter into 5' End During PCR

This example describes an embodiment of the invention based on predicted results rather than results actually achieved. Cells and barcode_adapter template are put together in reaction containers whereby the majority of reaction containers have only one cell and one template molecule, or one cell and one barcode_adapter template bead, for example, by a droplet generator device and the reaction containers are water-in-oil droplets, such as in example 14. The template switching oligo (TSO) comprises a fixed sequence, optionally a UMI, and a $1^{st}$ strand cDNA complementary sequence (5'adapter in Table 29). The 3' adapter sequence comprises a fixed sequence, optionally a UMI, and either oligo(dT) or a random or semi-random sequence (3'_adapter_oligodT and 3'_adapter_randomer respectively in Table 29), or in combination.

The reverse transcription reaction with a cell and a barcode_adapter template bead is performed at 50° C. for 3 minutes, followed by 42° C. for 3 hours, followed by standard PCR cycling conditions, in the following reaction conditions:

| RT reaction mix | |
|---|---|
| Tris-HCl pH 8 | 20 mM |
| NaCl | 3.33 mM |
| KCl | 10 mM |
| (NH$_4$)$_2$SO$_4$ | 10 mM |
| MgSO$_4$ | 7 mM |
| EDTA | 0.5 mM |
| Betaine | 90 mM |
| BSA | 0.4 mg/ml |
| DTT | 4 mM |
| Tween 20 | 0.30% |
| dNTPs | 2 mM |
| Ribolock | 1.6 U/μL |
| Klenow fragment | 0.4 U/μL |
| Nt.BbvCI | 0.3 U/μL |
| E. coli IPP | 0.001 U/μL |
| T4gp32 | 0.25 μg/μL |
| Maxima H- | 3 U/μL |
| 5' adapter | 1 μM |
| 3'_adapter_PCR_oligodT and/or 3'_adapter_PCR_randomer | 0.1 μM (each) |
| 3'_PCR_primer | 0.5 μM |

5'_PCR_barcode_adapter_primer is generated off a barcode_adapter_template using either a DNAP (with the appropriate strand-displacing DNAP recognition site, such as a nick created by a nicking enzyme, on the barcode_adapter_template). Here, Klenow fragment is used as the DNAP and Nt.BbvCI is used as the nicking endonuclease, and the recognition site is "CCTCAGC". After reverse transcription, primers with their 3'end complementary to the adapter sequences added to the $1^{st}$ strand cDNA are used for amplification, with the forward primer being 5'_PCR_barcode_adapter_primer, which is generated from barcode adapter templates, and reverse primer being 3'_PCR_primer.

Barcoding occurs during the PCR reaction as the barcode_adapter (5'_PCR_barcode_adapter_primer) is the forward primer, and the barcode adapter is incorporated into the 5' end of $1^{st}$ strand cDNA (FIG. 11).

Target genes of interest can also be amplified by performing amplification using 5'_PCR_barcode_adapter_primer as the forward primer, and reverse primers comprising gene-specific sequences.

The library is then pooled and prepared for next-gen sequencing, such as on the Illumina or Ion Torrent platform.

TABLE 29

Primer sequences

| Primers | Sequence (SEQ ID NO:) |
|---|---|
| 5'adapter | GGAAGATAGGGATAACAGGGTAATG [UMI] GCGGG (106) |
| 3'_adapter_PCR_oligodT | ATTAGGAGACACAATAGGGAGGCA [UMI] TTTTT TTTTT TTTTT TTTTT TTTTT (113) |
| 3'_adapter_PCR_randomer | ATTAGGAGACACAATAGGGAGGCA [UMI] N$_x$ (114), where x ranges from 6-15 |
| 5'_PCR_barcode_adapter_primer | GGCGACCACCGAGATCTACAC [barcode part1] GCTGAGACATGTGAAGAGG [barcode part2] |

TABLE 29-continued

Primer sequences

| Primers | Sequence (SEQ ID NO:) |
|---|---|
| | GGAAGATAGGGATAACAGGGTAATG (115), the barcode comprises [barcode part1] and [barcode part2] |
| 3'_PCR_primer | ATTAGGAGACACAATAGGGAGGCA (116) |

T. Example 20

Incorporating Barcode_Adapter into 3' End During PCR

This example describes an embodiment of the invention based on predicted results rather than results actually achieved. This example is similar to Example 19, except that the barcode adapter generated from barcode adapter templates is used as the reverse primer in PCR. Reverse transcription is performed as in Example 19, and in PCR 5'_PCR_primer is the forward primer, and 3'_PCR_barcode_adapter_primer is generated from barcode_adapter_template and used as the reverse primer (FIG. 12). The reverse transcription reaction with a cell and a barcode adapter template bead is performed at 50° C. for 3 minutes, followed by 42° C. for 3 hours, followed by standard PCR cycling conditions, in the following reaction conditions:

| RT reaction mix | |
|---|---|
| Tris-HCl pH 8 | 20 mM |
| NaCl | 3.33 mM |
| KCl | 10 mM |
| $(NH_4)_2SO_4$ | 10 mM |
| $MgSO_4$ | 7 mM |
| EDTA | 0.5 mM |
| Betaine | 90 mM |
| BSA | 0.4 mg/ml |
| DTT | 4 mM |
| Tween 20 | 0.30% |
| dNTPs | 2 mM |
| Ribolock | 1.6 U/μL |
| Klenow fragment | 0.4 U/μL |
| Nt.BbvCI | 0.3 U/μL |
| *E. coli* IPP | 0.001 U/μL |
| T4gp32 | 0.25 μg/μL |
| Maxima H- | 3 U/μL |
| 5' adapter | 1 μM |
| 3'_adapter_PCR_oligodT and/or 3'_adapter_PCR_randomer | 0.1 μM (each) |
| 5'_PCR_primer | 0.5 μM |

Target genes of interest can also be amplified by performing amplification using and reverse forward primers comprising gene-specific sequences, and 3'_PCR_barcode_adapter_primer as the reverse primer.

The library is then pooled and prepared for next-gen sequencing, such as on the Illumina or Ion Torrent platform.

TABLE 30

Primer sequences

| Primers | Sequence (SEQ ID NO:) |
|---|---|
| 5'_PCR_primer | GGAAGATAGGGATAACAGGGTAATG (117) |
| 3'_PCR_barcode_adapter_primer | GTGGGCTCGGAGATGTGTATAAGAGA [barcode part1] GCTGAGACATGTGAAGAGG [barcode part2] ATTAGGAGACACAATAGGGAGGCA (118), the barcode comprises [barcode part1] and [barcode part2] |

U. Example 21

Barcoding RNA from Non-Cell Sources

In embodiments of the current invention, all RNA in the reaction container are barcoded, provided that the primer used in the reaction can bind to and initiate reverse transcription for a particular RNA. Therefore, exogenously introduced RNA can also be barcoded. In this example, RNA generated using in vitro transcription was barcoded.

SpikeIn sequence was ordered from IDT and PCR amplified with Phusion DNA polymerase using SPIKEIN-FW and SPIKEIN-RV as primers to obtain double stranded material with a 5' T7 RNAP promoter sequence and a 3' poly A tail. The product was then cleaned up with Qiagen MinElute kit and the DNA product was used for in vitro transcription with Life Technologies' T7 MEGAScript kit. The RNA thus obtained was then cleaned up by washing and concentrating with 10 mM Tris using Amicon 30 kDA columns (Millipore).

In each well of eight 96-well plates, a single memory B cell along with 0.5 ng yeast tRNA (Life Technologies) and 0.1 pg of Spike-In RNA were reverse transcribed. In a 10 μL reaction per well, the reaction was:

| | |
|---|---|
| 10x MMLV buffer (NEB) | 1 μL |
| 10 mM Tris pH 8.0 | To 10 μL |
| 1 μM biotinylated oligo(dT)$_{25}$ (SEQ ID NO: 40) | 0.003 μL |
| 100 mM $MgCl_2$ | 0.3 μL |
| Ribolock | 0.025 μL |
| T4gp32 (NEB) | 0.006 μL |
| MaxH- (Fisher Scientific) | 0.04 μL |
| wellID-adapter | 1 μL |

The reaction was incubated at 55° C. for 3 minutes, and then at 42° C. for 2 hours. Each well in a 96-well plate had a different well barcode in the wellID-adapter. The reaction was then cleaned up by binding $1^{st}$ strand cDNA with streptavidin paramagnetic C1 Dynabeads (Life Technologies) that binds to the biotinylated oligodT, and then using a magnet to pull down the $1^{st}$ strand cDNA, and washing them 3× with BWB buffer (2M NaCl in TE) and then 3× with 10 mM Tris, and resuspended in 15 μL of 10 mM Tris.

Two rounds of PCR amplification was done to amplify up heavy and light chain immunoglobulin genes. A different plate barcode sequence was added to all pooled barcoded cDNA in a different plate.

Per Well for PCR1:

| | |
|---|---|
| H₂O | 27.575 μL |
| 5x Q5 Buffer | 12.5 μL |
| MgCl2 | 0.375 μL |
| DMSO | 2.5 μL |
| dNTP | 1.25 μL |
| FW1-short | 2.5 μL |
| K-GSP1 | 1.4 μL |
| L-GSP1 | 1.25 μL |
| G-GSP1 | 1.4 μL |
| ET-SSB (NEB) | 0.625 μL |
| BSA | 0.625 μL |
| Q5 Enzyme | 0.5 μL |
| Plate-ID | 5 μL |
| Template | 5 μL |

Product from PCR1 was diluted 50× and used in PCR2. Reaction per well for PCR2:

| | |
|---|---|
| H₂O | 18.42 μL |
| 5x Q5 buffer | 6 μL |
| MgCl₂ | 0.18 μL |
| DMSO | 1 μL |
| dNTP | 0.6 μL |
| 2FR | 0.6 μL |
| G-GSP2 or K-GSP2 and L-GSP2 | 0.6 μL |
| BSA | 0.3 μL |
| Q5 | 0.3 μL |
| Template | 2 μL |

The amounts of resulting amplified material was normalized and prepared as in Example 11 for 454 sequencing. Primers used in this example may be found in Tables 13, 14 and 32.

454 reads obtained were binned based on plate- and well-ID barcodes. Therefore, reads can be binned back to the original well in a specific plate. Reads were assembled with Newbler after clipping off the barcode sequences. For each contig, we performed a Smith-Waterman alignment of the contig with the Spike-In sequence using a scoring matrix of 2 for a match, −1 for a mismatch, −1 for a gap open and −1 for a gap extension. Any contig with a score >800 was considered a match. We counted the number of wells on each plate for which a match was observed. The Spike-In sequence was detected in the large majority of the wells (Table 31).

TABLE 31

Wells in which Spike-In sequence was detected

| RT Plate physical barcode | Plate-ID barcode | Wells in which sequence was present | Percent (%) |
|---|---|---|---|
| F041172 | p029 | 87 | 90.6 |
| F041173 | p061 | 76 | 79.2 |
| F041174 | p066 | 90 | 93.8 |
| F041189 | p069 | 93 | 96.9 |
| F041056 | p103 | 92 | 95.8 |
| F041170 | p149 | 87 | 90.6 |
| F041175 | p158 | 94 | 97.9 |
| F041171 | p193 | 82 | 85.4 |

TABLE 32

Sequences used

| Primers/ Oligos | Sequence (SEQ ID NO:) |
|---|---|
| Spike-In | ATCGTCTAAT ACGACTCACT ATAGGGTCCC TGAGCTGAAC GGGAAGGAAG GCTGGGGCTC ATTTGAGGTG CAGCTGTTGG AGATGACCCA GTCTCCAGCC TCCCTGCGTC ATGGGTGTGA ACCATTAGCT GTGCTCGCGC TACTCTCTCT TTCTGGCCTG GAGGCTATCC AGCACAGCGA CACCCACTCC TCCGTACTCC AAAGATTCAG GTTTACTCAC GTCATCCAGC AGAGAATGGA AAGTCAAATT TCCTGAATTG CTATGTGTCT GGGTTTCATC CATCCGACAT TGAAGTTGAC TTACTGAAGA ATGGAGAGAG AATTGAAAAA GTGGAGCATT CAGACTTGTC TTTCAGCAAG GACTGGTCTT TCTATCTCTT GTACTACACT GAATTCACCC CCACTGAAAA AGATGAGTAT GCCTGCCGTG TGAACCATGT GACTTTGTCA CAGCCCAAGA TAGTTAAGTG GGCACAAAGA GCTTCAACAG GGGAGAATCG AGACATGTAA GCAGCATCAT GGAGCTGGGC TGCCTGGTCA AGGAC (119) |
| SPIKEIN-FW | ATCGTCTAATACGACTCACTATAGGGTCC (120) |
| SPIKEIN-RV | TTTTT TTTTT TTTTT TTTTT TTTTT TTTTT TTTTT GTC CTT GAC CAG GCA GCC CAG (121) |
| wellID-adapter | CACGACCGGUGCTCGATTTAG[well-barcode]AGGAGGG (122) |
| Plate-ID | GAGAGACTGACAGCGTATCGCCTCCCTCGCGCCATCAG [plate-barcode] CACGACCGGTGCTCGATTTAG (123) |

[well-barcode] = SEQ ID NOS: 47606-47711;
[plate-barcode] = SEQ ID NOS: 47712-47719.

V. Example 22

Barcoding RNA from Non-Cell Sources to Identify Cell Populations

This example describes an embodiment of the invention based on predicted results rather than results actually achieved. As shown in Example 21, exogenously introduced RNA can be barcoded. In this example, barcoded RNA is used to identify specific cell populations. Spike-In DNA is generated as in Example 21, except that SPIKEIN-FW has a 5' NH2 modification. It is conjugated to an anti-CD4 antibody using All-in-One Antibody-Oligonucleotide Conjugation Kit (Solulink). RNA generated from Spike-In DNA using in vitro transcription may also be conjugated instead to anti-CD4 antibody.

T cells are prepared and sequenced as in Example 15, with an additional step being the T cells are incubated with the Spike-In conjugated anti-CD4 antibody before running the T cells on a droplet generator and subsequently barcoding the RNA. Reads obtained are binned based on index-ID and barcodes added by barcode adapters. Therefore, reads can be binned back to the original reaction container. Smith-Waterman alignment of the contig with the Spike-In sequence using a scoring matrix of 2 for a match, −1 for a mismatch, −1 for a gap open and −1 for a gap extension is done. Any contig with a score >800 is considered a match. We then count the reaction containers in which a match was observed. For reaction containers in which the Spike-In sequence is detected, the T cell is then identified as a CD4 T cell (FIG. 14A). Multiple antibodies coupled with differ-

W. Example 23

Barcoding RNA from Non-Cell Sources to Identify Antigen-Specific B Cells

This example describes an embodiment of the invention based on predicted results rather than results actually achieved. In this example, exogenously introduced RNA is barcoded and used to identify antigen-specific B cells. Spike-In DNA is generated as in Example 21, except that SPIKEIN-FW has a 5' NH2 modification. It is conjugated to an influenza hemagglutinin antigen using All-in-One Antibody-Oligonucleotide Conjugation Kit (Solulink). RNA generated from Spike-In DNA using in vitro transcription may also be conjugated instead to hemagglutinin.

B cells from influenza-vaccine immunized mice are prepared as in Example 8 and sequenced, with an additional step being the B cells are incubated with the Spike-In conjugated antigen before barcoding them. Reads obtained are binned based on index-ID and barcodes added by barcode adapters. Therefore, reads can be binned back to the original reaction container. Smith-Waterman alignment of the contig with the Spike-In sequence using a scoring matrix of 2 for a match, −1 for a mismatch, −1 for a gap open and −1 for a gap extension is done. Any contig with a score >800 is considered a match. We then count the reaction containers in which a match was observed. For reaction containers in which the Spike-In sequence is detected, the B cell is then identified as being hemagglutinin-specific (FIG. 14B). Multiple antigens coupled with different Spike-In sequences can be used, with the end result being different B cells specific for different antigens can be identified in the same experimental run.

X. Example 24

Barcoding RNA from Non-Cell Sources to Identify Antigen-Specific T Cells

This example describes an embodiment of the invention based on predicted results rather than results actually achieved. In this example, exogenously introduced RNA is barcoded and used to identify antigen-specific B cells. Spike-In DNA is generated as in Example 21, except that SPIKEIN-FW has a 5' NH2 modification. It is conjugated to a particular peptide-MHC antigen using All-in-One Antibody-Oligonucleotide Conjugation Kit (Solulink). RNA generated from Spike-In DNA using in vitro transcription may also be conjugated instead to peptide-MHC complex.

T cells are prepared and sequenced as in Example 15, with an additional step being the T cells are incubated with the Spike-In conjugated anti-CD4 antibody before running the T cells on a droplet generator and subsequently barcoding the RNA. Reads obtained are binned based on index-ID and barcodes added by barcode adapters. Therefore, reads can be binned back to the original reaction container. Smith-Waterman alignment of the contig with the Spike-In sequence using a scoring matrix of 2 for a match, −1 for a mismatch, −1 for a gap open and −1 for a gap extension is done. Any contig with a score >800 is considered a match. We then count the reaction containers in which a match was observed. For reaction containers in which the Spike-In sequence is detected, the T cell is then identified as antigen-specific (FIG. 14C). Multiple different peptide-MHCs coupled with different Spike-In sequences can be used, with the end result being different T cells recognizing different peptide-MHCs can be identified in the same experimental run.

TABLE 33

| Most frequently observed genes. | | |
|---|---|---|
| geneID | Description | cells |
| ENSG00000062716 | vacuole membrane protein 1 | 101 |
| ENSG00000137265 | interferon regulatory factor 4 | 59 |
| ENSG00000075624 | actin, beta | 47 |
| ENSG00000092820 | ezrin | 32 |
| ENSG00000026508 | CD44 molecule (Indian blood group) | 30 |
| ENSG00000111537 | interferon, gamma | 30 |
| ENSG00000177954 | ribosomal protein S27 | 30 |
| ENSG00000070756 | poly(A) binding protein, cytoplasmic 1 | 25 |
| ENSG00000132510 | lysine (K)-specific demethylase 6B | 25 |
| ENSG00000164924 | tyrosine 3-monooxygenase/tryptophan 5-monooxygenase activation protein, zeta | 25 |

It is understood that the examples and embodiments described herein are for illustrative purposes only and that various modifications or changes in light thereof will be suggested to persons skilled in the art and are to be included within the spirit and purview of this application and scope of the appended claims. All publications, sequence accession numbers, patents, and patent applications cited herein are hereby incorporated by reference in their entirety for all purposes.

---

SEQUENCE LISTING (47719 sequences)

SEQ ID NO: 1 - DNA, 36 bp, Artificial Sequence
  synthetic oligo primer emB-T7bridge2 used to make barcode adapter template bead library
  modified_base (1)...(1): t modifierd by dual-biotin-C18spacer-C18 spacer
taatacgactcactataggataaagcggccgcaaat

SEQ ID NO: 2 - DNA, 55 bp, Artificial Sequence
  synthetic oligo primer emB-BCbridge2 used to make barcode adapter template bead library
  modified_base (1)...(2): cm
ccccctgtttaaaccthhhthhhhthhhhthhhthhhhatttgcggccgctttat

SEQ ID NO: 3 - DNA, 22 bp, Artificial Sequence
  synthetic oligo primer emB-BCbridge2 random combination used to make barcode adapter template bead library
hhhthhhhthhhhthhhthhhh

SEQ ID NO: 4 - DNA, 36 bp, Artificial Sequence; identical to SEQ ID NO: 1
  synthetic oligo primer emB-T7bridgefree used to make barcode adapter template bead library

SEQ ID NO: 5 - DNA, 16 bp, Artificial Sequence
  synthetic oligo primer emB-Rv3 used to make barcode adapter template bead library
  modified_base (1)...(1): cm modified byAlexaFluor647-C18 spacer
  modified_base (2)...(2): cm
ccccctgtttaaacct

SEQ ID NO: 6 - DNA, 19 bp, Artificial Sequence
  synthetic T7 RNA polymerase (RNAP) promoter sequence
taatacgactcactatagg

SEQ ID NO: 7 - DNA, 42 bp, Artificial Sequence
  synthetic oligo primer emB-T7bridgeIsceI used to make barcode adapter template bead library
  modified_base (1)...(1): t modified by dual-biotin-C18spacer-C18spacer
taatacgactcactataggatagggataacagggtaatagga

SEQ ID NO: 8 - DNA, 60 bp, Artificial Sequence
  synthetic oligo primer emB-BCbridgeISceI_2 used to make barcode adapter template bead library
  modified_base (1)...(2): cm
cccccagtttaaactccthhhthhhhthhhhthhhthhhhtcctattaccctgttatccc

SEQ ID NO: 9 - DNA, 42 bp, Artificial Sequence; identical to SEQ ID NO: 7
  synthetic oligo primer emB-T7bridgefreeIsceI_2 used to make barcode adapter template bead library

SEQ ID NO: 10 - DNA, 18 bp, Artificial Sequence
  synthetic oligo primer emB_IsceI_RV used to make barcode adapter template bead library
  modified_base (1)...(1): cm modified by AlexaFluor647-C18spacer
  modified_base (2)...(2): cm
cccccagtttaaactcct

SEQ ID NO: 11 - DNA, 54 bp, Artificial Sequence
  synthetic oligo primer S1-oligo used to make barcode adapter template bead library
  modified_base (1)...(1): a modified by desthiobiotin-C18spacer
atattaatacgactcactataggcatagggataacagggtaatgagatggatag

SEQ ID NO: 12 - DNA, 60 bp, Artificial Sequence
  synthetic oligo primer W-oligo-a used to make barcode adapter template bead library
  modified_base (30)...(36): n = i
cctcctcctcctcccagtgagctgcgtctnnnnnnntcattaccctgttatccctatgcc

SEQ ID NO: 13 - DNA, 56 bp, Artificial Sequence
  synthetic oligo primer W-oligo-b used to make barcode adapter template bead library
  modified_base (26)...(32): n = i
ctcctcctcccagtgagctgcgtctnnnnnnntcattaccctgttatccctatgcc

SEQ ID NO: 14 - DNA, 28 bp, Artificial Sequence
  synthetic oligo primer S2-oligo-a used to make barcode adapter template bead library
  modified_base (1)...(2): cm
cccctcctaacctcctcctcctcctccc

SEQ ID NO: 15 - DNA, 23 bp, Artificial Sequence
  synthetic oligo primer S2-oligo-b used to make barcode adapter template bead library
  modified_base (1)...(2): cm
cccctcctaaccctcctcctccc

SEQ ID NO: 16 - DNA, 22 bp, Artificial Sequence
  synthetic oligo(dT)-20VN
  modified_base (22)...(22): n = g, a, c or t
ttttttttttttttttttttvn

SEQ ID NO: 17 - DNA, 21 bp, Artificial Sequence
  synthetic PCR1 and PCR2 primer L_GSP1, oligo primer DNA barcode adapter w24
tytgtgggacttccactgctc

SEQ ID NO: 18 - DNA, 23 bp, Artificial Sequence
  synthetic PCR1 and PCR2 primer G_GSP1
tcttgtccaccttggtgttgctg

SEQ ID NO: 19 - DNA, 21 bp, Artificial Sequence
  synthetic PCR1 and PCR2 primer K_GSP1
cgattggagggcgttatccac

SEQ ID NO: 20 - DNA, 48 bp, Artificial Sequence
  synthetic PCR1 and PCR2 primer K_GS2, K_GSP2s
ctatgcgccttgccagcccgctcagtcagatggcgggaagatgaagac

SEQ ID NO: 21 - DNA, 48 bp, Artificial Sequence
  synthetic PCR1 and PCR2 primer L_GSP2, L_GSP2s
ctatgcgccttgccagcccgctcaggaggagggygggaacagagtgac

SEQ ID NO: 22 - DNA, 49 bp, Artificial Sequence
  synthetic PCR1 and PCR2 primer G_GSP2, G_GSP2s
ctatgcgccttgccagcccgctcaggggaagtagtccttgaccaggcag

SEQ ID NO: 23 - DNA, 67 bp, Artificial Sequence
  synthetic PCR1 and PCR2 primer BC_Long
gagagactgacagcgtatcgcctccctcgcgccatcagacgagtgcgtggataaagcggccgcaaat

SEQ ID NO: 24 - DNA, 24 bp, Artificial Sequence
  synthetic PCR1 and PCR2 primer FW_Ishort, FW_1short
gagagactgacagcgtatcgcctc

SEQ ID NO: 25 - DNA, 18 bp, Artificial Sequence
  synthetic PCR1 and PCR2 primer 2FR mixed 1:1 with SEQ ID NO:26
cgtatcgcctccctcgcg

SEQ ID NO: 26 - DNA, 19 bp, Artificial Sequence
  synthetic PCR1 and PCR2 primer 2FR mixed 1:1 with SEQ ID NO:25
ctatgcgccttgccagccc

SEQ ID NO: 27 - DNA, 69 bp, Artificial Sequence
  synthetic oligo primer FW1_Long
gagagactgacagcgtatcgcctccctcgcgccatcagacgagtgcgtcacgaccggtgctcgatttag

SEQ ID NO: 28 - DNA, 27 bp, Artificial Sequence
  synthetic primer L_GSP1_murine for PCR of murine immunoglobulin genes mixed 50:50 with SEQ ID NO:29
actcttctccacagtgtccccttcatg

SEQ ID NO: 29 - DNA, 27 bp, Artificial Sequence
  synthetic primer L_GSP1_murine for PCR of murine immunoglobulin genes mixed 50:50 with SEQ ID NO:28
actcttctccacagtgtgaccttcatg

SEQ ID NO: 30 - DNA, 22 bp, Artificial Sequence
  synthetic primer G_GSP1_murine for PCR of murine immunoglobulin genes mixed 50:50 with SEQ ID NO:31
ctggacagggatccagagttcc

SEQ ID NO: 31 - DNA, 22 bp, Artificial Sequence
  synthetic primer G_GSP1_murine for PCR of murine immunoglobulin genes mixed 50:50 with SEQ ID NO:30
ctggacagggctccatagttcc

SEQ ID NO: 32 - DNA, 23 bp, Artificial Sequence
  synthetic primer K_GSP1_murine for PCR of murine immunoglobulin genes
ccattttgtcgttcactgccatc

SEQ ID NO: 33 - DNA, 21 bp, Artificial Sequence
  synthetic primer M_GSP1_murine for PCR of murine immunoglobulin genes
ccagagaagccatcccgtggt

SEQ ID NO: 34 - DNA, 47 bp, Artificial Sequence
  synthetic primer K_GSP2_murine for PCR of murine immunoglobulin genes
ctatgcgccttgccagcccgctcagcactggatggtgggaagatgga

SEQ ID NO: 35 - DNA, 49 bp, Artificial Sequence
  synthetic primer L_GSP2_murine for PCR of murine immunoglobulin genes mixed 50:50 with SEQ ID NO:36
ctatgcgccttgccagcccgctcagggccttgttagtctcgagctcttc

SEQ ID NO: 36 - DNA, 49 bp, Artificial Sequence
  synthetic primer L_GSP2_murine for PCR of murine immunoglobulin genes mixed 50:50 with SEQ ID NO:35
ctatgcgccttgccagcccgctcagggctttgttttcctkgagctcctc

SEQ ID NO: 37 - DNA, 47 bp, Artificial Sequence
  synthetic primer G_GSP2_murine for PCR of murine immunoglobulin genes mixed 50:50 with SEQ ID NO:38
ctatgcgccttgccagcccgctcagggggccagtggatagachgatg

SEQ ID NO: 38 - DNA, 49 bp, Artificial Sequence
  synthetic primer L_GSP2_murine for PCR of murine immunoglobulin genes mixed 50:50 with SEQ ID NO:37
ctatgcgccttgccagcccgctcagcagggaccaagggatagacagatg

SEQ ID NO: 39 - DNA, 51 bp, Artificial Sequence
  synthetic primer M_GSP2_murine for PCR of murine immunoglobulin genes
ctatgcgccttgccagcccgctcaggraagacatttgggraggactgactc

SEQ ID NO: 40 - DNA, 25 bp, Artificial Sequence
  synthetic oligo(dT)-25
ttttttttttttttttttttttttt

SEQ ID NO: 41 - DNA, 73 bp, Artificial Sequence
  synthetic PCR1 and PCR2 primer bc_fwlong_ISceI
gagagactgacagcgtatcgcctccctcgcgccatcagacgagtgcgtggatagggataacagggtaatagga

SEQ ID NO: 42 - DNA, 56 bp, Artificial Sequence
  synthetic primer mix Lib1-FR mixed 1:1 with SEQ ID NO:43
  modified_base (31)...(34): n = g, a, c or t
ccatctcatccctgcgtgtctccgactcagnnnncgtatcgcctccctcgcgccat

SEQ ID NO: 43 - DNA, 58 bp, Artificial Sequence
  synthetic primer mix Lib1-FR mixed 1:1 with SEQ ID NO:42
  modified_base (31)...(34): n = g, a, c or t
cctatcccctgtgtgccttggcagtctcagnnnnctatgcgccttgccagcccgctca

SEQ ID NO: 44 - DNA, 56 bp, Artificial Sequence
  synthetic primer mix Lib2-FR mixed 1:1 with SEQ ID NO:45
  modified_base (31)...(34): n = g, a, c or t
cctatcccctgtgtgccttggcagtctcagnnnncgtatcgcctccctcgcgccat

SEQ ID NO: 45 - DNA, 58 bp, Artificial Sequence
  synthetic primer mix Lib2-FR mixed 1:1 with SEQ ID NO:44
  modified_base (31)...(34): n = g, a, c or t
ccatctcatccctgcgtgtctccgactcagnnnnctatgcgccttgccagcccgctca

SEQ ID NO: 46 - DNA, 20 bp, Artificial Sequence
  synthetic T2' sequence used to identify DNA barcodes
gggataacagggtaatagga

SEQ ID NO: 47 - DNA, 18 bp, Artificial Sequence
  synthetic T1 sequence used to identify DNA barcodes
aggagtttaaactggggg

SEQ ID NO: 48 - DNA, 60 bp, Artificial Sequence
  synthetic oligo primer emB_BCbridgeISceI_N used to make barcode adapter template bead library
acccagtttaaacctccthhhthhhhthhhhthhhthhhhtcctattaccctgttatccc

SEQ ID NO: 49 - DNA, 29 bp, Artificial Sequence
  synthetic oligo primer emB_ISceI_RV_n used to make barcode adapter template bead library
cccchhhhhhhhaccagtttaaacctcct

SEQ ID NO: 50 - DNA, 46 bp, Artificial Sequence
  synthetic oligodT_n
cacgaccggtgctcgatttagttttttttttttttttttttttttt

SEQ ID NO: 51 - DNA, 21 bp, Artificial Sequence
  synthetic PCR primer RV_1
cacgaccggtgctcgatttag

SEQ ID NO: 52 - DNA, 120 bp, Artificial Sequence
  synthetic combinatorially generated barcode adapter template
  modified_base (1)...(1): a modified by dual-biotin-C18spacer-C18spacer
  modified_base (47)...(62): [barcode part1], nnnnnnnnnnnnnnnn = one of SEQ ID NOS:127-45126
  modified_base (82)...(93): [barcode part2], nnnnnnnnnnnn = one of SEQ ID NOS:45127-47561
atattaatacgactcactataggaagatagggataacagggtaatgnnnnnnnnnnnnnnnngctgagacatgtgaagaggnnnnnnnnnnnngctcttcggagggaddddddddgcggg

SEQ ID NO: 53 - DNA, 120 bp, Artificial Sequence
  synthetic combinatorially generated barcode adapter template
  modified_base (1)...(1): a modified by dual-biotin-C18spacer-C18spacer
  modified_base (47)...(62): [barcode part1], nnnnnnnnnnnnnnnn = one of SEQ ID NOS:127-45126
  modified_base (82)...(93): [barcode part2], nnnnnnnnnnnn = one of SEQ ID NOS:45127-47561
atattaatacgactcactataggaagatagggataacagggtaatgnnnnnnnnnnnnnnnngctgagacatgtgaagaggnnnnnnnnnnnntcgtctcggagggaddddddddgcggg

SEQ ID NO: 54 - DNA, 120 bp, Artificial Sequence
  synthetic combinatorially generated barcode adapter template
  modified_base (1)...(1): a modified by dual-biotin-C18spacer-C18spacer
  modified_base (47)...(62): [barcode part1], nnnnnnnnnnnnnnnn = one of SEQ ID NOS:127-45126
  modified_base (82)...(93): [barcode part2], nnnnnnnnnnnn = one of SEQ ID NOS:45127-47561
atattaatacgactcactataggaagatagggataacagggtaatgnnnnnnnnnnnnnnnngctgagacatgtgaagaggnnnnnnnnnnnnacctcagcgagggaddddddddgcggg

SEQ ID NO: 55 - DNA, 46 bp, Artificial Sequence
  synthetic SAV_bead_linker for combinatorially generated barcode adapter template sequence
  modified_base (1)...(1): a modified by dual-biotin-C18spacer-C18spacer
atattaatacgactcactataggaagatagggataacagggtaatg

SEQ ID NO: 56 - DNA, 46 bp, Artificial Sequence; identical to SEQ ID NO: 55
  synthetic Linker_free for combinatorially generated barcode adapter template sequence

SEQ ID NO: 57 - DNA, 107 bp, Artificial Sequence
  synthetic barcode-containing oligo for combinatorially generated barcode adapter template sequence
  modified_base (47)...(62): [barcode part1], nnnnnnnnnnnnnnnn = one of SEQ ID NOS:127-45126
  modified_base (82)...(93): [barcode part2], nnnnnnnnnnnn = one of SEQ ID NOS:45127-47561
atattaatacgactcactataggaagatagggataacagggtaatgnnnnnnnnnnnnnnnngctgagacatgtgaagaggnnnnnnnnnnnngctcttcggaggga

SEQ ID NO: 58 - DNA, 107 bp, Artificial Sequence
  synthetic barcode-containing oligo for combinatorially generated barcode adapter template sequence
  modified_base (47)...(62): [barcode part1], nnnnnnnnnnnnnnnn = one of SEQ ID NOS:127-45126
  modified_base (82)...(93): [barcode part2], nnnnnnnnnnnn = one of SEQ ID NOS:45127-47561
atattaatacgactcactataggaagatagggataacagggtaatgnnnnnnnnnnnnnnnngctgagacatgtgaagaggnnnnnnnnnnnntcgtctcggaggga

SEQ ID NO: 59 - DNA, 107 bp, Artificial Sequence
  synthetic barcode-containing oligo for combinatorially generated barcode adapter template sequence
  modified_base (47)...(62): [barcode part1], nnnnnnnnnnnnnnnn = one of SEQ ID NOS:127-45126
  modified_base (82)...(93): [barcode part2], nnnnnnnnnnnn = one of SEQ ID NOS:45127-47561
atattaatacgactcactataggaagatagggataacagggtaatgnnnnnnnnnnnnnnnngctgagacatgtgaagaggnnnnnnnnnnnnacctcagcgaggga

SEQ ID NO: 60 - DNA, 27 bp, Artificial Sequence
  synthetic non-mispriming reverse primer Rv_type1 for combinatorially generated barcode adapter template sequence
  modified_base (1)...(1): cm modified by 6-FAM
  modified_base (2)...(2): cm
cccgchhhhhhhhtccctccgaagagc

SEQ ID NO: 61 - DNA, 27 bp, Artificial Sequence
  synthetic non-mispriming reverse primer Rv_type2 for combinatorially generated barcode adapter template sequence
  modified_base (1)...(1): cm modified by Cy3
  modified_base (2)...(2): cm
cccgchhhhhhhhtccctccgagacga

SEQ ID NO: 62 - DNA, 27 bp, Artificial Sequence
  synthetic non-mispriming reverse primer Rv_type3 for combinatorially generated barcode adapter template sequence
  modified_base (1)...(1): cm modified by AlexaFluor647
  modified_base (2)...(2): cm
cccgchhhhhhhhtccctcgctgaggt

SEQ ID NO: 63 - DNA, 21 bp, Artificial Sequence
  synthetic make_longbc_rv1 to generate barcode-containing oligo for combinatorially generated barcode adapter template sequence
gatagggataacagggtaatg

SEQ ID NO: 64 - DNA, 56 bp, Artificial Sequence
  synthetic BC_part1_sense to generate barcode-containing oligo for combinatorially generated barcode adapter template sequence
  modified_base (22)...(37): [barcode part1], nnnnnnnnnnnnnnnn = one of SEQ ID NOS:127-45126
gatagggataacagggtaatgnnnnnnnnnnnnnnnngctgagacatgtgaagagg

SEQ ID NO: 65 - DNA, 45 bp, Artificial Sequence
  synthetic BC_part2_type1_antisense to generate barcode-containing oligo for combinatorially generated barcode adapter template sequence
  modified_base (15)...(26): [barcode part2], nnnnnnnnnnnn = one of SEQ ID NOS:45127-47561
tccctccgaagagcnnnnnnnnnnnncctcttcacatgtctcagc

SEQ ID NO: 66 - DNA, 14 bp, Artificial Sequence
  synthetic make_longbc_rv2 to generate barcode-containing oligo for combinatorially generated barcode adapter template sequence
tccctccgaagagc

SEQ ID NO: 67 - DNA, 45 bp, Artificial Sequence
  synthetic BC_part2_type2_antisense to generate barcode-containing oligo for combinatorially generated barcode adapter template sequence
  modified_base (15)...(26): [barcode part2], nnnnnnnnnnnn = one of SEQ ID NOS:45127-47561
tccctccgagacgannnnnnnnnnnncctcttcacatgtctcagc

SEQ ID NO: 68 - DNA, 14 bp, Artificial Sequence
  synthetic make_longbc_rv2 to generate barcode-containing oligo for combinatorially generated barcode adapter template sequence
tccctccgagacga

SEQ ID NO: 69 - DNA, 45 bp, Artificial Sequence
  synthetic BC_part2_type3_antisense to generate barcode-containing oligo for combinatorially generated barcode adapter template sequence
  modified_base (15)...(26): [barcode part2], nnnnnnnnnnnn = one of SEQ ID NOS:45127-47561
tccctcgctgaggtnnnnnnnnnnnncctcttcacatgtctcagc

SEQ ID NO: 70 - DNA, 14 bp, Artificial Sequence
  synthetic make_longbc_rv3 to generate barcode-containing oligo for combinatorially generated barcode adapter template sequence
tccctcgctgaggt

SEQ ID NO: 71 - DNA, 44 bp, Artificial Sequence
  synthetic PCR1 and PCR2 primer FW2-N-V2
ctatgcgccttgccagaatgatacggcgaccaccgagatctaca

SEQ ID NO: 72 - DNA, 65 bp, Artificial Sequence
  synthetic PCR1 and PCR2 primer Index_sID
  modified_base (22)...(29): [i5 index primers], nnnnnnnn = one of SEQ ID NOS:47562-47605
ggcgaccaccgagatctacacnnnnnnnntcgtcggcagcggaagatagggataacagggtaatg

SEQ ID NO: 73 - DNA, 20 bp, Artificial Sequence
  synthetic PCR1 and PCR2 primer PCR1_short_n_v2
ggcgaccaccgagatctaca

SEQ ID NO: 74 - DNA, 24 bp, Artificial Sequence
  synthetic PCR1 and PCR2 primer PCR1-RV-N v2
attaggagacacaatagggaggca

SEQ ID NO: 75 - DNA, 26 bp, Artificial Sequence
  synthetic PCR1 and PCR2 primer RV2-n
gtgggctcggagatgtgtataagaga

SEQ ID NO: 76 - DNA, 26 bp, Artificial Sequence
  synthetic PCR1 and PCR2 primer TRAC 53-78
ggtgaataggcagacagacttgtcac

SEQ ID NO: 77 - DNA, 49 bp, Artificial Sequence
  synthetic PCR1 and PCR2 primer TRAC GSP2 mixed 1:1:1:1 with SEQ ID NOS:79-81
  modified_base (30)...(30): n = g, a, c or t
gtgggctcggagatgtgtataagagacagntacacggcagggtcagggt

SEQ ID NO: 78 - DNA, 50 bp, Artificial Sequence
  synthetic PCR1 and PCR2 primer TRAC GSP2 mixed 1:1:1:1 with SEQ ID NOS:78, 80 and 81
  modified_base (30)...(31): n = g, a, c or t
gtgggctcggagatgtgtataagagacagnntacacggcagggtcagggt

SEQ ID NO: 79 - DNA, 51 bp, Artificial Sequence
  synthetic PCR1 and PCR2 primer TRAC GSP2 mixed 1:1:1:1 with SEQ ID NOS:78, 79 and 81
  modified_base (30)...(32): n = g, a, c or t
gtgggctcggagatgtgtataagagacagnnntacacggcagggtcagggt

SEQ ID NO: 80 - DNA, 52 bp, Artificial Sequence
  synthetic PCR1 and PCR2 primer TRAC GSP2 mixed 1:1:1:1 with SEQ ID NOS:78-80
  modified_base (30)...(33): n = g, a, c or t
gtgggctcggagatgtgtataagagacagnnnntacacggcagggtcagggt

SEQ ID NO: 81 - DNA, 24 bp, Artificial Sequence
  synthetic PCR1 and PCR2 primer TRBC 37-60
ctctgcttctgatggctcaaacac

SEQ ID NO: 82 - DNA, 52 bp, Artificial Sequence
  synthetic PCR1 and PCR2 primer TRBC GSP2 mixed 1:1:1:1 with SEQ ID NOS:84-86
  modified_base (30)...(30): n = g, a, c or t
gtgggctcggagatgtgtataagagacagnatggctcaaacacagcgacctc

SEQ ID NO: 83 - DNA, 53 bp, Artificial Sequence
  synthetic PCR1 and PCR2 primer TRBC GSP2 mixed 1:1:1:1 with SEQ ID NOS:83, 85 and 86
  modified_base (30)...(31): n = g, a, c or t
gtgggctcggagatgtgtataagagacagnnatggctcaaacacagcgacctc

SEQ ID NO: 84 - DNA, 54 bp, Artificial Sequence
  synthetic PCR1 and PCR2 primer TRBC GSP2 mixed 1:1:1:1 with SEQ ID NOS:83, 84 and 86
  modified_base (30)...(32): n = g, a, c or t
gtgggctcggagatgtgtataagagacagnnnatggctcaaacacagcgacctc

SEQ ID NO: 85 - DNA, 55 bp, Artificial Sequence
  synthetic PCR1 and PCR2 primer TRBC GSP2 mixed 1:1:1:1 with SEQ ID NOS:83-85
  modified_base (30)...(33): n = g, a, c or t
gtgggctcggagatgtgtataagagacagnnnnatggctcaaacacagcgacctc

SEQ ID NO: 86 - DNA, 26 bp, Artificial Sequence
  synthetic primer Next_i5_n used in library PCR amplification
aatgatacggcgaccaccgagatcta

SEQ ID NO: 87 - DNA, 60 bp, Artificial Sequence
  synthetic primer Next_i7_FULL_n used in library PCR amplification
caagcagaagacggcatacgagattcgccttagtctcgtgggctcggagatgtgtataag

SEQ ID NO: 88 - DNA, 22 bp, Artificial Sequence
  synthetic T cells targeted gene reverse primer IFNgamma (PCR1) for PCR1
gcttccctgttttagctgctgg

SEQ ID NO: 89 - DNA, 52 bp, Artificial Sequence
  synthetic T cells targeted gene reverse primer IFNgamma (PCR2) for PCR2 mixed 1:1:1:1 with SEQ ID NOS:91-93
  modified_base (30)...(30): n = g, a, c or t
gtgggctcggagatgtgtataagagacagncgacagttcagccatcacttgg

SEQ ID NO: 90 - DNA, 53 bp, Artificial Sequence
  synthetic T cells targeted gene reverse primer IFNgamma (PCR2) for PCR2 mixed 1:1:1:1 with SEQ ID NOS:90, 92 and 93
  modified_base (30)...(31): n = g, a, c or t
gtgggctcggagatgtgtataagagacagnncgacagttcagccatcacttgg

SEQ ID NO: 91 - DNA, 54 bp, Artificial Sequence
  synthetic T cells targeted gene reverse primer IFNgamma (PCR2) for PCR2 mixed 1:1:1:1 with SEQ ID NOS:90, 91 and 93
  modified_base (30)...(32): n = g, a, c or t
gtgggctcggagatgtgtataagagacagnnncgacagttcagccatcacttgg

SEQ ID NO: 92 - DNA, 55 bp, Artificial Sequence
  synthetic T cells targeted gene reverse primer IFNgamma (PCR2) for PCR2 mixed 1:1:1:1 with SEQ ID NOS:90-92
  modified_base (30)...(33): n = g, a, c or t
gtgggctcggagatgtgtataagagacagnnnncgacagttcagccatcacttgg

SEQ ID NO: 93 - DNA, 20 bp, Artificial Sequence
  synthetic T cells targeted gene reverse primer CD4 (PCR1) for PCR1
gctgagacacggagagggtc

SEQ ID NO: 94 - DNA, 50 bp, Artificial Sequence
  synthetic T cells targeted gene reverse primer CD4 (PCR2) for PCR2 mixed 1:1:1:1 with SEQ ID NOS:96-98
  modified_base (30)...(30): n = g, a, c or t
gtgggctcggagatgtgtataagagacagnagcaggtgggtgtcagagtt

SEQ ID NO: 95 - DNA, 51 bp, Artificial Sequence
  synthetic T cells targeted gene reverse primer CD4 (PCR2) for PCR2 mixed 1:1:1:1 with SEQ ID NOS:95, 97 and 98
  modified_base (30)...(31): n = g, a, c or t
gtgggctcggagatgtgtataagagacagnnagcaggtgggtgtcagagtt

SEQ ID NO: 96 - DNA, 52 bp, Artificial Sequence
  synthetic T cells targeted gene reverse primer CD4 (PCR2) for PCR2 mixed 1:1:1:1 with SEQ ID NOS:95, 96 and 98
  modified_base (30)...(32): n = g, a, c or t
gtgggctcggagatgtgtataagagacagnnnagcaggtgggtgtcagagtt

SEQ ID NO: 97 - DNA, 53 bp, Artificial Sequence
  synthetic T cells targeted gene reverse primer CD4 (PCR2) for PCR2 mixed 1:1:1:1 with SEQ ID NOS:95-97
  modified_base (30)...(33): n = g, a, c or t
gtgggctcggagatgtgtataagagacagnnnnagcaggtgggtgtcagagtt

SEQ ID NO: 98 - DNA, 20 bp, Artificial Sequence
  synthetic T cells targeted gene reverse primer CD8 (PCR1) for PCR1
gtgagggcgagagtaggcag

SEQ ID NO: 99 - DNA, 50 bp, Artificial Sequence
  synthetic T cells targeted gene reverse primer CD8 (PCR2) for PCR2 mixed 1:1:1:1 with SEQ ID NOS:101-103
  modified_base (30)...(30): n = g, a, c or t
gtgggctcggagatgtgtataagagacagntcaccgaggaaggaccctct

SEQ ID NO: 100 - DNA, 51 bp, Artificial Sequence
  synthetic T cells targeted gene reverse primer CD8 (PCR2) for PCR2 mixed 1:1:1:1 with SEQ I NOS:100, 102 and 103
  modified_base (30)...(31): n = g, a, c or t
gtgggctcggagatgtgtataagagacagnntcaccgaggaaggaccctct

SEQ ID NO: 101 - DNA, 52 bp, Artificial Sequence
  synthetic T cells targeted gene reverse primer CD8 (PCR2) for PCR2 mixed 1:1:1:1 with SEQ ID NOS:100, 101 and 103
  modified_base (30)...(32): n = g, a, c or t
gtgggctcggagatgtgtataagagacagnnntcaccgaggaaggaccctct

SEQ ID NO: 102 - DNA, 53 bp, Artificial Sequence
  synthetic T cells targeted gene reverse primer CD8 (PCR2) for PCR2 mixed 1:1:1:1 with SEQ ID NOS:100-102
  modified_base (30)...(33): n = g, a, c or t
gtgggctcggagatgtgtataagagacagnnnntcaccgaggaaggaccctct

SEQ ID NO: 103 - DNA, 24 bp, Artificial Sequence
  synthetic primer v2_PCR1_RV_n used for whole transcriptomic amplification and library prep
attaggagacacaatagggaggca

SEQ ID NO: 104 - DNA, 24 bp, Artificial Sequence
  synthetic primer Next_i5_n_v2 used for whole transcriptomic amplification and library prep
ctatgcgccttgccagaatgatac

SEQ ID NO: 105 - DNA, 47 bp, Artificial Sequence
  synthetic primer Next_i7_n used for whole transcriptomic amplification and library prep
caagcagaagacggcatacgagattcgccttagtctcgtgggctcgg

SEQ ID NO: 106 - DNA, 38 bp, Artificial Sequence
  synthetic primer 5' adapter
ggaagatagggataacagggtaatgddddddddgcggg

SEQ ID NO: 107 - DNA, 118 bp, Artificial Sequence
  synthetic primer barcode_adapter_5c_oligodT
  modified_base (25)...(40): [barcode part1], nnnnnnnnnnnnnnnn = one of SEQ ID NOS:127-45126
  modified_base (60)...(71): [barcode part2], nnnnnnnnnnnn = one of SEQ ID NOS:45127-47561
attaggagacacaatagggaggcannnnnnnnnnnnnnnngctgagacatgtgaagaggnnnnnnnnnnnngctcttcggagggaddddddddttttttttttttttttttttttttt

SEQ ID NO: 108 - DNA, 118 bp, Artificial Sequence
  synthetic primer barcode_adapter_5c_oligodT
  modified_base (25)...(40): [barcode part1], nnnnnnnnnnnnnnnn = one of SEQ ID NOS:127-45126
  modified_base (60)...(71): [barcode part2], nnnnnnnnnnnn = one of SEQ ID NOS:45127-47561
attaggagacacaatagggaggcannnnnnnnnnnnnnnngctgagacatgtgaagaggnnnnnnnnnnnntcgtctcggagggaddddddddttttttttttttttttttttttttt

SEQ ID NO: 109 - DNA, 118 bp, Artificial Sequence
  synthetic primer barcode_adapter_5c_oligodT
  modified_base (25)...(40): [barcode part1], nnnnnnnnnnnnnnnn = one of SEQ ID NOS:127-45126
  modified_base (60)...(71): [barcode part2], nnnnnnnnnnnn = one of SEQ ID NOS:45127-47561
attaggagacacaatagggaggcannnnnnnnnnnnnnnngctgagacatgtgaagaggnnnnnnnnnnnnacctcagcgagggaddddddddttttttttttttttttttttttttt

SEQ ID NO: 110 - DNA, 109 bp, Artificial Sequence
  synthetic primer barcode_adapter_5c_randomer
  modified_base (25)...(40): [barcode part1], nnnnnnnnnnnnnnnn = one of SEQ ID NOS:127-45126
  modified_base (60)...(71): [barcode part2], nnnnnnnnnnnn = one of SEQ ID NOS:45127-47561
  modified_base (94)...(99): n = g, a, c or t
  modified_base (100)...(109): n = g, a, c or t, may be present or absent
attaggagacacaatagggaggcannnnnnnnnnnnnnnngctgagacatgtgaagaggnnnnnnnnnnnngctcttcggagggaddddddddnnnnnnnnnnnnnnnn

SEQ ID NO: 111 - DNA, 109 bp, Artificial Sequence
  synthetic primer barcode_adapter_5c_randomer
  modified_base (25)...(40): [barcode part1], nnnnnnnnnnnnnnnn = one of SEQ ID NOS:127-45126
  modified_base (60)...(71): [barcode part2], nnnnnnnnnnnn = one of SEQ ID NOS:45127-47561
  modified_base (94)...(99): n = g, a, c or t
  modified_base (100)...(109): n = g, a, c or t, may be present or absent
attaggagacacaatagggaggcannnnnnnnnnnnnnnngctgagacatgtgaagaggnnnnnnnnnnnntcgtctcggagggaddddddddnnnnnnnnnnnnnnnn

SEQ ID NO: 112 - DNA, 109 bp, Artificial Sequence
  synthetic primer barcode_adapter_5c_randomer
  modified_base (25)...(40): [barcode part1], nnnnnnnnnnnnnnnn = one of SEQ ID NOS:127-45126
  modified_base (60)...(71): [barcode part2], nnnnnnnnnnnn = one of SEQ ID NOS:45127-47561
  modified_base (94)...(99): n = g, a, c or t
  modified_base (100)...(109): n = g, a, c or t, may be present or absent
attaggagacacaatagggaggcannnnnnnnnnnnnnnngctgagacatgtgaagaggnnnnnnnnnnnnacctcagcgagggaddddddddnnnnnnnnnnnnnnnn

SEQ ID NO: 113 - DNA, 57 bp, Artificial Sequence
  synthetic primer 3'_adapter_PCR_oligodT
attaggagacacaatagggaggcaddddddddttttttttttttttttttttttttt

SEQ ID NO: 114 - DNA, 48 bp, Artificial Sequence
  synthetic primer 3'_adapter_PCR_randomer
  modified_base (33)...(38): n = g, a, c or t
  modified_base (39)...(48): n = g, a, c or t, may be present or absent
attaggagacacaatagggaggcaddddddddnnnnnnnnnnnnnnnn

SEQ ID NO: 115 - DNA, 93 bp, Artificial Sequence
  synthetic primer 5'_PCR_barcode_adapter_primer
  modified_base (22)...(37): [barcode part1], nnnnnnnnnnnnnnnn = one of SEQ ID NOS:127-45126
  modified_base (57)...(68): [barcode part2], nnnnnnnnnnnn = one of SEQ ID NOS:45127-47561
ggcgaccaccgagatctacacnnnnnnnnnnnnnnnngctgagacatgtgaagaggnnnnnnnnnnnnggaagatagggataacagggtaatg

SEQ ID NO: 116 - DNA, 24 bp, Artificial Sequence
  synthetic primer 3'_PCR_primer
attaggagacacaatagggaggca

SEQ ID NO: 117 - DNA, 25 bp, Artificial Sequence
  synthetic forward primer 5'_PCR_primer
ggaagatagggataacagggtaatg

SEQ ID NO: 118 - DNA, 97 bp, Artificial Sequence
  synthetic reverse primer 3'_PCR_barcode_adapter_primer
  modified_base (27)...(42): [barcode part1], nnnnnnnnnnnnnnnn = one of SEQ ID NOS:127-45126
  modified_base (62)...(73): [barcode part2], nnnnnnnnnnnn = one of SEQ ID NOS:45127-47561
gtgggctcggagatgtgtataagagannnnnnnnnnnnnnnngctgagacatgtgaagaggnnnnnnnnnnnnattaggagacacaatagggaggca

SEQ ID NO: 119 - DNA, 545 bp, Artificial Sequence
  synthetic oligo Spike-In
atcgtctaatacgactcactatagggtccctgagctgaacgggaaggaaggctggggctcatttgaggtgcagctgttggagatgacccagtctccagcctccctgcgtcatgggtgtgaaccattagctgtgctcgcgctactctctctttctggcctggaggctatccagcacagcgacacccactcctccgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggcacaaagagcttcaacaggggagaatcgagacatgtaagcagcatcatggagctgggctgcctggtcaaggac

SEQ ID NO: 120 - DNA, 29 bp, Artificial Sequence
  synthetic primer SPIKEIN-FW
atcgtctaatacgactcactatagggtcc

SEQ ID NO: 121 - DNA, 56 bp, Artificial Sequence
  synthetic primer SPIKEIN-RV
tttttttttttttttttttttttttttttttttttgtccttgaccaggcagcccag

SEQ ID NO: 122 - DNA, 49 bp, Artificial Sequence
  synthetic oligo wellID-adapter
  Description of Combined DNA/RNA Molecule: synthetic oligo wellID-adapter
  modified_base (22)...(42): [well-barcode], nnnnnnnnnnnnnnnnnnnnn = one of SE ID NOS:47606-47711
cacgaccggugctcgatttagnnnnnnnnnnnnnnnnnnnnnaggaggg

SEQ ID NO: 123 - DNA, 98 bp, Artificial Sequence
  synthetic oligo Plate-ID
  modified_base (39)...(77): [plate-barcode], nnnnnnnnnnnnnnnnnnnnnnnnnnnnnnnnnnnnnnn = one of SEQ ID NOS:47712-47719
gagagactgacagcgtatcgcctccctcgcgccatcagnnnnnnnnnnnnnnnnnnnnnnnnnnnnnnnnnnnnnnncacgaccggtgctcgatttag

SEQ ID NO: 124 - DNA, 27 bp, Artificial Sequence
  synthetic shared barcode of paired heavy and light chain sequences
gccgaccacggcacaagcgccgaaaat

SEQ ID NO: 125 - protein, 140 aa, Artificial Sequence
  synthetic paired heavy chain sequence produced from shared barcode
MEFGLSWLFLVAILKGVQCGVQLLESGGGLVQPGGSLRLSCAGSQFTFSTYAMNWVRQAPGKGLEWVSGISGDGYRIQYADSVEGRFSISRDNSNNMVYLQMTSLRAEDTAVYFCAKDLFPRTIGYFDYWGQGTRVTVSS

SEQ ID NO: 126 - protein, 126 aa, Artificial Sequence
  synthetic paired light chain sequence produced from shared barcode
MEAPAQLLFLLLLWLPDTTGKIVMTQSPATLSVSPGERATLSCRASQSISINLAWYQHKPGQAPRLLIYGASTRATAIPARFSGSVSGTEFTLTISSLQSEDFAVYYCQQYDDWPRTFGQGTKVEI

SEQ ID NO: 127 - DNA, 16 bp, Artificial Sequence
  synthetic [barcode part1]
aatcctcagtcgtact

SEQ ID NO: 128 - DNA, 16 bp, Artificial Sequence
  synthetic [barcode part1]
atacgcagtcgtaacc

SEQ ID NO: 129 - DNA, 16 bp, Artificial Sequence
  synthetic [barcode part1]
ccttgtgcaacaattc

SEQ ID NO: 130 - DNA, 16 bp, Artificial Sequence
  synthetic [barcode part1]
gaccagacctgtgaag

SEQ ID NO: 131 - DNA, 16 bp, Artificial Sequence
  synthetic [barcode part1]
tctctcggaacacctg

SEQ ID NO: 132 - DNA, 16 bp, Artificial Sequence
  synthetic [barcode part1]
cgtcacgtgattaacg

SEQ ID NO: 133 - DNA, 16 bp, Artificial Sequence
  synthetic [barcode part1]
cctaccttgtctatcg

SEQ ID NO: 134 - DNA, 16 bp, Artificial Sequence
  synthetic [barcode part1]
agatcggacgcgttag

SEQ ID NO: 135 - DNA, 16 bp, Artificial Sequence
  synthetic [barcode part1]
agataaggacgccgtc

SEQ ID NO: 136 - DNA, 16 bp, Artificial Sequence
  synthetic [barcode part1]
atccggacttgttact

SEQ ID NO: 137 - DNA, 16 bp, Artificial Sequence
  synthetic [barcode part1]
cactgtactggaactg

SEQ ID NO: 138 - DNA, 16 bp, Artificial Sequence
  synthetic [barcode part1]
tgacgcactctcggtt

SEQ ID NO: 139 - DNA, 16 bp, Artificial Sequence
  synthetic [barcode part1]
gtgtcctatcaagttc

SEQ ID NO: 140 - DNA, 16 bp, Artificial Sequence
  synthetic [barcode part1]
gaggtagtgttcggac

SEQ ID NO: 141 - DNA, 16 bp, Artificial Sequence
  synthetic [barcode part1]
cgagatcaccagttgt

SEQ ID NO: 142 - DNA, 16 bp, Artificial Sequence
  synthetic [barcode part1]
tgcgtcctgttggact

SEQ ID NO: 143 - DNA, 16 bp, Artificial Sequence
  synthetic [barcode part1]
tgaggtcaaggttcct

SEQ ID NO: 144 - DNA, 16 bp, Artificial Sequence
  synthetic [barcode part1]
aactaccacggttcag

SEQ ID NO: 145 - DNA, 16 bp, Artificial Sequence
  synthetic [barcode part1]
caactaggttgcaacc

SEQ ID NO: 146 - DNA, 16 bp, Artificial Sequence
  synthetic [barcode part1]
cctaagtcgccttgtg

SEQ ID NO: 147 - DNA, 16 bp, Artificial Sequence
  synthetic [barcode part1]
acggtgtccaagactt

SEQ ID NO: 148 - DNA, 16 bp, Artificial Sequence
  synthetic [barcode part1]
ttcgattcacgtggcc

SEQ ID NO: 149 - DNA, 16 bp, Artificial Sequence
  synthetic [barcode part1]
cacaccgaactcttcg

SEQ ID NO: 150 - DNA, 16 bp, Artificial Sequence
  synthetic [barcode part1]
tgcgtcttcgtatctc

SEQ ID NO: 151 - DNA, 16 bp, Artificial Sequence
  synthetic [barcode part1]
caggttagattcgacc

SEQ ID NO: 152 - DNA, 16 bp, Artificial Sequence
  synthetic [barcode part1]
tgtggaggttgccaag

SEQ ID NO: 153 - DNA, 16 bp, Artificial Sequence
  synthetic [barcode part1]
tagaagaccaagaggc

SEQ ID NO: 154 - DNA, 16 bp, Artificial Sequence
  synthetic [barcode part1]
tggtactagtgttgcg

SEQ ID NO: 155 - DNA, 16 bp, Artificial Sequence
  synthetic [barcode part1]
aggtccacggagagtt

SEQ ID NO: 156 - DNA, 16 bp, Artificial Sequence
  synthetic [barcode part1]
gagacgaattctgtcc

SEQ ID NO: 157 - DNA, 16 bp, Artificial Sequence
  synthetic [barcode part1]
tacgatcctccgtcag

SEQ ID NO: 158 - DNA, 16 bp, Artificial Sequence
  synthetic [barcode part1]
aacgtacaaccgaggc

SEQ ID NO: 159 - DNA, 16 bp, Artificial Sequence
  synthetic [barcode part1]
tgtacacgtaccacag

SEQ ID NO: 160 - DNA, 16 bp, Artificial Sequence
  synthetic [barcode part1]
tcggccttactctact

SEQ ID NO: 161 - DNA, 16 bp, Artificial Sequence
  synthetic [barcode part1]
gtaacggatagtcgcg

SEQ ID NO: 162 - DNA, 16 bp, Artificial Sequence
  synthetic [barcode part1]
ataatcacgaccacgc

SEQ ID NO: 163 - DNA, 16 bp, Artificial Sequence
  synthetic [barcode part1]
tccgatctgtgcagtc

SEQ ID NO: 164 - DNA, 16 bp, Artificial Sequence
  synthetic [barcode part1]
cctctagtcgattctc

SEQ ID NO: 165 - DNA, 16 bp, Artificial Sequence
  synthetic [barcode part1]
gtccttatactggact

SEQ ID NO: 166 - DNA, 16 bp, Artificial Sequence
  synthetic [barcode part1]
atctgactcttcacag

SEQ ID NO: 167 - DNA, 16 bp, Artificial Sequence
  synthetic [barcode part1]
ccggtgttatacagtg

SEQ ID NO: 168 - DNA, 16 bp, Artificial Sequence
  synthetic [barcode part1]
atactctactaccgac

SEQ ID NO: 169 - DNA, 16 bp, Artificial Sequence
  synthetic [barcode part1]
tgtggttgaggcagtg

SEQ ID NO: 170 - DNA, 16 bp, Artificial Sequence
  synthetic [barcode part1]
gacgtgattacactcg

SEQ ID NO: 171 - DNA, 16 bp, Artificial Sequence
  synthetic [barcode part1]
ttccaaccagtggagt

SEQ ID NO: 172 - DNA, 16 bp, Artificial Sequence
  synthetic [barcode part1]
gacaggatcggtacac

SEQ ID NO: 173 - DNA, 16 bp, Artificial Sequence
  synthetic [barcode part1]
tacggttgtgtccaag

SEQ ID NO: 174 - DNA, 16 bp, Artificial Sequence
  synthetic [barcode part1]
ccagtccagacgttct

SEQ ID NO: 175 - DNA, 16 bp, Artificial Sequence
  synthetic [barcode part1]
tccgtacagtccaacc

SEQ ID NO: 176 - DNA, 16 bp, Artificial Sequence
  synthetic [barcode part1]
taagtagaacgccgcg

SEQ ID NO: 177 - DNA, 16 bp, Artificial Sequence
  synthetic [barcode part1]
actggtgatagagtgt

SEQ ID NO: 178 - DNA, 16 bp, Artificial Sequence
  synthetic [barcode part1]
gtagactgccgaagac

SEQ ID NO: 179 - DNA, 16 bp, Artificial Sequence
  synthetic [barcode part1]
acagagactctgcact

SEQ ID NO: 180 - DNA, 16 bp, Artificial Sequence
  synthetic [barcode part1]
tccttcgagatatctg

SEQ ID NO: 181 - DNA, 16 bp, Artificial Sequence
  synthetic [barcode part1]
gtcttcggataacttc

SEQ ID NO: 182 - DNA, 16 bp, Artificial Sequence
  synthetic [barcode part1]
cacaacttggccttcg

SEQ ID NO: 183 - DNA, 16 bp, Artificial Sequence
  synthetic [barcode part1]
gcctcacttgcacagt

SEQ ID NO: 184 - DNA, 16 bp, Artificial Sequence
  synthetic [barcode part1]
gtgtggtacaccaact

SEQ ID NO: 185 - DNA, 16 bp, Artificial Sequence
  synthetic [barcode part1]
gtacgcagttacggtt

SEQ ID NO: 186 - DNA, 16 bp, Artificial Sequence
  synthetic [barcode part1]
gaacagaacgagtggt

SEQ ID NO: 187 - DNA, 16 bp, Artificial Sequence
  synthetic [barcode part1]
caccaggtgaactatc

SEQ ID NO: 188 - DNA, 16 bp, Artificial Sequence
  synthetic [barcode part1]
gtcctggaatcctaag

SEQ ID NO: 189 - DNA, 16 bp, Artificial Sequence
  synthetic [barcode part1]
gcgtcgtacctattcg

SEQ ID NO: 190 - DNA, 16 bp, Artificial Sequence
  synthetic [barcode part1]
tgcggatataacgagt

SEQ ID NO: 191 - DNA, 16 bp, Artificial Sequence
  synthetic [barcode part1]
acgttccactactggc

SEQ ID NO: 192 - DNA, 16 bp, Artificial Sequence
  synthetic [barcode part1]
tgcaactaggagttag

SEQ ID NO: 193 - DNA, 16 bp, Artificial Sequence
  synthetic [barcode part1]
atcaacctgtgtgcag

SEQ ID NO: 194 - DNA, 16 bp, Artificial Sequence
  synthetic [barcode part1]
gcaaccggttatacac

SEQ ID NO: 195 - DNA, 16 bp, Artificial Sequence
  synthetic [barcode part1]
aagaggtgagtactct

SEQ ID NO: 196 - DNA, 16 bp, Artificial Sequence
  synthetic [barcode part1]
aacctgaccaacagtc

SEQ ID NO: 197 - DNA, 16 bp, Artificial Sequence
  synthetic [barcode part1]
aggtatccgtcgtctc

SEQ ID NO: 198 - DNA, 16 bp, Artificial Sequence
  synthetic [barcode part1]
ataacacggcctcagt

SEQ ID NO: 199 - DNA, 16 bp, Artificial Sequence
  synthetic [barcode part1]
cagttagatactgcgc

SEQ ID NO: 200 - DNA, 16 bp, Artificial Sequence
  synthetic [barcode part1]
cgtgaccgttaccttg

SEQ ID NO: 201 - DNA, 16 bp, Artificial Sequence
  synthetic [barcode part1]
cgtgtggtattagtgc

SEQ ID NO: 202 - DNA, 16 bp, Artificial Sequence
  synthetic [barcode part1]
acgtaacggaatcggc

SEQ ID NO: 203 - DNA, 16 bp, Artificial Sequence
  synthetic [barcode part1]
acttgtgtcttaccag

SEQ ID NO: 204 - DNA, 16 bp, Artificial Sequence
  synthetic [barcode part1]
cgtacgcgttaatcag

SEQ ID NO: 205 - DNA, 16 bp, Artificial Sequence
  synthetic [barcode part1]
gcaggtaagtggatag

SEQ ID NO: 206 - DNA, 16 bp, Artificial Sequence
  synthetic [barcode part1]
gccagacaacgtagac

SEQ ID NO: 207 - DNA, 16 bp, Artificial Sequence
  synthetic [barcode part1]
tgcgtaggtgatcgtt

SEQ ID NO: 208 - DNA, 16 bp, Artificial Sequence
  synthetic [barcode part1]
agatattgtctgcggc

SEQ ID NO: 209 - DNA, 16 bp, Artificial Sequence
  synthetic [barcode part1]
tggccttcttcttgac

SEQ ID NO: 210 - DNA, 16 bp, Artificial Sequence
  synthetic [barcode part1]
agatcaaggaagaccg

SEQ ID NO: 211 - DNA, 16 bp, Artificial Sequence
  synthetic [barcode part1]
tacgacggcagacagt

SEQ ID NO: 212 - DNA, 16 bp, Artificial Sequence
  synthetic [barcode part1]
tgaattgtcctgcgtt

SEQ ID NO: 213 - DNA, 16 bp, Artificial Sequence
  synthetic [barcode part1]
gacaaccttggtgact

SEQ ID NO: 214 - DNA, 16 bp, Artificial Sequence
  synthetic [barcode part1]
ttggactatatcctcg

SEQ ID NO: 215 - DNA, 16 bp, Artificial Sequence
  synthetic [barcode part1]
aagttgaacgcgccag

SEQ ID NO: 216 - DNA, 16 bp, Artificial Sequence
  synthetic [barcode part1]
gtagtctgatacagag

SEQ ID NO: 217 - DNA, 16 bp, Artificial Sequence
  synthetic [barcode part1]
ccggtctagatcaagt

SEQ ID NO: 218 - DNA, 16 bp, Artificial Sequence
  synthetic [barcode part1]
tcttcagactggtact

SEQ ID NO: 219 - DNA, 16 bp, Artificial Sequence
  synthetic [barcode part1]
cggacgcgttattcct

SEQ ID NO: 220 - DNA, 16 bp, Artificial Sequence
  synthetic [barcode part1]
actgaggaattctccg

SEQ ID NO: 221 - DNA, 16 bp, Artificial Sequence
  synthetic [barcode part1]
ccgccacttcagatac

SEQ ID NO: 222 - DNA, 16 bp, Artificial Sequence
  synthetic [barcode part1]
ttggcaggtggagact

SEQ ID NO: 223 - DNA, 16 bp, Artificial Sequence
  synthetic [barcode part1]
taggaagtcctctggt

SEQ ID NO: 224 - DNA, 16 bp, Artificial Sequence
  synthetic [barcode part1]
attgttcgttcacgac

SEQ ID NO: 225 - DNA, 16 bp, Artificial Sequence
  synthetic [barcode part1]
cgttgtaaggattccg

SEQ ID NO: 226 - DNA, 16 bp, Artificial Sequence
  synthetic [barcode part1]
cgaccacacttcctag

SEQ ID NO: 227 - DNA, 16 bp, Artificial Sequence
  synthetic [barcode part1]
tgcggacctgtcttac

SEQ ID NO: 228 - DNA, 16 bp, Artificial Sequence
  synthetic [barcode part1]
taacagaggtaaggcg

SEQ ID NO: 229 - DNA, 16 bp, Artificial Sequence
  synthetic [barcode part1]
ccagtgaattctcgtt

SEQ ID NO: 230 - DNA, 16 bp, Artificial Sequence
  synthetic [barcode part1]
aacaccggattgacct

SEQ ID NO: 231 - DNA, 16 bp, Artificial Sequence
  synthetic [barcode part1]
tcaacagataaggacc

SEQ ID NO: 232 - DNA, 16 bp, Artificial Sequence
  synthetic [barcode part1]
acacacgaccgtagtt

SEQ ID NO: 233 - DNA, 16 bp, Artificial Sequence
  synthetic [barcode part1]
gaagataccgccagac

SEQ ID NO: 234 - DNA, 16 bp, Artificial Sequence
  synthetic [barcode part1]
ttgtgaggcctctcac

SEQ ID NO: 235 - DNA, 16 bp, Artificial Sequence
  synthetic [barcode part1]
aatccggaagatacgt

SEQ ID NO: 236 - DNA, 16 bp, Artificial Sequence
  synthetic [barcode part1]
agtagtctaatccggc

SEQ ID NO: 237 - DNA, 16 bp, Artificial Sequence
  synthetic [barcode part1]
taagtgcaccgaggac

SEQ ID NO: 238 - DNA, 16 bp, Artificial Sequence
  synthetic [barcode part1]
acgtctcttgagtcgc

SEQ ID NO: 239 - DNA, 16 bp, Artificial Sequence
  synthetic [barcode part1]
aacgatcttggcgatc

SEQ ID NO: 240 - DNA, 16 bp, Artificial Sequence
  synthetic [barcode part1]
aacgaggtaatcctcc

SEQ ID NO: 241 - DNA, 16 bp, Artificial Sequence
  synthetic [barcode part1]
aatccgtgtagtagag

SEQ ID NO: 242 - DNA, 16 bp, Artificial Sequence
  synthetic [barcode part1]
aagttgcaagtgtgac

SEQ ID NO: 243 - DNA, 16 bp, Artificial Sequence
  synthetic [barcode part1]
gcctattaggcagact

SEQ ID NO: 244 - DNA, 16 bp, Artificial Sequence
  synthetic [barcode part1]
aacactggttgactgc

SEQ ID NO: 245 - DNA, 16 bp, Artificial Sequence
  synthetic [barcode part1]
tgcctcttcggtagtg

SEQ ID NO: 246 - DNA, 16 bp, Artificial Sequence
  synthetic [barcode part1]
aattgagagaccggag

SEQ ID NO: 247 - DNA, 16 bp, Artificial Sequence
  synthetic [barcode part1]
tagttcggatacgaag

SEQ ID NO: 248 - DNA, 16 bp, Artificial Sequence
  synthetic [barcode part1]
ccgaggcgatactatt

SEQ ID NO: 249 - DNA, 16 bp, Artificial Sequence
  synthetic [barcode part1]
tctgtataccgagttc

SEQ ID NO: 250 - DNA, 16 bp, Artificial Sequence
  synthetic [barcode part1]
cactgccggtaatagt

SEQ ID NO: 251 - DNA, 16 bp, Artificial Sequence
  synthetic [barcode part1]
tcggaattgtctgttc

SEQ ID NO: 252 - DNA, 16 bp, Artificial Sequence
  synthetic [barcode part1]
aatcggttcggtcaac

SEQ ID NO: 253 - DNA, 16 bp, Artificial Sequence
  synthetic [barcode part1]
gccttaccagattcgc

SEQ ID NO: 254 - DNA, 16 bp, Artificial Sequence
  synthetic [barcode part1]
tacgtaccacagtacg

SEQ ID NO: 255 - DNA, 16 bp, Artificial Sequence
  synthetic [barcode part1]
aggtctgtagaagact

SEQ ID NO: 256 - DNA, 16 bp, Artificial Sequence
  synthetic [barcode part1]
cagatctgtagtgaag

SEQ ID NO: 257 - DNA, 16 bp, Artificial Sequence
  synthetic [barcode part1]
tcacacaggaggatcg

SEQ ID NO: 258 - DNA, 16 bp, Artificial Sequence
  synthetic [barcode part1]
gcaggtacagaatccg

SEQ ID NO: 259 - DNA, 16 bp, Artificial Sequence
  synthetic [barcode part1]
attcaatccgacggtg

SEQ ID NO: 260 - DNA, 16 bp, Artificial Sequence
  synthetic [barcode part1]
tcaacgagtgaagatc

SEQ ID NO: 261 - DNA, 16 bp, Artificial Sequence
  synthetic [barcode part1]
ccactgtgaattcgcc

SEQ ID NO: 262 - DNA, 16 bp, Artificial Sequence
  synthetic [barcode part1]
tcgccttgcgtgattg

SEQ ID NO: 263 - DNA, 16 bp, Artificial Sequence
  synthetic [barcode part1]
gaggtagataagttcc

SEQ ID NO: 264 - DNA, 16 bp, Artificial Sequence
  synthetic [barcode part1]
gttcctaacggtccgt

SEQ ID NO: 265 - DNA, 16 bp, Artificial Sequence
  synthetic [barcode part1]
gcaatcgagaagactt

SEQ ID NO: 266 - DNA, 16 bp, Artificial Sequence
  synthetic [barcode part1]
accttcacgaatcact

SEQ ID NO: 267 - DNA, 16 bp, Artificial Sequence
  synthetic [barcode part1]
cgcgcagacaactatt

SEQ ID NO: 268 - DNA, 16 bp, Artificial Sequence
  synthetic [barcode part1]
acgactgcgatacact

SEQ ID NO: 269 - DNA, 16 bp, Artificial Sequence
  synthetic [barcode part1]
aatcaagtccggttcg

SEQ ID NO: 270 - DNA, 16 bp, Artificial Sequence
  synthetic [barcode part1]
gcactaagaaggccac

SEQ ID NO: 271 - DNA, 16 bp, Artificial Sequence
  synthetic [barcode part1]
tcaacttctcgtagac

SEQ ID NO: 272 - DNA, 16 bp, Artificial Sequence
  synthetic [barcode part1]
cacgcggtatcttatt

SEQ ID NO: 273 - DNA, 16 bp, Artificial Sequence
  synthetic [barcode part1]
tctcgtgttgaatcac

SEQ ID NO: 274 - DNA, 16 bp, Artificial Sequence
  synthetic [barcode part1]
atactctccaggttac

SEQ ID NO: 275 - DNA, 16 bp, Artificial Sequence
  synthetic [barcode part1]
tgcaacgtactcgcct

SEQ ID NO: 276 - DNA, 16 bp, Artificial Sequence
  synthetic [barcode part1]
atcagtggtccaagtc

SEQ ID NO: 277 - DNA, 16 bp, Artificial Sequence
  synthetic [barcode part1]
taacgtgcggtgagac

SEQ ID NO: 278 - DNA, 16 bp, Artificial Sequence
  synthetic [barcode part1]
tagagtaatccaggtg

SEQ ID NO: 279 - DNA, 16 bp, Artificial Sequence
  synthetic [barcode part1]
ataccttcgtgccttc

SEQ ID NO: 280 - DNA, 16 bp, Artificial Sequence
  synthetic [barcode part1]
gagttcaccaccactc

SEQ ID NO: 281 - DNA, 16 bp, Artificial Sequence
  synthetic [barcode part1]
gtctgtcctacggtac

SEQ ID NO: 282 - DNA, 16 bp, Artificial Sequence
  synthetic [barcode part1]
cgattggtgactgact

SEQ ID NO: 283 - DNA, 16 bp, Artificial Sequence
  synthetic [barcode part1]
actcctaatccggcgt

SEQ ID NO: 284 - DNA, 16 bp, Artificial Sequence
  synthetic [barcode part1]
actgtgattactcacc

SEQ ID NO: 285 - DNA, 16 bp, Artificial Sequence
  synthetic [barcode part1]
gtgcagaaggttgtcg

SEQ ID NO: 286 - DNA, 16 bp, Artificial Sequence
  synthetic [barcode part1]
ttggaatcgagtgagt

SEQ ID NO: 287 - DNA, 16 bp, Artificial Sequence
  synthetic [barcode part1]
tgaggacagattgttg

SEQ ID NO: 288 - DNA, 16 bp, Artificial Sequence
  synthetic [barcode part1]
tatactatcctgaccg

SEQ ID NO: 289 - DNA, 16 bp, Artificial Sequence
  synthetic [barcode part1]
cgttgcgtgatatcag

SEQ ID NO: 290 - DNA, 16 bp, Artificial Sequence
  synthetic [barcode part1]
agtccagactagacct

SEQ ID NO: 291 - DNA, 16 bp, Artificial Sequence
  synthetic [barcode part1]
gacttaagtgtggagt

SEQ ID NO: 292 - DNA, 16 bp, Artificial Sequence
  synthetic [barcode part1]
cacgtaatagacctgc

SEQ ID NO: 293 - DNA, 16 bp, Artificial Sequence
  synthetic [barcode part1]
acgaggaccagattgc

SEQ ID NO: 294 - DNA, 16 bp, Artificial Sequence
  synthetic [barcode part1]
gatccttaggacggtt

SEQ ID NO: 295 - DNA, 16 bp, Artificial Sequence
  synthetic [barcode part1]
caaggtgatccttcag

SEQ ID NO: 296 - DNA, 16 bp, Artificial Sequence
  synthetic [barcode part1]
gtgcgaacctgtattg

SEQ ID NO: 297 - DNA, 16 bp, Artificial Sequence
  synthetic [barcode part1]
tctcgcgcagtagtct

SEQ ID NO: 298 - DNA, 16 bp, Artificial Sequence
  synthetic [barcode part1]
tcttctactcgtagag

SEQ ID NO: 299 - DNA, 16 bp, Artificial Sequence
  synthetic [barcode part1]
gaatcgccttatacct

SEQ ID NO: 300 - DNA, 16 bp, Artificial Sequence
  synthetic [barcode part1]
agagtgactcgtcgtt

SEQ ID NO: 301 - DNA, 16 bp, Artificial Sequence
  synthetic [barcode part1]
aggtgagattccggac

SEQ ID NO: 302 - DNA, 16 bp, Artificial Sequence
  synthetic [barcode part1]
aactcactcgtaggtg

SEQ ID NO: 303 - DNA, 16 bp, Artificial Sequence
  synthetic [barcode part1]
tgagtgcgttactctt

SEQ ID NO: 304 - DNA, 16 bp, Artificial Sequence
  synthetic [barcode part1]
tgtactgactggtacg

SEQ ID NO: 305 - DNA, 16 bp, Artificial Sequence
  synthetic [barcode part1]
gtatcacttcggagtg

SEQ ID NO: 306 - DNA, 16 bp, Artificial Sequence
  synthetic [barcode part1]
aacgacttcttcacac

SEQ ID NO: 307 - DNA, 16 bp, Artificial Sequence
  synthetic [barcode part1]
tagatcggtcactgac

SEQ ID NO: 308 - DNA, 16 bp, Artificial Sequence
  synthetic [barcode part1]
caggttaccttgcacc

SEQ ID NO: 309 - DNA, 16 bp, Artificial Sequence
  synthetic [barcode part1]
acaaccgatacgtcgt

SEQ ID NO: 310 - DNA, 16 bp, Artificial Sequence
  synthetic [barcode part1]
acgagtcgatcacact

SEQ ID NO: 311 - DNA, 16 bp, Artificial Sequence
  synthetic [barcode part1]
taccactaacacacct

SEQ ID NO: 312 - DNA, 16 bp, Artificial Sequence
  synthetic [barcode part1]
ccaagacttgtctgtt

SEQ ID NO: 313 - DNA, 16 bp, Artificial Sequence
  synthetic [barcode part1]
tcacagtacgttgcag

SEQ ID NO: 314 - DNA, 16 bp, Artificial Sequence
  synthetic [barcode part1]
tatcggtcaatcgcag

SEQ ID NO: 315 - DNA, 16 bp, Artificial Sequence
  synthetic [barcode part1]
cgtctctatacaggag

SEQ ID NO: 316 - DNA, 16 bp, Artificial Sequence
  synthetic [barcode part1]
cgagtagtgttcgttg

SEQ ID NO: 317 - DNA, 16 bp, Artificial Sequence
  synthetic [barcode part1]
cgtgcgtattgtagtg

SEQ ID NO: 318 - DNA, 16 bp, Artificial Sequence
  synthetic [barcode part1]
gtcacgacaagactct

SEQ ID NO: 319 - DNA, 16 bp, Artificial Sequence
  synthetic [barcode part1]
gttgatcctaggatcg

SEQ ID NO: 320 - DNA, 16 bp, Artificial Sequence
  synthetic [barcode part1]
ttcaccggattcacgc

SEQ ID NO: 321 - DNA, 16 bp, Artificial Sequence
  synthetic [barcode part1]
tctaccgtagttcctc

SEQ ID NO: 322 - DNA, 16 bp, Artificial Sequence
  synthetic [barcode part1]
aggtctgtctggtcct

SEQ ID NO: 323 - DNA, 16 bp, Artificial Sequence
  synthetic [barcode part1]
taggaggagaactgac

SEQ ID NO: 324 - DNA, 16 bp, Artificial Sequence
  synthetic [barcode part1]
tagtcgttaccggtag

SEQ ID NO: 325 - DNA, 16 bp, Artificial Sequence
  synthetic [barcode part1]
gatatcactggtcggt

SEQ ID NO: 326 - DNA, 16 bp, Artificial Sequence
  synthetic [barcode part1]
gacgtactcaggaggt

SEQ ID NO: 327 - DNA, 16 bp, Artificial Sequence
  synthetic [barcode part1]
ttcgagtgtagtcgtg

SEQ ID NO: 328 - DNA, 16 bp, Artificial Sequence
  synthetic [barcode part1]
agacctagtctctcgc

SEQ ID NO: 329 - DNA, 16 bp, Artificial Sequence
  synthetic [barcode part1]
gactctcgagaatcac

SEQ ID NO: 330 - DNA, 16 bp, Artificial Sequence
  synthetic [barcode part1]
ccaacttagtgacggt

SEQ ID NO: 331 - DNA, 16 bp, Artificial Sequence
  synthetic [barcode part1]
tctcttcaggagagac

SEQ ID NO: 332 - DNA, 16 bp, Artificial Sequence
  synthetic [barcode part1]
atccaccggcgttatc

SEQ ID NO: 333 - DNA, 16 bp, Artificial Sequence
  synthetic [barcode part1]
cagactggatccaact

SEQ ID NO: 334 - DNA, 16 bp, Artificial Sequence
  synthetic [barcode part1]
tcactaggatcgtcag

SEQ ID NO: 335 - DNA, 16 bp, Artificial Sequence
  synthetic [barcode part1]
gaccggttagtattgc

SEQ ID NO: 336 - DNA, 16 bp, Artificial Sequence
  synthetic [barcode part1]
gaatcctgagaaggag

SEQ ID NO: 337 - DNA, 16 bp, Artificial Sequence
  synthetic [barcode part1]
ccgttcgtccagagtt

SEQ ID NO: 338 - DNA, 16 bp, Artificial Sequence
  synthetic [barcode part1]
agtaccgcgtggtatt

SEQ ID NO: 339 - DNA, 16 bp, Artificial Sequence
  synthetic [barcode part1]
tcctcctcttcagagt

SEQ ID NO: 340 - DNA, 16 bp, Artificial Sequence
  synthetic [barcode part1]
tctctctagaggagac

SEQ ID NO: 341 - DNA, 16 bp, Artificial Sequence
  synthetic [barcode part1]
agtgatctcgacagtc

SEQ ID NO: 342 - DNA, 16 bp, Artificial Sequence
  synthetic [barcode part1]
gagagtggtaggaatc

SEQ ID NO: 343 - DNA, 16 bp, Artificial Sequence
  synthetic [barcode part1]
cacgttcctactggac

SEQ ID NO: 344 - DNA, 16 bp, Artificial Sequence
  synthetic [barcode part1]
gtggagaccagactac

SEQ ID NO: 345 - DNA, 16 bp, Artificial Sequence
  synthetic [barcode part1]
gcggaagtcggcaatt

SEQ ID NO: 346 - DNA, 16 bp, Artificial Sequence
  synthetic [barcode part1]
gccagtgatctctcac

SEQ ID NO: 347 - DNA, 16 bp, Artificial Sequence
  synthetic [barcode part1]
gtggccagattcttcc

SEQ ID NO: 348 - DNA, 16 bp, Artificial Sequence
  synthetic [barcode part1]
aagacagtgaggcagt

SEQ ID NO: 349 - DNA, 16 bp, Artificial Sequence
  synthetic [barcode part1]
tgttgttagacactcc

SEQ ID NO: 350 - DNA, 16 bp, Artificial Sequence
  synthetic [barcode part1]
tacagatacctcgtct

SEQ ID NO: 351 - DNA, 16 bp, Artificial Sequence
  synthetic [barcode part1]
ccagatactcactgcc

SEQ ID NO: 352 - DNA, 16 bp, Artificial Sequence
  synthetic [barcode part1]
gccgacaatctaagtc

SEQ ID NO: 353 - DNA, 16 bp, Artificial Sequence
  synthetic [barcode part1]
aagttgcacaactcgc

SEQ ID NO: 354 - DNA, 16 bp, Artificial Sequence
  synthetic [barcode part1]
gatagaggaccgcact

SEQ ID NO: 355 - DNA, 16 bp, Artificial Sequence
  synthetic [barcode part1]
gtggaccgagacaatc

SEQ ID NO: 356 - DNA, 16 bp, Artificial Sequence
  synthetic [barcode part1]
gtacggtccgattcct

SEQ ID NO: 357 - DNA, 16 bp, Artificial Sequence
  synthetic [barcode part1]
ttcgaccgtcggtatc

SEQ ID NO: 358 - DNA, 16 bp, Artificial Sequence
  synthetic [barcode part1]
cacaagtaacaagacc

SEQ ID NO: 359 - DNA, 16 bp, Artificial Sequence
  synthetic [barcode part1]
tctaacctgtggttgt

SEQ ID NO: 360 - DNA, 16 bp, Artificial Sequence
  synthetic [barcode part1]
gtgacgaagtggtaag

SEQ ID NO: 361 - DNA, 16 bp, Artificial Sequence
  synthetic [barcode part1]
acgtacaattggtcgc

SEQ ID NO: 362 - DNA, 16 bp, Artificial Sequence
  synthetic [barcode part1]
atcactgtacgcctcg

SEQ ID NO: 363 - DNA, 16 bp, Artificial Sequence
  synthetic [barcode part1]
tggcgatcgatctagt

SEQ ID NO: 364 - DNA, 16 bp, Artificial Sequence
  synthetic [barcode part1]
caggtcgtctctgtac

SEQ ID NO: 365 - DNA, 16 bp, Artificial Sequence
  synthetic [barcode part1]
ccgtaatacacgtacg

SEQ ID NO: 366 - DNA, 16 bp, Artificial Sequence
  synthetic [barcode part1]
tcgcctgtactgtggt

SEQ ID NO: 367 - DNA, 16 bp, Artificial Sequence
  synthetic [barcode part1]
cctcttcaatctcggt

SEQ ID NO: 368 - DNA, 16 bp, Artificial Sequence
  synthetic [barcode part1]
aagttccagttccgag

SEQ ID NO: 369 - DNA, 16 bp, Artificial Sequence
  synthetic [barcode part1]
ttcgatctacgcaact

SEQ ID NO: 370 - DNA, 16 bp, Artificial Sequence
  synthetic [barcode part1]
gcacaacacgtcaact

SEQ ID NO: 371 - DNA, 16 bp, Artificial Sequence
  synthetic [barcode part1]
gagactgacacgactg

SEQ ID NO: 372 - DNA, 16 bp, Artificial Sequence
  synthetic [barcode part1]
tagacgcacgcaactt

SEQ ID NO: 373 - DNA, 16 bp, Artificial Sequence
  synthetic [barcode part1]
agtgccaatcacggtt

SEQ ID NO: 374 - DNA, 16 bp, Artificial Sequence
  synthetic [barcode part1]
agtcctcttctatcgc

SEQ ID NO: 375 - DNA, 16 bp, Artificial Sequence
  synthetic [barcode part1]
taggtgtgatcacgtc

SEQ ID NO: 376 - DNA, 16 bp, Artificial Sequence
  synthetic [barcode part1]
cgaatcagaccgttac

SEQ ID NO: 377 - DNA, 16 bp, Artificial Sequence
  synthetic [barcode part1]
tcaccgcgtcttatct

SEQ ID NO: 378 - DNA, 16 bp, Artificial Sequence
  synthetic [barcode part1]
gcgatattgtggtgtc

SEQ ID NO: 379 - DNA, 16 bp, Artificial Sequence
  synthetic [barcode part1]
cagtataaccactcct

SEQ ID NO: 380 - DNA, 16 bp, Artificial Sequence
  synthetic [barcode part1]
tacgcaaggcggtaac

SEQ ID NO: 381 - DNA, 16 bp, Artificial Sequence
  synthetic [barcode part1]
gatcgtacaactgtgc

SEQ ID NO: 382 - DNA, 16 bp, Artificial Sequence
  synthetic [barcode part1]
atcgcgcaattcgtag

SEQ ID NO: 383 - DNA, 16 bp, Artificial Sequence
  synthetic [barcode part1]
aagaccgcaattcctg

SEQ ID NO: 384 - DNA, 16 bp, Artificial Sequence
  synthetic [barcode part1]
gacgaagtagttcctc

SEQ ID NO: 385 - DNA, 16 bp, Artificial Sequence
  synthetic [barcode part1]
aatagttccttgcgtc

SEQ ID NO: 386 - DNA, 16 bp, Artificial Sequence
  synthetic [barcode part1]
gtggaacagtgaagtg

SEQ ID NO: 387 - DNA, 16 bp, Artificial Sequence
  synthetic [barcode part1]
ccaaggtcctgaagtt

SEQ ID NO: 388 - DNA, 16 bp, Artificial Sequence
  synthetic [barcode part1]
gacgttatcaactggc

SEQ ID NO: 389 - DNA, 16 bp, Artificial Sequence
  synthetic [barcode part1]
atattggcctcgttgt

SEQ ID NO: 390 - DNA, 16 bp, Artificial Sequence
  synthetic [barcode part1]
cagaccaaccaagtct

SEQ ID NO: 391 - DNA, 16 bp, Artificial Sequence
  synthetic [barcode part1]
gacttaagaggcgcgt

SEQ ID NO: 392 - DNA, 16 bp, Artificial Sequence
  synthetic [barcode part1]
atccacctctattcgc

SEQ ID NO: 393 - DNA, 16 bp, Artificial Sequence
  synthetic [barcode part1]
ttaactcaggcacttc

SEQ ID NO: 394 - DNA, 16 bp, Artificial Sequence
  synthetic [barcode part1]
gcagacttgacctcct

SEQ ID NO: 395 - DNA, 16 bp, Artificial Sequence
  synthetic [barcode part1]
gaacctaatcctctac

SEQ ID NO: 396 - DNA, 16 bp, Artificial Sequence
  synthetic [barcode part1]
agtcgtgccgatcctt

SEQ ID NO: 397 - DNA, 16 bp, Artificial Sequence
  synthetic [barcode part1]
tgatcgtcttgattcg

SEQ ID NO: 398 - DNA, 16 bp, Artificial Sequence
  synthetic [barcode part1]
gattcaaccttcacgt

SEQ ID NO: 399 - DNA, 16 bp, Artificial Sequence
  synthetic [barcode part1]
acaactctgaactgcg

SEQ ID NO: 400 - DNA, 16 bp, Artificial Sequence
  synthetic [barcode part1]
gcactgagtgtgatct

SEQ ID NO: 401 - DNA, 16 bp, Artificial Sequence
  synthetic [barcode part1]
tcagatatccaggcgt

SEQ ID NO: 402 - DNA, 16 bp, Artificial Sequence
  synthetic [barcode part1]
gttggagatcggtgtg

SEQ ID NO: 403 - DNA, 16 bp, Artificial Sequence
  synthetic [barcode part1]
ttcctgacaactgtgt

SEQ ID NO: 404 - DNA, 16 bp, Artificial Sequence
  synthetic [barcode part1]
caacggcacacagaac

SEQ ID NO: 405 - DNA, 16 bp, Artificial Sequence
  synthetic [barcode part1]
tggtgataactcgacc

SEQ ID NO: 406 - DNA, 16 bp, Artificial Sequence
  synthetic [barcode part1]
cggtgacacactcttc

SEQ ID NO: 407 - DNA, 16 bp, Artificial Sequence
  synthetic [barcode part1]
ttccagtccaacgcgt

SEQ ID NO: 408 - DNA, 16 bp, Artificial Sequence
  synthetic [barcode part1]
taggatctgacgtcac

SEQ ID NO: 409 - DNA, 16 bp, Artificial Sequence
  synthetic [barcode part1]
attgcgagataccgtc

SEQ ID NO: 410 - DNA, 16 bp, Artificial Sequence
  synthetic [barcode part1]
cagtagtgtgcaggac

SEQ ID NO: 411 - DNA, 16 bp, Artificial Sequence
  synthetic [barcode part1]
taagatcgaggcctct

SEQ ID NO: 412 - DNA, 16 bp, Artificial Sequence
  synthetic [barcode part1]
gaactcaacctcttac

SEQ ID NO: 413 - DNA, 16 bp, Artificial Sequence
  synthetic [barcode part1]
tcctcgtgaattgttg

SEQ ID NO: 414 - DNA, 16 bp, Artificial Sequence
  synthetic [barcode part1]
aacgttgattacggcc

SEQ ID NO: 415 - DNA, 16 bp, Artificial Sequence
  synthetic [barcode part1]
cggtatagatctgtgc

SEQ ID NO: 416 - DNA, 16 bp, Artificial Sequence
  synthetic [barcode part1]
atccaggacggatctt

SEQ ID NO: 417 - DNA, 16 bp, Artificial Sequence
  synthetic [barcode part1]
aggtcagtcgaagaag

SEQ ID NO: 418 - DNA, 16 bp, Artificial Sequence
  synthetic [barcode part1]
ttctggccgtgaatcc

SEQ ID NO: 419 - DNA, 16 bp, Artificial Sequence
  synthetic [barcode part1]
ttgaggccgttacagt

SEQ ID NO: 420 - DNA, 16 bp, Artificial Sequence
  synthetic [barcode part1]
tatctcaaggcgacac

SEQ ID NO: 421 - DNA, 16 bp, Artificial Sequence
  synthetic [barcode part1]
cacgaccactagagag

SEQ ID NO: 422 - DNA, 16 bp, Artificial Sequence
  synthetic [barcode part1]
cgtgtccaggtcactt

SEQ ID NO: 423 - DNA, 16 bp, Artificial Sequence
  synthetic [barcode part1]
caacacagtgttcgac

SEQ ID NO: 424 - DNA, 16 bp, Artificial Sequence
  synthetic [barcode part1]
gtccggtagttatcag

SEQ ID NO: 425 - DNA, 16 bp, Artificial Sequence
  synthetic [barcode part1]
tgttcttctgacggcg

SEQ ID NO: 426 - DNA, 16 bp, Artificial Sequence
  synthetic [barcode part1]
ttctaactgtactggc

SEQ ID NO: 427 - DNA, 16 bp, Artificial Sequence
  synthetic [barcode part1]
acctcacagatacttc

SEQ ID NO: 428 - DNA, 16 bp, Artificial Sequence
  synthetic [barcode part1]
tccgccgtatagatcc

SEQ ID NO: 429 - DNA, 16 bp, Artificial Sequence
  synthetic [barcode part1]
tctccttgagatctcc

SEQ ID NO: 430 - DNA, 16 bp, Artificial Sequence
  synthetic [barcode part1]
gtcgtatacgcagttg

SEQ ID NO: 431 - DNA, 16 bp, Artificial Sequence
  synthetic [barcode part1]
ttcgccagattcgtgc

SEQ ID NO: 432 - DNA, 16 bp, Artificial Sequence
  synthetic [barcode part1]
actctcctgactgcag

SEQ ID NO: 433 - DNA, 16 bp, Artificial Sequence
  synthetic [barcode part1]
agtgtgtcagtacgtc

SEQ ID NO: 434 - DNA, 16 bp, Artificial Sequence
  synthetic [barcode part1]
tccaccggattgcact

SEQ ID NO: 435 - DNA, 16 bp, Artificial Sequence
  synthetic [barcode part1]
taatcaggactggcct

SEQ ID NO: 436 - DNA, 16 bp, Artificial Sequence
  synthetic [barcode part1]
gttcctgacgagaatc

SEQ ID NO: 437 - DNA, 16 bp, Artificial Sequence
  synthetic [barcode part1]
tgtggcgtgttcgttc

SEQ ID NO: 438 - DNA, 16 bp, Artificial Sequence
  synthetic [barcode part1]
ttgcagtgacttcgag

SEQ ID NO: 439 - DNA, 16 bp, Artificial Sequence
  synthetic [barcode part1]
gtcaggtggatacggt

SEQ ID NO: 440 - DNA, 16 bp, Artificial Sequence
  synthetic [barcode part1]
tcggatatctggacac

SEQ ID NO: 441 - DNA, 16 bp, Artificial Sequence
  synthetic [barcode part1]
ttgtcgcaatatccac

SEQ ID NO: 442 - DNA, 16 bp, Artificial Sequence
  synthetic [barcode part1]
atcacagtccgttcgc

SEQ ID NO: 443 - DNA, 16 bp, Artificial Sequence
  synthetic [barcode part1]
acgacacgatcagtct

SEQ ID NO: 444 - DNA, 16 bp, Artificial Sequence
  synthetic [barcode part1]
acgcaagttactagag

SEQ ID NO: 445 - DNA, 16 bp, Artificial Sequence
  synthetic [barcode part1]
tagaccaggttatcgc

SEQ ID NO: 446 - DNA, 16 bp, Artificial Sequence
  synthetic [barcode part1]
cgtacaggagtgtctt

SEQ ID NO: 447 - DNA, 16 bp, Artificial Sequence
  synthetic [barcode part1]
gtggcgtgttaactac

SEQ ID NO: 448 - DNA, 16 bp, Artificial Sequence
  synthetic [barcode part1]
aatacgcaatcaggac

SEQ ID NO: 449 - DNA, 16 bp, Artificial Sequence
  synthetic [barcode part1]
cgtacgagaaccaggt

SEQ ID NO: 450 - DNA, 16 bp, Artificial Sequence
  synthetic [barcode part1]
acgttgagattgcgtc

SEQ ID NO: 451 - DNA, 16 bp, Artificial Sequence
  synthetic [barcode part1]
cgaatcaggaacgcac

SEQ ID NO: 452 - DNA, 16 bp, Artificial Sequence
  synthetic [barcode part1]
attgcggcctgtctgt

SEQ ID NO: 453 - DNA, 16 bp, Artificial Sequence
  synthetic [barcode part1]
gtgtaggtccggtaag

SEQ ID NO: 454 - DNA, 16 bp, Artificial Sequence
  synthetic [barcode part1]
gagaaccggagaattg

SEQ ID NO: 455 - DNA, 16 bp, Artificial Sequence
  synthetic [barcode part1]
ccgagatcttgagact

SEQ ID NO: 456 - DNA, 16 bp, Artificial Sequence
  synthetic [barcode part1]
gaggacacaagttatc

SEQ ID NO: 457 - DNA, 16 bp, Artificial Sequence
  synthetic [barcode part1]
gtataactctctcggt

SEQ ID NO: 458 - DNA, 16 bp, Artificial Sequence
  synthetic [barcode part1]
tagactatcggaccgt

SEQ ID NO: 459 - DNA, 16 bp, Artificial Sequence
  synthetic [barcode part1]
tctaccgcgtgaactc

SEQ ID NO: 460 - DNA, 16 bp, Artificial Sequence
  synthetic [barcode part1]
cggatacagagtaact

SEQ ID NO: 461 - DNA, 16 bp, Artificial Sequence
  synthetic [barcode part1]
acctcgcacgactact

SEQ ID NO: 462 - DNA, 16 bp, Artificial Sequence
  synthetic [barcode part1]
acaggttgactcacac

SEQ ID NO: 463 - DNA, 16 bp, Artificial Sequence
  synthetic [barcode part1]
caataactcggaccgt

SEQ ID NO: 464 - DNA, 16 bp, Artificial Sequence
  synthetic [barcode part1]
gacaatatccgtcacg

SEQ ID NO: 465 - DNA, 16 bp, Artificial Sequence
  synthetic [barcode part1]
gaacgtccgtcgttct

SEQ ID NO: 466 - DNA, 16 bp, Artificial Sequence
  synthetic [barcode part1]
gtctaggtcgccttgt

SEQ ID NO: 467 - DNA, 16 bp, Artificial Sequence
  synthetic [barcode part1]
tcttacgcaacgactt

SEQ ID NO: 468 - DNA, 16 bp, Artificial Sequence
  synthetic [barcode part1]
gagtgacttggcacag

SEQ ID NO: 469 - DNA, 16 bp, Artificial Sequence
  synthetic [barcode part1]
ccaatcctcacgcaac

SEQ ID NO: 470 - DNA, 16 bp, Artificial Sequence
  synthetic [barcode part1]
cgagtgattgtagtag

SEQ ID NO: 471 - DNA, 16 bp, Artificial Sequence
  synthetic [barcode part1]
gaccagttggtcaact

SEQ ID NO: 472 - DNA, 16 bp, Artificial Sequence
  synthetic [barcode part1]
caatcacgaatcgaag

SEQ ID NO: 473 - DNA, 16 bp, Artificial Sequence
  synthetic [barcode part1]
gtcttgagtcgactag

SEQ ID NO: 474 - DNA, 16 bp, Artificial Sequence
  synthetic [barcode part1]
acggattgcgtgattc

SEQ ID NO: 475 - DNA, 16 bp, Artificial Sequence
  synthetic [barcode part1]
ttgtactcacctctgc

SEQ ID NO: 476 - DNA, 16 bp, Artificial Sequence
  synthetic [barcode part1]
gaatctaggcgtacct

SEQ ID NO: 477 - DNA, 16 bp, Artificial Sequence
  synthetic [barcode part1]
ccaacgaagtggtctt

SEQ ID NO: 478 - DNA, 16 bp, Artificial Sequence
  synthetic [barcode part1]
cgaacaggtcctagag

SEQ ID NO: 479 - DNA, 16 bp, Artificial Sequence
  synthetic [barcode part1]
ttactcgtgttacggt

SEQ ID NO: 480 - DNA, 16 bp, Artificial Sequence
  synthetic [barcode part1]
tccaccgactacttct

SEQ ID NO: 481 - DNA, 16 bp, Artificial Sequence
  synthetic [barcode part1]
acgtgttaacgtgtcg

SEQ ID NO: 482 - DNA, 16 bp, Artificial Sequence
  synthetic [barcode part1]
cgcggtgataggtagt

SEQ ID NO: 483 - DNA, 16 bp, Artificial Sequence
  synthetic [barcode part1]
gtgacaccagtcagtt

SEQ ID NO: 484 - DNA, 16 bp, Artificial Sequence
  synthetic [barcode part1]
gcctagattgcgaact

SEQ ID NO: 485 - DNA, 16 bp, Artificial Sequence
  synthetic [barcode part1]
tcgagatactcacttc

SEQ ID NO: 486 - DNA, 16 bp, Artificial Sequence
  synthetic [barcode part1]
acgtgtgtggtatcgt

SEQ ID NO: 487 - DNA, 16 bp, Artificial Sequence
  synthetic [barcode part1]
gcgaactactattcct

SEQ ID NO: 488 - DNA, 16 bp, Artificial Sequence
  synthetic [barcode part1]
gatccgagtgcaaggt

SEQ ID NO: 489 - DNA, 16 bp, Artificial Sequence
  synthetic [barcode part1]
agtcaacgtgtacacc

SEQ ID NO: 490 - DNA, 16 bp, Artificial Sequence
  synthetic [barcode part1]
tccttaactgacctcc

SEQ ID NO: 491 - DNA, 16 bp, Artificial Sequence
  synthetic [barcode part1]
tatcgttgtcttccgc

SEQ ID NO: 492 - DNA, 16 bp, Artificial Sequence
  synthetic [barcode part1]
ccaggacaagtgaacc

SEQ ID NO: 493 - DNA, 16 bp, Artificial Sequence
  synthetic [barcode part1]
actgaatacctccact

SEQ ID NO: 494 - DNA, 16 bp, Artificial Sequence
  synthetic [barcode part1]
aacgtgtgtgtgtcac

SEQ ID NO: 495 - DNA, 16 bp, Artificial Sequence
  synthetic [barcode part1]
tctacttgagtggacg

SEQ ID NO: 496 - DNA, 16 bp, Artificial Sequence
  synthetic [barcode part1]
cgacttcaaggagttc

SEQ ID NO: 497 - DNA, 16 bp, Artificial Sequence
  synthetic [barcode part1]
ttccacggacctgatc

SEQ ID NO: 498 - DNA, 16 bp, Artificial Sequence
  synthetic [barcode part1]
cggataccgacgaagt

SEQ ID NO: 499 - DNA, 16 bp, Artificial Sequence
  synthetic [barcode part1]
accggaatcaattccg

SEQ ID NO: 500 - DNA, 16 bp, Artificial Sequence
  synthetic [barcode part1]
agtgttctccaacttg

SEQ ID NO: 501 - DNA, 16 bp, Artificial Sequence
  synthetic [barcode part1]
acaccaacagtaagac

SEQ ID NO: 502 - DNA, 16 bp, Artificial Sequence
  synthetic [barcode part1]
ttaccttcggtccttg

SEQ ID NO: 503 - DNA, 16 bp, Artificial Sequence
  synthetic [barcode part1]
cacttcctcggatcag

SEQ ID NO: 504 - DNA, 16 bp, Artificial Sequence
  synthetic [barcode part1]
tcacagagagttgaac

SEQ ID NO: 505 - DNA, 16 bp, Artificial Sequence
  synthetic [barcode part1]
tctcgtgtacaaggac

SEQ ID NO: 506 - DNA, 16 bp, Artificial Sequence
  synthetic [barcode part1]
acgacacctagtcagt

SEQ ID NO: 507 - DNA, 16 bp, Artificial Sequence
  synthetic [barcode part1]
acaggaccacttggag

SEQ ID NO: 508 - DNA, 16 bp, Artificial Sequence
  synthetic [barcode part1]
tgaactctctgttacg

SEQ ID NO: 509 - DNA, 16 bp, Artificial Sequence
  synthetic [barcode part1]
gcaaggtagtgtccag

SEQ ID NO: 510 - DNA, 16 bp, Artificial Sequence
  synthetic [barcode part1]
tctccagatactagtc

SEQ ID NO: 511 - DNA, 16 bp, Artificial Sequence
  synthetic [barcode part1]
gactctaatctactcg

SEQ ID NO: 512 - DNA, 16 bp, Artificial Sequence
  synthetic [barcode part1]
ttcgattgaagtcggc

SEQ ID NO: 513 - DNA, 16 bp, Artificial Sequence
  synthetic [barcode part1]
ccgtgaactactactt

SEQ ID NO: 514 - DNA, 16 bp, Artificial Sequence
  synthetic [barcode part1]
ttgacgaaggtgtggc

SEQ ID NO: 515 - DNA, 16 bp, Artificial Sequence
  synthetic [barcode part1]
tagtcctacgcgtcgt

SEQ ID NO: 516 - DNA, 16 bp, Artificial Sequence
  synthetic [barcode part1]
gtcggataggtcactt

SEQ ID NO: 517 - DNA, 16 bp, Artificial Sequence
  synthetic [barcode part1]
cgttcaccttggaacc

SEQ ID NO: 518 - DNA, 16 bp, Artificial Sequence
  synthetic [barcode part1]
gacttggtcaggttgt

SEQ ID NO: 519 - DNA, 16 bp, Artificial Sequence
  synthetic [barcode part1]
aggagtctatagtcag

SEQ ID NO: 520 - DNA, 16 bp, Artificial Sequence
  synthetic [barcode part1]
aactcgtgaatctgcg

SEQ ID NO: 521 - DNA, 16 bp, Artificial Sequence
  synthetic [barcode part1]
gtgttacctatccgcg

SEQ ID NO: 522 - DNA, 16 bp, Artificial Sequence
  synthetic [barcode part1]
agtagaagtgttcgac

SEQ ID NO: 523 - DNA, 16 bp, Artificial Sequence
  synthetic [barcode part1]
gtccgttgatactgcc

SEQ ID NO: 524 - DNA, 16 bp, Artificial Sequence
  synthetic [barcode part1]
gaacgacgagaatcag

SEQ ID NO: 525 - DNA, 16 bp, Artificial Sequence
  synthetic [barcode part1]
ccaagtagacgagacc

SEQ ID NO: 526 - DNA, 16 bp, Artificial Sequence
  synthetic [barcode part1]
tgttgagttacactcc

SEQ ID NO: 527 - DNA, 16 bp, Artificial Sequence
  synthetic [barcode part1]
tgtgtcagtacgtcag

SEQ ID NO: 528 - DNA, 16 bp, Artificial Sequence
  synthetic [barcode part1]
cgtgtctagattatcc

SEQ ID NO: 529 - DNA, 16 bp, Artificial Sequence
  synthetic [barcode part1]
cgtagaccaagacggt

SEQ ID NO: 530 - DNA, 16 bp, Artificial Sequence
  synthetic [barcode part1]
gcacaccttgtcactg

SEQ ID NO: 531 - DNA, 16 bp, Artificial Sequence
  synthetic [barcode part1]
tagacacgtcagaggc

SEQ ID NO: 532 - DNA, 16 bp, Artificial Sequence
  synthetic [barcode part1]
agtcgaccggtattgt

SEQ ID NO: 533 - DNA, 16 bp, Artificial Sequence
  synthetic [barcode part1]
cacctatcgaacaggt

SEQ ID NO: 534 - DNA, 16 bp, Artificial Sequence
  synthetic [barcode part1]
gttacaccacaccaag

SEQ ID NO: 535 - DNA, 16 bp, Artificial Sequence
  synthetic [barcode part1]
cagtcggtagtatcac

SEQ ID NO: 536 - DNA, 16 bp, Artificial Sequence
  synthetic [barcode part1]
aaggcctaatagacgt

SEQ ID NO: 537 - DNA, 16 bp, Artificial Sequence
  synthetic [barcode part1]
tctaccgatactcggc

SEQ ID NO: 538 - DNA, 16 bp, Artificial Sequence
  synthetic [barcode part1]
acggtatagttggtcc

SEQ ID NO: 539 - DNA, 16 bp, Artificial Sequence
  synthetic [barcode part1]
caagtcggagagtatt

SEQ ID NO: 540 - DNA, 16 bp, Artificial Sequence
  synthetic [barcode part1]
ttaagaggattgcacg

SEQ ID NO: 541 - DNA, 16 bp, Artificial Sequence
  synthetic [barcode part1]
gagtacctcacctcgt

SEQ ID NO: 542 - DNA, 16 bp, Artificial Sequence
  synthetic [barcode part1]
cagttgatacaacgcc

SEQ ID NO: 543 - DNA, 16 bp, Artificial Sequence
  synthetic [barcode part1]
ccggatctcgaattag

SEQ ID NO: 544 - DNA, 16 bp, Artificial Sequence
  synthetic [barcode part1]
taggtgtgtgtgactc

SEQ ID NO: 545 - DNA, 16 bp, Artificial Sequence
  synthetic [barcode part1]
cctgacttataaccac

SEQ ID NO: 546 - DNA, 16 bp, Artificial Sequence
  synthetic [barcode part1]
gtacgataccaacgtc

SEQ ID NO: 547 - DNA, 16 bp, Artificial Sequence
  synthetic [barcode part1]
taccactcgccttgtt

SEQ ID NO: 548 - DNA, 16 bp, Artificial Sequence
  synthetic [barcode part1]
agatattggacaacgc

SEQ ID NO: 549 - DNA, 16 bp, Artificial Sequence
  synthetic [barcode part1]
cactatcaacgacggt

SEQ ID NO: 550 - DNA, 16 bp, Artificial Sequence
  synthetic [barcode part1]
atccaaggtgaactcc

SEQ ID NO: 551 - DNA, 16 bp, Artificial Sequence
  synthetic [barcode part1]
ccgcaactaataccag

SEQ ID NO: 552 - DNA, 16 bp, Artificial Sequence
  synthetic [barcode part1]
atccggataaggcggt

SEQ ID NO: 553 - DNA, 16 bp, Artificial Sequence
  synthetic [barcode part1]
gttcaccacagtattc

SEQ ID NO: 554 - DNA, 16 bp, Artificial Sequence
  synthetic [barcode part1]
tatcgcagtatcgcag

SEQ ID NO: 555 - DNA, 16 bp, Artificial Sequence
  synthetic [barcode part1]
caaggtcgccacaatt

SEQ ID NO: 556 - DNA, 16 bp, Artificial Sequence
  synthetic [barcode part1]
tagtacgtcgaacgtc

SEQ ID NO: 557 - DNA, 16 bp, Artificial Sequence
  synthetic [barcode part1]
cacaacaggtgttgtc

SEQ ID NO: 558 - DNA, 16 bp, Artificial Sequence
  synthetic [barcode part1]
cgaaggtctattagag

SEQ ID NO: 559 - DNA, 16 bp, Artificial Sequence
  synthetic [barcode part1]
tgtcctccgatagtcg

SEQ ID NO: 560 - DNA, 16 bp, Artificial Sequence
  synthetic [barcode part1]
agagattacgccgacg

SEQ ID NO: 561 - DNA, 16 bp, Artificial Sequence
  synthetic [barcode part1]
agactactccacgtcc

SEQ ID NO: 562 - DNA, 16 bp, Artificial Sequence
  synthetic [barcode part1]
gaactaacggtacgcg

SEQ ID NO: 563 - DNA, 16 bp, Artificial Sequence
  synthetic [barcode part1]
caacgccacaagtgag

SEQ ID NO: 564 - DNA, 16 bp, Artificial Sequence
  synthetic [barcode part1]
tcgttaggaaggcgtg

SEQ ID NO: 565 - DNA, 16 bp, Artificial Sequence
  synthetic [barcode part1]
gcaagtgcgaatagag

SEQ ID NO: 566 - DNA, 16 bp, Artificial Sequence
  synthetic [barcode part1]
ttcaccagaggatcgt

SEQ ID NO: 567 - DNA, 16 bp, Artificial Sequence
  synthetic [barcode part1]
accagttgaaggagag

SEQ ID NO: 568 - DNA, 16 bp, Artificial Sequence
  synthetic [barcode part1]
atcaacctcagagtcg

SEQ ID NO: 569 - DNA, 16 bp, Artificial Sequence
  synthetic [barcode part1]
acgtcaggtcaggagt

SEQ ID NO: 570 - DNA, 16 bp, Artificial Sequence
  synthetic [barcode part1]
ttacctgcaagatcct

SEQ ID NO: 571 - DNA, 16 bp, Artificial Sequence
  synthetic [barcode part1]
gtgtaggtgccaagtg

SEQ ID NO: 572 - DNA, 16 bp, Artificial Sequence
  synthetic [barcode part1]
agtaacacacttggag

SEQ ID NO: 573 - DNA, 16 bp, Artificial Sequence
  synthetic [barcode part1]
aatcggtcgacactac

SEQ ID NO: 574 - DNA, 16 bp, Artificial Sequence
  synthetic [barcode part1]
gtccgcaatacgattg

SEQ ID NO: 575 - DNA, 16 bp, Artificial Sequence
  synthetic [barcode part1]
ttatctgtccactcgc

SEQ ID NO: 576 - DNA, 16 bp, Artificial Sequence
  synthetic [barcode part1]
agattcggtaactgcc

SEQ ID NO: 577 - DNA, 16 bp, Artificial Sequence
  synthetic [barcode part1]
atctacttccgtccac

SEQ ID NO: 578 - DNA, 16 bp, Artificial Sequence
  synthetic [barcode part1]
gcgatcgcgatatatc

SEQ ID NO: 579 - DNA, 16 bp, Artificial Sequence
  synthetic [barcode part1]
taacctgcacctccag

SEQ ID NO: 580 - DNA, 16 bp, Artificial Sequence
  synthetic [barcode part1]
ccaacggttcgataac

SEQ ID NO: 581 - DNA, 16 bp, Artificial Sequence
  synthetic [barcode part1]
tgcgcacctaactaag

SEQ ID NO: 582 - DNA, 16 bp, Artificial Sequence
  synthetic [barcode part1]
tactggtagtctcttg

SEQ ID NO: 583 - DNA, 16 bp, Artificial Sequence
  synthetic [barcode part1]
gaaccacgcaagaatt

SEQ ID NO: 584 - DNA, 16 bp, Artificial Sequence
  synthetic [barcode part1]
taggtgtccaacacac

SEQ ID NO: 585 - DNA, 16 bp, Artificial Sequence
  synthetic [barcode part1]
gacggaattgatacac

SEQ ID NO: 586 - DNA, 16 bp, Artificial Sequence
  synthetic [barcode part1]
gtacttcgcgtctctt

SEQ ID NO: 587 - DNA, 16 bp, Artificial Sequence
  synthetic [barcode part1]
gaccaactgaccaact

SEQ ID NO: 588 - DNA, 16 bp, Artificial Sequence
  synthetic [barcode part1]
tctgcacgtattctcc

SEQ ID NO: 589 - DNA, 16 bp, Artificial Sequence
  synthetic [barcode part1]
caactactagagagtg

SEQ ID NO: 590 - DNA, 16 bp, Artificial Sequence
  synthetic [barcode part1]
ttccgtacacacctct

SEQ ID NO: 591 - DNA, 16 bp, Artificial Sequence
  synthetic [barcode part1]
ttgcaggtgtcctatt

SEQ ID NO: 592 - DNA, 16 bp, Artificial Sequence
  synthetic [barcode part1]
ttggtcttgtcaacgt

SEQ ID NO: 593 - DNA, 16 bp, Artificial Sequence
  synthetic [barcode part1]
tattcctgagaacgcg

SEQ ID NO: 594 - DNA, 16 bp, Artificial Sequence
  synthetic [barcode part1]
tcagagtaatagacgc

SEQ ID NO: 595 - DNA, 16 bp, Artificial Sequence
  synthetic [barcode part1]
gtgaactggtcgtatc

SEQ ID NO: 596 - DNA, 16 bp, Artificial Sequence
  synthetic [barcode part1]
tcagtcacaaccaacg

SEQ ID NO: 597 - DNA, 16 bp, Artificial Sequence
  synthetic [barcode part1]
aggcgaaccgtgatac

SEQ ID NO: 598 - DNA, 16 bp, Artificial Sequence
  synthetic [barcode part1]
gtacgagagattatcg

SEQ ID NO: 599 - DNA, 16 bp, Artificial Sequence
  synthetic [barcode part1]
gcacaacgaggtcagt

SEQ ID NO: 600 - DNA, 16 bp, Artificial Sequence
  synthetic [barcode part1]
gagatcggtgttcgag

SEQ ID NO: 601 - DNA, 16 bp, Artificial Sequence
  synthetic [barcode part1]
tctgaacagaccggag

SEQ ID NO: 602 - DNA, 16 bp, Artificial Sequence
  synthetic [barcode part1]
ttcctgcagtgacctg

SEQ ID NO: 603 - DNA, 16 bp, Artificial Sequence
  synthetic [barcode part1]
ttaagatcaggtggac

SEQ ID NO: 604 - DNA, 16 bp, Artificial Sequence
  synthetic [barcode part1]
cgcctacttcggaact

SEQ ID NO: 605 - DNA, 16 bp, Artificial Sequence
  synthetic [barcode part1]
gccggttctagaattg

SEQ ID NO: 606 - DNA, 16 bp, Artificial Sequence
  synthetic [barcode part1]
ttccgacctctcaatc

SEQ ID NO: 607 - DNA, 16 bp, Artificial Sequence
  synthetic [barcode part1]
actgtcaacacctccg

SEQ ID NO: 608 - DNA, 16 bp, Artificial Sequence
  synthetic [barcode part1]
acgttactacttgtcg

SEQ ID NO: 609 - DNA, 16 bp, Artificial Sequence
  synthetic [barcode part1]
ccaactatacaacgcg

SEQ ID NO: 610 - DNA, 16 bp, Artificial Sequence
  synthetic [barcode part1]
tccagtcaccaacgtc

SEQ ID NO: 611 - DNA, 16 bp, Artificial Sequence
  synthetic [barcode part1]
tgacttcgccacgtgt

SEQ ID NO: 612 - DNA, 16 bp, Artificial Sequence
  synthetic [barcode part1]
tgtagtggtagacaac

SEQ ID NO: 613 - DNA, 16 bp, Artificial Sequence
  synthetic [barcode part1]
aagaggtagacactct

SEQ ID NO: 614 - DNA, 16 bp, Artificial Sequence
  synthetic [barcode part1]
tagtccaccgcacttg

SEQ ID NO: 615 - DNA, 16 bp, Artificial Sequence
  synthetic [barcode part1]
ccacagaacgagacgt

SEQ ID NO: 616 - DNA, 16 bp, Artificial Sequence
  synthetic [barcode part1]
aagttcgtaaggagtc

SEQ ID NO: 617 - DNA, 16 bp, Artificial Sequence
  synthetic [barcode part1]
cctgaggatatcacac

SEQ ID NO: 618 - DNA, 16 bp, Artificial Sequence
  synthetic [barcode part1]
tcgtcgtctgttctac

SEQ ID NO: 619 - DNA, 16 bp, Artificial Sequence
  synthetic [barcode part1]
atacttatccgccgcg

SEQ ID NO: 620 - DNA, 16 bp, Artificial Sequence
  synthetic [barcode part1]
gcctactacttgtctc

SEQ ID NO: 621 - DNA, 16 bp, Artificial Sequence
  synthetic [barcode part1]
gacaatacagataccg

SEQ ID NO: 622 - DNA, 16 bp, Artificial Sequence
  synthetic [barcode part1]
aatcgtccgtcctcag

SEQ ID NO: 623 - DNA, 16 bp, Artificial Sequence
  synthetic [barcode part1]
cggtgaagatagagtg

SEQ ID NO: 624 - DNA, 16 bp, Artificial Sequence
  synthetic [barcode part1]
gttccgtgaacgtctc

SEQ ID NO: 625 - DNA, 16 bp, Artificial Sequence
  synthetic [barcode part1]
gtaattaatcggcgcc

SEQ ID NO: 626 - DNA, 16 bp, Artificial Sequence
  synthetic [barcode part1]
agtaagaagtcgtgtc

SEQ ID NO: 627 - DNA, 16 bp, Artificial Sequence
  synthetic [barcode part1]
gccgcggtacttattc

SEQ ID NO: 628 - DNA, 16 bp, Artificial Sequence
  synthetic [barcode part1]
gcgtccttacacttct

SEQ ID NO: 629 - DNA, 16 bp, Artificial Sequence
  synthetic [barcode part1]
gtaacggaacacgtcg

SEQ ID NO: 630 - DNA, 16 bp, Artificial Sequence
  synthetic [barcode part1]
acaccaggcacaactt

SEQ ID NO: 631 - DNA, 16 bp, Artificial Sequence
  synthetic [barcode part1]
acgataaggatcggag

SEQ ID NO: 632 - DNA, 16 bp, Artificial Sequence
  synthetic [barcode part1]
gtcgtagtatcgcagt

SEQ ID NO: 633 - DNA, 16 bp, Artificial Sequence
  synthetic [barcode part1]
cagtaggtgttactcg

SEQ ID NO: 634 - DNA, 16 bp, Artificial Sequence
  synthetic [barcode part1]
aagtattccgcaggtc

SEQ ID NO: 635 - DNA, 16 bp, Artificial Sequence
  synthetic [barcode part1]
gaggtgtccaacaacg

SEQ ID NO: 636 - DNA, 16 bp, Artificial Sequence
  synthetic [barcode part1]
tgaacgcctctgtcgt

SEQ ID NO: 637 - DNA, 16 bp, Artificial Sequence
  synthetic [barcode part1]
gttcgtctactgcgac

SEQ ID NO: 638 - DNA, 16 bp, Artificial Sequence
  synthetic [barcode part1]
atcgtacgtgtaaccg

SEQ ID NO: 639 - DNA, 16 bp, Artificial Sequence
  synthetic [barcode part1]
aacaatcgtgcaaggt

SEQ ID NO: 640 - DNA, 16 bp, Artificial Sequence
  synthetic [barcode part1]
cacacttcgtcaagtt

SEQ ID NO: 641 - DNA, 16 bp, Artificial Sequence
  synthetic [barcode part1]
agaagatcctataggc

SEQ ID NO: 642 - DNA, 16 bp, Artificial Sequence
  synthetic [barcode part1]
acacgcctaccaatag

SEQ ID NO: 643 - DNA, 16 bp, Artificial Sequence
  synthetic [barcode part1]
gactggttgaccaact

SEQ ID NO: 644 - DNA, 16 bp, Artificial Sequence
  synthetic [barcode part1]
agaggtctaacgcgtg

SEQ ID NO: 645 - DNA, 16 bp, Artificial Sequence
  synthetic [barcode part1]
aacactggttgtgacc

SEQ ID NO: 646 - DNA, 16 bp, Artificial Sequence
  synthetic [barcode part1]
attctcacctaacgac

SEQ ID NO: 647 - DNA, 16 bp, Artificial Sequence
  synthetic [barcode part1]
actcacagtacggttg

SEQ ID NO: 648 - DNA, 16 bp, Artificial Sequence
  synthetic [barcode part1]
tactaccaacacgtct

SEQ ID NO: 649 - DNA, 16 bp, Artificial Sequence
  synthetic [barcode part1]
aggacgacttagacgc

SEQ ID NO: 650 - DNA, 16 bp, Artificial Sequence
  synthetic [barcode part1]
tgcgcagtaagttcac

SEQ ID NO: 651 - DNA, 16 bp, Artificial Sequence
  synthetic [barcode part1]
gtctgcggaaggttag

SEQ ID NO: 652 - DNA, 16 bp, Artificial Sequence
  synthetic [barcode part1]
attagttcggttggcg

SEQ ID NO: 653 - DNA, 16 bp, Artificial Sequence
  synthetic [barcode part1]
tcgaacttccttacag

SEQ ID NO: 654 - DNA, 16 bp, Artificial Sequence
  synthetic [barcode part1]
tacagtgttactcgtc

SEQ ID NO: 655 - DNA, 16 bp, Artificial Sequence
  synthetic [barcode part1]
ccttattggtgaggtg

SEQ ID NO: 656 - DNA, 16 bp, Artificial Sequence
  synthetic [barcode part1]
gtctgtcttatagtgc

SEQ ID NO: 657 - DNA, 16 bp, Artificial Sequence
  synthetic [barcode part1]
atcagactcgcactcc

SEQ ID NO: 658 - DNA, 16 bp, Artificial Sequence
  synthetic [barcode part1]
actcggagtctgtagt

SEQ ID NO: 659 - DNA, 16 bp, Artificial Sequence
  synthetic [barcode part1]
tatacaacgttggcgc

SEQ ID NO: 660 - DNA, 16 bp, Artificial Sequence
  synthetic [barcode part1]
cgacaatccgaatcac

SEQ ID NO: 661 - DNA, 16 bp, Artificial Sequence
  synthetic [barcode part1]
tcgtctaagtgtcact

SEQ ID NO: 662 - DNA, 16 bp, Artificial Sequence
  synthetic [barcode part1]
tcggataacctgtgac

SEQ ID NO: 663 - DNA, 16 bp, Artificial Sequence
  synthetic [barcode part1]
gactccgataacactg

SEQ ID NO: 664 - DNA, 16 bp, Artificial Sequence
  synthetic [barcode part1]
acagttctaccgagtg

SEQ ID NO: 665 - DNA, 16 bp, Artificial Sequence
  synthetic [barcode part1]
gactgatagaggagac

SEQ ID NO: 666 - DNA, 16 bp, Artificial Sequence
  synthetic [barcode part1]
atagaggtcgacgatt

SEQ ID NO: 667 - DNA, 16 bp, Artificial Sequence
  synthetic [barcode part1]
taagacaccgtcgttg

SEQ ID NO: 668 - DNA, 16 bp, Artificial Sequence
  synthetic [barcode part1]
cggttcttacggttgc

SEQ ID NO: 669 - DNA, 16 bp, Artificial Sequence
  synthetic [barcode part1]
agaatccacggtatcc

SEQ ID NO: 670 - DNA, 16 bp, Artificial Sequence
  synthetic [barcode part1]
caaggaacgacgtatt

SEQ ID NO: 671 - DNA, 16 bp, Artificial Sequence
  synthetic [barcode part1]
cagtgaccagtagtct

SEQ ID NO: 672 - DNA, 16 bp, Artificial Sequence
  synthetic [barcode part1]
tacgtaacaggtccgt

SEQ ID NO: 673 - DNA, 16 bp, Artificial Sequence
  synthetic [barcode part1]
gattagaccgcgcaag

SEQ ID NO: 674 - DNA, 16 bp, Artificial Sequence
  synthetic [barcode part1]
gtcacttacgaacctt

SEQ ID NO: 675 - DNA, 16 bp, Artificial Sequence
  synthetic [barcode part1]
acagtggcactaatag

SEQ ID NO: 676 - DNA, 16 bp, Artificial Sequence
  synthetic [barcode part1]
gactgttgaactgtcg

SEQ ID NO: 677 - DNA, 16 bp, Artificial Sequence
  synthetic [barcode part1]
tgacacgtgattctct

SEQ ID NO: 678 - DNA, 16 bp, Artificial Sequence
  synthetic [barcode part1]
tcggaagtagtaggag

SEQ ID NO: 679 - DNA, 16 bp, Artificial Sequence
  synthetic [barcode part1]
ttattgagtgcctctg

SEQ ID NO: 680 - DNA, 16 bp, Artificial Sequence
  synthetic [barcode part1]
gcacacgtagttgatc

SEQ ID NO: 681 - DNA, 16 bp, Artificial Sequence
  synthetic [barcode part1]
tacactggttggtacg

SEQ ID NO: 682 - DNA, 16 bp, Artificial Sequence
  synthetic [barcode part1]
ttagtgcaaggttgag

SEQ ID NO: 683 - DNA, 16 bp, Artificial Sequence
  synthetic [barcode part1]
gattgcacgatacgtc

SEQ ID NO: 684 - DNA, 16 bp, Artificial Sequence
  synthetic [barcode part1]
cctgcgtaatccaatt

SEQ ID NO: 685 - DNA, 16 bp, Artificial Sequence
  synthetic [barcode part1]
aataaggccaggtgcc

SEQ ID NO: 686 - DNA, 16 bp, Artificial Sequence
  synthetic [barcode part1]
gttgtgactcgaagtc

SEQ ID NO: 687 - DNA, 16 bp, Artificial Sequence
  synthetic [barcode part1]
tgtgatcagtccgtag

SEQ ID NO: 688 - DNA, 16 bp, Artificial Sequence
  synthetic [barcode part1]
gattgatcgcacgtgt

SEQ ID NO: 689 - DNA, 16 bp, Artificial Sequence
  synthetic [barcode part1]
gtggtacgtacgtact

SEQ ID NO: 690 - DNA, 16 bp, Artificial Sequence
  synthetic [barcode part1]
tcgataggcagagacc

SEQ ID NO: 691 - DNA, 16 bp, Artificial Sequence
  synthetic [barcode part1]
gactgtactctaatcc

SEQ ID NO: 692 - DNA, 16 bp, Artificial Sequence
  synthetic [barcode part1]
tccttcgatccagacg

SEQ ID NO: 693 - DNA, 16 bp, Artificial Sequence
  synthetic [barcode part1]
cactagtctaaccttg

SEQ ID NO: 694 - DNA, 16 bp, Artificial Sequence
  synthetic [barcode part1]
tctgcgcagaagtgtt

SEQ ID NO: 695 - DNA, 16 bp, Artificial Sequence
  synthetic [barcode part1]
cgaggtccaatactac

SEQ ID NO: 696 - DNA, 16 bp, Artificial Sequence
  synthetic [barcode part1]
tctcgcaagttatcac

SEQ ID NO: 697 - DNA, 16 bp, Artificial Sequence
  synthetic [barcode part1]
acggccgtcttagtct

SEQ ID NO: 698 - DNA, 16 bp, Artificial Sequence
  synthetic [barcode part1]
atccagaggatagtac

SEQ ID NO: 699 - DNA, 16 bp, Artificial Sequence
  synthetic [barcode part1]
cctaagatcgagactc

SEQ ID NO: 700 - DNA, 16 bp, Artificial Sequence
  synthetic [barcode part1]
gcctgaactacgagtt

SEQ ID NO: 701 - DNA, 16 bp, Artificial Sequence
  synthetic [barcode part1]
gaccgatatcgtgact

SEQ ID NO: 702 - DNA, 16 bp, Artificial Sequence
  synthetic [barcode part1]
gttcgccgatattact

SEQ ID NO: 703 - DNA, 16 bp, Artificial Sequence
  synthetic [barcode part1]
atcttctcgcgaccag

SEQ ID NO: 704 - DNA, 16 bp, Artificial Sequence
  synthetic [barcode part1]
cctcgttactctgttg

SEQ ID NO: 705 - DNA, 16 bp, Artificial Sequence
  synthetic [barcode part1]
tcaaggtcagaacctc

SEQ ID NO: 706 - DNA, 16 bp, Artificial Sequence
  synthetic [barcode part1]
atcagactcgcgtctc

SEQ ID NO: 707 - DNA, 16 bp, Artificial Sequence
  synthetic [barcode part1]
gcgacaattatcaccg

SEQ ID NO: 708 - DNA, 16 bp, Artificial Sequence
  synthetic [barcode part1]
gtaccgacgacgaagt

SEQ ID NO: 709 - DNA, 16 bp, Artificial Sequence
  synthetic [barcode part1]
gaatacaattgccgag

SEQ ID NO: 710 - DNA, 16 bp, Artificial Sequence
  synthetic [barcode part1]
cagtacttatcgcgag

SEQ ID NO: 711 - DNA, 16 bp, Artificial Sequence
  synthetic [barcode part1]
acgtcaacgacctctc

SEQ ID NO: 712 - DNA, 16 bp, Artificial Sequence
  synthetic [barcode part1]
tgttgagattctcacc

SEQ ID NO: 713 - DNA, 16 bp, Artificial Sequence
  synthetic [barcode part1]
gttgtagattcgtctc

SEQ ID NO: 714 - DNA, 16 bp, Artificial Sequence
  synthetic [barcode part1]
cctcctagaatacttg

SEQ ID NO: 715 - DNA, 16 bp, Artificial Sequence
  synthetic [barcode part1]
tatcactgtctgaacc

SEQ ID NO: 716 - DNA, 16 bp, Artificial Sequence
  synthetic [barcode part1]
ttcggttctccgactt

SEQ ID NO: 717 - DNA, 16 bp, Artificial Sequence
  synthetic [barcode part1]
tgcctgccaagactct

SEQ ID NO: 718 - DNA, 16 bp, Artificial Sequence
  synthetic [barcode part1]
aataactggaacgtgc

SEQ ID NO: 719 - DNA, 16 bp, Artificial Sequence
  synthetic [barcode part1]
ataggaaccttacgcc

SEQ ID NO: 720 - DNA, 16 bp, Artificial Sequence
  synthetic [barcode part1]
aagtggaggcgtcgtt

SEQ ID NO: 721 - DNA, 16 bp, Artificial Sequence
  synthetic [barcode part1]
ttacgtctcgccgagt

SEQ ID NO: 722 - DNA, 16 bp, Artificial Sequence
  synthetic [barcode part1]
tctacgtcagtggcct

SEQ ID NO: 723 - DNA, 16 bp, Artificial Sequence
  synthetic [barcode part1]
ccttcgtcttggtgag

SEQ ID NO: 724 - DNA, 16 bp, Artificial Sequence
  synthetic [barcode part1]
gtctccaatccagtgc

SEQ ID NO: 725 - DNA, 16 bp, Artificial Sequence
  synthetic [barcode part1]
cctctggtacacaatt

SEQ ID NO: 726 - DNA, 16 bp, Artificial Sequence
  synthetic [barcode part1]
gtaaggaccgatagtt

SEQ ID NO: 727 - DNA, 16 bp, Artificial Sequence
  synthetic [barcode part1]
cgaagactatcctcag

SEQ ID NO: 728 - DNA, 16 bp, Artificial Sequence
  synthetic [barcode part1]
tcaaggtcaaggtctc

SEQ ID NO: 729 - DNA, 16 bp, Artificial Sequence
  synthetic [barcode part1]
acaccgcaacaggtag

SEQ ID NO: 730 - DNA, 16 bp, Artificial Sequence
  synthetic [barcode part1]
tcaactgcacagtgtg

SEQ ID NO: 731 - DNA, 16 bp, Artificial Sequence
  synthetic [barcode part1]
aatccgtcttaggcag

SEQ ID NO: 732 - DNA, 16 bp, Artificial Sequence
  synthetic [barcode part1]
gtccacctgttacggt

SEQ ID NO: 733 - DNA, 16 bp, Artificial Sequence
  synthetic [barcode part1]
tccgtgtcaacttggc

SEQ ID NO: 734 - DNA, 16 bp, Artificial Sequence
  synthetic [barcode part1]
tggttctacgtcgatt

SEQ ID NO: 735 - DNA, 16 bp, Artificial Sequence
  synthetic [barcode part1]
tcagtcaccaatcgag

SEQ ID NO: 736 - DNA, 16 bp, Artificial Sequence
  synthetic [barcode part1]
agtgactaacctggtc

SEQ ID NO: 737 - DNA, 16 bp, Artificial Sequence
  synthetic [barcode part1]
cgagattgagaccttc

SEQ ID NO: 738 - DNA, 16 bp, Artificial Sequence
  synthetic [barcode part1]
caacctctacgtgacc

SEQ ID NO: 739 - DNA, 16 bp, Artificial Sequence
  synthetic [barcode part1]
ccgtactgaacacaac

SEQ ID NO: 740 - DNA, 16 bp, Artificial Sequence
  synthetic [barcode part1]
gcgtcacacctatctg

SEQ ID NO: 741 - DNA, 16 bp, Artificial Sequence
  synthetic [barcode part1]
gatccgattgacgact

SEQ ID NO: 742 - DNA, 16 bp, Artificial Sequence
  synthetic [barcode part1]
aatctctcgcactggc

SEQ ID NO: 743 - DNA, 16 bp, Artificial Sequence
  synthetic [barcode part1]
cgcactgtatacagtg

SEQ ID NO: 744 - DNA, 16 bp, Artificial Sequence
  synthetic [barcode part1]
tactcgtgtggacagt

SEQ ID NO: 745 - DNA, 16 bp, Artificial Sequence
  synthetic [barcode part1]
tggcgcaactacttcc

SEQ ID NO: 746 - DNA, 16 bp, Artificial Sequence
  synthetic [barcode part1]
agtcgacaactccagt

SEQ ID NO: 747 - DNA, 16 bp, Artificial Sequence
  synthetic [barcode part1]
gcacaagtatcctcag

SEQ ID NO: 748 - DNA, 16 bp, Artificial Sequence
  synthetic [barcode part1]
gttcgatcaacggttg

SEQ ID NO: 749 - DNA, 16 bp, Artificial Sequence
  synthetic [barcode part1]
tctggatcagacctag

SEQ ID NO: 750 - DNA, 16 bp, Artificial Sequence
  synthetic [barcode part1]
ttagacaacgacgagt

SEQ ID NO: 751 - DNA, 16 bp, Artificial Sequence
  synthetic [barcode part1]
tccacacgacttgacc

SEQ ID NO: 752 - DNA, 16 bp, Artificial Sequence
  synthetic [barcode part1]
caagttccttgtcgcg

SEQ ID NO: 753 - DNA, 16 bp, Artificial Sequence
  synthetic [barcode part1]
gtgtgccggtatattg

SEQ ID NO: 754 - DNA, 16 bp, Artificial Sequence
  synthetic [barcode part1]
actgcggagacgaatc

SEQ ID NO: 755 - DNA, 16 bp, Artificial Sequence
  synthetic [barcode part1]
aattccgaacgttgcg

SEQ ID NO: 756 - DNA, 16 bp, Artificial Sequence
  synthetic [barcode part1]
gtacacgtacacgtgt

SEQ ID NO: 757 - DNA, 16 bp, Artificial Sequence
  synthetic [barcode part1]
ttgcgataattggccg

SEQ ID NO: 758 - DNA, 16 bp, Artificial Sequence
  synthetic [barcode part1]
cagattcaggttcgtg

SEQ ID NO: 759 - DNA, 16 bp, Artificial Sequence
  synthetic [barcode part1]
gagagtgtatcctcac

SEQ ID NO: 760 - DNA, 16 bp, Artificial Sequence
  synthetic [barcode part1]
gtatcgtcctagaacg

SEQ ID NO: 761 - DNA, 16 bp, Artificial Sequence
  synthetic [barcode part1]
tccagtagttctcgcg

SEQ ID NO: 762 - DNA, 16 bp, Artificial Sequence
  synthetic [barcode part1]
tactctgcctaggcgt

SEQ ID NO: 763 - DNA, 16 bp, Artificial Sequence
  synthetic [barcode part1]
tgaccttgtcgcgtgt

SEQ ID NO: 764 - DNA, 16 bp, Artificial Sequence
  synthetic [barcode part1]
ttcggaggtcagttgt

SEQ ID NO: 765 - DNA, 16 bp, Artificial Sequence
  synthetic [barcode part1]
tacgtctctgttgagt

SEQ ID NO: 766 - DNA, 16 bp, Artificial Sequence
  synthetic [barcode part1]
aacggagtcgaatatc

SEQ ID NO: 767 - DNA, 16 bp, Artificial Sequence
  synthetic [barcode part1]
gaacagaacttcaggt

SEQ ID NO: 768 - DNA, 16 bp, Artificial Sequence
  synthetic [barcode part1]
tgttaccttcgtgagt

SEQ ID NO: 769 - DNA, 16 bp, Artificial Sequence
  synthetic [barcode part1]
aagtaacggaacgacg

SEQ ID NO: 770 - DNA, 16 bp, Artificial Sequence
  synthetic [barcode part1]
cgattagttccaggac

SEQ ID NO: 771 - DNA, 16 bp, Artificial Sequence
  synthetic [barcode part1]
tgattgagtcgcggtt

SEQ ID NO: 772 - DNA, 16 bp, Artificial Sequence
  synthetic [barcode part1]
actaacgaggtgtctc

SEQ ID NO: 773 - DNA, 16 bp, Artificial Sequence
  synthetic [barcode part1]
cgacgattgcactcct

SEQ ID NO: 774 - DNA, 16 bp, Artificial Sequence
  synthetic [barcode part1]
aactgtggtgtgttgc

SEQ ID NO: 775 - DNA, 16 bp, Artificial Sequence
  synthetic [barcode part1]
attgtcgaccgaatcg

SEQ ID NO: 776 - DNA, 16 bp, Artificial Sequence
  synthetic [barcode part1]
gtaggcctcttactgc

SEQ ID NO: 777 - DNA, 16 bp, Artificial Sequence
  synthetic [barcode part1]
tagaacacactccgtg

SEQ ID NO: 778 - DNA, 16 bp, Artificial Sequence
  synthetic [barcode part1]
acttgacgtgtaagag

SEQ ID NO: 779 - DNA, 16 bp, Artificial Sequence
  synthetic [barcode part1]
tccaatcacgcgtcgt

SEQ ID NO: 780 - DNA, 16 bp, Artificial Sequence
  synthetic [barcode part1]
tcagtcaggccttaag

SEQ ID NO: 781 - DNA, 16 bp, Artificial Sequence
  synthetic [barcode part1]
tctgttaggtcgcgtc

SEQ ID NO: 782 - DNA, 16 bp, Artificial Sequence
  synthetic [barcode part1]
gtaagtcacgtgactc

SEQ ID NO: 783 - DNA, 16 bp, Artificial Sequence
  synthetic [barcode part1]
tcttgcgttccgtatc

SEQ ID NO: 784 - DNA, 16 bp, Artificial Sequence
  synthetic [barcode part1]
cactggacaaggacgt

SEQ ID NO: 785 - DNA, 16 bp, Artificial Sequence
  synthetic [barcode part1]
tatccagaatcacgcg

SEQ ID NO: 786 - DNA, 16 bp, Artificial Sequence
  synthetic [barcode part1]
tctcaccacgaacctg

SEQ ID NO: 787 - DNA, 16 bp, Artificial Sequence
  synthetic [barcode part1]
gtggaaccagagtaag

SEQ ID NO: 788 - DNA, 16 bp, Artificial Sequence
  synthetic [barcode part1]
tcaagtcgaggtatag

SEQ ID NO: 789 - DNA, 16 bp, Artificial Sequence
  synthetic [barcode part1]
gagacttggcgaacac

SEQ ID NO: 790 - DNA, 16 bp, Artificial Sequence
  synthetic [barcode part1]
tagtggcgtatctctt

SEQ ID NO: 791 - DNA, 16 bp, Artificial Sequence
  synthetic [barcode part1]
cctagttccgatctct

SEQ ID NO: 792 - DNA, 16 bp, Artificial Sequence
  synthetic [barcode part1]
gcactagtgacttctt

SEQ ID NO: 793 - DNA, 16 bp, Artificial Sequence
  synthetic [barcode part1]
taacaataggagtgcc

SEQ ID NO: 794 - DNA, 16 bp, Artificial Sequence
  synthetic [barcode part1]
cgatcttgtgtatcgt

SEQ ID NO: 795 - DNA, 16 bp, Artificial Sequence
  synthetic [barcode part1]
gttataggacgagtgt

SEQ ID NO: 796 - DNA, 16 bp, Artificial Sequence
  synthetic [barcode part1]
taggccgttctcgtac

SEQ ID NO: 797 - DNA, 16 bp, Artificial Sequence
  synthetic [barcode part1]
aaccttccgacttcct

SEQ ID NO: 798 - DNA, 16 bp, Artificial Sequence
  synthetic [barcode part1]
gattgacgatcagtcc

SEQ ID NO: 799 - DNA, 16 bp, Artificial Sequence
  synthetic [barcode part1]
aatacgcagagtcggc

SEQ ID NO: 800 - DNA, 16 bp, Artificial Sequence
  synthetic [barcode part1]
aagtaaggtcttaggc

SEQ ID NO: 801 - DNA, 16 bp, Artificial Sequence
  synthetic [barcode part1]
gcaatcttgagtcgtg

SEQ ID NO: 802 - DNA, 16 bp, Artificial Sequence
  synthetic [barcode part1]
gatctgatacgttctc

SEQ ID NO: 803 - DNA, 16 bp, Artificial Sequence
  synthetic [barcode part1]
gtaccaagtacgatcc

SEQ ID NO: 804 - DNA, 16 bp, Artificial Sequence
  synthetic [barcode part1]
gtcacctaagttcgcc

SEQ ID NO: 805 - DNA, 16 bp, Artificial Sequence
  synthetic [barcode part1]
gagaattcgcgaccag

SEQ ID NO: 806 - DNA, 16 bp, Artificial Sequence
  synthetic [barcode part1]
gtctactacgatacct

SEQ ID NO: 807 - DNA, 16 bp, Artificial Sequence
  synthetic [barcode part1]
cgtcttctgtactctg

SEQ ID NO: 808 - DNA, 16 bp, Artificial Sequence
  synthetic [barcode part1]
tacactcctaccaagt

SEQ ID NO: 809 - DNA, 16 bp, Artificial Sequence
  synthetic [barcode part1]
taggcgaagtattacg

SEQ ID NO: 810 - DNA, 16 bp, Artificial Sequence
  synthetic [barcode part1]
ttgaattcgcgaagag

SEQ ID NO: 811 - DNA, 16 bp, Artificial Sequence
  synthetic [barcode part1]
actacgatactcgttc

SEQ ID NO: 812 - DNA, 16 bp, Artificial Sequence
  synthetic [barcode part1]
tggacttaacgcctag

SEQ ID NO: 813 - DNA, 16 bp, Artificial Sequence
  synthetic [barcode part1]
agtacggtagattgtg

SEQ ID NO: 814 - DNA, 16 bp, Artificial Sequence
  synthetic [barcode part1]
aacgtgtctccttggc

SEQ ID NO: 815 - DNA, 16 bp, Artificial Sequence
  synthetic [barcode part1]
agtgttcgcgagacag

SEQ ID NO: 816 - DNA, 16 bp, Artificial Sequence
  synthetic [barcode part1]
ttcgcaccaataactc

SEQ ID NO: 817 - DNA, 16 bp, Artificial Sequence
  synthetic [barcode part1]
tacttacgaacggacc

SEQ ID NO: 818 - DNA, 16 bp, Artificial Sequence
  synthetic [barcode part1]
gcggaatagtacttag

SEQ ID NO: 819 - DNA, 16 bp, Artificial Sequence
  synthetic [barcode part1]
tcctatagactcgatc

SEQ ID NO: 820 - DNA, 16 bp, Artificial Sequence
  synthetic [barcode part1]
tacgtaatcactgcct

SEQ ID NO: 821 - DNA, 16 bp, Artificial Sequence
  synthetic [barcode part1]
atctccgagtggttcc

SEQ ID NO: 822 - DNA, 16 bp, Artificial Sequence
  synthetic [barcode part1]
gtagttactctgacct

SEQ ID NO: 823 - DNA, 16 bp, Artificial Sequence
  synthetic [barcode part1]
tggatatcgatctcct

SEQ ID NO: 824 - DNA, 16 bp, Artificial Sequence
  synthetic [barcode part1]
caccttccggtagttg

SEQ ID NO: 825 - DNA, 16 bp, Artificial Sequence
  synthetic [barcode part1]
tgtcaggacaatccgt

SEQ ID NO: 826 - DNA, 16 bp, Artificial Sequence
  synthetic [barcode part1]
tctctaaggaactggc

SEQ ID NO: 827 - DNA, 16 bp, Artificial Sequence
  synthetic [barcode part1]
cggccgaattgtagtt

SEQ ID NO: 828 - DNA, 16 bp, Artificial Sequence
  synthetic [barcode part1]
tgcactacttcttgag

SEQ ID NO: 829 - DNA, 16 bp, Artificial Sequence
  synthetic [barcode part1]
cacttgccggaacttc

SEQ ID NO: 830 - DNA, 16 bp, Artificial Sequence
  synthetic [barcode part1]
ttcgacacaagtcacg

SEQ ID NO: 831 - DNA, 16 bp, Artificial Sequence
  synthetic [barcode part1]
tgcggcgaggtaagtt

SEQ ID NO: 832 - DNA, 16 bp, Artificial Sequence
  synthetic [barcode part1]
agtacgtgtgtgtcac

SEQ ID NO: 833 - DNA, 16 bp, Artificial Sequence
  synthetic [barcode part1]
cagtgtagattgcgtc

SEQ ID NO: 834 - DNA, 16 bp, Artificial Sequence
  synthetic [barcode part1]
tcgtcaacggttcaag

SEQ ID NO: 835 - DNA, 16 bp, Artificial Sequence
  synthetic [barcode part1]
gagtatctgccgttcc

SEQ ID NO: 836 - DNA, 16 bp, Artificial Sequence
  synthetic [barcode part1]
ttgccggatatcctcg

SEQ ID NO: 837 - DNA, 16 bp, Artificial Sequence
  synthetic [barcode part1]
tacgtcactgaagaag

SEQ ID NO: 838 - DNA, 16 bp, Artificial Sequence
  synthetic [barcode part1]
ttctaggacgacgttg

SEQ ID NO: 839 - DNA, 16 bp, Artificial Sequence
  synthetic [barcode part1]
cacactatcaacttcg

SEQ ID NO: 840 - DNA, 16 bp, Artificial Sequence
  synthetic [barcode part1]
gatcgtggaaggacct

SEQ ID NO: 841 - DNA, 16 bp, Artificial Sequence
  synthetic [barcode part1]
tgttgtggtcacagtg

SEQ ID NO: 842 - DNA, 16 bp, Artificial Sequence
  synthetic [barcode part1]
tatcggagacgtaggc

SEQ ID NO: 843 - DNA, 16 bp, Artificial Sequence
  synthetic [barcode part1]
gcagacaagacctcag

SEQ ID NO: 844 - DNA, 16 bp, Artificial Sequence
  synthetic [barcode part1]
agacgtgtccttacag

SEQ ID NO: 845 - DNA, 16 bp, Artificial Sequence
  synthetic [barcode part1]
acgactgccaattctt

SEQ ID NO: 846 - DNA, 16 bp, Artificial Sequence
  synthetic [barcode part1]
taagtgccacggattc

SEQ ID NO: 847 - DNA, 16 bp, Artificial Sequence
  synthetic [barcode part1]
tatcaggtccacgtcc

SEQ ID NO: 848 - DNA, 16 bp, Artificial Sequence
  synthetic [barcode part1]
cgacgcaactagagac

SEQ ID NO: 849 - DNA, 16 bp, Artificial Sequence
  synthetic [barcode part1]
cgaacaccgatctcct

SEQ ID NO: 850 - DNA, 16 bp, Artificial Sequence
  synthetic [barcode part1]
cagtaatcgcgcctct

SEQ ID NO: 851 - DNA, 16 bp, Artificial Sequence
  synthetic [barcode part1]
acagtactgtgtgtgc

SEQ ID NO: 852 - DNA, 16 bp, Artificial Sequence
  synthetic [barcode part1]
tgtataagtccggacc

SEQ ID NO: 853 - DNA, 16 bp, Artificial Sequence
  synthetic [barcode part1]
cacgagactctatacg

SEQ ID NO: 854 - DNA, 16 bp, Artificial Sequence
  synthetic [barcode part1]
tgtcgaagtcctcgtc

SEQ ID NO: 855 - DNA, 16 bp, Artificial Sequence
  synthetic [barcode part1]
atcggccttaatcgag

SEQ ID NO: 856 - DNA, 16 bp, Artificial Sequence
  synthetic [barcode part1]
cctctaaggaaggtct

SEQ ID NO: 857 - DNA, 16 bp, Artificial Sequence
  synthetic [barcode part1]
agatactgcaacgagt

SEQ ID NO: 858 - DNA, 16 bp, Artificial Sequence
  synthetic [barcode part1]
tgagatctggtcagtc

SEQ ID NO: 859 - DNA, 16 bp, Artificial Sequence
  synthetic [barcode part1]
acttgagttcaggcac

SEQ ID NO: 860 - DNA, 16 bp, Artificial Sequence
  synthetic [barcode part1]
cctactgatatccggc

SEQ ID NO: 861 - DNA, 16 bp, Artificial Sequence
  synthetic [barcode part1]
atctctgcaggaacgt

SEQ ID NO: 862 - DNA, 16 bp, Artificial Sequence
  synthetic [barcode part1]
acagaaggcgtctctt

SEQ ID NO: 863 - DNA, 16 bp, Artificial Sequence
  synthetic [barcode part1]
aacgtctgttctctag

SEQ ID NO: 864 - DNA, 16 bp, Artificial Sequence
  synthetic [barcode part1]
ccagaagactattccg

SEQ ID NO: 865 - DNA, 16 bp, Artificial Sequence
  synthetic [barcode part1]
aacctgttgtctggag

SEQ ID NO: 866 - DNA, 16 bp, Artificial Sequence
  synthetic [barcode part1]
ttacaggtacctcgcc

SEQ ID NO: 867 - DNA, 16 bp, Artificial Sequence
  synthetic [barcode part1]
ttctccgataaggcag

SEQ ID NO: 868 - DNA, 16 bp, Artificial Sequence
  synthetic [barcode part1]
ttggcgacttgtatct

SEQ ID NO: 869 - DNA, 16 bp, Artificial Sequence
  synthetic [barcode part1]
tcaactcaggcgcctt

SEQ ID NO: 870 - DNA, 16 bp, Artificial Sequence
  synthetic [barcode part1]
cggcaggtaagtgttg

SEQ ID NO: 871 - DNA, 16 bp, Artificial Sequence
  synthetic [barcode part1]
gccgtggtgaacaagt

SEQ ID NO: 872 - DNA, 16 bp, Artificial Sequence
  synthetic [barcode part1]
tataggcagataacgc

SEQ ID NO: 873 - DNA, 16 bp, Artificial Sequence
  synthetic [barcode part1]
tcgataaggcgatcct

SEQ ID NO: 874 - DNA, 16 bp, Artificial Sequence
  synthetic [barcode part1]
gcacgatccggttctt

SEQ ID NO: 875 - DNA, 16 bp, Artificial Sequence
  synthetic [barcode part1]
gaggcaattgttccac

SEQ ID NO: 876 - DNA, 16 bp, Artificial Sequence
  synthetic [barcode part1]
ttgcagtctgaccaag

SEQ ID NO: 877 - DNA, 16 bp, Artificial Sequence
  synthetic [barcode part1]
gtgcgtcttgttattg

SEQ ID NO: 878 - DNA, 16 bp, Artificial Sequence
  synthetic [barcode part1]
tacagtcacgtggttg

SEQ ID NO: 879 - DNA, 16 bp, Artificial Sequence
  synthetic [barcode part1]
cggagattcaccgaag

SEQ ID NO: 880 - DNA, 16 bp, Artificial Sequence
  synthetic [barcode part1]
gtgtccggaacgatag

SEQ ID NO: 881 - DNA, 16 bp, Artificial Sequence
  synthetic [barcode part1]
ttcttcaacgactacg

SEQ ID NO: 882 - DNA, 16 bp, Artificial Sequence
  synthetic [barcode part1]
ttccagtacacggcct

SEQ ID NO: 883 - DNA, 16 bp, Artificial Sequence
  synthetic [barcode part1]
tcctggccaatctctt

SEQ ID NO: 884 - DNA, 16 bp, Artificial Sequence
  synthetic [barcode part1]
tgaggtcgaccaatct

SEQ ID NO: 885 - DNA, 16 bp, Artificial Sequence
  synthetic [barcode part1]
acgatcttatcggacg

SEQ ID NO: 886 - DNA, 16 bp, Artificial Sequence
  synthetic [barcode part1]
tgatcgaccaagactc

SEQ ID NO: 887 - DNA, 16 bp, Artificial Sequence
  synthetic [barcode part1]
cggacgttcttgttgc

SEQ ID NO: 888 - DNA, 16 bp, Artificial Sequence
  synthetic [barcode part1]
tagtcgatacggtacc

SEQ ID NO: 889 - DNA, 16 bp, Artificial Sequence
  synthetic [barcode part1]
aatctgacgcgttctt

SEQ ID NO: 890 - DNA, 16 bp, Artificial Sequence
  synthetic [barcode part1]
caccacctctacgagt

SEQ ID NO: 891 - DNA, 16 bp, Artificial Sequence
  synthetic [barcode part1]
aattcggaggagtgcc

SEQ ID NO: 892 - DNA, 16 bp, Artificial Sequence
  synthetic [barcode part1]
gagacaggcctacaac

SEQ ID NO: 893 - DNA, 16 bp, Artificial Sequence
  synthetic [barcode part1]
taacagaacagactcg

SEQ ID NO: 894 - DNA, 16 bp, Artificial Sequence
  synthetic [barcode part1]
tctaaccggagttggt

SEQ ID NO: 895 - DNA, 16 bp, Artificial Sequence
  synthetic [barcode part1]
gtaatcgtgcaactgc

SEQ ID NO: 896 - DNA, 16 bp, Artificial Sequence
  synthetic [barcode part1]
cggacctagtattcag

SEQ ID NO: 897 - DNA, 16 bp, Artificial Sequence
  synthetic [barcode part1]
taatccggcaatccag

SEQ ID NO: 898 - DNA, 16 bp, Artificial Sequence
  synthetic [barcode part1]
ccaacagtctacgcct

SEQ ID NO: 899 - DNA, 16 bp, Artificial Sequence
  synthetic [barcode part1]
cacgcacaatcgattg

SEQ ID NO: 900 - DNA, 16 bp, Artificial Sequence
  synthetic [barcode part1]
ttagtggtagaggcgc

SEQ ID NO: 901 - DNA, 16 bp, Artificial Sequence
  synthetic [barcode part1]
gttaggtgtccttatc

SEQ ID NO: 902 - DNA, 16 bp, Artificial Sequence
  synthetic [barcode part1]
gatagaaggttcgcgc

SEQ ID NO: 903 - DNA, 16 bp, Artificial Sequence
  synthetic [barcode part1]
tgtgatctcgaacgtg

SEQ ID NO: 904 - DNA, 16 bp, Artificial Sequence
  synthetic [barcode part1]
gtatacaacgccgtgt

SEQ ID NO: 905 - DNA, 16 bp, Artificial Sequence
  synthetic [barcode part1]
gacggtctgtacttcc

SEQ ID NO: 906 - DNA, 16 bp, Artificial Sequence
  synthetic [barcode part1]
gagtctggatagtagt

SEQ ID NO: 907 - DNA, 16 bp, Artificial Sequence
  synthetic [barcode part1]
tccagtcacgttggtc

SEQ ID NO: 908 - DNA, 16 bp, Artificial Sequence
  synthetic [barcode part1]
gcctcttcctcttaag

SEQ ID NO: 909 - DNA, 16 bp, Artificial Sequence
  synthetic [barcode part1]
cgtaacgttacgacgt

SEQ ID NO: 910 - DNA, 16 bp, Artificial Sequence
  synthetic [barcode part1]
gaggacttcagttctg

SEQ ID NO: 911 - DNA, 16 bp, Artificial Sequence
  synthetic [barcode part1]
ttcagaggccaatcac

SEQ ID NO: 912 - DNA, 16 bp, Artificial Sequence
  synthetic [barcode part1]
gccacggaagtgagtt

SEQ ID NO: 913 - DNA, 16 bp, Artificial Sequence
  synthetic [barcode part1]
tcgcctagaatcttac

SEQ ID NO: 914 - DNA, 16 bp, Artificial Sequence
  synthetic [barcode part1]
gtcctaaggtcaactg

SEQ ID NO: 915 - DNA, 16 bp, Artificial Sequence
  synthetic [barcode part1]
gttgtacaagacggcg

SEQ ID NO: 916 - DNA, 16 bp, Artificial Sequence
  synthetic [barcode part1]
acttccacgttgagtt

SEQ ID NO: 917 - DNA, 16 bp, Artificial Sequence
  synthetic [barcode part1]
caagtcaggttactgc

SEQ ID NO: 918 - DNA, 16 bp, Artificial Sequence
  synthetic [barcode part1]
aataggatcaacacgc

SEQ ID NO: 919 - DNA, 16 bp, Artificial Sequence
  synthetic [barcode part1]
atctattacggcacct

SEQ ID NO: 920 - DNA, 16 bp, Artificial Sequence
  synthetic [barcode part1]
ttgtgcacctcctgag

SEQ ID NO: 921 - DNA, 16 bp, Artificial Sequence
  synthetic [barcode part1]
acactgagatcgtacc

SEQ ID NO: 922 - DNA, 16 bp, Artificial Sequence
  synthetic [barcode part1]
tacgagttgaggtggc

SEQ ID NO: 923 - DNA, 16 bp, Artificial Sequence
  synthetic [barcode part1]
cgagttaccagattgc

SEQ ID NO: 924 - DNA, 16 bp, Artificial Sequence
  synthetic [barcode part1]
tctagacacttggacg

SEQ ID NO: 925 - DNA, 16 bp, Artificial Sequence
  synthetic [barcode part1]
taatcctattggtgcc

SEQ ID NO: 926 - DNA, 16 bp, Artificial Sequence
  synthetic [barcode part1]
agtaactagaggcact

SEQ ID NO: 927 - DNA, 16 bp, Artificial Sequence
  synthetic [barcode part1]
gttgagtcttacgttc

SEQ ID NO: 928 - DNA, 16 bp, Artificial Sequence
  synthetic [barcode part1]
agatactgccttacct

SEQ ID NO: 929 - DNA, 16 bp, Artificial Sequence
  synthetic [barcode part1]
tatcaattcggttccg

SEQ ID NO: 930 - DNA, 16 bp, Artificial Sequence
  synthetic [barcode part1]
tacacttcaccgaatc

SEQ ID NO: 931 - DNA, 16 bp, Artificial Sequence
  synthetic [barcode part1]
gcaacacgatctcagt

SEQ ID NO: 932 - DNA, 16 bp, Artificial Sequence
  synthetic [barcode part1]
gcacaacctccgatct

SEQ ID NO: 933 - DNA, 16 bp, Artificial Sequence
  synthetic [barcode part1]
ttgtagaacggccgtt

SEQ ID NO: 934 - DNA, 16 bp, Artificial Sequence
  synthetic [barcode part1]
cctccgaatcaatact

SEQ ID NO: 935 - DNA, 16 bp, Artificial Sequence
  synthetic [barcode part1]
tcttggtgtacaacct

SEQ ID NO: 936 - DNA, 16 bp, Artificial Sequence
  synthetic [barcode part1]
tattagagtctggcgc

SEQ ID NO: 937 - DNA, 16 bp, Artificial Sequence
  synthetic [barcode part1]
aatctaaccttcacgc

SEQ ID NO: 938 - DNA, 16 bp, Artificial Sequence
  synthetic [barcode part1]
atcttctctccggttg

SEQ ID NO: 939 - DNA, 16 bp, Artificial Sequence
  synthetic [barcode part1]
tagagtcgttggtcac

SEQ ID NO: 940 - DNA, 16 bp, Artificial Sequence
  synthetic [barcode part1]
taaccagagttctggc

SEQ ID NO: 941 - DNA, 16 bp, Artificial Sequence
  synthetic [barcode part1]
gtaactacgtgcggtt

SEQ ID NO: 942 - DNA, 16 bp, Artificial Sequence
  synthetic [barcode part1]
aggcctattattgcct

SEQ ID NO: 943 - DNA, 16 bp, Artificial Sequence
  synthetic [barcode part1]
caggaggtggtgtgtt

SEQ ID NO: 944 - DNA, 16 bp, Artificial Sequence
  synthetic [barcode part1]
tagacacttctactgc

SEQ ID NO: 945 - DNA, 16 bp, Artificial Sequence
  synthetic [barcode part1]
gttggacggtgattct

SEQ ID NO: 946 - DNA, 16 bp, Artificial Sequence
  synthetic [barcode part1]
cgagaagtcaatcctc

SEQ ID NO: 947 - DNA, 16 bp, Artificial Sequence
  synthetic [barcode part1]
tggtggttcttgtgtt

SEQ ID NO: 948 - DNA, 16 bp, Artificial Sequence
  synthetic [barcode part1]
ttacggaacaaggtac

SEQ ID NO: 949 - DNA, 16 bp, Artificial Sequence
  synthetic [barcode part1]
gccggataataacctc

SEQ ID NO: 950 - DNA, 16 bp, Artificial Sequence
  synthetic [barcode part1]
cactgagtgccgaatt

SEQ ID NO: 951 - DNA, 16 bp, Artificial Sequence
  synthetic [barcode part1]
acgttacggtactacg

SEQ ID NO: 952 - DNA, 16 bp, Artificial Sequence
  synthetic [barcode part1]
caggagatcaacttcc

SEQ ID NO: 953 - DNA, 16 bp, Artificial Sequence
  synthetic [barcode part1]
cgtctcttacaaggag

SEQ ID NO: 954 - DNA, 16 bp, Artificial Sequence
  synthetic [barcode part1]
cctaagttgtcggtag

SEQ ID NO: 955 - DNA, 16 bp, Artificial Sequence
  synthetic [barcode part1]
tactggtgtcaacgtg

SEQ ID NO: 956 - DNA, 16 bp, Artificial Sequence
  synthetic [barcode part1]
agatactccacggact

SEQ ID NO: 957 - DNA, 16 bp, Artificial Sequence
  synthetic [barcode part1]
gtgtgcaatcgcgatt

SEQ ID NO: 958 - DNA, 16 bp, Artificial Sequence
  synthetic [barcode part1]
acctctaggtaacctt

SEQ ID NO: 959 - DNA, 16 bp, Artificial Sequence
  synthetic [barcode part1]
atcggtactcgtagac

SEQ ID NO: 960 - DNA, 16 bp, Artificial Sequence
  synthetic [barcode part1]
gccaacaaggccaagt

SEQ ID NO: 961 - DNA, 16 bp, Artificial Sequence
  synthetic [barcode part1]
tgcaactgcgtaatcg

SEQ ID NO: 962 - DNA, 16 bp, Artificial Sequence
  synthetic [barcode part1]
cgtgcaaggtagtggt

SEQ ID NO: 963 - DNA, 16 bp, Artificial Sequence
  synthetic [barcode part1]
gtccacctccgagatt

SEQ ID NO: 964 - DNA, 16 bp, Artificial Sequence
  synthetic [barcode part1]
tagactcaggcggtag

SEQ ID NO: 965 - DNA, 16 bp, Artificial Sequence
  synthetic [barcode part1]
gatcagtatcgcagtc

SEQ ID NO: 966 - DNA, 16 bp, Artificial Sequence
  synthetic [barcode part1]
acttgcaggttgtgtg

SEQ ID NO: 967 - DNA, 16 bp, Artificial Sequence
  synthetic [barcode part1]
gtgcagtgtaccaact

SEQ ID NO: 968 - DNA, 16 bp, Artificial Sequence
  synthetic [barcode part1]
cactgcgtaacactag

SEQ ID NO: 969 - DNA, 16 bp, Artificial Sequence
  synthetic [barcode part1]
ccaattctgagtctgt

SEQ ID NO: 970 - DNA, 16 bp, Artificial Sequence
  synthetic [barcode part1]
tcgaagttctgtctac

SEQ ID NO: 971 - DNA, 16 bp, Artificial Sequence
  synthetic [barcode part1]
gattcgacgcgttctc

SEQ ID NO: 972 - DNA, 16 bp, Artificial Sequence
  synthetic [barcode part1]
ttggtctaacacacct

SEQ ID NO: 973 - DNA, 16 bp, Artificial Sequence
  synthetic [barcode part1]
gtgtcctattgttgac

SEQ ID NO: 974 - DNA, 16 bp, Artificial Sequence
  synthetic [barcode part1]
attctgtctaccgtcc

SEQ ID NO: 975 - DNA, 16 bp, Artificial Sequence
  synthetic [barcode part1]
acactgacacagatcc

SEQ ID NO: 976 - DNA, 16 bp, Artificial Sequence
  synthetic [barcode part1]
accttcctgtacggtg

SEQ ID NO: 977 - DNA, 16 bp, Artificial Sequence
  synthetic [barcode part1]
taccgccgtctagact

SEQ ID NO: 978 - DNA, 16 bp, Artificial Sequence
  synthetic [barcode part1]
gtggcaccaatcaatc

SEQ ID NO: 979 - DNA, 16 bp, Artificial Sequence
  synthetic [barcode part1]
gacttagagttaccgc

SEQ ID NO: 980 - DNA, 16 bp, Artificial Sequence
  synthetic [barcode part1]
aatcagacgtcagtag

SEQ ID NO: 981 - DNA, 16 bp, Artificial Sequence
  synthetic [barcode part1]
taggacgcctaattcg

SEQ ID NO: 982 - DNA, 16 bp, Artificial Sequence
  synthetic [barcode part1]
accttgttccgtaagt

SEQ ID NO: 983 - DNA, 16 bp, Artificial Sequence
  synthetic [barcode part1]
taagtgtcagtggagt

SEQ ID NO: 984 - DNA, 16 bp, Artificial Sequence
  synthetic [barcode part1]
ttcgagacgtgatacc

SEQ ID NO: 985 - DNA, 16 bp, Artificial Sequence
  synthetic [barcode part1]
ttacgaatccgatcct

SEQ ID NO: 986 - DNA, 16 bp, Artificial Sequence
  synthetic [barcode part1]
tgcgagatcggactag

SEQ ID NO: 987 - DNA, 16 bp, Artificial Sequence
  synthetic [barcode part1]
tatcactctaccgtcc

SEQ ID NO: 988 - DNA, 16 bp, Artificial Sequence
  synthetic [barcode part1]
ccgcagacttagtctc

SEQ ID NO: 989 - DNA, 16 bp, Artificial Sequence
  synthetic [barcode part1]
tcgtccagtggtatcc

SEQ ID NO: 990 - DNA, 16 bp, Artificial Sequence
  synthetic [barcode part1]
tagacggacctcagag

SEQ ID NO: 991 - DNA, 16 bp, Artificial Sequence
  synthetic [barcode part1]
tcgcgagtattgacac

SEQ ID NO: 992 - DNA, 16 bp, Artificial Sequence
  synthetic [barcode part1]
ttccgcactggtgatc

SEQ ID NO: 993 - DNA, 16 bp, Artificial Sequence
  synthetic [barcode part1]
gaacactagtaaggtc

SEQ ID NO: 994 - DNA, 16 bp, Artificial Sequence
  synthetic [barcode part1]
agaccgtgtaggaatt

SEQ ID NO: 995 - DNA, 16 bp, Artificial Sequence
  synthetic [barcode part1]
gacgtagtgaggatag

SEQ ID NO: 996 - DNA, 16 bp, Artificial Sequence
  synthetic [barcode part1]
accggatcagactgtt

SEQ ID NO: 997 - DNA, 16 bp, Artificial Sequence
  synthetic [barcode part1]
aggtccaggtggtagt

SEQ ID NO: 998 - DNA, 16 bp, Artificial Sequence
  synthetic [barcode part1]
tgcagttgttatcctg

SEQ ID NO: 999 - DNA, 16 bp, Artificial Sequence
  synthetic [barcode part1]
atcctgtcgccttgtt

SEQ ID NO: 1000 - DNA, 16 bp, Artificial Sequence
  synthetic [barcode part1]
tgtgtaacgaggagtt

SEQ ID NO: 1001 - DNA, 16 bp, Artificial Sequence
  synthetic [barcode part1]
ttgaagacgcgaattg

SEQ ID NO: 1002 - DNA, 16 bp, Artificial Sequence
  synthetic [barcode part1]
attccgaccgattgag

SEQ ID NO: 1003 - DNA, 16 bp, Artificial Sequence
  synthetic [barcode part1]
tgacaggtctgttacg

SEQ ID NO: 1004 - DNA, 16 bp, Artificial Sequence
  synthetic [barcode part1]
agacgttcactattcc

SEQ ID NO: 1005 - DNA, 16 bp, Artificial Sequence
  synthetic [barcode part1]
tgacctcaccagtgtc

SEQ ID NO: 1006 - DNA, 16 bp, Artificial Sequence
  synthetic [barcode part1]
tggcgaacagacgttg

SEQ ID NO: 1007 - DNA, 16 bp, Artificial Sequence
  synthetic [barcode part1]
tcctaagacctcgaag

SEQ ID NO: 1008 - DNA, 16 bp, Artificial Sequence
  synthetic [barcode part1]
ttatccgcaaggttct

SEQ ID NO: 1009 - DNA, 16 bp, Artificial Sequence
  synthetic [barcode part1]
atataacgtgccgacc

SEQ ID NO: 1010 - DNA, 16 bp, Artificial Sequence
  synthetic [barcode part1]
gcacctcttcttacgt

SEQ ID NO: 1011 - DNA, 16 bp, Artificial Sequence
  synthetic [barcode part1]
tctcggtaggaatcac

SEQ ID NO: 1012 - DNA, 16 bp, Artificial Sequence
  synthetic [barcode part1]
caacaatctggcgact

SEQ ID NO: 1013 - DNA, 16 bp, Artificial Sequence
  synthetic [barcode part1]
tcgcaggcctaacttc

SEQ ID NO: 1014 - DNA, 16 bp, Artificial Sequence
  synthetic [barcode part1]
cgccgagtattgagtt

SEQ ID NO: 1015 - DNA, 16 bp, Artificial Sequence
  synthetic [barcode part1]
tacgacgcctaaggtt

SEQ ID NO: 1016 - DNA, 16 bp, Artificial Sequence
  synthetic [barcode part1]
cgactatctatcactg

SEQ ID NO: 1017 - DNA, 16 bp, Artificial Sequence
  synthetic [barcode part1]
gagttggtggtacacg

SEQ ID NO: 1018 - DNA, 16 bp, Artificial Sequence
  synthetic [barcode part1]
ccgccactgagtattc

SEQ ID NO: 1019 - DNA, 16 bp, Artificial Sequence
  synthetic [barcode part1]
taaggtccaatcgacc

SEQ ID NO: 1020 - DNA, 16 bp, Artificial Sequence
  synthetic [barcode part1]
tcttccgccacacaag

SEQ ID NO: 1021 - DNA, 16 bp, Artificial Sequence
  synthetic [barcode part1]
taataggcctgttgcg

SEQ ID NO: 1022 - DNA, 16 bp, Artificial Sequence
  synthetic [barcode part1]
tctaaccgtgttgact

SEQ ID NO: 1023 - DNA, 16 bp, Artificial Sequence
  synthetic [barcode part1]
ccgtaccgaattatct

SEQ ID NO: 1024 - DNA, 16 bp, Artificial Sequence
  synthetic [barcode part1]
tacttgtctcgttcgc

SEQ ID NO: 1025 - DNA, 16 bp, Artificial Sequence
  synthetic [barcode part1]
tacggatccgtgaatc

SEQ ID NO: 1026 - DNA, 16 bp, Artificial Sequence
  synthetic [barcode part1]
caagttgaagaacacc

SEQ ID NO: 1027 - DNA, 16 bp, Artificial Sequence
  synthetic [barcode part1]
gacctattctatcacg

SEQ ID NO: 1028 - DNA, 16 bp, Artificial Sequence
  synthetic [barcode part1]
ccaccactggacactt

SEQ ID NO: 1029 - DNA, 16 bp, Artificial Sequence
  synthetic [barcode part1]
gacactacgcagtatc

SEQ ID NO: 1030 - DNA, 16 bp, Artificial Sequence
  synthetic [barcode part1]
gaataacgcgtgaccg

SEQ ID NO: 1031 - DNA, 16 bp, Artificial Sequence
  synthetic [barcode part1]
tgcctcgagactcgtt

SEQ ID NO: 1032 - DNA, 16 bp, Artificial Sequence
  synthetic [barcode part1]
tcttgacctcctgact

SEQ ID NO: 1033 - DNA, 16 bp, Artificial Sequence
  synthetic [barcode part1]
ccgacaatctgtatct

SEQ ID NO: 1034 - DNA, 16 bp, Artificial Sequence
  synthetic [barcode part1]
cgtgcacttgactaag

SEQ ID NO: 1035 - DNA, 16 bp, Artificial Sequence
  synthetic [barcode part1]
aactcggccagtaact

SEQ ID NO: 1036 - DNA, 16 bp, Artificial Sequence
  synthetic [barcode part1]
gaccaagtgttagtag

SEQ ID NO: 1037 - DNA, 16 bp, Artificial Sequence
  synthetic [barcode part1]
cctatattggtccaac

SEQ ID NO: 1038 - DNA, 16 bp, Artificial Sequence
  synthetic [barcode part1]
ttgtcgcggtatctgc

SEQ ID NO: 1039 - DNA, 16 bp, Artificial Sequence
  synthetic [barcode part1]
tggttcctagtatacc

SEQ ID NO: 1040 - DNA, 16 bp, Artificial Sequence
  synthetic [barcode part1]
aacctagtgacgactc

SEQ ID NO: 1041 - DNA, 16 bp, Artificial Sequence
  synthetic [barcode part1]
atacagactcgcactg

SEQ ID NO: 1042 - DNA, 16 bp, Artificial Sequence
  synthetic [barcode part1]
gacaaccacacttctt

SEQ ID NO: 1043 - DNA, 16 bp, Artificial Sequence
  synthetic [barcode part1]
tcgtgcgtagtatacg

SEQ ID NO: 1044 - DNA, 16 bp, Artificial Sequence
  synthetic [barcode part1]
gcgagatctgtgaacg

SEQ ID NO: 1045 - DNA, 16 bp, Artificial Sequence
  synthetic [barcode part1]
cgtaacgtgagtaagt

SEQ ID NO: 1046 - DNA, 16 bp, Artificial Sequence
  synthetic [barcode part1]
cctgtgcaactcggtt

SEQ ID NO: 1047 - DNA, 16 bp, Artificial Sequence
  synthetic [barcode part1]
aattagtgtcggccac

SEQ ID NO: 1048 - DNA, 16 bp, Artificial Sequence
  synthetic [barcode part1]
tcaactggtgtcacag

SEQ ID NO: 1049 - DNA, 16 bp, Artificial Sequence
  synthetic [barcode part1]
cactacacttcaggag

SEQ ID NO: 1050 - DNA, 16 bp, Artificial Sequence
  synthetic [barcode part1]
tcttaggacttatccg

SEQ ID NO: 1051 - DNA, 16 bp, Artificial Sequence
  synthetic [barcode part1]
acagacttcagacacc

SEQ ID NO: 1052 - DNA, 16 bp, Artificial Sequence
  synthetic [barcode part1]
tcgtccttaacctctg

SEQ ID NO: 1053 - DNA, 16 bp, Artificial Sequence
  synthetic [barcode part1]
tgcacagtggatctgt

SEQ ID NO: 1054 - DNA, 16 bp, Artificial Sequence
  synthetic [barcode part1]
tatacgacaccggtgt

SEQ ID NO: 1055 - DNA, 16 bp, Artificial Sequence
  synthetic [barcode part1]
ccgcaaggcaattatc

SEQ ID NO: 1056 - DNA, 16 bp, Artificial Sequence
  synthetic [barcode part1]
gtggaggttggatcgt

SEQ ID NO: 1057 - DNA, 16 bp, Artificial Sequence
  synthetic [barcode part1]
cgtggacacaacagac

SEQ ID NO: 1058 - DNA, 16 bp, Artificial Sequence
  synthetic [barcode part1]
ttgtctattacgacgc

SEQ ID NO: 1059 - DNA, 16 bp, Artificial Sequence
  synthetic [barcode part1]
ccacacctaggtcgtt

SEQ ID NO: 1060 - DNA, 16 bp, Artificial Sequence
  synthetic [barcode part1]
gaataccacaacagac

SEQ ID NO: 1061 - DNA, 16 bp, Artificial Sequence
  synthetic [barcode part1]
gcgattacaaccacac

SEQ ID NO: 1062 - DNA, 16 bp, Artificial Sequence
  synthetic [barcode part1]
tctcaccgtccacaag

SEQ ID NO: 1063 - DNA, 16 bp, Artificial Sequence
  synthetic [barcode part1]
tctcagaccacctacg

SEQ ID NO: 1064 - DNA, 16 bp, Artificial Sequence
  synthetic [barcode part1]
tggcgatagtcactgt

SEQ ID NO: 1065 - DNA, 16 bp, Artificial Sequence
  synthetic [barcode part1]
aagattggcacctaag

SEQ ID NO: 1066 - DNA, 16 bp, Artificial Sequence
  synthetic [barcode part1]
ttctgtatctccgtgc

SEQ ID NO: 1067 - DNA, 16 bp, Artificial Sequence
  synthetic [barcode part1]
cgaagaaggagttggt

SEQ ID NO: 1068 - DNA, 16 bp, Artificial Sequence
  synthetic [barcode part1]
taaggtagaacgtctg

SEQ ID NO: 1069 - DNA, 16 bp, Artificial Sequence
  synthetic [barcode part1]
ccagagaagaggttag

SEQ ID NO: 1070 - DNA, 16 bp, Artificial Sequence
  synthetic [barcode part1]
gtggaggaccactagt

SEQ ID NO: 1071 - DNA, 16 bp, Artificial Sequence
  synthetic [barcode part1]
gcctactagacaagtc

SEQ ID NO: 1072 - DNA, 16 bp, Artificial Sequence
  synthetic [barcode part1]
aactaagacggttgtg

SEQ ID NO: 1073 - DNA, 16 bp, Artificial Sequence
  synthetic [barcode part1]
gtgattgaatcaggac

SEQ ID NO: 1074 - DNA, 16 bp, Artificial Sequence
  synthetic [barcode part1]
gcaaggtgaacaacag

SEQ ID NO: 1075 - DNA, 16 bp, Artificial Sequence
  synthetic [barcode part1]
cgtagtgccacctgtt

SEQ ID NO: 1076 - DNA, 16 bp, Artificial Sequence
  synthetic [barcode part1]
gaatctgtctgacttc

SEQ ID NO: 1077 - DNA, 16 bp, Artificial Sequence
  synthetic [barcode part1]
tcgcacgagagaatcg

SEQ ID NO: 1078 - DNA, 16 bp, Artificial Sequence
  synthetic [barcode part1]
gagaccaagtcgtacg

SEQ ID NO: 1079 - DNA, 16 bp, Artificial Sequence
  synthetic [barcode part1]
gcacgaatctagtaag

SEQ ID NO: 1080 - DNA, 16 bp, Artificial Sequence
  synthetic [barcode part1]
caattccgcgttagtt

SEQ ID NO: 1081 - DNA, 16 bp, Artificial Sequence
  synthetic [barcode part1]
gttagtgtgagaggcc

SEQ ID NO: 1082 - DNA, 16 bp, Artificial Sequence
  synthetic [barcode part1]
cgaacttgcaagtctg

SEQ ID NO: 1083 - DNA, 16 bp, Artificial Sequence
  synthetic [barcode part1]
acttgtggaggattag

SEQ ID NO: 1084 - DNA, 16 bp, Artificial Sequence
  synthetic [barcode part1]
tccacaccaacgatcc

SEQ ID NO: 1085 - DNA, 16 bp, Artificial Sequence
  synthetic [barcode part1]
acgttccaactaccgc

SEQ ID NO: 1086 - DNA, 16 bp, Artificial Sequence
  synthetic [barcode part1]
tagtgtgagaagttgc

SEQ ID NO: 1087 - DNA, 16 bp, Artificial Sequence
  synthetic [barcode part1]
actacctgtggattct

SEQ ID NO: 1088 - DNA, 16 bp, Artificial Sequence
  synthetic [barcode part1]
tccggttattacacac

SEQ ID NO: 1089 - DNA, 16 bp, Artificial Sequence
  synthetic [barcode part1]
tgattaggtgccgtgt

SEQ ID NO: 1090 - DNA, 16 bp, Artificial Sequence
  synthetic [barcode part1]
tccgatccacagtcac

SEQ ID NO: 1091 - DNA, 16 bp, Artificial Sequence
  synthetic [barcode part1]
cgtcagattgtgtctt

SEQ ID NO: 1092 - DNA, 16 bp, Artificial Sequence
  synthetic [barcode part1]
taccgaatccgtgtcc

SEQ ID NO: 1093 - DNA, 16 bp, Artificial Sequence
  synthetic [barcode part1]
gtccacctgaggttct

SEQ ID NO: 1094 - DNA, 16 bp, Artificial Sequence
  synthetic [barcode part1]
attcgcacggtctctg

SEQ ID NO: 1095 - DNA, 16 bp, Artificial Sequence
  synthetic [barcode part1]
gattctctgcgttagt

SEQ ID NO: 1096 - DNA, 16 bp, Artificial Sequence
  synthetic [barcode part1]
tggtacaatcaccttc

SEQ ID NO: 1097 - DNA, 16 bp, Artificial Sequence
  synthetic [barcode part1]
agaatcagtgcgaccg

SEQ ID NO: 1098 - DNA, 16 bp, Artificial Sequence
  synthetic [barcode part1]
tccgaccttaggaagt

SEQ ID NO: 1099 - DNA, 16 bp, Artificial Sequence
  synthetic [barcode part1]
tgacaggaggcaatag

SEQ ID NO: 1100 - DNA, 16 bp, Artificial Sequence
  synthetic [barcode part1]
cctgatactgtatctg

SEQ ID NO: 1101 - DNA, 16 bp, Artificial Sequence
  synthetic [barcode part1]
acagtgtgtcaactgc

SEQ ID NO: 1102 - DNA, 16 bp, Artificial Sequence
  synthetic [barcode part1]
gcaggtctcctgttac

SEQ ID NO: 1103 - DNA, 16 bp, Artificial Sequence
  synthetic [barcode part1]
attctgtcactagtgc

SEQ ID NO: 1104 - DNA, 16 bp, Artificial Sequence
  synthetic [barcode part1]
caccactagatatctc

SEQ ID NO: 1105 - DNA, 16 bp, Artificial Sequence
  synthetic [barcode part1]
aagtcacaggcacgac

SEQ ID NO: 1106 - DNA, 16 bp, Artificial Sequence
  synthetic [barcode part1]
atagtatcgcacgtgc

SEQ ID NO: 1107 - DNA, 16 bp, Artificial Sequence
  synthetic [barcode part1]
gcctccgattcagtac

SEQ ID NO: 1108 - DNA, 16 bp, Artificial Sequence
  synthetic [barcode part1]
gtaggcctgtgaattc

SEQ ID NO: 1109 - DNA, 16 bp, Artificial Sequence
  synthetic [barcode part1]
caatcttaaccgaggc

SEQ ID NO: 1110 - DNA, 16 bp, Artificial Sequence
  synthetic [barcode part1]
taccacaactgtggtg

SEQ ID NO: 1111 - DNA, 16 bp, Artificial Sequence
  synthetic [barcode part1]
agtatcaccagtcggt

SEQ ID NO: 1112 - DNA, 16 bp, Artificial Sequence
  synthetic [barcode part1]
gcacctgacttcactg

SEQ ID NO: 1113 - DNA, 16 bp, Artificial Sequence
  synthetic [barcode part1]
tggatcgcaacgatct

SEQ ID NO: 1114 - DNA, 16 bp, Artificial Sequence
  synthetic [barcode part1]
tcctacaaccgttagt

SEQ ID NO: 1115 - DNA, 16 bp, Artificial Sequence
  synthetic [barcode part1]
aaggtagtggacgcct

SEQ ID NO: 1116 - DNA, 16 bp, Artificial Sequence
  synthetic [barcode part1]
attctacgttcgaacc

SEQ ID NO: 1117 - DNA, 16 bp, Artificial Sequence
  synthetic [barcode part1]
actacagtccggaatc

SEQ ID NO: 1118 - DNA, 16 bp, Artificial Sequence
  synthetic [barcode part1]
aaccagttggtcagtc

SEQ ID NO: 1119 - DNA, 16 bp, Artificial Sequence
  synthetic [barcode part1]
cgcgtctctgttaggt

SEQ ID NO: 1120 - DNA, 16 bp, Artificial Sequence
  synthetic [barcode part1]
actcaacgtacaagag

SEQ ID NO: 1121 - DNA, 16 bp, Artificial Sequence
  synthetic [barcode part1]
actggttacgtacgtg

SEQ ID NO: 1122 - DNA, 16 bp, Artificial Sequence
  synthetic [barcode part1]
tacctgttgtctgcct

SEQ ID NO: 1123 - DNA, 16 bp, Artificial Sequence
  synthetic [barcode part1]
aggcggactacagtgt

SEQ ID NO: 1124 - DNA, 16 bp, Artificial Sequence
  synthetic [barcode part1]
cgtacagtctaatcct

SEQ ID NO: 1125 - DNA, 16 bp, Artificial Sequence
  synthetic [barcode part1]
ataaccgtctcttgac

SEQ ID NO: 1126 - DNA, 16 bp, Artificial Sequence
  synthetic [barcode part1]
acacaacgtgtcaacc

SEQ ID NO: 1127 - DNA, 16 bp, Artificial Sequence
  synthetic [barcode part1]
cgacagataggacaag

SEQ ID NO: 1128 - DNA, 16 bp, Artificial Sequence
  synthetic [barcode part1]
cggatcctattatctg

SEQ ID NO: 1129 - DNA, 16 bp, Artificial Sequence
  synthetic [barcode part1]
ttccacagtcactagt

SEQ ID NO: 1130 - DNA, 16 bp, Artificial Sequence
  synthetic [barcode part1]
agtcgtgagagaatct

SEQ ID NO: 1131 - DNA, 16 bp, Artificial Sequence
  synthetic [barcode part1]
taccgcgccaattaag

SEQ ID NO: 1132 - DNA, 16 bp, Artificial Sequence
  synthetic [barcode part1]
agaattggtcgaggag

SEQ ID NO: 1133 - DNA, 16 bp, Artificial Sequence
  synthetic [barcode part1]
aactggcagttccagt

SEQ ID NO: 1134 - DNA, 16 bp, Artificial Sequence
  synthetic [barcode part1]
tcctcaccactgagtg

SEQ ID NO: 1135 - DNA, 16 bp, Artificial Sequence
  synthetic [barcode part1]
ccgacttctattgtcc

SEQ ID NO: 1136 - DNA, 16 bp, Artificial Sequence
  synthetic [barcode part1]
tccggttctccaattc

SEQ ID NO: 1137 - DNA, 16 bp, Artificial Sequence
  synthetic [barcode part1]
ttacgagacctctcgc

SEQ ID NO: 1138 - DNA, 16 bp, Artificial Sequence
  synthetic [barcode part1]
cctctcagaatatctg

SEQ ID NO: 1139 - DNA, 16 bp, Artificial Sequence
  synthetic [barcode part1]
taggatcgtcaactgc

SEQ ID NO: 1140 - DNA, 16 bp, Artificial Sequence
  synthetic [barcode part1]
acactcagtctgtgag

SEQ ID NO: 1141 - DNA, 16 bp, Artificial Sequence
  synthetic [barcode part1]
gaagattcgacgcgtg

SEQ ID NO: 1142 - DNA, 16 bp, Artificial Sequence
  synthetic [barcode part1]
tacgtagtcgccgttc

SEQ ID NO: 1143 - DNA, 16 bp, Artificial Sequence
  synthetic [barcode part1]
taagatccacacgcgt

SEQ ID NO: 1144 - DNA, 16 bp, Artificial Sequence
  synthetic [barcode part1]
tactgagtatctctgc

SEQ ID NO: 1145 - DNA, 16 bp, Artificial Sequence
  synthetic [barcode part1]
ttcaccggcacctaac

SEQ ID NO: 1146 - DNA, 16 bp, Artificial Sequence
  synthetic [barcode part1]
ccagttcctcaacttc

SEQ ID NO: 1147 - DNA, 16 bp, Artificial Sequence
  synthetic [barcode part1]
acggcctattcctgtg

SEQ ID NO: 1148 - DNA, 16 bp, Artificial Sequence
  synthetic [barcode part1]
gtatccagacggagtg

SEQ ID NO: 1149 - DNA, 16 bp, Artificial Sequence
  synthetic [barcode part1]
accgcctgagttcgtt

SEQ ID NO: 1150 - DNA, 16 bp, Artificial Sequence
  synthetic [barcode part1]
gaaggatcgaatctgt

SEQ ID NO: 1151 - DNA, 16 bp, Artificial Sequence
  synthetic [barcode part1]
acgtgtaccgactaac

SEQ ID NO: 1152 - DNA, 16 bp, Artificial Sequence
  synthetic [barcode part1]
aattcaacgcaggaac

SEQ ID NO: 1153 - DNA, 16 bp, Artificial Sequence
  synthetic [barcode part1]
cgccgagacctctatt

SEQ ID NO: 1154 - DNA, 16 bp, Artificial Sequence
  synthetic [barcode part1]
ccggcaggaattactt

SEQ ID NO: 1155 - DNA, 16 bp, Artificial Sequence
  synthetic [barcode part1]
gcgtcgttattcaccg

SEQ ID NO: 1156 - DNA, 16 bp, Artificial Sequence
  synthetic [barcode part1]
cgccagttcttctgag

SEQ ID NO: 1157 - DNA, 16 bp, Artificial Sequence
  synthetic [barcode part1]
gttctccaccacgtag

SEQ ID NO: 1158 - DNA, 16 bp, Artificial Sequence
  synthetic [barcode part1]
gtctacctctgaggtc

SEQ ID NO: 1159 - DNA, 16 bp, Artificial Sequence
  synthetic [barcode part1]
tggtcttggaggactt

SEQ ID NO: 1160 - DNA, 16 bp, Artificial Sequence
  synthetic [barcode part1]
ccaattcagtggcagt

SEQ ID NO: 1161 - DNA, 16 bp, Artificial Sequence
  synthetic [barcode part1]
accaccgattgttgag

SEQ ID NO: 1162 - DNA, 16 bp, Artificial Sequence
  synthetic [barcode part1]
agttcttggttcgcgc

SEQ ID NO: 1163 - DNA, 16 bp, Artificial Sequence
  synthetic [barcode part1]
gatctagtcttacacc

SEQ ID NO: 1164 - DNA, 16 bp, Artificial Sequence
  synthetic [barcode part1]
gattgcgtcaagaagt

SEQ ID NO: 1165 - DNA, 16 bp, Artificial Sequence
  synthetic [barcode part1]
gaattgcactcgacac

SEQ ID NO: 1166 - DNA, 16 bp, Artificial Sequence
  synthetic [barcode part1]
ccactgtgttctgttc

SEQ ID NO: 1167 - DNA, 16 bp, Artificial Sequence
  synthetic [barcode part1]
ccactaattgacggtg

SEQ ID NO: 1168 - DNA, 16 bp, Artificial Sequence
  synthetic [barcode part1]
acaccgataacaaggt

SEQ ID NO: 1169 - DNA, 16 bp, Artificial Sequence
  synthetic [barcode part1]
aaccgagttatacgag

SEQ ID NO: 1170 - DNA, 16 bp, Artificial Sequence
  synthetic [barcode part1]
taactctcgcagtcgc

SEQ ID NO: 1171 - DNA, 16 bp, Artificial Sequence
  synthetic [barcode part1]
aagactaacgcaactg

SEQ ID NO: 1172 - DNA, 16 bp, Artificial Sequence
  synthetic [barcode part1]
acactccttaacaacc

SEQ ID NO: 1173 - DNA, 16 bp, Artificial Sequence
  synthetic [barcode part1]
gacacactggtacact

SEQ ID NO: 1174 - DNA, 16 bp, Artificial Sequence
  synthetic [barcode part1]
cagaatctctcaggac

SEQ ID NO: 1175 - DNA, 16 bp, Artificial Sequence
  synthetic [barcode part1]
ccttgtctaagtgccg

SEQ ID NO: 1176 - DNA, 16 bp, Artificial Sequence
  synthetic [barcode part1]
agttgcgtcaacttct

SEQ ID NO: 1177 - DNA, 16 bp, Artificial Sequence
  synthetic [barcode part1]
gtgttgagaagaccgc

SEQ ID NO: 1178 - DNA, 16 bp, Artificial Sequence
  synthetic [barcode part1]
tccgttgtcgatacgc

SEQ ID NO: 1179 - DNA, 16 bp, Artificial Sequence
  synthetic [barcode part1]
tccgcagatagacttg

SEQ ID NO: 1180 - DNA, 16 bp, Artificial Sequence
  synthetic [barcode part1]
atactaactggcgtgc

SEQ ID NO: 1181 - DNA, 16 bp, Artificial Sequence
  synthetic [barcode part1]
gaacaagtggacaggt

SEQ ID NO: 1182 - DNA, 16 bp, Artificial Sequence
  synthetic [barcode part1]
cgttggacgaaggtgt

SEQ ID NO: 1183 - DNA, 16 bp, Artificial Sequence
  synthetic [barcode part1]
ccggtctagtagtagt

SEQ ID NO: 1184 - DNA, 16 bp, Artificial Sequence
  synthetic [barcode part1]
aacactggtactgtgc

SEQ ID NO: 1185 - DNA, 16 bp, Artificial Sequence
  synthetic [barcode part1]
gtcagtactactactc

SEQ ID NO: 1186 - DNA, 16 bp, Artificial Sequence
  synthetic [barcode part1]
gcaataaccaccgttg

SEQ ID NO: 1187 - DNA, 16 bp, Artificial Sequence
  synthetic [barcode part1]
tactatccacctcacc

SEQ ID NO: 1188 - DNA, 16 bp, Artificial Sequence
  synthetic [barcode part1]
agattatcacttccgc

SEQ ID NO: 1189 - DNA, 16 bp, Artificial Sequence
  synthetic [barcode part1]
gtaacaatctgcgaag

SEQ ID NO: 1190 - DNA, 16 bp, Artificial Sequence
  synthetic [barcode part1]
tggaataccgtgtaag

SEQ ID NO: 1191 - DNA, 16 bp, Artificial Sequence
  synthetic [barcode part1]
ttcaacgataaggacg

SEQ ID NO: 1192 - DNA, 16 bp, Artificial Sequence
  synthetic [barcode part1]
aattcgccgtctagag

SEQ ID NO: 1193 - DNA, 16 bp, Artificial Sequence
  synthetic [barcode part1]
cctgttagtcgttcct

SEQ ID NO: 1194 - DNA, 16 bp, Artificial Sequence
  synthetic [barcode part1]
cgaggagtaattgtgt

SEQ ID NO: 1195 - DNA, 16 bp, Artificial Sequence
  synthetic [barcode part1]
cctgtatcgtgtctct

SEQ ID NO: 1196 - DNA, 16 bp, Artificial Sequence
  synthetic [barcode part1]
gtgattgcacgactac

SEQ ID NO: 1197 - DNA, 16 bp, Artificial Sequence
  synthetic [barcode part1]
gtcacgaccgtctact

SEQ ID NO: 1198 - DNA, 16 bp, Artificial Sequence
  synthetic [barcode part1]
ttaacgaagtgcgagt

SEQ ID NO: 1199 - DNA, 16 bp, Artificial Sequence
  synthetic [barcode part1]
aagtcgtcaggagtgc

SEQ ID NO: 1200 - DNA, 16 bp, Artificial Sequence
  synthetic [barcode part1]
tcgtcacgtaataggc

SEQ ID NO: 1201 - DNA, 16 bp, Artificial Sequence
  synthetic [barcode part1]
tgttcaggtacagtcg

SEQ ID NO: 1202 - DNA, 16 bp, Artificial Sequence
  synthetic [barcode part1]
gccggtgtgaagagtt

SEQ ID NO: 1203 - DNA, 16 bp, Artificial Sequence
  synthetic [barcode part1]
tggtagtcaatctggc

SEQ ID NO: 1204 - DNA, 16 bp, Artificial Sequence
  synthetic [barcode part1]
tcacgttggtggcctt

SEQ ID NO: 1205 - DNA, 16 bp, Artificial Sequence
  synthetic [barcode part1]
aagtaaccacgttgag

SEQ ID NO: 1206 - DNA, 16 bp, Artificial Sequence
  synthetic [barcode part1]
tcagtacgtactggtg

SEQ ID NO: 1207 - DNA, 16 bp, Artificial Sequence
  synthetic [barcode part1]
gagtggttgtgagtcg

SEQ ID NO: 1208 - DNA, 16 bp, Artificial Sequence
  synthetic [barcode part1]
gtgacgattacgtaag

SEQ ID NO: 1209 - DNA, 16 bp, Artificial Sequence
  synthetic [barcode part1]
gcagattcgtgaactc

SEQ ID NO: 1210 - DNA, 16 bp, Artificial Sequence
  synthetic [barcode part1]
gaggtacgatccagtg

SEQ ID NO: 1211 - DNA, 16 bp, Artificial Sequence
  synthetic [barcode part1]
aacgccgttggttaac

SEQ ID NO: 1212 - DNA, 16 bp, Artificial Sequence
  synthetic [barcode part1]
cgttagacttgtactc

SEQ ID NO: 1213 - DNA, 16 bp, Artificial Sequence
  synthetic [barcode part1]
tacgacttcagtgcag

SEQ ID NO: 1214 - DNA, 16 bp, Artificial Sequence
  synthetic [barcode part1]
gcgtgtaaggacttct

SEQ ID NO: 1215 - DNA, 16 bp, Artificial Sequence
  synthetic [barcode part1]
atcgttcaagtggcgt

SEQ ID NO: 1216 - DNA, 16 bp, Artificial Sequence
  synthetic [barcode part1]
aacacacgtgtgtcac

SEQ ID NO: 1217 - DNA, 16 bp, Artificial Sequence
  synthetic [barcode part1]
tcgtaagtccaacttc

SEQ ID NO: 1218 - DNA, 16 bp, Artificial Sequence
  synthetic [barcode part1]
ttgtcgcggatctacc

SEQ ID NO: 1219 - DNA, 16 bp, Artificial Sequence
  synthetic [barcode part1]
tgtatctgagtgcgac

SEQ ID NO: 1220 - DNA, 16 bp, Artificial Sequence
  synthetic [barcode part1]
tcctacagaccaccgt

SEQ ID NO: 1221 - DNA, 16 bp, Artificial Sequence
  synthetic [barcode part1]
atacggttcaactctc

SEQ ID NO: 1222 - DNA, 16 bp, Artificial Sequence
  synthetic [barcode part1]
ttagttcgcagtcgcc

SEQ ID NO: 1223 - DNA, 16 bp, Artificial Sequence
  synthetic [barcode part1]
gcctgtcctcagagtt

SEQ ID NO: 1224 - DNA, 16 bp, Artificial Sequence
  synthetic [barcode part1]
atccagtaagacacag

SEQ ID NO: 1225 - DNA, 16 bp, Artificial Sequence
  synthetic [barcode part1]
tctaaggaaggaaggc

SEQ ID NO: 1226 - DNA, 16 bp, Artificial Sequence
  synthetic [barcode part1]
ttggtggtaccgaact

SEQ ID NO: 1227 - DNA, 16 bp, Artificial Sequence
  synthetic [barcode part1]
agatctcttcctctcg

SEQ ID NO: 1228 - DNA, 16 bp, Artificial Sequence
  synthetic [barcode part1]
tatcctgtcgccttgt

SEQ ID NO: 1229 - DNA, 16 bp, Artificial Sequence
  synthetic [barcode part1]
cgcgacgatagtactt

SEQ ID NO: 1230 - DNA, 16 bp, Artificial Sequence
  synthetic [barcode part1]
caggttagttaggtcc

SEQ ID NO: 1231 - DNA, 16 bp, Artificial Sequence
  synthetic [barcode part1]
gtattccaatcgtcgt

SEQ ID NO: 1232 - DNA, 16 bp, Artificial Sequence
  synthetic [barcode part1]
ttcagacttcacggag

SEQ ID NO: 1233 - DNA, 16 bp, Artificial Sequence
  synthetic [barcode part1]
tcttctccggtgttac

SEQ ID NO: 1234 - DNA, 16 bp, Artificial Sequence
  synthetic [barcode part1]
accagacgaactgtct

SEQ ID NO: 1235 - DNA, 16 bp, Artificial Sequence
  synthetic [barcode part1]
tgacctccaacacacc

SEQ ID NO: 1236 - DNA, 16 bp, Artificial Sequence
  synthetic [barcode part1]
attaggaacgcgccag

SEQ ID NO: 1237 - DNA, 16 bp, Artificial Sequence
  synthetic [barcode part1]
gcgcgagttcgataag

SEQ ID NO: 1238 - DNA, 16 bp, Artificial Sequence
  synthetic [barcode part1]
tcgcggattattactc

SEQ ID NO: 1239 - DNA, 16 bp, Artificial Sequence
  synthetic [barcode part1]
cgtgaactactcgagt

SEQ ID NO: 1240 - DNA, 16 bp, Artificial Sequence
  synthetic [barcode part1]
acgaccgttagtctcc

SEQ ID NO: 1241 - DNA, 16 bp, Artificial Sequence
  synthetic [barcode part1]
tgttgtgtgtggtgtg

SEQ ID NO: 1242 - DNA, 16 bp, Artificial Sequence
  synthetic [barcode part1]
ttcacactcgagttgt

SEQ ID NO: 1243 - DNA, 16 bp, Artificial Sequence
  synthetic [barcode part1]
ccagaaggattacgcg

SEQ ID NO: 1244 - DNA, 16 bp, Artificial Sequence
  synthetic [barcode part1]
gtgcaatctaatctcc

SEQ ID NO: 1245 - DNA, 16 bp, Artificial Sequence
  synthetic [barcode part1]
aagtgcctcgccttgt

SEQ ID NO: 1246 - DNA, 16 bp, Artificial Sequence
  synthetic [barcode part1]
gataggcctcagaacg

SEQ ID NO: 1247 - DNA, 16 bp, Artificial Sequence
  synthetic [barcode part1]
ttggatcggttcaacg

SEQ ID NO: 1248 - DNA, 16 bp, Artificial Sequence
  synthetic [barcode part1]
tcagacaccacctcac

SEQ ID NO: 1249 - DNA, 16 bp, Artificial Sequence
  synthetic [barcode part1]
tcgaggatcctactag

SEQ ID NO: 1250 - DNA, 16 bp, Artificial Sequence
  synthetic [barcode part1]
cacggtgatagtatcc

SEQ ID NO: 1251 - DNA, 16 bp, Artificial Sequence
  synthetic [barcode part1]
ttggttctgtcggcgt

SEQ ID NO: 1252 - DNA, 16 bp, Artificial Sequence
  synthetic [barcode part1]
agttctgccgcaatag

SEQ ID NO: 1253 - DNA, 16 bp, Artificial Sequence
  synthetic [barcode part1]
gacaatccgcaaggac

SEQ ID NO: 1254 - DNA, 16 bp, Artificial Sequence
  synthetic [barcode part1]
tcctaccaccttactg

SEQ ID NO: 1255 - DNA, 16 bp, Artificial Sequence
  synthetic [barcode part1]
tcgaggacaatctctg

SEQ ID NO: 1256 - DNA, 16 bp, Artificial Sequence
  synthetic [barcode part1]
tgttgaggagtacggc

SEQ ID NO: 1257 - DNA, 16 bp, Artificial Sequence
  synthetic [barcode part1]
gttggcctatacacag

SEQ ID NO: 1258 - DNA, 16 bp, Artificial Sequence
  synthetic [barcode part1]
attgtctcttgccacc

SEQ ID NO: 1259 - DNA, 16 bp, Artificial Sequence
  synthetic [barcode part1]
actacgaacttacctc

SEQ ID NO: 1260 - DNA, 16 bp, Artificial Sequence
  synthetic [barcode part1]
gtagtggttgcacgag

SEQ ID NO: 1261 - DNA, 16 bp, Artificial Sequence
  synthetic [barcode part1]
tgcaacttgatccttg

SEQ ID NO: 1262 - DNA, 16 bp, Artificial Sequence
  synthetic [barcode part1]
tcgccttgattatacg

SEQ ID NO: 1263 - DNA, 16 bp, Artificial Sequence
  synthetic [barcode part1]
acttccgataaggacc

SEQ ID NO: 1264 - DNA, 16 bp, Artificial Sequence
  synthetic [barcode part1]
agagacgcaggaatac

SEQ ID NO: 1265 - DNA, 16 bp, Artificial Sequence
  synthetic [barcode part1]
agttcgtggcaagacg

SEQ ID NO: 1266 - DNA, 16 bp, Artificial Sequence
  synthetic [barcode part1]
tcctattcctagacag

SEQ ID NO: 1267 - DNA, 16 bp, Artificial Sequence
  synthetic [barcode part1]
aatcttaccacctacg

SEQ ID NO: 1268 - DNA, 16 bp, Artificial Sequence
  synthetic [barcode part1]
agtctccttctgtcac

SEQ ID NO: 1269 - DNA, 16 bp, Artificial Sequence
  synthetic [barcode part1]
ttacaggtaccaacgc

SEQ ID NO: 1270 - DNA, 16 bp, Artificial Sequence
  synthetic [barcode part1]
ccgttcgtgaacaagt

SEQ ID NO: 1271 - DNA, 16 bp, Artificial Sequence
  synthetic [barcode part1]
tcgaggcgaattctac

SEQ ID NO: 1272 - DNA, 16 bp, Artificial Sequence
  synthetic [barcode part1]
gtatcttcaactcgac

SEQ ID NO: 1273 - DNA, 16 bp, Artificial Sequence
  synthetic [barcode part1]
acacagtgtaccaacc

SEQ ID NO: 1274 - DNA, 16 bp, Artificial Sequence
  synthetic [barcode part1]
atcgcctctattccac

SEQ ID NO: 1275 - DNA, 16 bp, Artificial Sequence
  synthetic [barcode part1]
ttacttacgtcgcagt

SEQ ID NO: 1276 - DNA, 16 bp, Artificial Sequence
  synthetic [barcode part1]
acgtggaaggttattg

SEQ ID NO: 1277 - DNA, 16 bp, Artificial Sequence
  synthetic [barcode part1]
acaagaggcacaaggt

SEQ ID NO: 1278 - DNA, 16 bp, Artificial Sequence
  synthetic [barcode part1]
cgaaccgtagtagttc

SEQ ID NO: 1279 - DNA, 16 bp, Artificial Sequence
  synthetic [barcode part1]
tcctgtcgatatctag

SEQ ID NO: 1280 - DNA, 16 bp, Artificial Sequence
  synthetic [barcode part1]
tcgtctaacagacggt

SEQ ID NO: 1281 - DNA, 16 bp, Artificial Sequence
  synthetic [barcode part1]
gattgcgagagaactt

SEQ ID NO: 1282 - DNA, 16 bp, Artificial Sequence
  synthetic [barcode part1]
ttcgacctctcagttc

SEQ ID NO: 1283 - DNA, 16 bp, Artificial Sequence
  synthetic [barcode part1]
accgtaaggtgagtgc

SEQ ID NO: 1284 - DNA, 16 bp, Artificial Sequence
  synthetic [barcode part1]
cagttaggaccgattc

SEQ ID NO: 1285 - DNA, 16 bp, Artificial Sequence
  synthetic [barcode part1]
tcctcaggtaccgatc

SEQ ID NO: 1286 - DNA, 16 bp, Artificial Sequence
  synthetic [barcode part1]
tcaggacctcaagact

SEQ ID NO: 1287 - DNA, 16 bp, Artificial Sequence
  synthetic [barcode part1]
gtgagtcaagagttgt

SEQ ID NO: 1288 - DNA, 16 bp, Artificial Sequence
  synthetic [barcode part1]
cgcggttccaatatag

SEQ ID NO: 1289 - DNA, 16 bp, Artificial Sequence
  synthetic [barcode part1]
agttcacgacgtctag

SEQ ID NO: 1290 - DNA, 16 bp, Artificial Sequence
  synthetic [barcode part1]
gttgttcgtctgtagt

SEQ ID NO: 1291 - DNA, 16 bp, Artificial Sequence
  synthetic [barcode part1]
gaatctccttccttcg

SEQ ID NO: 1292 - DNA, 16 bp, Artificial Sequence
  synthetic [barcode part1]
agttgaccaaccaacc

SEQ ID NO: 1293 - DNA, 16 bp, Artificial Sequence
  synthetic [barcode part1]
atcagtgtgcctcgtc

SEQ ID NO: 1294 - DNA, 16 bp, Artificial Sequence
  synthetic [barcode part1]
tacgtcagtaccaacg

SEQ ID NO: 1295 - DNA, 16 bp, Artificial Sequence
  synthetic [barcode part1]
tgaggactgaattacg

SEQ ID NO: 1296 - DNA, 16 bp, Artificial Sequence
  synthetic [barcode part1]
aataacctggtggcct

SEQ ID NO: 1297 - DNA, 16 bp, Artificial Sequence
  synthetic [barcode part1]
acgcgacaatcctctc

SEQ ID NO: 1298 - DNA, 16 bp, Artificial Sequence
  synthetic [barcode part1]
gcgcacggattaactt

SEQ ID NO: 1299 - DNA, 16 bp, Artificial Sequence
  synthetic [barcode part1]
tggtagtctaagtcgc

SEQ ID NO: 1300 - DNA, 16 bp, Artificial Sequence
  synthetic [barcode part1]
gttagaccaccgaatc

SEQ ID NO: 1301 - DNA, 16 bp, Artificial Sequence
  synthetic [barcode part1]
aggatcttactgtggc

SEQ ID NO: 1302 - DNA, 16 bp, Artificial Sequence
  synthetic [barcode part1]
gtctagttcctacgcg

SEQ ID NO: 1303 - DNA, 16 bp, Artificial Sequence
  synthetic [barcode part1]
gtaacgcggaagaagt

SEQ ID NO: 1304 - DNA, 16 bp, Artificial Sequence
  synthetic [barcode part1]
gccactgtgtgttctg

SEQ ID NO: 1305 - DNA, 16 bp, Artificial Sequence
  synthetic [barcode part1]
ttgcgttgtctccgtt

SEQ ID NO: 1306 - DNA, 16 bp, Artificial Sequence
  synthetic [barcode part1]
tgaaccacctcacacc

SEQ ID NO: 1307 - DNA, 16 bp, Artificial Sequence
  synthetic [barcode part1]
aataccgccgatcaac

SEQ ID NO: 1308 - DNA, 16 bp, Artificial Sequence
  synthetic [barcode part1]
cagttaggagagagac

SEQ ID NO: 1309 - DNA, 16 bp, Artificial Sequence
  synthetic [barcode part1]
gaggaacagtgtgtcc

SEQ ID NO: 1310 - DNA, 16 bp, Artificial Sequence
  synthetic [barcode part1]
tctcgactcaagtatc

SEQ ID NO: 1311 - DNA, 16 bp, Artificial Sequence
  synthetic [barcode part1]
aatcacgttcctcggc

SEQ ID NO: 1312 - DNA, 16 bp, Artificial Sequence
  synthetic [barcode part1]
aacgaccttgaaccgt

SEQ ID NO: 1313 - DNA, 16 bp, Artificial Sequence
  synthetic [barcode part1]
ccactcgtactcactt

SEQ ID NO: 1314 - DNA, 16 bp, Artificial Sequence
  synthetic [barcode part1]
cggagagattggcgtt

SEQ ID NO: 1315 - DNA, 16 bp, Artificial Sequence
  synthetic [barcode part1]
tgccttcctaacggtg

SEQ ID NO: 1316 - DNA, 16 bp, Artificial Sequence
  synthetic [barcode part1]
aatcacgccgatctcc

SEQ ID NO: 1317 - DNA, 16 bp, Artificial Sequence
  synthetic [barcode part1]
gaagtggcctattacc

SEQ ID NO: 1318 - DNA, 16 bp, Artificial Sequence
  synthetic [barcode part1]
tgtcaccagacgtctc

SEQ ID NO: 1319 - DNA, 16 bp, Artificial Sequence
  synthetic [barcode part1]
accagtatagagaacc

SEQ ID NO: 1320 - DNA, 16 bp, Artificial Sequence
  synthetic [barcode part1]
gactcctcacgaactc

SEQ ID NO: 1321 - DNA, 16 bp, Artificial Sequence
  synthetic [barcode part1]
tggaccaactgtcagt

SEQ ID NO: 1322 - DNA, 16 bp, Artificial Sequence
  synthetic [barcode part1]
cggtcaacaatcggtt

SEQ ID NO: 1323 - DNA, 16 bp, Artificial Sequence
  synthetic [barcode part1]
tgcaatcaccgccttg

SEQ ID NO: 1324 - DNA, 16 bp, Artificial Sequence
  synthetic [barcode part1]
ttgaggtgtccgtctc

SEQ ID NO: 1325 - DNA, 16 bp, Artificial Sequence
  synthetic [barcode part1]
attcgcacaatccttg

SEQ ID NO: 1326 - DNA, 16 bp, Artificial Sequence
  synthetic [barcode part1]
cggattaagtcgtcac

SEQ ID NO: 1327 - DNA, 16 bp, Artificial Sequence
  synthetic [barcode part1]
tgatcttgtaccgatc

SEQ ID NO: 1328 - DNA, 16 bp, Artificial Sequence
  synthetic [barcode part1]
caggtagtctaggacg

SEQ ID NO: 1329 - DNA, 16 bp, Artificial Sequence
  synthetic [barcode part1]
atcagtcctccaagag

SEQ ID NO: 1330 - DNA, 16 bp, Artificial Sequence
  synthetic [barcode part1]
gttctgcacagaacac

SEQ ID NO: 1331 - DNA, 16 bp, Artificial Sequence
  synthetic [barcode part1]
gcgccgaattggaagt

SEQ ID NO: 1332 - DNA, 16 bp, Artificial Sequence
  synthetic [barcode part1]
cgtggtgcgttataac

SEQ ID NO: 1333 - DNA, 16 bp, Artificial Sequence
  synthetic [barcode part1]
tactggtggttagaag

SEQ ID NO: 1334 - DNA, 16 bp, Artificial Sequence
  synthetic [barcode part1]
tataactcacgccgag

SEQ ID NO: 1335 - DNA, 16 bp, Artificial Sequence
  synthetic [barcode part1]
gagactgcagtagaag

SEQ ID NO: 1336 - DNA, 16 bp, Artificial Sequence
  synthetic [barcode part1]
gacgaacacagacaag

SEQ ID NO: 1337 - DNA, 16 bp, Artificial Sequence
  synthetic [barcode part1]
ttctcaggtacgttgt

SEQ ID NO: 1338 - DNA, 16 bp, Artificial Sequence
  synthetic [barcode part1]
accaccttctgagtgc

SEQ ID NO: 1339 - DNA, 16 bp, Artificial Sequence
  synthetic [barcode part1]
gtacacagtactacgc

SEQ ID NO: 1340 - DNA, 16 bp, Artificial Sequence
  synthetic [barcode part1]
cctccaatataactgc

SEQ ID NO: 1341 - DNA, 16 bp, Artificial Sequence
  synthetic [barcode part1]
acgaagacagtggcct

SEQ ID NO: 1342 - DNA, 16 bp, Artificial Sequence
  synthetic [barcode part1]
cctcgagtgtctgttg

SEQ ID NO: 1343 - DNA, 16 bp, Artificial Sequence
  synthetic [barcode part1]
tgttggaaggtgtaac

SEQ ID NO: 1344 - DNA, 16 bp, Artificial Sequence
  synthetic [barcode part1]
acgtctcctggatcac

SEQ ID NO: 1345 - DNA, 16 bp, Artificial Sequence
  synthetic [barcode part1]
tggtgcaatatccggt

SEQ ID NO: 1346 - DNA, 16 bp, Artificial Sequence
  synthetic [barcode part1]
agttgacacacacgtc

SEQ ID NO: 1347 - DNA, 16 bp, Artificial Sequence
  synthetic [barcode part1]
aggttctgaggttctg

SEQ ID NO: 1348 - DNA, 16 bp, Artificial Sequence
  synthetic [barcode part1]
gacaatccgacagttc

SEQ ID NO: 1349 - DNA, 16 bp, Artificial Sequence
  synthetic [barcode part1]
agttattccgcacttg

SEQ ID NO: 1350 - DNA, 16 bp, Artificial Sequence
  synthetic [barcode part1]
cagtgataccgaatcc

SEQ ID NO: 1351 - DNA, 16 bp, Artificial Sequence
  synthetic [barcode part1]
acgtactcgaatccag

SEQ ID NO: 1352 - DNA, 16 bp, Artificial Sequence
  synthetic [barcode part1]
actaccaggaggtacg

SEQ ID NO: 1353 - DNA, 16 bp, Artificial Sequence
  synthetic [barcode part1]
tgcacgcagttaatcg

SEQ ID NO: 1354 - DNA, 16 bp, Artificial Sequence
  synthetic [barcode part1]
aattgacactggccgt

SEQ ID NO: 1355 - DNA, 16 bp, Artificial Sequence
  synthetic [barcode part1]
cactgaacactctcgc

SEQ ID NO: 1356 - DNA, 16 bp, Artificial Sequence
  synthetic [barcode part1]
ccgactggtgttatag

SEQ ID NO: 1357 - DNA, 16 bp, Artificial Sequence
  synthetic [barcode part1]
attgcggttgtctact

SEQ ID NO: 1358 - DNA, 16 bp, Artificial Sequence
  synthetic [barcode part1]
cgtgaagaatccggtg

SEQ ID NO: 1359 - DNA, 16 bp, Artificial Sequence
  synthetic [barcode part1]
tagtacggactcgtac

SEQ ID NO: 1360 - DNA, 16 bp, Artificial Sequence
  synthetic [barcode part1]
gtggttgacgtactgt

SEQ ID NO: 1361 - DNA, 16 bp, Artificial Sequence
  synthetic [barcode part1]
gttgttcgcaggcctt

SEQ ID NO: 1362 - DNA, 16 bp, Artificial Sequence
  synthetic [barcode part1]
gttgcaagacaggcac

SEQ ID NO: 1363 - DNA, 16 bp, Artificial Sequence
  synthetic [barcode part1]
tacgtaggtgattgcc

SEQ ID NO: 1364 - DNA, 16 bp, Artificial Sequence
  synthetic [barcode part1]
gactgttcgaactgtg

SEQ ID NO: 1365 - DNA, 16 bp, Artificial Sequence
  synthetic [barcode part1]
ataaccgaggaggtcc

SEQ ID NO: 1366 - DNA, 16 bp, Artificial Sequence
  synthetic [barcode part1]
aatcgactctctcctc

SEQ ID NO: 1367 - DNA, 16 bp, Artificial Sequence
  synthetic [barcode part1]
tattccgttcaggtgt

SEQ ID NO: 1368 - DNA, 16 bp, Artificial Sequence
  synthetic [barcode part1]
ttggtcagttgtgacg

SEQ ID NO: 1369 - DNA, 16 bp, Artificial Sequence
  synthetic [barcode part1]
tgtcggcctgatcttg

SEQ ID NO: 1370 - DNA, 16 bp, Artificial Sequence
  synthetic [barcode part1]
gactgttggcgtagag

SEQ ID NO: 1371 - DNA, 16 bp, Artificial Sequence
  synthetic [barcode part1]
tcgtatcgagtcactt

SEQ ID NO: 1372 - DNA, 16 bp, Artificial Sequence
  synthetic [barcode part1]
ccaataagacacgagt

SEQ ID NO: 1373 - DNA, 16 bp, Artificial Sequence
  synthetic [barcode part1]
caatacgccaacacac

SEQ ID NO: 1374 - DNA, 16 bp, Artificial Sequence
  synthetic [barcode part1]
gaagtgcaatctaacg

SEQ ID NO: 1375 - DNA, 16 bp, Artificial Sequence
  synthetic [barcode part1]
agaactcgcagataac

SEQ ID NO: 1376 - DNA, 16 bp, Artificial Sequence
  synthetic [barcode part1]
cagtgtaccagtacac

SEQ ID NO: 1377 - DNA, 16 bp, Artificial Sequence
  synthetic [barcode part1]
gatcggatccaacttg

SEQ ID NO: 1378 - DNA, 16 bp, Artificial Sequence
  synthetic [barcode part1]
gtacgagatccttgtg

SEQ ID NO: 1379 - DNA, 16 bp, Artificial Sequence
  synthetic [barcode part1]
aggttcggatacacct

SEQ ID NO: 1380 - DNA, 16 bp, Artificial Sequence
  synthetic [barcode part1]
tccaggataacgtcgt

SEQ ID NO: 1381 - DNA, 16 bp, Artificial Sequence
  synthetic [barcode part1]
cagttctactgtgtgt

SEQ ID NO: 1382 - DNA, 16 bp, Artificial Sequence
  synthetic [barcode part1]
tattcgtgacgttacc

SEQ ID NO: 1383 - DNA, 16 bp, Artificial Sequence
  synthetic [barcode part1]
gaacactctgttctac

SEQ ID NO: 1384 - DNA, 16 bp, Artificial Sequence
  synthetic [barcode part1]
gtgcgtggtattgtac

SEQ ID NO: 1385 - DNA, 16 bp, Artificial Sequence
  synthetic [barcode part1]
attgacctcctcttcg

SEQ ID NO: 1386 - DNA, 16 bp, Artificial Sequence
  synthetic [barcode part1]
acagttgatcgtacgc

SEQ ID NO: 1387 - DNA, 16 bp, Artificial Sequence
  synthetic [barcode part1]
gccgtctagtactcgt

SEQ ID NO: 1388 - DNA, 16 bp, Artificial Sequence
  synthetic [barcode part1]
accttcggacgattcc

SEQ ID NO: 1389 - DNA, 16 bp, Artificial Sequence
  synthetic [barcode part1]
cgtacgcctaactaag

SEQ ID NO: 1390 - DNA, 16 bp, Artificial Sequence
  synthetic [barcode part1]
gtcgtgcgagaactag

SEQ ID NO: 1391 - DNA, 16 bp, Artificial Sequence
  synthetic [barcode part1]
gagacagagtgcctac

SEQ ID NO: 1392 - DNA, 16 bp, Artificial Sequence
  synthetic [barcode part1]
acttacctccacctgt

SEQ ID NO: 1393 - DNA, 16 bp, Artificial Sequence
  synthetic [barcode part1]
tcctcttgaggttctc

SEQ ID NO: 1394 - DNA, 16 bp, Artificial Sequence
  synthetic [barcode part1]
aacagtaacggcgaag

SEQ ID NO: 1395 - DNA, 16 bp, Artificial Sequence
  synthetic [barcode part1]
actgtccgaactcgtc

SEQ ID NO: 1396 - DNA, 16 bp, Artificial Sequence
  synthetic [barcode part1]
cctgaatcttggcctg

SEQ ID NO: 1397 - DNA, 16 bp, Artificial Sequence
  synthetic [barcode part1]
tgtaggtcagaacaac

SEQ ID NO: 1398 - DNA, 16 bp, Artificial Sequence
  synthetic [barcode part1]
gtcttacctcggttct

SEQ ID NO: 1399 - DNA, 16 bp, Artificial Sequence
  synthetic [barcode part1]
agatcctaactgaccg

SEQ ID NO: 1400 - DNA, 16 bp, Artificial Sequence
  synthetic [barcode part1]
acacgttaggccagag

SEQ ID NO: 1401 - DNA, 16 bp, Artificial Sequence
  synthetic [barcode part1]
cctccttacgcgtatt

SEQ ID NO: 1402 - DNA, 16 bp, Artificial Sequence
  synthetic [barcode part1]
tcctcctactaaccgt

SEQ ID NO: 1403 - DNA, 16 bp, Artificial Sequence
  synthetic [barcode part1]
attagatcgagagtgc

SEQ ID NO: 1404 - DNA, 16 bp, Artificial Sequence
  synthetic [barcode part1]
ttcgacttgtgcgatt

SEQ ID NO: 1405 - DNA, 16 bp, Artificial Sequence
  synthetic [barcode part1]
aaggatataccaggtc

SEQ ID NO: 1406 - DNA, 16 bp, Artificial Sequence
  synthetic [barcode part1]
gtcgcgtctctgttag

SEQ ID NO: 1407 - DNA, 16 bp, Artificial Sequence
  synthetic [barcode part1]
actcagtccggattag

SEQ ID NO: 1408 - DNA, 16 bp, Artificial Sequence
  synthetic [barcode part1]
cgacttagtagaagtg

SEQ ID NO: 1409 - DNA, 16 bp, Artificial Sequence
  synthetic [barcode part1]
gatctctaactgcact

SEQ ID NO: 1410 - DNA, 16 bp, Artificial Sequence
  synthetic [barcode part1]
tgcctgcagtgtcgtt

SEQ ID NO: 1411 - DNA, 16 bp, Artificial Sequence
  synthetic [barcode part1]
atccggagttcgtagt

SEQ ID NO: 1412 - DNA, 16 bp, Artificial Sequence
  synthetic [barcode part1]
gaggacttacgattag

SEQ ID NO: 1413 - DNA, 16 bp, Artificial Sequence
  synthetic [barcode part1]
ccagattccagactag

SEQ ID NO: 1414 - DNA, 16 bp, Artificial Sequence
  synthetic [barcode part1]
tgatcctaggatcggt

SEQ ID NO: 1415 - DNA, 16 bp, Artificial Sequence
  synthetic [barcode part1]
ccgttggtcgaattag

SEQ ID NO: 1416 - DNA, 16 bp, Artificial Sequence
  synthetic [barcode part1]
ataagtggagtcctag

SEQ ID NO: 1417 - DNA, 16 bp, Artificial Sequence
  synthetic [barcode part1]
tacgtcttccacacct

SEQ ID NO: 1418 - DNA, 16 bp, Artificial Sequence
  synthetic [barcode part1]
cactcactctggaacc

SEQ ID NO: 1419 - DNA, 16 bp, Artificial Sequence
  synthetic [barcode part1]
gtaattggtgccggtt

SEQ ID NO: 1420 - DNA, 16 bp, Artificial Sequence
  synthetic [barcode part1]
atctcttgtcagtacg

SEQ ID NO: 1421 - DNA, 16 bp, Artificial Sequence
  synthetic [barcode part1]
tgtggtatatccactc

SEQ ID NO: 1422 - DNA, 16 bp, Artificial Sequence
  synthetic [barcode part1]
aggttggagtcttctg

SEQ ID NO: 1423 - DNA, 16 bp, Artificial Sequence
  synthetic [barcode part1]
taacacgccttgttac

SEQ ID NO: 1424 - DNA, 16 bp, Artificial Sequence
  synthetic [barcode part1]
gaacttactgcgcagt

SEQ ID NO: 1425 - DNA, 16 bp, Artificial Sequence
  synthetic [barcode part1]
taagtgaggatcctag

SEQ ID NO: 1426 - DNA, 16 bp, Artificial Sequence
  synthetic [barcode part1]
gcggacgtattataag

SEQ ID NO: 1427 - DNA, 16 bp, Artificial Sequence
  synthetic [barcode part1]
gtctaagacctgtgac

SEQ ID NO: 1428 - DNA, 16 bp, Artificial Sequence
  synthetic [barcode part1]
cgtctcgtatcgtctt

SEQ ID NO: 1429 - DNA, 16 bp, Artificial Sequence
  synthetic [barcode part1]
tctcaacaaccgtact

SEQ ID NO: 1430 - DNA, 16 bp, Artificial Sequence
  synthetic [barcode part1]
ccgactctaccaacgt

SEQ ID NO: 1431 - DNA, 16 bp, Artificial Sequence
  synthetic [barcode part1]
cggatcgtgcaagaac

SEQ ID NO: 1432 - DNA, 16 bp, Artificial Sequence
  synthetic [barcode part1]
gcgtataggttagtcc

SEQ ID NO: 1433 - DNA, 16 bp, Artificial Sequence
  synthetic [barcode part1]
agttcgtcgagtatcg

SEQ ID NO: 1434 - DNA, 16 bp, Artificial Sequence
  synthetic [barcode part1]
agtacggactcaatag

SEQ ID NO: 1435 - DNA, 16 bp, Artificial Sequence
  synthetic [barcode part1]
agagaagaggagagag

SEQ ID NO: 1436 - DNA, 16 bp, Artificial Sequence
  synthetic [barcode part1]
tgccttgacaataggc

SEQ ID NO: 1437 - DNA, 16 bp, Artificial Sequence
  synthetic [barcode part1]
ccttggcaactgcact

SEQ ID NO: 1438 - DNA, 16 bp, Artificial Sequence
  synthetic [barcode part1]
gaatcaatagtacgcg

SEQ ID NO: 1439 - DNA, 16 bp, Artificial Sequence
  synthetic [barcode part1]
tggtctatccgtattg

SEQ ID NO: 1440 - DNA, 16 bp, Artificial Sequence
  synthetic [barcode part1]
tgaccgatctcctctt

SEQ ID NO: 1441 - DNA, 16 bp, Artificial Sequence
  synthetic [barcode part1]
tgccgaaggtacgagt

SEQ ID NO: 1442 - DNA, 16 bp, Artificial Sequence
  synthetic [barcode part1]
gtagttcggtgcgaag

SEQ ID NO: 1443 - DNA, 16 bp, Artificial Sequence
  synthetic [barcode part1]
ccttgacctagacgtc

SEQ ID NO: 1444 - DNA, 16 bp, Artificial Sequence
  synthetic [barcode part1]
aatcgtgtctcggtcc

SEQ ID NO: 1445 - DNA, 16 bp, Artificial Sequence
  synthetic [barcode part1]
tagtcggaggactctt

SEQ ID NO: 1446 - DNA, 16 bp, Artificial Sequence
  synthetic [barcode part1]
aggactgcgatagaag

SEQ ID NO: 1447 - DNA, 16 bp, Artificial Sequence
  synthetic [barcode part1]
gcacctctcgacagtt

SEQ ID NO: 1448 - DNA, 16 bp, Artificial Sequence
  synthetic [barcode part1]
gcgtattaagttggag

SEQ ID NO: 1449 - DNA, 16 bp, Artificial Sequence
  synthetic [barcode part1]
gacgttaagttccgac

SEQ ID NO: 1450 - DNA, 16 bp, Artificial Sequence
  synthetic [barcode part1]
gtataatccggtcttc

SEQ ID NO: 1451 - DNA, 16 bp, Artificial Sequence
  synthetic [barcode part1]
gaggtggaacagagtt

SEQ ID NO: 1452 - DNA, 16 bp, Artificial Sequence
  synthetic [barcode part1]
ccttcttgtacgtacc

SEQ ID NO: 1453 - DNA, 16 bp, Artificial Sequence
  synthetic [barcode part1]
attgcgaggcaggtac

SEQ ID NO: 1454 - DNA, 16 bp, Artificial Sequence
  synthetic [barcode part1]
accggtgttatacgac

SEQ ID NO: 1455 - DNA, 16 bp, Artificial Sequence
  synthetic [barcode part1]
gttggacttcgtgcct

SEQ ID NO: 1456 - DNA, 16 bp, Artificial Sequence
  synthetic [barcode part1]
agacctaactcctcgc

SEQ ID NO: 1457 - DNA, 16 bp, Artificial Sequence
  synthetic [barcode part1]
tctcggtacgcctaac

SEQ ID NO: 1458 - DNA, 16 bp, Artificial Sequence
  synthetic [barcode part1]
caggaacttgtgtctg

SEQ ID NO: 1459 - DNA, 16 bp, Artificial Sequence
  synthetic [barcode part1]
gccaagacgatcacag

SEQ ID NO: 1460 - DNA, 16 bp, Artificial Sequence
  synthetic [barcode part1]
atacacggttaaccgc

SEQ ID NO: 1461 - DNA, 16 bp, Artificial Sequence
  synthetic [barcode part1]
ttctacgtcgaatcgt

SEQ ID NO: 1462 - DNA, 16 bp, Artificial Sequence
  synthetic [barcode part1]
gaccttaggtactacg

SEQ ID NO: 1463 - DNA, 16 bp, Artificial Sequence
  synthetic [barcode part1]
gaagtctcctaagacc

SEQ ID NO: 1464 - DNA, 16 bp, Artificial Sequence
  synthetic [barcode part1]
tccttggacactggtc

SEQ ID NO: 1465 - DNA, 16 bp, Artificial Sequence
  synthetic [barcode part1]
acctcgttaccaacgc

SEQ ID NO: 1466 - DNA, 16 bp, Artificial Sequence
  synthetic [barcode part1]
tgagactcagtactgc

SEQ ID NO: 1467 - DNA, 16 bp, Artificial Sequence
  synthetic [barcode part1]
cctgtctgaatagacg

SEQ ID NO: 1468 - DNA, 16 bp, Artificial Sequence
  synthetic [barcode part1]
tacggagtgcaagaag

SEQ ID NO: 1469 - DNA, 16 bp, Artificial Sequence
  synthetic [barcode part1]
tccagttattgcacgt

SEQ ID NO: 1470 - DNA, 16 bp, Artificial Sequence
  synthetic [barcode part1]
cgttatctgccggtgt

SEQ ID NO: 1471 - DNA, 16 bp, Artificial Sequence
  synthetic [barcode part1]
tactcgcaacgtcgtc

SEQ ID NO: 1472 - DNA, 16 bp, Artificial Sequence
  synthetic [barcode part1]
aatacgaagaccgttg

SEQ ID NO: 1473 - DNA, 16 bp, Artificial Sequence
  synthetic [barcode part1]
gaagacctcaattccg

SEQ ID NO: 1474 - DNA, 16 bp, Artificial Sequence
  synthetic [barcode part1]
aagagtgccacgttct

SEQ ID NO: 1475 - DNA, 16 bp, Artificial Sequence
  synthetic [barcode part1]
atacacggacctcaac

SEQ ID NO: 1476 - DNA, 16 bp, Artificial Sequence
  synthetic [barcode part1]
ttgacgtactggtacg

SEQ ID NO: 1477 - DNA, 16 bp, Artificial Sequence
  synthetic [barcode part1]
acctgattaacgaccg

SEQ ID NO: 1478 - DNA, 16 bp, Artificial Sequence
  synthetic [barcode part1]
gaccaatactacggtc

SEQ ID NO: 1479 - DNA, 16 bp, Artificial Sequence
  synthetic [barcode part1]
gcgatcggactaagac

SEQ ID NO: 1480 - DNA, 16 bp, Artificial Sequence
  synthetic [barcode part1]
accagtagtaatcgcc

SEQ ID NO: 1481 - DNA, 16 bp, Artificial Sequence
  synthetic [barcode part1]
tcgcctgtatcacggt

SEQ ID NO: 1482 - DNA, 16 bp, Artificial Sequence
  synthetic [barcode part1]
attgcacggaacggtg

SEQ ID NO: 1483 - DNA, 16 bp, Artificial Sequence
  synthetic [barcode part1]
gttccaaggttgatcg

SEQ ID NO: 1484 - DNA, 16 bp, Artificial Sequence
  synthetic [barcode part1]
accggtagtgactgtt

SEQ ID NO: 1485 - DNA, 16 bp, Artificial Sequence
  synthetic [barcode part1]
acgaattatcgcctct

SEQ ID NO: 1486 - DNA, 16 bp, Artificial Sequence
  synthetic [barcode part1]
cacgcgattcgacttc

SEQ ID NO: 1487 - DNA, 16 bp, Artificial Sequence
  synthetic [barcode part1]
cgtataccttcttccg

SEQ ID NO: 1488 - DNA, 16 bp, Artificial Sequence
  synthetic [barcode part1]
tatacgacacctcgtt

SEQ ID NO: 1489 - DNA, 16 bp, Artificial Sequence
  synthetic [barcode part1]
tatatacggtcggtcg

SEQ ID NO: 1490 - DNA, 16 bp, Artificial Sequence
  synthetic [barcode part1]
tgaaccgttccgcact

SEQ ID NO: 1491 - DNA, 16 bp, Artificial Sequence
  synthetic [barcode part1]
cctggtcctaactctt

SEQ ID NO: 1492 - DNA, 16 bp, Artificial Sequence
  synthetic [barcode part1]
tgcaacaacaacgtcc

SEQ ID NO: 1493 - DNA, 16 bp, Artificial Sequence
  synthetic [barcode part1]
tctacttaacgttgcg

SEQ ID NO: 1494 - DNA, 16 bp, Artificial Sequence
  synthetic [barcode part1]
gtaaccggcgttagtt

SEQ ID NO: 1495 - DNA, 16 bp, Artificial Sequence
  synthetic [barcode part1]
ttcaactgaccgagac

SEQ ID NO: 1496 - DNA, 16 bp, Artificial Sequence
  synthetic [barcode part1]
accacagtgttcgcct

SEQ ID NO: 1497 - DNA, 16 bp, Artificial Sequence
  synthetic [barcode part1]
gtcactactggatcag

SEQ ID NO: 1498 - DNA, 16 bp, Artificial Sequence
  synthetic [barcode part1]
gaagtcgaactgcacg

SEQ ID NO: 1499 - DNA, 16 bp, Artificial Sequence
  synthetic [barcode part1]
aggacacggttcagtg

SEQ ID NO: 1500 - DNA, 16 bp, Artificial Sequence
  synthetic [barcode part1]
gacaggatccttagtc

SEQ ID NO: 1501 - DNA, 16 bp, Artificial Sequence
  synthetic [barcode part1]
tctgcgtgtcgtcaac

SEQ ID NO: 1502 - DNA, 16 bp, Artificial Sequence
  synthetic [barcode part1]
atagaccgtcgaaggc

SEQ ID NO: 1503 - DNA, 16 bp, Artificial Sequence
  synthetic [barcode part1]
gtgtgtaatacacgcc

SEQ ID NO: 1504 - DNA, 16 bp, Artificial Sequence
  synthetic [barcode part1]
gcgaacttgatagagt

SEQ ID NO: 1505 - DNA, 16 bp, Artificial Sequence
  synthetic [barcode part1]
agaggcacactgagtc

SEQ ID NO: 1506 - DNA, 16 bp, Artificial Sequence
  synthetic [barcode part1]
cagacgttacgtcagt

SEQ ID NO: 1507 - DNA, 16 bp, Artificial Sequence
  synthetic [barcode part1]
ccggtctcttgatctt

SEQ ID NO: 1508 - DNA, 16 bp, Artificial Sequence
  synthetic [barcode part1]
aacagaaccggcgtac

SEQ ID NO: 1509 - DNA, 16 bp, Artificial Sequence
  synthetic [barcode part1]
ccttgtccttgaatag

SEQ ID NO: 1510 - DNA, 16 bp, Artificial Sequence
  synthetic [barcode part1]
cacttaggaaggttag

SEQ ID NO: 1511 - DNA, 16 bp, Artificial Sequence
  synthetic [barcode part1]
gtaactcagattgccg

SEQ ID NO: 1512 - DNA, 16 bp, Artificial Sequence
  synthetic [barcode part1]
tggattgagttgccac

SEQ ID NO: 1513 - DNA, 16 bp, Artificial Sequence
  synthetic [barcode part1]
cagttagaccgattgc

SEQ ID NO: 1514 - DNA, 16 bp, Artificial Sequence
  synthetic [barcode part1]
attcgcagtgcgattg

SEQ ID NO: 1515 - DNA, 16 bp, Artificial Sequence
  synthetic [barcode part1]
caggaacctatcggag

SEQ ID NO: 1516 - DNA, 16 bp, Artificial Sequence
  synthetic [barcode part1]
tacctagtacgaaccg

SEQ ID NO: 1517 - DNA, 16 bp, Artificial Sequence
  synthetic [barcode part1]
gagttgcgtctctatt

SEQ ID NO: 1518 - DNA, 16 bp, Artificial Sequence
  synthetic [barcode part1]
agagaattaccagtgc

SEQ ID NO: 1519 - DNA, 16 bp, Artificial Sequence
  synthetic [barcode part1]
tattaccgcgaccgtc

SEQ ID NO: 1520 - DNA, 16 bp, Artificial Sequence
  synthetic [barcode part1]
ataggaagaagtgcgc

SEQ ID NO: 1521 - DNA, 16 bp, Artificial Sequence
  synthetic [barcode part1]
accaatctcaaccgag

SEQ ID NO: 1522 - DNA, 16 bp, Artificial Sequence
  synthetic [barcode part1]
gtacgtagtcagttgc

SEQ ID NO: 1523 - DNA, 16 bp, Artificial Sequence
  synthetic [barcode part1]
tacagacgagttcacc

SEQ ID NO: 1524 - DNA, 16 bp, Artificial Sequence
  synthetic [barcode part1]
cgtgtccacgagaatt

SEQ ID NO: 1525 - DNA, 16 bp, Artificial Sequence
  synthetic [barcode part1]
aacaactgcacgaagt

SEQ ID NO: 1526 - DNA, 16 bp, Artificial Sequence
  synthetic [barcode part1]
cagacgcaatctgtac

SEQ ID NO: 1527 - DNA, 16 bp, Artificial Sequence
  synthetic [barcode part1]
caggacactcgtagag

SEQ ID NO: 1528 - DNA, 16 bp, Artificial Sequence
  synthetic [barcode part1]
cacgaccggaatagtg

SEQ ID NO: 1529 - DNA, 16 bp, Artificial Sequence
  synthetic [barcode part1]
atcctccaccagtgtg

SEQ ID NO: 1530 - DNA, 16 bp, Artificial Sequence
  synthetic [barcode part1]
taacctgcagactgtg

SEQ ID NO: 1531 - DNA, 16 bp, Artificial Sequence
  synthetic [barcode part1]
acgtacgtcgaagtct

SEQ ID NO: 1532 - DNA, 16 bp, Artificial Sequence
  synthetic [barcode part1]
atcggtattcaactcc

SEQ ID NO: 1533 - DNA, 16 bp, Artificial Sequence
  synthetic [barcode part1]
gttcttatcgcgtctc

SEQ ID NO: 1534 - DNA, 16 bp, Artificial Sequence
  synthetic [barcode part1]
aatcagaagaccggag

SEQ ID NO: 1535 - DNA, 16 bp, Artificial Sequence
  synthetic [barcode part1]
tgcggaatcaacggtg

SEQ ID NO: 1536 - DNA, 16 bp, Artificial Sequence
  synthetic [barcode part1]
gaagtagaggtctact

SEQ ID NO: 1537 - DNA, 16 bp, Artificial Sequence
  synthetic [barcode part1]
taggaagtgatcgtgt

SEQ ID NO: 1538 - DNA, 16 bp, Artificial Sequence
  synthetic [barcode part1]
cctagttcgtgtagtt

SEQ ID NO: 1539 - DNA, 16 bp, Artificial Sequence
  synthetic [barcode part1]
gattggtcgataccac

SEQ ID NO: 1540 - DNA, 16 bp, Artificial Sequence
  synthetic [barcode part1]
gttacttaggtccgcc

SEQ ID NO: 1541 - DNA, 16 bp, Artificial Sequence
  synthetic [barcode part1]
tcaacggtaagagtgt

SEQ ID NO: 1542 - DNA, 16 bp, Artificial Sequence
  synthetic [barcode part1]
agtggtgagatctgcg

SEQ ID NO: 1543 - DNA, 16 bp, Artificial Sequence
  synthetic [barcode part1]
gcagttgtggttgtgt

SEQ ID NO: 1544 - DNA, 16 bp, Artificial Sequence
  synthetic [barcode part1]
accactatctcgtgcg

SEQ ID NO: 1545 - DNA, 16 bp, Artificial Sequence
  synthetic [barcode part1]
atccgccactccaagt

SEQ ID NO: 1546 - DNA, 16 bp, Artificial Sequence
  synthetic [barcode part1]
gtgcaaggacagtctg

SEQ ID NO: 1547 - DNA, 16 bp, Artificial Sequence
  synthetic [barcode part1]
ttgcaacactggtcag

SEQ ID NO: 1548 - DNA, 16 bp, Artificial Sequence
  synthetic [barcode part1]
acaatccgaatacgag

SEQ ID NO: 1549 - DNA, 16 bp, Artificial Sequence
  synthetic [barcode part1]
attcgcacggttctcg

SEQ ID NO: 1550 - DNA, 16 bp, Artificial Sequence
  synthetic [barcode part1]
accagactccgtacct

SEQ ID NO: 1551 - DNA, 16 bp, Artificial Sequence
  synthetic [barcode part1]
ccaggcggacagaatt

SEQ ID NO: 1552 - DNA, 16 bp, Artificial Sequence
  synthetic [barcode part1]
taatccggcggaagtg

SEQ ID NO: 1553 - DNA, 16 bp, Artificial Sequence
  synthetic [barcode part1]
ccgtgtcttgccaagt

SEQ ID NO: 1554 - DNA, 16 bp, Artificial Sequence
  synthetic [barcode part1]
aagtatccaccacctt

SEQ ID NO: 1555 - DNA, 16 bp, Artificial Sequence
  synthetic [barcode part1]
agattgccgagttacc

SEQ ID NO: 1556 - DNA, 16 bp, Artificial Sequence
  synthetic [barcode part1]
tcaaggtctgcgatac

SEQ ID NO: 1557 - DNA, 16 bp, Artificial Sequence
  synthetic [barcode part1]
ttcaccaggttgtgtt

SEQ ID NO: 1558 - DNA, 16 bp, Artificial Sequence
  synthetic [barcode part1]
ttgcgtaatcgacgtg

SEQ ID NO: 1559 - DNA, 16 bp, Artificial Sequence
  synthetic [barcode part1]
ttcgtgagtgagtctg

SEQ ID NO: 1560 - DNA, 16 bp, Artificial Sequence
  synthetic [barcode part1]
cgtgtcttattagacc

SEQ ID NO: 1561 - DNA, 16 bp, Artificial Sequence
  synthetic [barcode part1]
tctcagaacttgtctg

SEQ ID NO: 1562 - DNA, 16 bp, Artificial Sequence
  synthetic [barcode part1]
agttcttcctctgacc

SEQ ID NO: 1563 - DNA, 16 bp, Artificial Sequence
  synthetic [barcode part1]
cacaagtaacagagtc

SEQ ID NO: 1564 - DNA, 16 bp, Artificial Sequence
  synthetic [barcode part1]
ttctggttcgaacact

SEQ ID NO: 1565 - DNA, 16 bp, Artificial Sequence
  synthetic [barcode part1]
aggtcgttccacacct

SEQ ID NO: 1566 - DNA, 16 bp, Artificial Sequence
  synthetic [barcode part1]
agaagtgagtgacctt

SEQ ID NO: 1567 - DNA, 16 bp, Artificial Sequence
  synthetic [barcode part1]
accgtatcaatctctg

SEQ ID NO: 1568 - DNA, 16 bp, Artificial Sequence
  synthetic [barcode part1]
tgcaggaatcagattg

SEQ ID NO: 1569 - DNA, 16 bp, Artificial Sequence
  synthetic [barcode part1]
atactcggacactcag

SEQ ID NO: 1570 - DNA, 16 bp, Artificial Sequence
  synthetic [barcode part1]
tgacgagaagtggtag

SEQ ID NO: 1571 - DNA, 16 bp, Artificial Sequence
  synthetic [barcode part1]
atctggagaacctacc

SEQ ID NO: 1572 - DNA, 16 bp, Artificial Sequence
  synthetic [barcode part1]
agagagagaccgattg

SEQ ID NO: 1573 - DNA, 16 bp, Artificial Sequence
  synthetic [barcode part1]
atcgacaaggtcggac

SEQ ID NO: 1574 - DNA, 16 bp, Artificial Sequence
  synthetic [barcode part1]
agagtagtatccaggt

SEQ ID NO: 1575 - DNA, 16 bp, Artificial Sequence
  synthetic [barcode part1]
gtcgtggtagaacttc

SEQ ID NO: 1576 - DNA, 16 bp, Artificial Sequence
  synthetic [barcode part1]
ataacagtcgcgtaag

SEQ ID NO: 1577 - DNA, 16 bp, Artificial Sequence
  synthetic [barcode part1]
tcaataggacgcaagt

SEQ ID NO: 1578 - DNA, 16 bp, Artificial Sequence
  synthetic [barcode part1]
tcgttaggtgcggaag

SEQ ID NO: 1579 - DNA, 16 bp, Artificial Sequence
  synthetic [barcode part1]
tgtctcggcctacaac

SEQ ID NO: 1580 - DNA, 16 bp, Artificial Sequence
  synthetic [barcode part1]
cagagacggatcgttg

SEQ ID NO: 1581 - DNA, 16 bp, Artificial Sequence
  synthetic [barcode part1]
gacgaacaacgagtag

SEQ ID NO: 1582 - DNA, 16 bp, Artificial Sequence
  synthetic [barcode part1]
ttaagagtgtaggtcg

SEQ ID NO: 1583 - DNA, 16 bp, Artificial Sequence
  synthetic [barcode part1]
gtgttccgttaccgac

SEQ ID NO: 1584 - DNA, 16 bp, Artificial Sequence
  synthetic [barcode part1]
caacgtagtcaagaac

SEQ ID NO: 1585 - DNA, 16 bp, Artificial Sequence
  synthetic [barcode part1]
cgaccagactaatcac

SEQ ID NO: 1586 - DNA, 16 bp, Artificial Sequence
  synthetic [barcode part1]
tgagatctgtgacgtc

SEQ ID NO: 1587 - DNA, 16 bp, Artificial Sequence
  synthetic [barcode part1]
gtgacagtacttcacg

SEQ ID NO: 1588 - DNA, 16 bp, Artificial Sequence
  synthetic [barcode part1]
gtagaccaccgaaggt

SEQ ID NO: 1589 - DNA, 16 bp, Artificial Sequence
  synthetic [barcode part1]
cggtataacgtgatcc

SEQ ID NO: 1590 - DNA, 16 bp, Artificial Sequence
  synthetic [barcode part1]
ttcacaccagttcagt

SEQ ID NO: 1591 - DNA, 16 bp, Artificial Sequence
  synthetic [barcode part1]
gtcagttatcacggtg

SEQ ID NO: 1592 - DNA, 16 bp, Artificial Sequence
  synthetic [barcode part1]
gtgttaaggagtggtt

SEQ ID NO: 1593 - DNA, 16 bp, Artificial Sequence
  synthetic [barcode part1]
ccaatacagttggaag

SEQ ID NO: 1594 - DNA, 16 bp, Artificial Sequence
  synthetic [barcode part1]
acgcgaacctgacaag

SEQ ID NO: 1595 - DNA, 16 bp, Artificial Sequence
  synthetic [barcode part1]
gcaagagtagtctaac

SEQ ID NO: 1596 - DNA, 16 bp, Artificial Sequence
  synthetic [barcode part1]
tacggaccttgccgtt

SEQ ID NO: 1597 - DNA, 16 bp, Artificial Sequence
  synthetic [barcode part1]
cgtgaagtgtattccg

SEQ ID NO: 1598 - DNA, 16 bp, Artificial Sequence
  synthetic [barcode part1]
gtgttgacgtgaatcc

SEQ ID NO: 1599 - DNA, 16 bp, Artificial Sequence
  synthetic [barcode part1]
gtgagagagttcaatc

SEQ ID NO: 1600 - DNA, 16 bp, Artificial Sequence
  synthetic [barcode part1]
agtgtcggagattcct

SEQ ID NO: 1601 - DNA, 16 bp, Artificial Sequence
  synthetic [barcode part1]
agacggaacggataac

SEQ ID NO: 1602 - DNA, 16 bp, Artificial Sequence
  synthetic [barcode part1]
tgttactgcctaggcc

SEQ ID NO: 1603 - DNA, 16 bp, Artificial Sequence
  synthetic [barcode part1]
gaagtatagaggtgcg

SEQ ID NO: 1604 - DNA, 16 bp, Artificial Sequence
  synthetic [barcode part1]
agtacacgtgtcaacc

SEQ ID NO: 1605 - DNA, 16 bp, Artificial Sequence
  synthetic [barcode part1]
acgcgtgtaacactac

SEQ ID NO: 1606 - DNA, 16 bp, Artificial Sequence
  synthetic [barcode part1]
tcgaccgattgtagtg

SEQ ID NO: 1607 - DNA, 16 bp, Artificial Sequence
  synthetic [barcode part1]
cactactggtagtggt

SEQ ID NO: 1608 - DNA, 16 bp, Artificial Sequence
  synthetic [barcode part1]
aatatacacgccgacc

SEQ ID NO: 1609 - DNA, 16 bp, Artificial Sequence
  synthetic [barcode part1]
accgagactaacttcg

SEQ ID NO: 1610 - DNA, 16 bp, Artificial Sequence
  synthetic [barcode part1]
cagtagtctaacgacc

SEQ ID NO: 1611 - DNA, 16 bp, Artificial Sequence
  synthetic [barcode part1]
tccgcgcaattcagtc

SEQ ID NO: 1612 - DNA, 16 bp, Artificial Sequence
  synthetic [barcode part1]
agaacaacggatatcc

SEQ ID NO: 1613 - DNA, 16 bp, Artificial Sequence
  synthetic [barcode part1]
acaactgcaactgtgc

SEQ ID NO: 1614 - DNA, 16 bp, Artificial Sequence
  synthetic [barcode part1]
tcgacctcttgatctc

SEQ ID NO: 1615 - DNA, 16 bp, Artificial Sequence
  synthetic [barcode part1]
ttaggcaaccttactc

SEQ ID NO: 1616 - DNA, 16 bp, Artificial Sequence
  synthetic [barcode part1]
tctgcgcgatcactgt

SEQ ID NO: 1617 - DNA, 16 bp, Artificial Sequence
  synthetic [barcode part1]
atcacggcaggatctt

SEQ ID NO: 1618 - DNA, 16 bp, Artificial Sequence
  synthetic [barcode part1]
gccggtaagactagac

SEQ ID NO: 1619 - DNA, 16 bp, Artificial Sequence
  synthetic [barcode part1]
gttgcaatcgcgatac

SEQ ID NO: 1620 - DNA, 16 bp, Artificial Sequence
  synthetic [barcode part1]
gacacacactgtgtgt

SEQ ID NO: 1621 - DNA, 16 bp, Artificial Sequence
  synthetic [barcode part1]
tgaggtgcctaacttg

SEQ ID NO: 1622 - DNA, 16 bp, Artificial Sequence
  synthetic [barcode part1]
cagttaccagacctag

SEQ ID NO: 1623 - DNA, 16 bp, Artificial Sequence
  synthetic [barcode part1]
ttggtgaattctcgtc

SEQ ID NO: 1624 - DNA, 16 bp, Artificial Sequence
  synthetic [barcode part1]
gaggtctagtaggcgt

SEQ ID NO: 1625 - DNA, 16 bp, Artificial Sequence
  synthetic [barcode part1]
gcgatcactaactctt

SEQ ID NO: 1626 - DNA, 16 bp, Artificial Sequence
  synthetic [barcode part1]
agacgacgattacgcg

SEQ ID NO: 1627 - DNA, 16 bp, Artificial Sequence
  synthetic [barcode part1]
atatcggaggaaccgc

SEQ ID NO: 1628 - DNA, 16 bp, Artificial Sequence
  synthetic [barcode part1]
ttccttcgagaccttc

SEQ ID NO: 1629 - DNA, 16 bp, Artificial Sequence
  synthetic [barcode part1]
atataaccggtacgcc

SEQ ID NO: 1630 - DNA, 16 bp, Artificial Sequence
  synthetic [barcode part1]
actcaggcgagacagt

SEQ ID NO: 1631 - DNA, 16 bp, Artificial Sequence
  synthetic [barcode part1]
gagtaatagtccgtag

SEQ ID NO: 1632 - DNA, 16 bp, Artificial Sequence
  synthetic [barcode part1]
tgttccgagtggaatc

SEQ ID NO: 1633 - DNA, 16 bp, Artificial Sequence
  synthetic [barcode part1]
tagacaataaggcctg

SEQ ID NO: 1634 - DNA, 16 bp, Artificial Sequence
  synthetic [barcode part1]
ccgactctattggcgt

SEQ ID NO: 1635 - DNA, 16 bp, Artificial Sequence
  synthetic [barcode part1]
tgattcgcgaggacag

SEQ ID NO: 1636 - DNA, 16 bp, Artificial Sequence
  synthetic [barcode part1]
aggacctaggcgagtt

SEQ ID NO: 1637 - DNA, 16 bp, Artificial Sequence
  synthetic [barcode part1]
gcactctgtatctctc

SEQ ID NO: 1638 - DNA, 16 bp, Artificial Sequence
  synthetic [barcode part1]
cgaacacgaggtgact

SEQ ID NO: 1639 - DNA, 16 bp, Artificial Sequence
  synthetic [barcode part1]
tatcctatcgtgaacc

SEQ ID NO: 1640 - DNA, 16 bp, Artificial Sequence
  synthetic [barcode part1]
caggagatagtacgcc

SEQ ID NO: 1641 - DNA, 16 bp, Artificial Sequence
  synthetic [barcode part1]
gtcgaatctgtgcctc

SEQ ID NO: 1642 - DNA, 16 bp, Artificial Sequence
  synthetic [barcode part1]
cgcgtcaactgtatag

SEQ ID NO: 1643 - DNA, 16 bp, Artificial Sequence
  synthetic [barcode part1]
ccggttctagaggatt

SEQ ID NO: 1644 - DNA, 16 bp, Artificial Sequence
  synthetic [barcode part1]
gattaccggcaacttg

SEQ ID NO: 1645 - DNA, 16 bp, Artificial Sequence
  synthetic [barcode part1]
gcgtggtacgtattac

SEQ ID NO: 1646 - DNA, 16 bp, Artificial Sequence
  synthetic [barcode part1]
accgttaatacttccg

SEQ ID NO: 1647 - DNA, 16 bp, Artificial Sequence
  synthetic [barcode part1]
caacgacggtctgatt

SEQ ID NO: 1648 - DNA, 16 bp, Artificial Sequence
  synthetic [barcode part1]
gaccgtcagactattg

SEQ ID NO: 1649 - DNA, 16 bp, Artificial Sequence
  synthetic [barcode part1]
tgtcgaggtaagagtt

SEQ ID NO: 1650 - DNA, 16 bp, Artificial Sequence
  synthetic [barcode part1]
taacgtccgtcgtaag

SEQ ID NO: 1651 - DNA, 16 bp, Artificial Sequence
  synthetic [barcode part1]
tgacgatacgttcttc

SEQ ID NO: 1652 - DNA, 16 bp, Artificial Sequence
  synthetic [barcode part1]
tgtggacgtaagtcct

SEQ ID NO: 1653 - DNA, 16 bp, Artificial Sequence
  synthetic [barcode part1]
aacggaagtgcctggt

SEQ ID NO: 1654 - DNA, 16 bp, Artificial Sequence
  synthetic [barcode part1]
tcaagtgttaccttgc

SEQ ID NO: 1655 - DNA, 16 bp, Artificial Sequence
  synthetic [barcode part1]
ccactctcaattctcg

SEQ ID NO: 1656 - DNA, 16 bp, Artificial Sequence
  synthetic [barcode part1]
atctggagaactcgtc

SEQ ID NO: 1657 - DNA, 16 bp, Artificial Sequence
  synthetic [barcode part1]
ccgataacaccttcgc

SEQ ID NO: 1658 - DNA, 16 bp, Artificial Sequence
  synthetic [barcode part1]
gcaagaccttagatag

SEQ ID NO: 1659 - DNA, 16 bp, Artificial Sequence
  synthetic [barcode part1]
acttacctctgaggtt

SEQ ID NO: 1660 - DNA, 16 bp, Artificial Sequence
  synthetic [barcode part1]
ccttagaggacaggtg

SEQ ID NO: 1661 - DNA, 16 bp, Artificial Sequence
  synthetic [barcode part1]
ccttagacggaatctg

SEQ ID NO: 1662 - DNA, 16 bp, Artificial Sequence
  synthetic [barcode part1]
taggcgagtaacgtcg

SEQ ID NO: 1663 - DNA, 16 bp, Artificial Sequence
  synthetic [barcode part1]
gcctatcgacactacc

SEQ ID NO: 1664 - DNA, 16 bp, Artificial Sequence
  synthetic [barcode part1]
tctgcgcaattcgatt

SEQ ID NO: 1665 - DNA, 16 bp, Artificial Sequence
  synthetic [barcode part1]
tcttcagacactggtt

SEQ ID NO: 1666 - DNA, 16 bp, Artificial Sequence
  synthetic [barcode part1]
tacacagtacttcacc

SEQ ID NO: 1667 - DNA, 16 bp, Artificial Sequence
  synthetic [barcode part1]
tcaggatcttatccac

SEQ ID NO: 1668 - DNA, 16 bp, Artificial Sequence
  synthetic [barcode part1]
tccaaccacaccgatc

SEQ ID NO: 1669 - DNA, 16 bp, Artificial Sequence
  synthetic [barcode part1]
cggtatagtacttggc

SEQ ID NO: 1670 - DNA, 16 bp, Artificial Sequence
  synthetic [barcode part1]
gataggccactacgag

SEQ ID NO: 1671 - DNA, 16 bp, Artificial Sequence
  synthetic [barcode part1]
tgatcttcagtcgtac

SEQ ID NO: 1672 - DNA, 16 bp, Artificial Sequence
  synthetic [barcode part1]
tccagtattgccgaag

SEQ ID NO: 1673 - DNA, 16 bp, Artificial Sequence
  synthetic [barcode part1]
atagtactgtgcgcgt

SEQ ID NO: 1674 - DNA, 16 bp, Artificial Sequence
  synthetic [barcode part1]
ttcgccactcttgatc

SEQ ID NO: 1675 - DNA, 16 bp, Artificial Sequence
  synthetic [barcode part1]
aacttcgatcctggag

SEQ ID NO: 1676 - DNA, 16 bp, Artificial Sequence
  synthetic [barcode part1]
gtagtaccgataccac

SEQ ID NO: 1677 - DNA, 16 bp, Artificial Sequence
  synthetic [barcode part1]
attactctctgccgtc

SEQ ID NO: 1678 - DNA, 16 bp, Artificial Sequence
  synthetic [barcode part1]
cctatcctgtcacgag

SEQ ID NO: 1679 - DNA, 16 bp, Artificial Sequence
  synthetic [barcode part1]
tacgtcacaacgtacg

SEQ ID NO: 1680 - DNA, 16 bp, Artificial Sequence
  synthetic [barcode part1]
ttctacgcagtccggt

SEQ ID NO: 1681 - DNA, 16 bp, Artificial Sequence
  synthetic [barcode part1]
cagaggttatcaagtg

SEQ ID NO: 1682 - DNA, 16 bp, Artificial Sequence
  synthetic [barcode part1]
cgataggagactcacg

SEQ ID NO: 1683 - DNA, 16 bp, Artificial Sequence
  synthetic [barcode part1]
gagattcgtccacctc

SEQ ID NO: 1684 - DNA, 16 bp, Artificial Sequence
  synthetic [barcode part1]
gtgtaactagtcgtgc

SEQ ID NO: 1685 - DNA, 16 bp, Artificial Sequence
  synthetic [barcode part1]
gattacgacgttggtc

SEQ ID NO: 1686 - DNA, 16 bp, Artificial Sequence
  synthetic [barcode part1]
taagaagtgcggttac

SEQ ID NO: 1687 - DNA, 16 bp, Artificial Sequence
  synthetic [barcode part1]
caagatacttgcgaag

SEQ ID NO: 1688 - DNA, 16 bp, Artificial Sequence
  synthetic [barcode part1]
gaatcgcgtgattcgt

SEQ ID NO: 1689 - DNA, 16 bp, Artificial Sequence
  synthetic [barcode part1]
taggcagttcgttcag

SEQ ID NO: 1690 - DNA, 16 bp, Artificial Sequence
  synthetic [barcode part1]
acggtagttactaccg

SEQ ID NO: 1691 - DNA, 16 bp, Artificial Sequence
  synthetic [barcode part1]
gtctcggagttagttg

SEQ ID NO: 1692 - DNA, 16 bp, Artificial Sequence
  synthetic [barcode part1]
gatctcacacttatcg

SEQ ID NO: 1693 - DNA, 16 bp, Artificial Sequence
  synthetic [barcode part1]
gcaacttaacgtagag

SEQ ID NO: 1694 - DNA, 16 bp, Artificial Sequence
  synthetic [barcode part1]
gtacctacttgccgtg

SEQ ID NO: 1695 - DNA, 16 bp, Artificial Sequence
  synthetic [barcode part1]
aacacgtggagagtcc

SEQ ID NO: 1696 - DNA, 16 bp, Artificial Sequence
  synthetic [barcode part1]
gcctgcaatataaccg

SEQ ID NO: 1697 - DNA, 16 bp, Artificial Sequence
  synthetic [barcode part1]
atcctgcacgaagtac

SEQ ID NO: 1698 - DNA, 16 bp, Artificial Sequence
  synthetic [barcode part1]
ataccactgttcgttg

SEQ ID NO: 1699 - DNA, 16 bp, Artificial Sequence
  synthetic [barcode part1]
cgtaactcttcactag

SEQ ID NO: 1700 - DNA, 16 bp, Artificial Sequence
  synthetic [barcode part1]
ttgtagaccgccacct

SEQ ID NO: 1701 - DNA, 16 bp, Artificial Sequence
  synthetic [barcode part1]
gttcaaccgattcgag

SEQ ID NO: 1702 - DNA, 16 bp, Artificial Sequence
  synthetic [barcode part1]
ccttaagaacaccacg

SEQ ID NO: 1703 - DNA, 16 bp, Artificial Sequence
  synthetic [barcode part1]
acggtcgcaattgtac

SEQ ID NO: 1704 - DNA, 16 bp, Artificial Sequence
  synthetic [barcode part1]
tacagacacagactcc

SEQ ID NO: 1705 - DNA, 16 bp, Artificial Sequence
  synthetic [barcode part1]
cgcgcagagatatctt

SEQ ID NO: 1706 - DNA, 16 bp, Artificial Sequence
  synthetic [barcode part1]
tatagtagataggcgc

SEQ ID NO: 1707 - DNA, 16 bp, Artificial Sequence
  synthetic [barcode part1]
cacactagaaggattg

SEQ ID NO: 1708 - DNA, 16 bp, Artificial Sequence
  synthetic [barcode part1]
attggcgtgcctcact

SEQ ID NO: 1709 - DNA, 16 bp, Artificial Sequence
  synthetic [barcode part1]
aagtagatcgtaacgc

SEQ ID NO: 1710 - DNA, 16 bp, Artificial Sequence
  synthetic [barcode part1]
ataggaggttgtcagt

SEQ ID NO: 1711 - DNA, 16 bp, Artificial Sequence
  synthetic [barcode part1]
aggtatcggatctacc

SEQ ID NO: 1712 - DNA, 16 bp, Artificial Sequence
  synthetic [barcode part1]
ccaacggcctaataac

SEQ ID NO: 1713 - DNA, 16 bp, Artificial Sequence
  synthetic [barcode part1]
gaggttgacgtgactg

SEQ ID NO: 1714 - DNA, 16 bp, Artificial Sequence
  synthetic [barcode part1]
tagtcttccaacctcc

SEQ ID NO: 1715 - DNA, 16 bp, Artificial Sequence
  synthetic [barcode part1]
agtaactcgtggaagt

SEQ ID NO: 1716 - DNA, 16 bp, Artificial Sequence
  synthetic [barcode part1]
tgtgtggtattccact

SEQ ID NO: 1717 - DNA, 16 bp, Artificial Sequence
  synthetic [barcode part1]
atccagttggtctgag

SEQ ID NO: 1718 - DNA, 16 bp, Artificial Sequence
  synthetic [barcode part1]
gcgaaggcgacaactt

SEQ ID NO: 1719 - DNA, 16 bp, Artificial Sequence
  synthetic [barcode part1]
tgtagtgtgagtgaac

SEQ ID NO: 1720 - DNA, 16 bp, Artificial Sequence
  synthetic [barcode part1]
agacaccgaacgacgt

SEQ ID NO: 1721 - DNA, 16 bp, Artificial Sequence
  synthetic [barcode part1]
acgttgattaggcacc

SEQ ID NO: 1722 - DNA, 16 bp, Artificial Sequence
  synthetic [barcode part1]
ataaggtggcgaagtg

SEQ ID NO: 1723 - DNA, 16 bp, Artificial Sequence
  synthetic [barcode part1]
gatcctaacaacaccg

SEQ ID NO: 1724 - DNA, 16 bp, Artificial Sequence
  synthetic [barcode part1]
gtgtctaaggtagtag

SEQ ID NO: 1725 - DNA, 16 bp, Artificial Sequence
  synthetic [barcode part1]
tccggacttattgccg

SEQ ID NO: 1726 - DNA, 16 bp, Artificial Sequence
  synthetic [barcode part1]
cacgacacaagacctt

SEQ ID NO: 1727 - DNA, 16 bp, Artificial Sequence
  synthetic [barcode part1]
agaataggttcgcggc

SEQ ID NO: 1728 - DNA, 16 bp, Artificial Sequence
  synthetic [barcode part1]
tagtcgttcacgcaag

SEQ ID NO: 1729 - DNA, 16 bp, Artificial Sequence
  synthetic [barcode part1]
ataaccgatcacgcac

SEQ ID NO: 1730 - DNA, 16 bp, Artificial Sequence
  synthetic [barcode part1]
tgcgcaggtggaatac

SEQ ID NO: 1731 - DNA, 16 bp, Artificial Sequence
  synthetic [barcode part1]
aactgtgcgatcgtac

SEQ ID NO: 1732 - DNA, 16 bp, Artificial Sequence
  synthetic [barcode part1]
ttcaccagactcgcgt

SEQ ID NO: 1733 - DNA, 16 bp, Artificial Sequence
  synthetic [barcode part1]
tgtgacgtattcacct

SEQ ID NO: 1734 - DNA, 16 bp, Artificial Sequence
  synthetic [barcode part1]
gacagtccgcgttctt

SEQ ID NO: 1735 - DNA, 16 bp, Artificial Sequence
  synthetic [barcode part1]
ccgataacaaggatac

SEQ ID NO: 1736 - DNA, 16 bp, Artificial Sequence
  synthetic [barcode part1]
taggtataggacgact

SEQ ID NO: 1737 - DNA, 16 bp, Artificial Sequence
  synthetic [barcode part1]
aagtccagttcgaacc

SEQ ID NO: 1738 - DNA, 16 bp, Artificial Sequence
  synthetic [barcode part1]
actgtccagacctgtc

SEQ ID NO: 1739 - DNA, 16 bp, Artificial Sequence
  synthetic [barcode part1]
tctctagagaaggcct

SEQ ID NO: 1740 - DNA, 16 bp, Artificial Sequence
  synthetic [barcode part1]
ccaacttaatacgcct

SEQ ID NO: 1741 - DNA, 16 bp, Artificial Sequence
  synthetic [barcode part1]
ttatcacgatacctgc

SEQ ID NO: 1742 - DNA, 16 bp, Artificial Sequence
  synthetic [barcode part1]
aacactggtacacgtc

SEQ ID NO: 1743 - DNA, 16 bp, Artificial Sequence
  synthetic [barcode part1]
taggttaccttgcgtt

SEQ ID NO: 1744 - DNA, 16 bp, Artificial Sequence
  synthetic [barcode part1]
cgagtcacctcacact

SEQ ID NO: 1745 - DNA, 16 bp, Artificial Sequence
  synthetic [barcode part1]
tcacggacggaggatt

SEQ ID NO: 1746 - DNA, 16 bp, Artificial Sequence
  synthetic [barcode part1]
gtggattcacggattc

SEQ ID NO: 1747 - DNA, 16 bp, Artificial Sequence
  synthetic [barcode part1]
ttgtccgttgtagtac

SEQ ID NO: 1748 - DNA, 16 bp, Artificial Sequence
  synthetic [barcode part1]
tacaattccggtgcag

SEQ ID NO: 1749 - DNA, 16 bp, Artificial Sequence
  synthetic [barcode part1]
agatctgcactccacc

SEQ ID NO: 1750 - DNA, 16 bp, Artificial Sequence
  synthetic [barcode part1]
tggcaatcggtaactc

SEQ ID NO: 1751 - DNA, 16 bp, Artificial Sequence
  synthetic [barcode part1]
gacacagacttagtag

SEQ ID NO: 1752 - DNA, 16 bp, Artificial Sequence
  synthetic [barcode part1]
ttctaacgagacgacc

SEQ ID NO: 1753 - DNA, 16 bp, Artificial Sequence
  synthetic [barcode part1]
gactgtggttgtgtgt

SEQ ID NO: 1754 - DNA, 16 bp, Artificial Sequence
  synthetic [barcode part1]
ccgtcgacgtattctg

SEQ ID NO: 1755 - DNA, 16 bp, Artificial Sequence
  synthetic [barcode part1]
atattaggtgcggtcc

SEQ ID NO: 1756 - DNA, 16 bp, Artificial Sequence
  synthetic [barcode part1]
aactcttcgtaggttc

SEQ ID NO: 1757 - DNA, 16 bp, Artificial Sequence
  synthetic [barcode part1]
cgaaggaggaactaac

SEQ ID NO: 1758 - DNA, 16 bp, Artificial Sequence
  synthetic [barcode part1]
agatcctctctaggag

SEQ ID NO: 1759 - DNA, 16 bp, Artificial Sequence
  synthetic [barcode part1]
gttacagattcacctc

SEQ ID NO: 1760 - DNA, 16 bp, Artificial Sequence
  synthetic [barcode part1]
gtgcagaataatccag

SEQ ID NO: 1761 - DNA, 16 bp, Artificial Sequence
  synthetic [barcode part1]
acctcctattgcgcag

SEQ ID NO: 1762 - DNA, 16 bp, Artificial Sequence
  synthetic [barcode part1]
acctgagtatcactct

SEQ ID NO: 1763 - DNA, 16 bp, Artificial Sequence
  synthetic [barcode part1]
aatagttgcacaggac

SEQ ID NO: 1764 - DNA, 16 bp, Artificial Sequence
  synthetic [barcode part1]
ttctgtacgtgtctcc

SEQ ID NO: 1765 - DNA, 16 bp, Artificial Sequence
  synthetic [barcode part1]
tcttctcgaccttgac

SEQ ID NO: 1766 - DNA, 16 bp, Artificial Sequence
  synthetic [barcode part1]
ttcgcgtggaagtatc

SEQ ID NO: 1767 - DNA, 16 bp, Artificial Sequence
  synthetic [barcode part1]
tccgtcgaatccacgt

SEQ ID NO: 1768 - DNA, 16 bp, Artificial Sequence
  synthetic [barcode part1]
gatcgtagatctcttc

SEQ ID NO: 1769 - DNA, 16 bp, Artificial Sequence
  synthetic [barcode part1]
actcagaacagactcc

SEQ ID NO: 1770 - DNA, 16 bp, Artificial Sequence
  synthetic [barcode part1]
atcagtgcagatctgc

SEQ ID NO: 1771 - DNA, 16 bp, Artificial Sequence
  synthetic [barcode part1]
gatacacagaagactc

SEQ ID NO: 1772 - DNA, 16 bp, Artificial Sequence
  synthetic [barcode part1]
cagagttgaccttgac

SEQ ID NO: 1773 - DNA, 16 bp, Artificial Sequence
  synthetic [barcode part1]
aaggagagttacgacg

SEQ ID NO: 1774 - DNA, 16 bp, Artificial Sequence
  synthetic [barcode part1]
gaatcgtctcagtgac

SEQ ID NO: 1775 - DNA, 16 bp, Artificial Sequence
  synthetic [barcode part1]
agttgactgcacacac

SEQ ID NO: 1776 - DNA, 16 bp, Artificial Sequence
  synthetic [barcode part1]
aggttgcgtggaggtt

SEQ ID NO: 1777 - DNA, 16 bp, Artificial Sequence
  synthetic [barcode part1]
tgtgaggtacgagaag

SEQ ID NO: 1778 - DNA, 16 bp, Artificial Sequence
  synthetic [barcode part1]
ccaactatccttctcg

SEQ ID NO: 1779 - DNA, 16 bp, Artificial Sequence
  synthetic [barcode part1]
ttgcaggtgtcaacgt

SEQ ID NO: 1780 - DNA, 16 bp, Artificial Sequence
  synthetic [barcode part1]
tgcaacggtccactct

SEQ ID NO: 1781 - DNA, 16 bp, Artificial Sequence
  synthetic [barcode part1]
caggatccaacactgt

SEQ ID NO: 1782 - DNA, 16 bp, Artificial Sequence
  synthetic [barcode part1]
gttacgatccgtctgc

SEQ ID NO: 1783 - DNA, 16 bp, Artificial Sequence
  synthetic [barcode part1]
gcacttacctgttgcg

SEQ ID NO: 1784 - DNA, 16 bp, Artificial Sequence
  synthetic [barcode part1]
tgacagtgatccaacc

SEQ ID NO: 1785 - DNA, 16 bp, Artificial Sequence
  synthetic [barcode part1]
cgcgatataaggcctt

SEQ ID NO: 1786 - DNA, 16 bp, Artificial Sequence
  synthetic [barcode part1]
cctctctaaggtcctt

SEQ ID NO: 1787 - DNA, 16 bp, Artificial Sequence
  synthetic [barcode part1]
ataacgacaagtccag

SEQ ID NO: 1788 - DNA, 16 bp, Artificial Sequence
  synthetic [barcode part1]
ccaacgaattcctgtt

SEQ ID NO: 1789 - DNA, 16 bp, Artificial Sequence
  synthetic [barcode part1]
aaggacaaggtgtggt

SEQ ID NO: 1790 - DNA, 16 bp, Artificial Sequence
  synthetic [barcode part1]
tcctacaccgaaccgt

SEQ ID NO: 1791 - DNA, 16 bp, Artificial Sequence
  synthetic [barcode part1]
cgttctctgtacttcg

SEQ ID NO: 1792 - DNA, 16 bp, Artificial Sequence
  synthetic [barcode part1]
cgatacacgaccttcc

SEQ ID NO: 1793 - DNA, 16 bp, Artificial Sequence
  synthetic [barcode part1]
ttacacgaaggagttg

SEQ ID NO: 1794 - DNA, 16 bp, Artificial Sequence
  synthetic [barcode part1]
ccttattacctcaccg

SEQ ID NO: 1795 - DNA, 16 bp, Artificial Sequence
  synthetic [barcode part1]
gtctctcttgagagag

SEQ ID NO: 1796 - DNA, 16 bp, Artificial Sequence
  synthetic [barcode part1]
gacttcttacggatct

SEQ ID NO: 1797 - DNA, 16 bp, Artificial Sequence
  synthetic [barcode part1]
agtagtcacactcttc

SEQ ID NO: 1798 - DNA, 16 bp, Artificial Sequence
  synthetic [barcode part1]
gatccaagttgttggc

SEQ ID NO: 1799 - DNA, 16 bp, Artificial Sequence
  synthetic [barcode part1]
ttgagactctaaggcc

SEQ ID NO: 1800 - DNA, 16 bp, Artificial Sequence
  synthetic [barcode part1]
gcacacactagttggt

SEQ ID NO: 1801 - DNA, 16 bp, Artificial Sequence
  synthetic [barcode part1]
ccgatatacgtgtcag

SEQ ID NO: 1802 - DNA, 16 bp, Artificial Sequence
  synthetic [barcode part1]
gtgcacacgtatacgt

SEQ ID NO: 1803 - DNA, 16 bp, Artificial Sequence
  synthetic [barcode part1]
caagtacgaggatcgc

SEQ ID NO: 1804 - DNA, 16 bp, Artificial Sequence
  synthetic [barcode part1]
attataggacgccacc

SEQ ID NO: 1805 - DNA, 16 bp, Artificial Sequence
  synthetic [barcode part1]
ccgtaattgaccagtg

SEQ ID NO: 1806 - DNA, 16 bp, Artificial Sequence
  synthetic [barcode part1]
tgaagaatacgcgatc

SEQ ID NO: 1807 - DNA, 16 bp, Artificial Sequence
  synthetic [barcode part1]
cgcaatagtcctgaac

SEQ ID NO: 1808 - DNA, 16 bp, Artificial Sequence
  synthetic [barcode part1]
cagttagtacagtgcc

SEQ ID NO: 1809 - DNA, 16 bp, Artificial Sequence
  synthetic [barcode part1]
agttcctaccgaaggt

SEQ ID NO: 1810 - DNA, 16 bp, Artificial Sequence
  synthetic [barcode part1]
tattcctctaacgacg

SEQ ID NO: 1811 - DNA, 16 bp, Artificial Sequence
  synthetic [barcode part1]
ttcgaccgtgccaatc

SEQ ID NO: 1812 - DNA, 16 bp, Artificial Sequence
  synthetic [barcode part1]
taacttctaacgtgcc

SEQ ID NO: 1813 - DNA, 16 bp, Artificial Sequence
  synthetic [barcode part1]
accagtgtatcctgtt

SEQ ID NO: 1814 - DNA, 16 bp, Artificial Sequence
  synthetic [barcode part1]
ttagtgcctggttccg

SEQ ID NO: 1815 - DNA, 16 bp, Artificial Sequence
  synthetic [barcode part1]
gtatacctcgttgttg

SEQ ID NO: 1816 - DNA, 16 bp, Artificial Sequence
  synthetic [barcode part1]
gcacgtgtgattgatc

SEQ ID NO: 1817 - DNA, 16 bp, Artificial Sequence
  synthetic [barcode part1]
caccactaagtcagac

SEQ ID NO: 1818 - DNA, 16 bp, Artificial Sequence
  synthetic [barcode part1]
cagttgttaggtccag

SEQ ID NO: 1819 - DNA, 16 bp, Artificial Sequence
  synthetic [barcode part1]
tgccgcctgaacttac

SEQ ID NO: 1820 - DNA, 16 bp, Artificial Sequence
  synthetic [barcode part1]
ataactgcgcgtggtt

SEQ ID NO: 1821 - DNA, 16 bp, Artificial Sequence
  synthetic [barcode part1]
gaagataacggttcac

SEQ ID NO: 1822 - DNA, 16 bp, Artificial Sequence
  synthetic [barcode part1]
caacagtggagtgtgc

SEQ ID NO: 1823 - DNA, 16 bp, Artificial Sequence
  synthetic [barcode part1]
tggtaactccttgtac

SEQ ID NO: 1824 - DNA, 16 bp, Artificial Sequence
  synthetic [barcode part1]
cggcagtattaagtcc

SEQ ID NO: 1825 - DNA, 16 bp, Artificial Sequence
  synthetic [barcode part1]
gccgagttctacgttc

SEQ ID NO: 1826 - DNA, 16 bp, Artificial Sequence
  synthetic [barcode part1]
gcctccaacaacctgt

SEQ ID NO: 1827 - DNA, 16 bp, Artificial Sequence
  synthetic [barcode part1]
tcggtgagtcctcgtt

SEQ ID NO: 1828 - DNA, 16 bp, Artificial Sequence
  synthetic [barcode part1]
aactataggccaagac

SEQ ID NO: 1829 - DNA, 16 bp, Artificial Sequence
  synthetic [barcode part1]
ccttggtccggtatac

SEQ ID NO: 1830 - DNA, 16 bp, Artificial Sequence
  synthetic [barcode part1]
tcgagtgacgataagt

SEQ ID NO: 1831 - DNA, 16 bp, Artificial Sequence
  synthetic [barcode part1]
tctactgcgtagatct

SEQ ID NO: 1832 - DNA, 16 bp, Artificial Sequence
  synthetic [barcode part1]
cgacgataccactagt

SEQ ID NO: 1833 - DNA, 16 bp, Artificial Sequence
  synthetic [barcode part1]
attctctgccacgcag

SEQ ID NO: 1834 - DNA, 16 bp, Artificial Sequence
  synthetic [barcode part1]
ttcctaggtgttggtt

SEQ ID NO: 1835 - DNA, 16 bp, Artificial Sequence
  synthetic [barcode part1]
actcttactcgcgttc

SEQ ID NO: 1836 - DNA, 16 bp, Artificial Sequence
  synthetic [barcode part1]
ttcagtgtaggagtag

SEQ ID NO: 1837 - DNA, 16 bp, Artificial Sequence
  synthetic [barcode part1]
aagaacgcagaggtgt

SEQ ID NO: 1838 - DNA, 16 bp, Artificial Sequence
  synthetic [barcode part1]
actctgagtcagtcag

SEQ ID NO: 1839 - DNA, 16 bp, Artificial Sequence
  synthetic [barcode part1]
ccgacgtagaagactg

SEQ ID NO: 1840 - DNA, 16 bp, Artificial Sequence
  synthetic [barcode part1]
tcgtattgtggtccgc

SEQ ID NO: 1841 - DNA, 16 bp, Artificial Sequence
  synthetic [barcode part1]
agattataggcgcggc

SEQ ID NO: 1842 - DNA, 16 bp, Artificial Sequence
  synthetic [barcode part1]
taatccgtggattgcg

SEQ ID NO: 1843 - DNA, 16 bp, Artificial Sequence
  synthetic [barcode part1]
aatcctgccacttgcg

SEQ ID NO: 1844 - DNA, 16 bp, Artificial Sequence
  synthetic [barcode part1]
cctcaataatcgcgtt

SEQ ID NO: 1845 - DNA, 16 bp, Artificial Sequence
  synthetic [barcode part1]
cagttcaccgtgtctg

SEQ ID NO: 1846 - DNA, 16 bp, Artificial Sequence
  synthetic [barcode part1]
ttgaggtgtgaacggc

SEQ ID NO: 1847 - DNA, 16 bp, Artificial Sequence
  synthetic [barcode part1]
gcctgaatattgcctt

SEQ ID NO: 1848 - DNA, 16 bp, Artificial Sequence
  synthetic [barcode part1]
tgcctattgttgtggt

SEQ ID NO: 1849 - DNA, 16 bp, Artificial Sequence
  synthetic [barcode part1]
gaccagttgactgact

SEQ ID NO: 1850 - DNA, 16 bp, Artificial Sequence
  synthetic [barcode part1]
actcgtcacgacgttc

SEQ ID NO: 1851 - DNA, 16 bp, Artificial Sequence
  synthetic [barcode part1]
caccggaacaagagtc

SEQ ID NO: 1852 - DNA, 16 bp, Artificial Sequence
  synthetic [barcode part1]
cggattgccttatact

SEQ ID NO: 1853 - DNA, 16 bp, Artificial Sequence
  synthetic [barcode part1]
tgccgaatctatacct

SEQ ID NO: 1854 - DNA, 16 bp, Artificial Sequence
  synthetic [barcode part1]
tgcggtgagatagacc

SEQ ID NO: 1855 - DNA, 16 bp, Artificial Sequence
  synthetic [barcode part1]
gtaggtggtctattcg

SEQ ID NO: 1856 - DNA, 16 bp, Artificial Sequence
  synthetic [barcode part1]
tcttgacgactcgcgt

SEQ ID NO: 1857 - DNA, 16 bp, Artificial Sequence
  synthetic [barcode part1]
cgagtatcttctgatc

SEQ ID NO: 1858 - DNA, 16 bp, Artificial Sequence
  synthetic [barcode part1]
tgacctcacgtactgc

SEQ ID NO: 1859 - DNA, 16 bp, Artificial Sequence
  synthetic [barcode part1]
agttaaggttcagacg

SEQ ID NO: 1860 - DNA, 16 bp, Artificial Sequence
  synthetic [barcode part1]
gactacggatcgaggt

SEQ ID NO: 1861 - DNA, 16 bp, Artificial Sequence
  synthetic [barcode part1]
tagataggttccgaag

SEQ ID NO: 1862 - DNA, 16 bp, Artificial Sequence
  synthetic [barcode part1]
aattcttgtgtggcct

SEQ ID NO: 1863 - DNA, 16 bp, Artificial Sequence
  synthetic [barcode part1]
caatctgtagaccgtg

SEQ ID NO: 1864 - DNA, 16 bp, Artificial Sequence
  synthetic [barcode part1]
cgtggcactacttgtc

SEQ ID NO: 1865 - DNA, 16 bp, Artificial Sequence
  synthetic [barcode part1]
acaccttgtcgccagt

SEQ ID NO: 1866 - DNA, 16 bp, Artificial Sequence
  synthetic [barcode part1]
agtaccttccacagag

SEQ ID NO: 1867 - DNA, 16 bp, Artificial Sequence
  synthetic [barcode part1]
gacaccacgtatacgt

SEQ ID NO: 1868 - DNA, 16 bp, Artificial Sequence
  synthetic [barcode part1]
agataggcagagtctt

SEQ ID NO: 1869 - DNA, 16 bp, Artificial Sequence
  synthetic [barcode part1]
caatctccgcacaatt

SEQ ID NO: 1870 - DNA, 16 bp, Artificial Sequence
  synthetic [barcode part1]
gttacctccgcggatt

SEQ ID NO: 1871 - DNA, 16 bp, Artificial Sequence
  synthetic [barcode part1]
tagaagatacgtggtc

SEQ ID NO: 1872 - DNA, 16 bp, Artificial Sequence
  synthetic [barcode part1]
tgcgagttactcaggt

SEQ ID NO: 1873 - DNA, 16 bp, Artificial Sequence
  synthetic [barcode part1]
ataataccgtgtgcgc

SEQ ID NO: 1874 - DNA, 16 bp, Artificial Sequence
  synthetic [barcode part1]
tctacgtcaacctagt

SEQ ID NO: 1875 - DNA, 16 bp, Artificial Sequence
  synthetic [barcode part1]
aggtgcaatcgttaag

SEQ ID NO: 1876 - DNA, 16 bp, Artificial Sequence
  synthetic [barcode part1]
tacaccacagtgtacg

SEQ ID NO: 1877 - DNA, 16 bp, Artificial Sequence
  synthetic [barcode part1]
cgtcgtcagtgtacct

SEQ ID NO: 1878 - DNA, 16 bp, Artificial Sequence
  synthetic [barcode part1]
gtgtggtagaactagt

SEQ ID NO: 1879 - DNA, 16 bp, Artificial Sequence
  synthetic [barcode part1]
cacggcaagtaggtac

SEQ ID NO: 1880 - DNA, 16 bp, Artificial Sequence
  synthetic [barcode part1]
gagttcaatcttctgc

SEQ ID NO: 1881 - DNA, 16 bp, Artificial Sequence
  synthetic [barcode part1]
taatcgcaacgtaccg

SEQ ID NO: 1882 - DNA, 16 bp, Artificial Sequence
  synthetic [barcode part1]
cgtagataggcagtgc

SEQ ID NO: 1883 - DNA, 16 bp, Artificial Sequence
  synthetic [barcode part1]
agaccaccaccagatt

SEQ ID NO: 1884 - DNA, 16 bp, Artificial Sequence
  synthetic [barcode part1]
attccacagtgcactt

SEQ ID NO: 1885 - DNA, 16 bp, Artificial Sequence
  synthetic [barcode part1]
gtccaatctggtaacg

SEQ ID NO: 1886 - DNA, 16 bp, Artificial Sequence
  synthetic [barcode part1]
gagagacaacgtattc

SEQ ID NO: 1887 - DNA, 16 bp, Artificial Sequence
  synthetic [barcode part1]
tcacgaggttcaggtt

SEQ ID NO: 1888 - DNA, 16 bp, Artificial Sequence
  synthetic [barcode part1]
tggtaacgtatcttcc

SEQ ID NO: 1889 - DNA, 16 bp, Artificial Sequence
  synthetic [barcode part1]
gttcctgtgttgaatc

SEQ ID NO: 1890 - DNA, 16 bp, Artificial Sequence
  synthetic [barcode part1]
actatcttctaggcac

SEQ ID NO: 1891 - DNA, 16 bp, Artificial Sequence
  synthetic [barcode part1]
tcgtagactgttgttc

SEQ ID NO: 1892 - DNA, 16 bp, Artificial Sequence
  synthetic [barcode part1]
cgatctacgaagatag

SEQ ID NO: 1893 - DNA, 16 bp, Artificial Sequence
  synthetic [barcode part1]
tacagtccacaggttg

SEQ ID NO: 1894 - DNA, 16 bp, Artificial Sequence
  synthetic [barcode part1]
tgaagattaccgagtg

SEQ ID NO: 1895 - DNA, 16 bp, Artificial Sequence
  synthetic [barcode part1]
ccttattcttggacag

SEQ ID NO: 1896 - DNA, 16 bp, Artificial Sequence
  synthetic [barcode part1]
cgcacttggtagttcc

SEQ ID NO: 1897 - DNA, 16 bp, Artificial Sequence
  synthetic [barcode part1]
gtaattatcttccggc

SEQ ID NO: 1898 - DNA, 16 bp, Artificial Sequence
  synthetic [barcode part1]
gaacagaacagacggt

SEQ ID NO: 1899 - DNA, 16 bp, Artificial Sequence
  synthetic [barcode part1]
agattagtgcgtagtg

SEQ ID NO: 1900 - DNA, 16 bp, Artificial Sequence
  synthetic [barcode part1]
actcggactcaagtgt

SEQ ID NO: 1901 - DNA, 16 bp, Artificial Sequence
  synthetic [barcode part1]
gtggtacctgagatct

SEQ ID NO: 1902 - DNA, 16 bp, Artificial Sequence
  synthetic [barcode part1]
cctcacacaacaattc

SEQ ID NO: 1903 - DNA, 16 bp, Artificial Sequence
  synthetic [barcode part1]
agatcggtcctagttg

SEQ ID NO: 1904 - DNA, 16 bp, Artificial Sequence
  synthetic [barcode part1]
taattgtggcgtgtcg

SEQ ID NO: 1905 - DNA, 16 bp, Artificial Sequence
  synthetic [barcode part1]
gtaagatcgagtatcg

SEQ ID NO: 1906 - DNA, 16 bp, Artificial Sequence
  synthetic [barcode part1]
cctgtgccgacaatct

SEQ ID NO: 1907 - DNA, 16 bp, Artificial Sequence
  synthetic [barcode part1]
aactcgagactgtcac

SEQ ID NO: 1908 - DNA, 16 bp, Artificial Sequence
  synthetic [barcode part1]
gttcgtcggtaagtac

SEQ ID NO: 1909 - DNA, 16 bp, Artificial Sequence
  synthetic [barcode part1]
agtggcacgttcgaag

SEQ ID NO: 1910 - DNA, 16 bp, Artificial Sequence
  synthetic [barcode part1]
taccacttgtcaacgt

SEQ ID NO: 1911 - DNA, 16 bp, Artificial Sequence
  synthetic [barcode part1]
cgattagaccgtagtc

SEQ ID NO: 1912 - DNA, 16 bp, Artificial Sequence
  synthetic [barcode part1]
actgcgaccgcctatt

SEQ ID NO: 1913 - DNA, 16 bp, Artificial Sequence
  synthetic [barcode part1]
tctgtccgaactccag

SEQ ID NO: 1914 - DNA, 16 bp, Artificial Sequence
  synthetic [barcode part1]
tgacgcaatactcggt

SEQ ID NO: 1915 - DNA, 16 bp, Artificial Sequence
  synthetic [barcode part1]
tgtgtcagaggtcgag

SEQ ID NO: 1916 - DNA, 16 bp, Artificial Sequence
  synthetic [barcode part1]
ccttcggtgcgtaact

SEQ ID NO: 1917 - DNA, 16 bp, Artificial Sequence
  synthetic [barcode part1]
tctaacgttgtgtctg

SEQ ID NO: 1918 - DNA, 16 bp, Artificial Sequence
  synthetic [barcode part1]
tgagtatcgcagacct

SEQ ID NO: 1919 - DNA, 16 bp, Artificial Sequence
  synthetic [barcode part1]
gtcctcagtggtctac

SEQ ID NO: 1920 - DNA, 16 bp, Artificial Sequence
  synthetic [barcode part1]
accgtattaacgagag

SEQ ID NO: 1921 - DNA, 16 bp, Artificial Sequence
  synthetic [barcode part1]
ttgcgcctgaaccact

SEQ ID NO: 1922 - DNA, 16 bp, Artificial Sequence
  synthetic [barcode part1]
aagtaagaacactgcc

SEQ ID NO: 1923 - DNA, 16 bp, Artificial Sequence
  synthetic [barcode part1]
gagtattgacggagtt

SEQ ID NO: 1924 - DNA, 16 bp, Artificial Sequence
  synthetic [barcode part1]
gaagatagtaacctgc

SEQ ID NO: 1925 - DNA, 16 bp, Artificial Sequence
  synthetic [barcode part1]
ccggagttactcactc

SEQ ID NO: 1926 - DNA, 16 bp, Artificial Sequence
  synthetic [barcode part1]
atagacactgcaacag

SEQ ID NO: 1927 - DNA, 16 bp, Artificial Sequence
  synthetic [barcode part1]
actctagacgtcacag

SEQ ID NO: 1928 - DNA, 16 bp, Artificial Sequence
  synthetic [barcode part1]
aatccaggcacgagac

SEQ ID NO: 1929 - DNA, 16 bp, Artificial Sequence
  synthetic [barcode part1]
ccaatcctccaatctc

SEQ ID NO: 1930 - DNA, 16 bp, Artificial Sequence
  synthetic [barcode part1]
cgtaggtagacctact

SEQ ID NO: 1931 - DNA, 16 bp, Artificial Sequence
  synthetic [barcode part1]
cctcttgtagagagtg

SEQ ID NO: 1932 - DNA, 16 bp, Artificial Sequence
  synthetic [barcode part1]
ccagaaggcgtaatcg

SEQ ID NO: 1933 - DNA, 16 bp, Artificial Sequence
  synthetic [barcode part1]
acgttaggagacggtc

SEQ ID NO: 1934 - DNA, 16 bp, Artificial Sequence
  synthetic [barcode part1]
aatctcgtgaggttcg

SEQ ID NO: 1935 - DNA, 16 bp, Artificial Sequence
  synthetic [barcode part1]
aaggtcggcacttgag

SEQ ID NO: 1936 - DNA, 16 bp, Artificial Sequence
  synthetic [barcode part1]
gcgaacctcttgtcac

SEQ ID NO: 1937 - DNA, 16 bp, Artificial Sequence
  synthetic [barcode part1]
acgactacaatcacgc

SEQ ID NO: 1938 - DNA, 16 bp, Artificial Sequence
  synthetic [barcode part1]
tgatcgagaggttctc

SEQ ID NO: 1939 - DNA, 16 bp, Artificial Sequence
  synthetic [barcode part1]
ttattgcctacgaacc

SEQ ID NO: 1940 - DNA, 16 bp, Artificial Sequence
  synthetic [barcode part1]
cgacttactatactcg

SEQ ID NO: 1941 - DNA, 16 bp, Artificial Sequence
  synthetic [barcode part1]
ataagtctgcaccggt

SEQ ID NO: 1942 - DNA, 16 bp, Artificial Sequence
  synthetic [barcode part1]
ttggtaccaactgcag

SEQ ID NO: 1943 - DNA, 16 bp, Artificial Sequence
  synthetic [barcode part1]
atctgtgcagtaagag

SEQ ID NO: 1944 - DNA, 16 bp, Artificial Sequence
  synthetic [barcode part1]
gccacctgatactcgt

SEQ ID NO: 1945 - DNA, 16 bp, Artificial Sequence
  synthetic [barcode part1]
ccaatctaacgcactt

SEQ ID NO: 1946 - DNA, 16 bp, Artificial Sequence
  synthetic [barcode part1]
tgagattccgagacct

SEQ ID NO: 1947 - DNA, 16 bp, Artificial Sequence
  synthetic [barcode part1]
acacaggtaaggacag

SEQ ID NO: 1948 - DNA, 16 bp, Artificial Sequence
  synthetic [barcode part1]
taagtcgaactcggtc

SEQ ID NO: 1949 - DNA, 16 bp, Artificial Sequence
  synthetic [barcode part1]
caccactacctcttac

SEQ ID NO: 1950 - DNA, 16 bp, Artificial Sequence
  synthetic [barcode part1]
actattcgtccgcgac

SEQ ID NO: 1951 - DNA, 16 bp, Artificial Sequence
  synthetic [barcode part1]
tagatccggacaatag

SEQ ID NO: 1952 - DNA, 16 bp, Artificial Sequence
  synthetic [barcode part1]
cggttagttgactggt

SEQ ID NO: 1953 - DNA, 16 bp, Artificial Sequence
  synthetic [barcode part1]
atctacgcctctgacg

SEQ ID NO: 1954 - DNA, 16 bp, Artificial Sequence
  synthetic [barcode part1]
agttaactggcgtcgt

SEQ ID NO: 1955 - DNA, 16 bp, Artificial Sequence
  synthetic [barcode part1]
aagacgataggtgtct

SEQ ID NO: 1956 - DNA, 16 bp, Artificial Sequence
  synthetic [barcode part1]
tctcctcaagaggagt

SEQ ID NO: 1957 - DNA, 16 bp, Artificial Sequence
  synthetic [barcode part1]
atacaagtccgcactg

SEQ ID NO: 1958 - DNA, 16 bp, Artificial Sequence
  synthetic [barcode part1]
tgcgagattagtagtg

SEQ ID NO: 1959 - DNA, 16 bp, Artificial Sequence
  synthetic [barcode part1]
cgcaataccgttcacc

SEQ ID NO: 1960 - DNA, 16 bp, Artificial Sequence
  synthetic [barcode part1]
acagttaacgccgact

SEQ ID NO: 1961 - DNA, 16 bp, Artificial Sequence
  synthetic [barcode part1]
gttgccggtactcttg

SEQ ID NO: 1962 - DNA, 16 bp, Artificial Sequence
  synthetic [barcode part1]
aaggaacaggtacctt

SEQ ID NO: 1963 - DNA, 16 bp, Artificial Sequence
  synthetic [barcode part1]
gtctgcgatcactctg

SEQ ID NO: 1964 - DNA, 16 bp, Artificial Sequence
  synthetic [barcode part1]
tgaacgtcctctgacc

SEQ ID NO: 1965 - DNA, 16 bp, Artificial Sequence
  synthetic [barcode part1]
cgaagtggcaactgtg

SEQ ID NO: 1966 - DNA, 16 bp, Artificial Sequence
  synthetic [barcode part1]
tctgtcgaggagttac

SEQ ID NO: 1967 - DNA, 16 bp, Artificial Sequence
  synthetic [barcode part1]
gaaggacgatatactc

SEQ ID NO: 1968 - DNA, 16 bp, Artificial Sequence
  synthetic [barcode part1]
atcgatctacgcacag

SEQ ID NO: 1969 - DNA, 16 bp, Artificial Sequence
  synthetic [barcode part1]
gtgccgtgtaggtaag

SEQ ID NO: 1970 - DNA, 16 bp, Artificial Sequence
  synthetic [barcode part1]
gcaagttcaataggac

SEQ ID NO: 1971 - DNA, 16 bp, Artificial Sequence
  synthetic [barcode part1]
aatcctgcacctaccg

SEQ ID NO: 1972 - DNA, 16 bp, Artificial Sequence
  synthetic [barcode part1]
atcggattatctccac

SEQ ID NO: 1973 - DNA, 16 bp, Artificial Sequence
  synthetic [barcode part1]
ttccagatactgcgag

SEQ ID NO: 1974 - DNA, 16 bp, Artificial Sequence
  synthetic [barcode part1]
taacggcggcctaatt

SEQ ID NO: 1975 - DNA, 16 bp, Artificial Sequence
  synthetic [barcode part1]
gtctggatactcgagt

SEQ ID NO: 1976 - DNA, 16 bp, Artificial Sequence
  synthetic [barcode part1]
tggagttcggttaacc

SEQ ID NO: 1977 - DNA, 16 bp, Artificial Sequence
  synthetic [barcode part1]
tatccgcggtgttacc

SEQ ID NO: 1978 - DNA, 16 bp, Artificial Sequence
  synthetic [barcode part1]
ttgtatcacagtctgc

SEQ ID NO: 1979 - DNA, 16 bp, Artificial Sequence
  synthetic [barcode part1]
gttggagatattggtg

SEQ ID NO: 1980 - DNA, 16 bp, Artificial Sequence
  synthetic [barcode part1]
actgtctccgcgaact

SEQ ID NO: 1981 - DNA, 16 bp, Artificial Sequence
  synthetic [barcode part1]
cgtatcaatcacgcag

SEQ ID NO: 1982 - DNA, 16 bp, Artificial Sequence
  synthetic [barcode part1]
ccaggcagatatctac

SEQ ID NO: 1983 - DNA, 16 bp, Artificial Sequence
  synthetic [barcode part1]
aagtgtacgacgaccg

SEQ ID NO: 1984 - DNA, 16 bp, Artificial Sequence
  synthetic [barcode part1]
tctacgccaatccgac

SEQ ID NO: 1985 - DNA, 16 bp, Artificial Sequence
  synthetic [barcode part1]
cagttaggccacaatc

SEQ ID NO: 1986 - DNA, 16 bp, Artificial Sequence
  synthetic [barcode part1]
tgacagtcaacttggc

SEQ ID NO: 1987 - DNA, 16 bp, Artificial Sequence
  synthetic [barcode part1]
attccttccttccgag

SEQ ID NO: 1988 - DNA, 16 bp, Artificial Sequence
  synthetic [barcode part1]
caactgagttgtgacc

SEQ ID NO: 1989 - DNA, 16 bp, Artificial Sequence
  synthetic [barcode part1]
tctacgccgactcaac

SEQ ID NO: 1990 - DNA, 16 bp, Artificial Sequence
  synthetic [barcode part1]
gtcctaattccaggag

SEQ ID NO: 1991 - DNA, 16 bp, Artificial Sequence
  synthetic [barcode part1]
gtacaatccgatctct

SEQ ID NO: 1992 - DNA, 16 bp, Artificial Sequence
  synthetic [barcode part1]
cggtaagaagtccgtg

SEQ ID NO: 1993 - DNA, 16 bp, Artificial Sequence
  synthetic [barcode part1]
tgtagtctgacaagag

SEQ ID NO: 1994 - DNA, 16 bp, Artificial Sequence
  synthetic [barcode part1]
acgtcagttaacgcgt

SEQ ID NO: 1995 - DNA, 16 bp, Artificial Sequence
  synthetic [barcode part1]
gtctcgcagacacctt

SEQ ID NO: 1996 - DNA, 16 bp, Artificial Sequence
  synthetic [barcode part1]
tggtcgacagtactgt

SEQ ID NO: 1997 - DNA, 16 bp, Artificial Sequence
  synthetic [barcode part1]
gtccttccgtgactag

SEQ ID NO: 1998 - DNA, 16 bp, Artificial Sequence
  synthetic [barcode part1]
tcgtcacactctactc

SEQ ID NO: 1999 - DNA, 16 bp, Artificial Sequence
  synthetic [barcode part1]
tgtgaaccaagtgtcc

SEQ ID NO: 2000 - DNA, 16 bp, Artificial Sequence
  synthetic [barcode part1]
gtacacgattgcgact

SEQ ID NO: 2001 - DNA, 16 bp, Artificial Sequence
  synthetic [barcode part1]
ttctgcctggacactg

SEQ ID NO: 2002 - DNA, 16 bp, Artificial Sequence
  synthetic [barcode part1]
ttctggtgcgcgatct

SEQ ID NO: 2003 - DNA, 16 bp, Artificial Sequence
  synthetic [barcode part1]
actaacgccgttgtcc

SEQ ID NO: 2004 - DNA, 16 bp, Artificial Sequence
  synthetic [barcode part1]
cgacgactagtaatcc

SEQ ID NO: 2005 - DNA, 16 bp, Artificial Sequence
  synthetic [barcode part1]
ttggtgacgtctccac

SEQ ID NO: 2006 - DNA, 16 bp, Artificial Sequence
  synthetic [barcode part1]
tctcttatccgatccg

SEQ ID NO: 2007 - DNA, 16 bp, Artificial Sequence
  synthetic [barcode part1]
tccgacctaacgtatt

SEQ ID NO: 2008 - DNA, 16 bp, Artificial Sequence
  synthetic [barcode part1]
acaaccagtcacacac

SEQ ID NO: 2009 - DNA, 16 bp, Artificial Sequence
  synthetic [barcode part1]
tcaacggacaactcgt

SEQ ID NO: 2010 - DNA, 16 bp, Artificial Sequence
  synthetic [barcode part1]
gttattaggcctggtg

SEQ ID NO: 2011 - DNA, 16 bp, Artificial Sequence
  synthetic [barcode part1]
ttagttcgtctcctgc

SEQ ID NO: 2012 - DNA, 16 bp, Artificial Sequence
  synthetic [barcode part1]
tgacaactgacgatcc

SEQ ID NO: 2013 - DNA, 16 bp, Artificial Sequence
  synthetic [barcode part1]
accacagacttatcct

SEQ ID NO: 2014 - DNA, 16 bp, Artificial Sequence
  synthetic [barcode part1]
gcacgacgattcttcc

SEQ ID NO: 2015 - DNA, 16 bp, Artificial Sequence
  synthetic [barcode part1]
gtgactggccgatatt

SEQ ID NO: 2016 - DNA, 16 bp, Artificial Sequence
  synthetic [barcode part1]
tcgagttccagatcag

SEQ ID NO: 2017 - DNA, 16 bp, Artificial Sequence
  synthetic [barcode part1]
attggaatcggttccg

SEQ ID NO: 2018 - DNA, 16 bp, Artificial Sequence
  synthetic [barcode part1]
atctgccacagacaac

SEQ ID NO: 2019 - DNA, 16 bp, Artificial Sequence
  synthetic [barcode part1]
ttggtccagtgcactc

SEQ ID NO: 2020 - DNA, 16 bp, Artificial Sequence
  synthetic [barcode part1]
ccttgtcaagtggtag

SEQ ID NO: 2021 - DNA, 16 bp, Artificial Sequence
  synthetic [barcode part1]
tggaagacctcaacct

SEQ ID NO: 2022 - DNA, 16 bp, Artificial Sequence
  synthetic [barcode part1]
gcacttaggatctgtg

SEQ ID NO: 2023 - DNA, 16 bp, Artificial Sequence
  synthetic [barcode part1]
ttactcacctagaacc

SEQ ID NO: 2024 - DNA, 16 bp, Artificial Sequence
  synthetic [barcode part1]
atactctcttccgcac

SEQ ID NO: 2025 - DNA, 16 bp, Artificial Sequence
  synthetic [barcode part1]
tctgcaagtagatccg

SEQ ID NO: 2026 - DNA, 16 bp, Artificial Sequence
  synthetic [barcode part1]
tgtacgtaccaaccag

SEQ ID NO: 2027 - DNA, 16 bp, Artificial Sequence
  synthetic [barcode part1]
caacggtagaggcact

SEQ ID NO: 2028 - DNA, 16 bp, Artificial Sequence
  synthetic [barcode part1]
gaccggtgattaatcc

SEQ ID NO: 2029 - DNA, 16 bp, Artificial Sequence
  synthetic [barcode part1]
tgtccacctgcgatac

SEQ ID NO: 2030 - DNA, 16 bp, Artificial Sequence
  synthetic [barcode part1]
aactggttcgaccaac

SEQ ID NO: 2031 - DNA, 16 bp, Artificial Sequence
  synthetic [barcode part1]
cgccaaggaactattc

SEQ ID NO: 2032 - DNA, 16 bp, Artificial Sequence
  synthetic [barcode part1]
cacggaaccgaatcag

SEQ ID NO: 2033 - DNA, 16 bp, Artificial Sequence
  synthetic [barcode part1]
tccaatctgtagtcgt

SEQ ID NO: 2034 - DNA, 16 bp, Artificial Sequence
  synthetic [barcode part1]
aaccgtgttagaaggt

SEQ ID NO: 2035 - DNA, 16 bp, Artificial Sequence
  synthetic [barcode part1]
ccacgttaagttactc

SEQ ID NO: 2036 - DNA, 16 bp, Artificial Sequence
  synthetic [barcode part1]
attgacgtgaaggatc

SEQ ID NO: 2037 - DNA, 16 bp, Artificial Sequence
  synthetic [barcode part1]
taggtgtcagtgaggc

SEQ ID NO: 2038 - DNA, 16 bp, Artificial Sequence
  synthetic [barcode part1]
gcgagagaatcaccgt

SEQ ID NO: 2039 - DNA, 16 bp, Artificial Sequence
  synthetic [barcode part1]
agacactatccgcaac

SEQ ID NO: 2040 - DNA, 16 bp, Artificial Sequence
  synthetic [barcode part1]
ttaactccggatctac

SEQ ID NO: 2041 - DNA, 16 bp, Artificial Sequence
  synthetic [barcode part1]
aaccgtggagaggtct

SEQ ID NO: 2042 - DNA, 16 bp, Artificial Sequence
  synthetic [barcode part1]
tgtgagtgcggtagac

SEQ ID NO: 2043 - DNA, 16 bp, Artificial Sequence
  synthetic [barcode part1]
aaccacacagtacgtc

SEQ ID NO: 2044 - DNA, 16 bp, Artificial Sequence
  synthetic [barcode part1]
gtgccggaattgtgtt

SEQ ID NO: 2045 - DNA, 16 bp, Artificial Sequence
  synthetic [barcode part1]
aacctgtatcctatcg

SEQ ID NO: 2046 - DNA, 16 bp, Artificial Sequence
  synthetic [barcode part1]
aaccgataaccggttc

SEQ ID NO: 2047 - DNA, 16 bp, Artificial Sequence
  synthetic [barcode part1]
caggtcgaactactac

SEQ ID NO: 2048 - DNA, 16 bp, Artificial Sequence
  synthetic [barcode part1]
tcctagattgcgacag

SEQ ID NO: 2049 - DNA, 16 bp, Artificial Sequence
  synthetic [barcode part1]
acggtagagtgcgttg

SEQ ID NO: 2050 - DNA, 16 bp, Artificial Sequence
  synthetic [barcode part1]
tgtcagtcctctcgag

SEQ ID NO: 2051 - DNA, 16 bp, Artificial Sequence
  synthetic [barcode part1]
cacggataacgtctgt

SEQ ID NO: 2052 - DNA, 16 bp, Artificial Sequence
  synthetic [barcode part1]
atccgtacctcgtcag

SEQ ID NO: 2053 - DNA, 16 bp, Artificial Sequence
  synthetic [barcode part1]
caccgaagagtatagt

SEQ ID NO: 2054 - DNA, 16 bp, Artificial Sequence
  synthetic [barcode part1]
attgacactcgatcct

SEQ ID NO: 2055 - DNA, 16 bp, Artificial Sequence
  synthetic [barcode part1]
gtggttacttcctggc

SEQ ID NO: 2056 - DNA, 16 bp, Artificial Sequence
  synthetic [barcode part1]
ttcgcctattcgttcg

SEQ ID NO: 2057 - DNA, 16 bp, Artificial Sequence
  synthetic [barcode part1]
ccagacctgtattccg

SEQ ID NO: 2058 - DNA, 16 bp, Artificial Sequence
  synthetic [barcode part1]
caaggttagtcctgac

SEQ ID NO: 2059 - DNA, 16 bp, Artificial Sequence
  synthetic [barcode part1]
aacggagtgtggactc

SEQ ID NO: 2060 - DNA, 16 bp, Artificial Sequence
  synthetic [barcode part1]
agttgcactagagaac

SEQ ID NO: 2061 - DNA, 16 bp, Artificial Sequence
  synthetic [barcode part1]
acgactgttggcctct

SEQ ID NO: 2062 - DNA, 16 bp, Artificial Sequence
  synthetic [barcode part1]
ttatcaccaggtatcc

SEQ ID NO: 2063 - DNA, 16 bp, Artificial Sequence
  synthetic [barcode part1]
aagtggacgaacaggt

SEQ ID NO: 2064 - DNA, 16 bp, Artificial Sequence
  synthetic [barcode part1]
tgccgactcaatcctg

SEQ ID NO: 2065 - DNA, 16 bp, Artificial Sequence
  synthetic [barcode part1]
acttatctggacggac

SEQ ID NO: 2066 - DNA, 16 bp, Artificial Sequence
  synthetic [barcode part1]
gttgcgagataccact

SEQ ID NO: 2067 - DNA, 16 bp, Artificial Sequence
  synthetic [barcode part1]
tgacgataagagtacc

SEQ ID NO: 2068 - DNA, 16 bp, Artificial Sequence
  synthetic [barcode part1]
gtagaatcgagtactg

SEQ ID NO: 2069 - DNA, 16 bp, Artificial Sequence
  synthetic [barcode part1]
gtcggactaagagtgc

SEQ ID NO: 2070 - DNA, 16 bp, Artificial Sequence
  synthetic [barcode part1]
gtgtaggttgttagag

SEQ ID NO: 2071 - DNA, 16 bp, Artificial Sequence
  synthetic [barcode part1]
tgatacgtcaggtacc

SEQ ID NO: 2072 - DNA, 16 bp, Artificial Sequence
  synthetic [barcode part1]
ttaaggcctgtccgtc

SEQ ID NO: 2073 - DNA, 16 bp, Artificial Sequence
  synthetic [barcode part1]
cgagtgtcacagatct

SEQ ID NO: 2074 - DNA, 16 bp, Artificial Sequence
  synthetic [barcode part1]
caactacttgccgtcg

SEQ ID NO: 2075 - DNA, 16 bp, Artificial Sequence
  synthetic [barcode part1]
ttcgagtctattgtcg

SEQ ID NO: 2076 - DNA, 16 bp, Artificial Sequence
  synthetic [barcode part1]
tcgcctaggtgttgtc

SEQ ID NO: 2077 - DNA, 16 bp, Artificial Sequence
  synthetic [barcode part1]
atagaccgagacgacc

SEQ ID NO: 2078 - DNA, 16 bp, Artificial Sequence
  synthetic [barcode part1]
tgtacgaacttcctac

SEQ ID NO: 2079 - DNA, 16 bp, Artificial Sequence
  synthetic [barcode part1]
tactctggtcttgcct

SEQ ID NO: 2080 - DNA, 16 bp, Artificial Sequence
  synthetic [barcode part1]
aagtcctaaggttccg

SEQ ID NO: 2081 - DNA, 16 bp, Artificial Sequence
  synthetic [barcode part1]
caatcggagttccagt

SEQ ID NO: 2082 - DNA, 16 bp, Artificial Sequence
  synthetic [barcode part1]
gattgcacgattgtgc

SEQ ID NO: 2083 - DNA, 16 bp, Artificial Sequence
  synthetic [barcode part1]
ttgagtgagacaacac

SEQ ID NO: 2084 - DNA, 16 bp, Artificial Sequence
  synthetic [barcode part1]
gtcctacacaactgcc

SEQ ID NO: 2085 - DNA, 16 bp, Artificial Sequence
  synthetic [barcode part1]
tggaaccacacgtact

SEQ ID NO: 2086 - DNA, 16 bp, Artificial Sequence
  synthetic [barcode part1]
acgagtccaacgaggt

SEQ ID NO: 2087 - DNA, 16 bp, Artificial Sequence
  synthetic [barcode part1]
tggttcactgcgttcg

SEQ ID NO: 2088 - DNA, 16 bp, Artificial Sequence
  synthetic [barcode part1]
tcttctcctctggaac

SEQ ID NO: 2089 - DNA, 16 bp, Artificial Sequence
  synthetic [barcode part1]
cggtaatcacagaggc

SEQ ID NO: 2090 - DNA, 16 bp, Artificial Sequence
  synthetic [barcode part1]
gtggtattcctaaggc

SEQ ID NO: 2091 - DNA, 16 bp, Artificial Sequence
  synthetic [barcode part1]
tggaccgactattgac

SEQ ID NO: 2092 - DNA, 16 bp, Artificial Sequence
  synthetic [barcode part1]
tactgtgcagttggtg

SEQ ID NO: 2093 - DNA, 16 bp, Artificial Sequence
  synthetic [barcode part1]
agaactctcacttacc

SEQ ID NO: 2094 - DNA, 16 bp, Artificial Sequence
  synthetic [barcode part1]
tgtaagtcaggcacct

SEQ ID NO: 2095 - DNA, 16 bp, Artificial Sequence
  synthetic [barcode part1]
gacctcgtctactcag

SEQ ID NO: 2096 - DNA, 16 bp, Artificial Sequence
  synthetic [barcode part1]
cgtacggaccttctac

SEQ ID NO: 2097 - DNA, 16 bp, Artificial Sequence
  synthetic [barcode part1]
attgcactctctaacg

SEQ ID NO: 2098 - DNA, 16 bp, Artificial Sequence
  synthetic [barcode part1]
gaaggacctcacagac

SEQ ID NO: 2099 - DNA, 16 bp, Artificial Sequence
  synthetic [barcode part1]
actcaactcgacagtg

SEQ ID NO: 2100 - DNA, 16 bp, Artificial Sequence
  synthetic [barcode part1]
tccgtcgttgacgtgt

SEQ ID NO: 2101 - DNA, 16 bp, Artificial Sequence
  synthetic [barcode part1]
tctcggtccttattgc

SEQ ID NO: 2102 - DNA, 16 bp, Artificial Sequence
  synthetic [barcode part1]
aatactacgtgcgtgc

SEQ ID NO: 2103 - DNA, 16 bp, Artificial Sequence
  synthetic [barcode part1]
cgtacttggatcgcct

SEQ ID NO: 2104 - DNA, 16 bp, Artificial Sequence
  synthetic [barcode part1]
ttgcggatcgttatct

SEQ ID NO: 2105 - DNA, 16 bp, Artificial Sequence
  synthetic [barcode part1]
gagacgacttactacc

SEQ ID NO: 2106 - DNA, 16 bp, Artificial Sequence
  synthetic [barcode part1]
acgtccgttgttccag

SEQ ID NO: 2107 - DNA, 16 bp, Artificial Sequence
  synthetic [barcode part1]
cgtctctgaagatacg

SEQ ID NO: 2108 - DNA, 16 bp, Artificial Sequence
  synthetic [barcode part1]
cgtgattgtcgccttg

SEQ ID NO: 2109 - DNA, 16 bp, Artificial Sequence
  synthetic [barcode part1]
ttattgcacggtggac

SEQ ID NO: 2110 - DNA, 16 bp, Artificial Sequence
  synthetic [barcode part1]
gtgactgtgtgtggtt

SEQ ID NO: 2111 - DNA, 16 bp, Artificial Sequence
  synthetic [barcode part1]
cagttggtcgagactt

SEQ ID NO: 2112 - DNA, 16 bp, Artificial Sequence
  synthetic [barcode part1]
cgtatcaggaattgag

SEQ ID NO: 2113 - DNA, 16 bp, Artificial Sequence
  synthetic [barcode part1]
gtaacgtccggttaac

SEQ ID NO: 2114 - DNA, 16 bp, Artificial Sequence
  synthetic [barcode part1]
tgttctgtgaacacct

SEQ ID NO: 2115 - DNA, 16 bp, Artificial Sequence
  synthetic [barcode part1]
cggtgtccacttactg

SEQ ID NO: 2116 - DNA, 16 bp, Artificial Sequence
  synthetic [barcode part1]
atcaacgccacgtaac

SEQ ID NO: 2117 - DNA, 16 bp, Artificial Sequence
  synthetic [barcode part1]
tccaattatcggtacc

SEQ ID NO: 2118 - DNA, 16 bp, Artificial Sequence
  synthetic [barcode part1]
tggccttcgcaattgc

SEQ ID NO: 2119 - DNA, 16 bp, Artificial Sequence
  synthetic [barcode part1]
cagtgttaggtaggcg

SEQ ID NO: 2120 - DNA, 16 bp, Artificial Sequence
  synthetic [barcode part1]
taacggcgatccaact

SEQ ID NO: 2121 - DNA, 16 bp, Artificial Sequence
  synthetic [barcode part1]
tccttccagttccagt

SEQ ID NO: 2122 - DNA, 16 bp, Artificial Sequence
  synthetic [barcode part1]
tgcggacgtaataggc

SEQ ID NO: 2123 - DNA, 16 bp, Artificial Sequence
  synthetic [barcode part1]
gtcggtacgaacttgt

SEQ ID NO: 2124 - DNA, 16 bp, Artificial Sequence
  synthetic [barcode part1]
caattcgtgtcagacg

SEQ ID NO: 2125 - DNA, 16 bp, Artificial Sequence
  synthetic [barcode part1]
gtacgtgaactggtct

SEQ ID NO: 2126 - DNA, 16 bp, Artificial Sequence
  synthetic [barcode part1]
agtaagagtcagaggc

SEQ ID NO: 2127 - DNA, 16 bp, Artificial Sequence
  synthetic [barcode part1]
accgtaagatactgcc

SEQ ID NO: 2128 - DNA, 16 bp, Artificial Sequence
  synthetic [barcode part1]
ccaaggtgagtaagtt

SEQ ID NO: 2129 - DNA, 16 bp, Artificial Sequence
  synthetic [barcode part1]
gtcaactctaaggtcg

SEQ ID NO: 2130 - DNA, 16 bp, Artificial Sequence
  synthetic [barcode part1]
cactccagtctgtgac

SEQ ID NO: 2131 - DNA, 16 bp, Artificial Sequence
  synthetic [barcode part1]
caattcggacgacttg

SEQ ID NO: 2132 - DNA, 16 bp, Artificial Sequence
  synthetic [barcode part1]
tcaacgaattcctacc

SEQ ID NO: 2133 - DNA, 16 bp, Artificial Sequence
  synthetic [barcode part1]
acgaattcagtctcct

SEQ ID NO: 2134 - DNA, 16 bp, Artificial Sequence
  synthetic [barcode part1]
cacggtacttacttgt

SEQ ID NO: 2135 - DNA, 16 bp, Artificial Sequence
  synthetic [barcode part1]
tcttcctaggaccttc

SEQ ID NO: 2136 - DNA, 16 bp, Artificial Sequence
  synthetic [barcode part1]
gtggacacagaacctg

SEQ ID NO: 2137 - DNA, 16 bp, Artificial Sequence
  synthetic [barcode part1]
gcgttagaggaattgt

SEQ ID NO: 2138 - DNA, 16 bp, Artificial Sequence
  synthetic [barcode part1]
taccagaatctctgtc

SEQ ID NO: 2139 - DNA, 16 bp, Artificial Sequence
  synthetic [barcode part1]
tcgtagatctgcagac

SEQ ID NO: 2140 - DNA, 16 bp, Artificial Sequence
  synthetic [barcode part1]
attgacctcggaatcg

SEQ ID NO: 2141 - DNA, 16 bp, Artificial Sequence
  synthetic [barcode part1]
tcaggacaagtcctgt

SEQ ID NO: 2142 - DNA, 16 bp, Artificial Sequence
  synthetic [barcode part1]
acggtaggacacgttg

SEQ ID NO: 2143 - DNA, 16 bp, Artificial Sequence
  synthetic [barcode part1]
tcctcggcgtgtaact

SEQ ID NO: 2144 - DNA, 16 bp, Artificial Sequence
  synthetic [barcode part1]
atctcgcggattagac

SEQ ID NO: 2145 - DNA, 16 bp, Artificial Sequence
  synthetic [barcode part1]
agtgtggatagagacg

SEQ ID NO: 2146 - DNA, 16 bp, Artificial Sequence
  synthetic [barcode part1]
agttggtacactgcac

SEQ ID NO: 2147 - DNA, 16 bp, Artificial Sequence
  synthetic [barcode part1]
gcaattggagatcaac

SEQ ID NO: 2148 - DNA, 16 bp, Artificial Sequence
  synthetic [barcode part1]
gtaactgatcgacacc

SEQ ID NO: 2149 - DNA, 16 bp, Artificial Sequence
  synthetic [barcode part1]
actacgaaggtggacc

SEQ ID NO: 2150 - DNA, 16 bp, Artificial Sequence
  synthetic [barcode part1]
gagacggaacagaact

SEQ ID NO: 2151 - DNA, 16 bp, Artificial Sequence
  synthetic [barcode part1]
gaggtgacacctagac

SEQ ID NO: 2152 - DNA, 16 bp, Artificial Sequence
  synthetic [barcode part1]
gccagtcaagaagaag

SEQ ID NO: 2153 - DNA, 16 bp, Artificial Sequence
  synthetic [barcode part1]
tggatcacgtgccttc

SEQ ID NO: 2154 - DNA, 16 bp, Artificial Sequence
  synthetic [barcode part1]
gtgatctcagatcacg

SEQ ID NO: 2155 - DNA, 16 bp, Artificial Sequence
  synthetic [barcode part1]
gtgtgacgttgacgtt

SEQ ID NO: 2156 - DNA, 16 bp, Artificial Sequence
  synthetic [barcode part1]
tattcctccgaactag

SEQ ID NO: 2157 - DNA, 16 bp, Artificial Sequence
  synthetic [barcode part1]
aagtacctcgttctac

SEQ ID NO: 2158 - DNA, 16 bp, Artificial Sequence
  synthetic [barcode part1]
cagatctatctcgttg

SEQ ID NO: 2159 - DNA, 16 bp, Artificial Sequence
  synthetic [barcode part1]
actccactgccaacac

SEQ ID NO: 2160 - DNA, 16 bp, Artificial Sequence
  synthetic [barcode part1]
gttagtcgttgcagtg

SEQ ID NO: 2161 - DNA, 16 bp, Artificial Sequence
  synthetic [barcode part1]
tcttggcgttaccttc

SEQ ID NO: 2162 - DNA, 16 bp, Artificial Sequence
  synthetic [barcode part1]
taaccttcgaccgcac

SEQ ID NO: 2163 - DNA, 16 bp, Artificial Sequence
  synthetic [barcode part1]
ccagacaacgacaggt

SEQ ID NO: 2164 - DNA, 16 bp, Artificial Sequence
  synthetic [barcode part1]
ttgtgcaacactgacg

SEQ ID NO: 2165 - DNA, 16 bp, Artificial Sequence
  synthetic [barcode part1]
gtaacgcaccgtgatt

SEQ ID NO: 2166 - DNA, 16 bp, Artificial Sequence
  synthetic [barcode part1]
tctacgcgttaccgac

SEQ ID NO: 2167 - DNA, 16 bp, Artificial Sequence
  synthetic [barcode part1]
gttcagaacgacggac

SEQ ID NO: 2168 - DNA, 16 bp, Artificial Sequence
  synthetic [barcode part1]
agtgcgacctagtgag

SEQ ID NO: 2169 - DNA, 16 bp, Artificial Sequence
  synthetic [barcode part1]
gattaagttcggcctg

SEQ ID NO: 2170 - DNA, 16 bp, Artificial Sequence
  synthetic [barcode part1]
aaccgcaccagaaggt

SEQ ID NO: 2171 - DNA, 16 bp, Artificial Sequence
  synthetic [barcode part1]
tgtatctgtcctcgtc

SEQ ID NO: 2172 - DNA, 16 bp, Artificial Sequence
  synthetic [barcode part1]
tggacttagacctacg

SEQ ID NO: 2173 - DNA, 16 bp, Artificial Sequence
  synthetic [barcode part1]
cggaattgactctgac

SEQ ID NO: 2174 - DNA, 16 bp, Artificial Sequence
  synthetic [barcode part1]
acacggaggcaattcg

SEQ ID NO: 2175 - DNA, 16 bp, Artificial Sequence
  synthetic [barcode part1]
gacgtacaattgaggt

SEQ ID NO: 2176 - DNA, 16 bp, Artificial Sequence
  synthetic [barcode part1]
agttggttcgagactc

SEQ ID NO: 2177 - DNA, 16 bp, Artificial Sequence
  synthetic [barcode part1]
acaggaattgacgact

SEQ ID NO: 2178 - DNA, 16 bp, Artificial Sequence
  synthetic [barcode part1]
cacactctcactggac

SEQ ID NO: 2179 - DNA, 16 bp, Artificial Sequence
  synthetic [barcode part1]
atccggacggatactt

SEQ ID NO: 2180 - DNA, 16 bp, Artificial Sequence
  synthetic [barcode part1]
gtcgttcttgcgaacc

SEQ ID NO: 2181 - DNA, 16 bp, Artificial Sequence
  synthetic [barcode part1]
accagtacactaacgc

SEQ ID NO: 2182 - DNA, 16 bp, Artificial Sequence
  synthetic [barcode part1]
cctacctcctaagacg

SEQ ID NO: 2183 - DNA, 16 bp, Artificial Sequence
  synthetic [barcode part1]
ataggaactaacgacc

SEQ ID NO: 2184 - DNA, 16 bp, Artificial Sequence
  synthetic [barcode part1]
gtggactcaacggagt

SEQ ID NO: 2185 - DNA, 16 bp, Artificial Sequence
  synthetic [barcode part1]
acggtcgtacaattgc

SEQ ID NO: 2186 - DNA, 16 bp, Artificial Sequence
  synthetic [barcode part1]
acacacacacagtacc

SEQ ID NO: 2187 - DNA, 16 bp, Artificial Sequence
  synthetic [barcode part1]
ttctcctggaatctcc

SEQ ID NO: 2188 - DNA, 16 bp, Artificial Sequence
  synthetic [barcode part1]
actggagtgtgcaacg

SEQ ID NO: 2189 - DNA, 16 bp, Artificial Sequence
  synthetic [barcode part1]
tgaaggagtgccgact

SEQ ID NO: 2190 - DNA, 16 bp, Artificial Sequence
  synthetic [barcode part1]
acgagtgccgtagtag

SEQ ID NO: 2191 - DNA, 16 bp, Artificial Sequence
  synthetic [barcode part1]
accgttcgaatctgcc

SEQ ID NO: 2192 - DNA, 16 bp, Artificial Sequence
  synthetic [barcode part1]
ttcgtccggtaagtag

SEQ ID NO: 2193 - DNA, 16 bp, Artificial Sequence
  synthetic [barcode part1]
aaccgccgaatacgag

SEQ ID NO: 2194 - DNA, 16 bp, Artificial Sequence
  synthetic [barcode part1]
tacaagaaccaagtcg

SEQ ID NO: 2195 - DNA, 16 bp, Artificial Sequence
  synthetic [barcode part1]
gtgagtctcttgttgt

SEQ ID NO: 2196 - DNA, 16 bp, Artificial Sequence
  synthetic [barcode part1]
atacgacggaaggtcc

SEQ ID NO: 2197 - DNA, 16 bp, Artificial Sequence
  synthetic [barcode part1]
gtgtatcggtaacaag

SEQ ID NO: 2198 - DNA, 16 bp, Artificial Sequence
  synthetic [barcode part1]
tggagacacttctacg

SEQ ID NO: 2199 - DNA, 16 bp, Artificial Sequence
  synthetic [barcode part1]
ttaggcggtagacctt

SEQ ID NO: 2200 - DNA, 16 bp, Artificial Sequence
  synthetic [barcode part1]
tcggttcagtaacgac

SEQ ID NO: 2201 - DNA, 16 bp, Artificial Sequence
  synthetic [barcode part1]
attgcctgccttacct

SEQ ID NO: 2202 - DNA, 16 bp, Artificial Sequence
  synthetic [barcode part1]
gcgtgatataccgact

SEQ ID NO: 2203 - DNA, 16 bp, Artificial Sequence
  synthetic [barcode part1]
gagagaatcgaccaag

SEQ ID NO: 2204 - DNA, 16 bp, Artificial Sequence
  synthetic [barcode part1]
cagactaggtcactac

SEQ ID NO: 2205 - DNA, 16 bp, Artificial Sequence
  synthetic [barcode part1]
atcgtaattcgcctgt

SEQ ID NO: 2206 - DNA, 16 bp, Artificial Sequence
  synthetic [barcode part1]
tccggactgaagagtg

SEQ ID NO: 2207 - DNA, 16 bp, Artificial Sequence
  synthetic [barcode part1]
tacaacgaacgaacac

SEQ ID NO: 2208 - DNA, 16 bp, Artificial Sequence
  synthetic [barcode part1]
gaattgcaagtgcggc

SEQ ID NO: 2209 - DNA, 16 bp, Artificial Sequence
  synthetic [barcode part1]
cagtgcaattactcct

SEQ ID NO: 2210 - DNA, 16 bp, Artificial Sequence
  synthetic [barcode part1]
tcgagtggcaagtctt

SEQ ID NO: 2211 - DNA, 16 bp, Artificial Sequence
  synthetic [barcode part1]
ttgtgccgagtacaac

SEQ ID NO: 2212 - DNA, 16 bp, Artificial Sequence
  synthetic [barcode part1]
ttaggcaatccgtgac

SEQ ID NO: 2213 - DNA, 16 bp, Artificial Sequence
  synthetic [barcode part1]
ttgtctatactacggc

SEQ ID NO: 2214 - DNA, 16 bp, Artificial Sequence
  synthetic [barcode part1]
cgtggtcgaagatcag

SEQ ID NO: 2215 - DNA, 16 bp, Artificial Sequence
  synthetic [barcode part1]
cacggaataacttgag

SEQ ID NO: 2216 - DNA, 16 bp, Artificial Sequence
  synthetic [barcode part1]
aagtccttcaagaccg

SEQ ID NO: 2217 - DNA, 16 bp, Artificial Sequence
  synthetic [barcode part1]
ccaaggaatactcaag

SEQ ID NO: 2218 - DNA, 16 bp, Artificial Sequence
  synthetic [barcode part1]
tggaatcctggaatcc

SEQ ID NO: 2219 - DNA, 16 bp, Artificial Sequence
  synthetic [barcode part1]
ttgcctgcagaacctc

SEQ ID NO: 2220 - DNA, 16 bp, Artificial Sequence
  synthetic [barcode part1]
tgttcaccactcacct

SEQ ID NO: 2221 - DNA, 16 bp, Artificial Sequence
  synthetic [barcode part1]
gattcctgaccgtatt

SEQ ID NO: 2222 - DNA, 16 bp, Artificial Sequence
  synthetic [barcode part1]
acctagatcgttccgc

SEQ ID NO: 2223 - DNA, 16 bp, Artificial Sequence
  synthetic [barcode part1]
cacaacttagtccttg

SEQ ID NO: 2224 - DNA, 16 bp, Artificial Sequence
  synthetic [barcode part1]
agttgacacactgtgc

SEQ ID NO: 2225 - DNA, 16 bp, Artificial Sequence
  synthetic [barcode part1]
caagttactctgcact

SEQ ID NO: 2226 - DNA, 16 bp, Artificial Sequence
  synthetic [barcode part1]
caacaactcaggtcac

SEQ ID NO: 2227 - DNA, 16 bp, Artificial Sequence
  synthetic [barcode part1]
tggatctagtgcctag

SEQ ID NO: 2228 - DNA, 16 bp, Artificial Sequence
  synthetic [barcode part1]
gcctcaccgttaacgt

SEQ ID NO: 2229 - DNA, 16 bp, Artificial Sequence
  synthetic [barcode part1]
tccgattatcacacgt

SEQ ID NO: 2230 - DNA, 16 bp, Artificial Sequence
  synthetic [barcode part1]
tgacgtattggtacgc

SEQ ID NO: 2231 - DNA, 16 bp, Artificial Sequence
  synthetic [barcode part1]
ttactacggactcgcc

SEQ ID NO: 2232 - DNA, 16 bp, Artificial Sequence
  synthetic [barcode part1]
ccagttaggaatctcg

SEQ ID NO: 2233 - DNA, 16 bp, Artificial Sequence
  synthetic [barcode part1]
gactcctctctcaatc

SEQ ID NO: 2234 - DNA, 16 bp, Artificial Sequence
  synthetic [barcode part1]
gtgcagaatctctgtg

SEQ ID NO: 2235 - DNA, 16 bp, Artificial Sequence
  synthetic [barcode part1]
ttgacacacactgacg

SEQ ID NO: 2236 - DNA, 16 bp, Artificial Sequence
  synthetic [barcode part1]
agagtatcacgtcctg

SEQ ID NO: 2237 - DNA, 16 bp, Artificial Sequence
  synthetic [barcode part1]
tagtggtaattgccgc

SEQ ID NO: 2238 - DNA, 16 bp, Artificial Sequence
  synthetic [barcode part1]
gatacgtagaattggc

SEQ ID NO: 2239 - DNA, 16 bp, Artificial Sequence
  synthetic [barcode part1]
gcctattcgccacagt

SEQ ID NO: 2240 - DNA, 16 bp, Artificial Sequence
  synthetic [barcode part1]
gcgaggatcggcaatt

SEQ ID NO: 2241 - DNA, 16 bp, Artificial Sequence
  synthetic [barcode part1]
cctattaggttcgcgc

SEQ ID NO: 2242 - DNA, 16 bp, Artificial Sequence
  synthetic [barcode part1]
tccgtattcggaccgt

SEQ ID NO: 2243 - DNA, 16 bp, Artificial Sequence
  synthetic [barcode part1]
gaccgaactgcgtaag

SEQ ID NO: 2244 - DNA, 16 bp, Artificial Sequence
  synthetic [barcode part1]
gtcgtcgaatctagtg

SEQ ID NO: 2245 - DNA, 16 bp, Artificial Sequence
  synthetic [barcode part1]
agattagaccggcgtg

SEQ ID NO: 2246 - DNA, 16 bp, Artificial Sequence
  synthetic [barcode part1]
aggatcttgagtagac

SEQ ID NO: 2247 - DNA, 16 bp, Artificial Sequence
  synthetic [barcode part1]
gttccactatcggtgc

SEQ ID NO: 2248 - DNA, 16 bp, Artificial Sequence
  synthetic [barcode part1]
gtggtgaacagagtag

SEQ ID NO: 2249 - DNA, 16 bp, Artificial Sequence
  synthetic [barcode part1]
tcgcgaatacttcact

SEQ ID NO: 2250 - DNA, 16 bp, Artificial Sequence
  synthetic [barcode part1]
tcgacagtcgcactct

SEQ ID NO: 2251 - DNA, 16 bp, Artificial Sequence
  synthetic [barcode part1]
acagagaccaggtcgt

SEQ ID NO: 2252 - DNA, 16 bp, Artificial Sequence
  synthetic [barcode part1]
caggccaataccttcc

SEQ ID NO: 2253 - DNA, 16 bp, Artificial Sequence
  synthetic [barcode part1]
gtagtggtagatctag

SEQ ID NO: 2254 - DNA, 16 bp, Artificial Sequence
  synthetic [barcode part1]
tgaatccacggcgaag

SEQ ID NO: 2255 - DNA, 16 bp, Artificial Sequence
  synthetic [barcode part1]
tgtacaactaccacct

SEQ ID NO: 2256 - DNA, 16 bp, Artificial Sequence
  synthetic [barcode part1]
cagactagagacgtgc

SEQ ID NO: 2257 - DNA, 16 bp, Artificial Sequence
  synthetic [barcode part1]
acactctaggacgtgt

SEQ ID NO: 2258 - DNA, 16 bp, Artificial Sequence
  synthetic [barcode part1]
atcagtataccggcgt

SEQ ID NO: 2259 - DNA, 16 bp, Artificial Sequence
  synthetic [barcode part1]
acgtctccggtctaac

SEQ ID NO: 2260 - DNA, 16 bp, Artificial Sequence
  synthetic [barcode part1]
agattgcgtaaggatc

SEQ ID NO: 2261 - DNA, 16 bp, Artificial Sequence
  synthetic [barcode part1]
tcacgatagaacctcg

SEQ ID NO: 2262 - DNA, 16 bp, Artificial Sequence
  synthetic [barcode part1]
tgcgtctcctaacgac

SEQ ID NO: 2263 - DNA, 16 bp, Artificial Sequence
  synthetic [barcode part1]
accagactgccagatt

SEQ ID NO: 2264 - DNA, 16 bp, Artificial Sequence
  synthetic [barcode part1]
cggcggagaataatag

SEQ ID NO: 2265 - DNA, 16 bp, Artificial Sequence
  synthetic [barcode part1]
gccgagtattcctgtc

SEQ ID NO: 2266 - DNA, 16 bp, Artificial Sequence
  synthetic [barcode part1]
cacaccgtcaactctg

SEQ ID NO: 2267 - DNA, 16 bp, Artificial Sequence
  synthetic [barcode part1]
atcttgttcgccactc

SEQ ID NO: 2268 - DNA, 16 bp, Artificial Sequence
  synthetic [barcode part1]
gccaatacgtcttatc

SEQ ID NO: 2269 - DNA, 16 bp, Artificial Sequence
  synthetic [barcode part1]
cggtattactcgtccg

SEQ ID NO: 2270 - DNA, 16 bp, Artificial Sequence
  synthetic [barcode part1]
attgacggttccttac

SEQ ID NO: 2271 - DNA, 16 bp, Artificial Sequence
  synthetic [barcode part1]
ttggttcgcagttact

SEQ ID NO: 2272 - DNA, 16 bp, Artificial Sequence
  synthetic [barcode part1]
tctggttcgcgcgatt

SEQ ID NO: 2273 - DNA, 16 bp, Artificial Sequence
  synthetic [barcode part1]
cgtagatctaccttac

SEQ ID NO: 2274 - DNA, 16 bp, Artificial Sequence
  synthetic [barcode part1]
gcaacttggatcgttg

SEQ ID NO: 2275 - DNA, 16 bp, Artificial Sequence
  synthetic [barcode part1]
atcctattccgcggac

SEQ ID NO: 2276 - DNA, 16 bp, Artificial Sequence
  synthetic [barcode part1]
tcctgtattccgcact

SEQ ID NO: 2277 - DNA, 16 bp, Artificial Sequence
  synthetic [barcode part1]
agtacacagaaggttc

SEQ ID NO: 2278 - DNA, 16 bp, Artificial Sequence
  synthetic [barcode part1]
tgttgttggcgcgttc

SEQ ID NO: 2279 - DNA, 16 bp, Artificial Sequence
  synthetic [barcode part1]
tatccttgattcgacg

SEQ ID NO: 2280 - DNA, 16 bp, Artificial Sequence
  synthetic [barcode part1]
taggcgtcacgttagt

SEQ ID NO: 2281 - DNA, 16 bp, Artificial Sequence
  synthetic [barcode part1]
tactaggccactagac

SEQ ID NO: 2282 - DNA, 16 bp, Artificial Sequence
  synthetic [barcode part1]
gcactgatataggcct

SEQ ID NO: 2283 - DNA, 16 bp, Artificial Sequence
  synthetic [barcode part1]
cagttctgtgtgttgt

SEQ ID NO: 2284 - DNA, 16 bp, Artificial Sequence
  synthetic [barcode part1]
tgcgcaagagtgttct

SEQ ID NO: 2285 - DNA, 16 bp, Artificial Sequence
  synthetic [barcode part1]
cctggcctaatatatc

SEQ ID NO: 2286 - DNA, 16 bp, Artificial Sequence
  synthetic [barcode part1]
aaccgcgattacacac

SEQ ID NO: 2287 - DNA, 16 bp, Artificial Sequence
  synthetic [barcode part1]
acactgttctgagacg

SEQ ID NO: 2288 - DNA, 16 bp, Artificial Sequence
  synthetic [barcode part1]
accagagaactcttcg

SEQ ID NO: 2289 - DNA, 16 bp, Artificial Sequence
  synthetic [barcode part1]
tcgagttattgccgag

SEQ ID NO: 2290 - DNA, 16 bp, Artificial Sequence
  synthetic [barcode part1]
cagtatctggagtctg

SEQ ID NO: 2291 - DNA, 16 bp, Artificial Sequence
  synthetic [barcode part1]
agtgtcacaaccaacc

SEQ ID NO: 2292 - DNA, 16 bp, Artificial Sequence
  synthetic [barcode part1]
agtcggagttcttcag

SEQ ID NO: 2293 - DNA, 16 bp, Artificial Sequence
  synthetic [barcode part1]
ttctgtatagttcggc

SEQ ID NO: 2294 - DNA, 16 bp, Artificial Sequence
  synthetic [barcode part1]
tgacagtcctcgtacc

SEQ ID NO: 2295 - DNA, 16 bp, Artificial Sequence
  synthetic [barcode part1]
caattattcaccgtcg

SEQ ID NO: 2296 - DNA, 16 bp, Artificial Sequence
  synthetic [barcode part1]
tactctagaacgacgc

SEQ ID NO: 2297 - DNA, 16 bp, Artificial Sequence
  synthetic [barcode part1]
aacacctggaccagag

SEQ ID NO: 2298 - DNA, 16 bp, Artificial Sequence
  synthetic [barcode part1]
gcctggactattccac

SEQ ID NO: 2299 - DNA, 16 bp, Artificial Sequence
  synthetic [barcode part1]
tacttctcaacaaccg

SEQ ID NO: 2300 - DNA, 16 bp, Artificial Sequence
  synthetic [barcode part1]
caccagaacgattcgt

SEQ ID NO: 2301 - DNA, 16 bp, Artificial Sequence
  synthetic [barcode part1]
gtagaggtaattcgac

SEQ ID NO: 2302 - DNA, 16 bp, Artificial Sequence
  synthetic [barcode part1]
ttgatcgcacacgtag

SEQ ID NO: 2303 - DNA, 16 bp, Artificial Sequence
  synthetic [barcode part1]
tagagagtagttgcgt

SEQ ID NO: 2304 - DNA, 16 bp, Artificial Sequence
  synthetic [barcode part1]
atctctaattcggcac

SEQ ID NO: 2305 - DNA, 16 bp, Artificial Sequence
  synthetic [barcode part1]
gtcttcctacacggtg

SEQ ID NO: 2306 - DNA, 16 bp, Artificial Sequence
  synthetic [barcode part1]
taattgacggtcggtc

SEQ ID NO: 2307 - DNA, 16 bp, Artificial Sequence
  synthetic [barcode part1]
aggttggattagtgtg

SEQ ID NO: 2308 - DNA, 16 bp, Artificial Sequence
  synthetic [barcode part1]
ttcgtgtggcctgact

SEQ ID NO: 2309 - DNA, 16 bp, Artificial Sequence
  synthetic [barcode part1]
aagactatctctggcg

SEQ ID NO: 2310 - DNA, 16 bp, Artificial Sequence
  synthetic [barcode part1]
gcgttctccaacaacc

SEQ ID NO: 2311 - DNA, 16 bp, Artificial Sequence
  synthetic [barcode part1]
gaactactcaccagac

SEQ ID NO: 2312 - DNA, 16 bp, Artificial Sequence
  synthetic [barcode part1]
cacacggtcactgttc

SEQ ID NO: 2313 - DNA, 16 bp, Artificial Sequence
  synthetic [barcode part1]
ttggtctctgttgcct

SEQ ID NO: 2314 - DNA, 16 bp, Artificial Sequence
  synthetic [barcode part1]
ccaatcttcgccactt

SEQ ID NO: 2315 - DNA, 16 bp, Artificial Sequence
  synthetic [barcode part1]
tcgagagtagtgagag

SEQ ID NO: 2316 - DNA, 16 bp, Artificial Sequence
  synthetic [barcode part1]
cgaatcactaacggtc

SEQ ID NO: 2317 - DNA, 16 bp, Artificial Sequence
  synthetic [barcode part1]
gttaattgttgcggcg

SEQ ID NO: 2318 - DNA, 16 bp, Artificial Sequence
  synthetic [barcode part1]
ccgagtcttctacgtg

SEQ ID NO: 2319 - DNA, 16 bp, Artificial Sequence
  synthetic [barcode part1]
ccagtccagtgtgtct

SEQ ID NO: 2320 - DNA, 16 bp, Artificial Sequence
  synthetic [barcode part1]
cagtgcacctctggtt

SEQ ID NO: 2321 - DNA, 16 bp, Artificial Sequence
  synthetic [barcode part1]
ttactctcttccgacg

SEQ ID NO: 2322 - DNA, 16 bp, Artificial Sequence
  synthetic [barcode part1]
ccgccaacaacttaag

SEQ ID NO: 2323 - DNA, 16 bp, Artificial Sequence
  synthetic [barcode part1]
gataactcttcgcgtt

SEQ ID NO: 2324 - DNA, 16 bp, Artificial Sequence
  synthetic [barcode part1]
tgattggtgcaacacc

SEQ ID NO: 2325 - DNA, 16 bp, Artificial Sequence
  synthetic [barcode part1]
acacgttaagtgcctg

SEQ ID NO: 2326 - DNA, 16 bp, Artificial Sequence
  synthetic [barcode part1]
gtctctcaaggaatcg

SEQ ID NO: 2327 - DNA, 16 bp, Artificial Sequence
  synthetic [barcode part1]
tccgtgtcgtatcttc

SEQ ID NO: 2328 - DNA, 16 bp, Artificial Sequence
  synthetic [barcode part1]
cagaccagatcactgt

SEQ ID NO: 2329 - DNA, 16 bp, Artificial Sequence
  synthetic [barcode part1]
aattgccggcgtgaag

SEQ ID NO: 2330 - DNA, 16 bp, Artificial Sequence
  synthetic [barcode part1]
aacctgacctcgtgtc

SEQ ID NO: 2331 - DNA, 16 bp, Artificial Sequence
  synthetic [barcode part1]
ttcgactagaaccggt

SEQ ID NO: 2332 - DNA, 16 bp, Artificial Sequence
  synthetic [barcode part1]
acctggaatctcactt

SEQ ID NO: 2333 - DNA, 16 bp, Artificial Sequence
  synthetic [barcode part1]
agtcgtgccgacttct

SEQ ID NO: 2334 - DNA, 16 bp, Artificial Sequence
  synthetic [barcode part1]
attgacgtctgcagac

SEQ ID NO: 2335 - DNA, 16 bp, Artificial Sequence
  synthetic [barcode part1]
tactgtggtacacgtg

SEQ ID NO: 2336 - DNA, 16 bp, Artificial Sequence
  synthetic [barcode part1]
gtgaattactgcctct

SEQ ID NO: 2337 - DNA, 16 bp, Artificial Sequence
  synthetic [barcode part1]
cgcaagaacactcttg

SEQ ID NO: 2338 - DNA, 16 bp, Artificial Sequence
  synthetic [barcode part1]
gcgattaaccagtacc

SEQ ID NO: 2339 - DNA, 16 bp, Artificial Sequence
  synthetic [barcode part1]
cgaatcgaaccgttgt

SEQ ID NO: 2340 - DNA, 16 bp, Artificial Sequence
  synthetic [barcode part1]
tagaggagtcggcgtt

SEQ ID NO: 2341 - DNA, 16 bp, Artificial Sequence
  synthetic [barcode part1]
tgaacctgcgaattcg

SEQ ID NO: 2342 - DNA, 16 bp, Artificial Sequence
  synthetic [barcode part1]
actcgagtctgttgtt

SEQ ID NO: 2343 - DNA, 16 bp, Artificial Sequence
  synthetic [barcode part1]
ttacgtggattaggag

SEQ ID NO: 2344 - DNA, 16 bp, Artificial Sequence
  synthetic [barcode part1]
atcgtgagaacaagtc

SEQ ID NO: 2345 - DNA, 16 bp, Artificial Sequence
  synthetic [barcode part1]
tggagagtacaatcac

SEQ ID NO: 2346 - DNA, 16 bp, Artificial Sequence
  synthetic [barcode part1]
gattattgcaggaacg

SEQ ID NO: 2347 - DNA, 16 bp, Artificial Sequence
  synthetic [barcode part1]
caacacaatcgagaac

SEQ ID NO: 2348 - DNA, 16 bp, Artificial Sequence
  synthetic [barcode part1]
cagaggtatctggcag

SEQ ID NO: 2349 - DNA, 16 bp, Artificial Sequence
  synthetic [barcode part1]
ttcgactaccacgcgt

SEQ ID NO: 2350 - DNA, 16 bp, Artificial Sequence
  synthetic [barcode part1]
tagatccagatccacg

SEQ ID NO: 2351 - DNA, 16 bp, Artificial Sequence
  synthetic [barcode part1]
gttggtgttcgcaagt

SEQ ID NO: 2352 - DNA, 16 bp, Artificial Sequence
  synthetic [barcode part1]
gatcagtctccaagac

SEQ ID NO: 2353 - DNA, 16 bp, Artificial Sequence
  synthetic [barcode part1]
ttgtaatcaaccggcg

SEQ ID NO: 2354 - DNA, 16 bp, Artificial Sequence
  synthetic [barcode part1]
acaaccaagaaggttc

SEQ ID NO: 2355 - DNA, 16 bp, Artificial Sequence
  synthetic [barcode part1]
cacttcaaggttcact

SEQ ID NO: 2356 - DNA, 16 bp, Artificial Sequence
  synthetic [barcode part1]
tgcagtaaccttggac

SEQ ID NO: 2357 - DNA, 16 bp, Artificial Sequence
  synthetic [barcode part1]
gtctggcaactatcag

SEQ ID NO: 2358 - DNA, 16 bp, Artificial Sequence
  synthetic [barcode part1]
tgactctgtcggtatt

SEQ ID NO: 2359 - DNA, 16 bp, Artificial Sequence
  synthetic [barcode part1]
gcggagaccgatagtt

SEQ ID NO: 2360 - DNA, 16 bp, Artificial Sequence
  synthetic [barcode part1]
gtgttgaaccgaggac

SEQ ID NO: 2361 - DNA, 16 bp, Artificial Sequence
  synthetic [barcode part1]
atctgtcctacggcgt

SEQ ID NO: 2362 - DNA, 16 bp, Artificial Sequence
  synthetic [barcode part1]
cctgtcagttgaagac

SEQ ID NO: 2363 - DNA, 16 bp, Artificial Sequence
  synthetic [barcode part1]
acctctcttagtcctg

SEQ ID NO: 2364 - DNA, 16 bp, Artificial Sequence
  synthetic [barcode part1]
acttactgtaggcgac

SEQ ID NO: 2365 - DNA, 16 bp, Artificial Sequence
  synthetic [barcode part1]
ttgttcacgtccgttc

SEQ ID NO: 2366 - DNA, 16 bp, Artificial Sequence
  synthetic [barcode part1]
cgcacttgaaccgttc

SEQ ID NO: 2367 - DNA, 16 bp, Artificial Sequence
  synthetic [barcode part1]
actactgtggttcgag

SEQ ID NO: 2368 - DNA, 16 bp, Artificial Sequence
  synthetic [barcode part1]
gaggaatcactaacgt

SEQ ID NO: 2369 - DNA, 16 bp, Artificial Sequence
  synthetic [barcode part1]
acacctcgtgtaagac

SEQ ID NO: 2370 - DNA, 16 bp, Artificial Sequence
  synthetic [barcode part1]
tggcgtggttacttcc

SEQ ID NO: 2371 - DNA, 16 bp, Artificial Sequence
  synthetic [barcode part1]
ttaatacggaaggtcg

SEQ ID NO: 2372 - DNA, 16 bp, Artificial Sequence
  synthetic [barcode part1]
attcgtggttaaggag

SEQ ID NO: 2373 - DNA, 16 bp, Artificial Sequence
  synthetic [barcode part1]
aaggaccaactggaag

SEQ ID NO: 2374 - DNA, 16 bp, Artificial Sequence
  synthetic [barcode part1]
aacgtgtcaacgtacc

SEQ ID NO: 2375 - DNA, 16 bp, Artificial Sequence
  synthetic [barcode part1]
taccgttacaaccact

SEQ ID NO: 2376 - DNA, 16 bp, Artificial Sequence
  synthetic [barcode part1]
acaacctggtgcagag

SEQ ID NO: 2377 - DNA, 16 bp, Artificial Sequence
  synthetic [barcode part1]
cggaagagtcaacacc

SEQ ID NO: 2378 - DNA, 16 bp, Artificial Sequence
  synthetic [barcode part1]
agttaagacggttacg

SEQ ID NO: 2379 - DNA, 16 bp, Artificial Sequence
  synthetic [barcode part1]
tgatcggaggatcctt

SEQ ID NO: 2380 - DNA, 16 bp, Artificial Sequence
  synthetic [barcode part1]
tcgacgagtcctcact

SEQ ID NO: 2381 - DNA, 16 bp, Artificial Sequence
  synthetic [barcode part1]
gcgaccagttgatatc

SEQ ID NO: 2382 - DNA, 16 bp, Artificial Sequence
  synthetic [barcode part1]
atccttacctgacaac

SEQ ID NO: 2383 - DNA, 16 bp, Artificial Sequence
  synthetic [barcode part1]
tatacaagtggccgtc

SEQ ID NO: 2384 - DNA, 16 bp, Artificial Sequence
  synthetic [barcode part1]
acgtctattcaggcag

SEQ ID NO: 2385 - DNA, 16 bp, Artificial Sequence
  synthetic [barcode part1]
agacttccgtgtacag

SEQ ID NO: 2386 - DNA, 16 bp, Artificial Sequence
  synthetic [barcode part1]
ttggagtacttacctc

SEQ ID NO: 2387 - DNA, 16 bp, Artificial Sequence
  synthetic [barcode part1]
gccgtacactgagaag

SEQ ID NO: 2388 - DNA, 16 bp, Artificial Sequence
  synthetic [barcode part1]
agaggaactctgagag

SEQ ID NO: 2389 - DNA, 16 bp, Artificial Sequence
  synthetic [barcode part1]
caggttaacgccttcc

SEQ ID NO: 2390 - DNA, 16 bp, Artificial Sequence
  synthetic [barcode part1]
agtaacttcggaccgt

SEQ ID NO: 2391 - DNA, 16 bp, Artificial Sequence
  synthetic [barcode part1]
atcttatctgtgcggt

SEQ ID NO: 2392 - DNA, 16 bp, Artificial Sequence
  synthetic [barcode part1]
agttggtaaccgactc

SEQ ID NO: 2393 - DNA, 16 bp, Artificial Sequence
  synthetic [barcode part1]
caactccttctggttc

SEQ ID NO: 2394 - DNA, 16 bp, Artificial Sequence
  synthetic [barcode part1]
caaggactaccagacg

SEQ ID NO: 2395 - DNA, 16 bp, Artificial Sequence
  synthetic [barcode part1]
ccaccacgtagacctt

SEQ ID NO: 2396 - DNA, 16 bp, Artificial Sequence
  synthetic [barcode part1]
cgaagtctgcaacact

SEQ ID NO: 2397 - DNA, 16 bp, Artificial Sequence
  synthetic [barcode part1]
gtgtctaagacttgcg

SEQ ID NO: 2398 - DNA, 16 bp, Artificial Sequence
  synthetic [barcode part1]
ttcgtatctggcggtc

SEQ ID NO: 2399 - DNA, 16 bp, Artificial Sequence
  synthetic [barcode part1]
cgttccactacagacc

SEQ ID NO: 2400 - DNA, 16 bp, Artificial Sequence
  synthetic [barcode part1]
gaatcctctaaggtcg

SEQ ID NO: 2401 - DNA, 16 bp, Artificial Sequence
  synthetic [barcode part1]
tcagtctcgagagact

SEQ ID NO: 2402 - DNA, 16 bp, Artificial Sequence
  synthetic [barcode part1]
agaccacgtagttcgt

SEQ ID NO: 2403 - DNA, 16 bp, Artificial Sequence
  synthetic [barcode part1]
ttggtggtcactgagt

SEQ ID NO: 2404 - DNA, 16 bp, Artificial Sequence
  synthetic [barcode part1]
ttccggttcaacacgc

SEQ ID NO: 2405 - DNA, 16 bp, Artificial Sequence
  synthetic [barcode part1]
ataggaacttccgcac

SEQ ID NO: 2406 - DNA, 16 bp, Artificial Sequence
  synthetic [barcode part1]
agacgactgatccttg

SEQ ID NO: 2407 - DNA, 16 bp, Artificial Sequence
  synthetic [barcode part1]
cgacggtctctatacc

SEQ ID NO: 2408 - DNA, 16 bp, Artificial Sequence
  synthetic [barcode part1]
tccaaccagaagatcc

SEQ ID NO: 2409 - DNA, 16 bp, Artificial Sequence
  synthetic [barcode part1]
gttgcctgagtaacac

SEQ ID NO: 2410 - DNA, 16 bp, Artificial Sequence
  synthetic [barcode part1]
agaggcgacgatctgt

SEQ ID NO: 2411 - DNA, 16 bp, Artificial Sequence
  synthetic [barcode part1]
agtgttatcggtcggt

SEQ ID NO: 2412 - DNA, 16 bp, Artificial Sequence
  synthetic [barcode part1]
cctcggagtctacttg

SEQ ID NO: 2413 - DNA, 16 bp, Artificial Sequence
  synthetic [barcode part1]
tcgtcaactaacgacg

SEQ ID NO: 2414 - DNA, 16 bp, Artificial Sequence
  synthetic [barcode part1]
cgcacactaataccag

SEQ ID NO: 2415 - DNA, 16 bp, Artificial Sequence
  synthetic [barcode part1]
ttatacaggtcctctg

SEQ ID NO: 2416 - DNA, 16 bp, Artificial Sequence
  synthetic [barcode part1]
gccactctacctaggt

SEQ ID NO: 2417 - DNA, 16 bp, Artificial Sequence
  synthetic [barcode part1]
ccttataacacgaggc

SEQ ID NO: 2418 - DNA, 16 bp, Artificial Sequence
  synthetic [barcode part1]
tgcgtgacacctcgtt

SEQ ID NO: 2419 - DNA, 16 bp, Artificial Sequence
  synthetic [barcode part1]
taggtctcacttggag

SEQ ID NO: 2420 - DNA, 16 bp, Artificial Sequence
  synthetic [barcode part1]
cgacgtctactcgttg

SEQ ID NO: 2421 - DNA, 16 bp, Artificial Sequence
  synthetic [barcode part1]
attgcacgattgtgcg

SEQ ID NO: 2422 - DNA, 16 bp, Artificial Sequence
  synthetic [barcode part1]
tgcgagttaggcactt

SEQ ID NO: 2423 - DNA, 16 bp, Artificial Sequence
  synthetic [barcode part1]
tcctaatccggcgtac

SEQ ID NO: 2424 - DNA, 16 bp, Artificial Sequence
  synthetic [barcode part1]
gttgtcttaccgcctt

SEQ ID NO: 2425 - DNA, 16 bp, Artificial Sequence
  synthetic [barcode part1]
agaactacgacttccg

SEQ ID NO: 2426 - DNA, 16 bp, Artificial Sequence
  synthetic [barcode part1]
tgtacgtgttgcaacg

SEQ ID NO: 2427 - DNA, 16 bp, Artificial Sequence
  synthetic [barcode part1]
tgccttctagtaatcg

SEQ ID NO: 2428 - DNA, 16 bp, Artificial Sequence
  synthetic [barcode part1]
cgttcaccaggacttc

SEQ ID NO: 2429 - DNA, 16 bp, Artificial Sequence
  synthetic [barcode part1]
aacagtaacggatctg

SEQ ID NO: 2430 - DNA, 16 bp, Artificial Sequence
  synthetic [barcode part1]
gaattcacacctcact

SEQ ID NO: 2431 - DNA, 16 bp, Artificial Sequence
  synthetic [barcode part1]
tcaccgtaggtctacc

SEQ ID NO: 2432 - DNA, 16 bp, Artificial Sequence
  synthetic [barcode part1]
tatagtattcgtccgc

SEQ ID NO: 2433 - DNA, 16 bp, Artificial Sequence
  synthetic [barcode part1]
ttcctggttccttgac

SEQ ID NO: 2434 - DNA, 16 bp, Artificial Sequence
  synthetic [barcode part1]
ccggtaggaactattc

SEQ ID NO: 2435 - DNA, 16 bp, Artificial Sequence
  synthetic [barcode part1]
tgattcgtgaatcgcg

SEQ ID NO: 2436 - DNA, 16 bp, Artificial Sequence
  synthetic [barcode part1]
cgattccgattccttc

SEQ ID NO: 2437 - DNA, 16 bp, Artificial Sequence
  synthetic [barcode part1]
tccaccgtacagacct

SEQ ID NO: 2438 - DNA, 16 bp, Artificial Sequence
  synthetic [barcode part1]
cgtgacaacgaacggt

SEQ ID NO: 2439 - DNA, 16 bp, Artificial Sequence
  synthetic [barcode part1]
tcgtcactaaggtgac

SEQ ID NO: 2440 - DNA, 16 bp, Artificial Sequence
  synthetic [barcode part1]
tcgtattcggattgtc

SEQ ID NO: 2441 - DNA, 16 bp, Artificial Sequence
  synthetic [barcode part1]
tccgaagtcaactggt

SEQ ID NO: 2442 - DNA, 16 bp, Artificial Sequence
  synthetic [barcode part1]
gtctcgcgtccgaatt

SEQ ID NO: 2443 - DNA, 16 bp, Artificial Sequence
  synthetic [barcode part1]
tgtgccgtcagaagag

SEQ ID NO: 2444 - DNA, 16 bp, Artificial Sequence
  synthetic [barcode part1]
acttacgtcgacgtag

SEQ ID NO: 2445 - DNA, 16 bp, Artificial Sequence
  synthetic [barcode part1]
tggaacctcgagatct

SEQ ID NO: 2446 - DNA, 16 bp, Artificial Sequence
  synthetic [barcode part1]
taggaatcaggtcgcg

SEQ ID NO: 2447 - DNA, 16 bp, Artificial Sequence
  synthetic [barcode part1]
cgaagaacacacaact

SEQ ID NO: 2448 - DNA, 16 bp, Artificial Sequence
  synthetic [barcode part1]
caacgccgttcacttg

SEQ ID NO: 2449 - DNA, 16 bp, Artificial Sequence
  synthetic [barcode part1]
gtgttccagttcaatc

SEQ ID NO: 2450 - DNA, 16 bp, Artificial Sequence
  synthetic [barcode part1]
caagtcgcacgttcct

SEQ ID NO: 2451 - DNA, 16 bp, Artificial Sequence
  synthetic [barcode part1]
gcgcgtattaactgac

SEQ ID NO: 2452 - DNA, 16 bp, Artificial Sequence
  synthetic [barcode part1]
caacggaaccttgttg

SEQ ID NO: 2453 - DNA, 16 bp, Artificial Sequence
  synthetic [barcode part1]
aattgcgaccggtatc

SEQ ID NO: 2454 - DNA, 16 bp, Artificial Sequence
  synthetic [barcode part1]
caacaacttctcgcgc

SEQ ID NO: 2455 - DNA, 16 bp, Artificial Sequence
  synthetic [barcode part1]
cggaagaacgtgttgc

SEQ ID NO: 2456 - DNA, 16 bp, Artificial Sequence
  synthetic [barcode part1]
caactcaataggagtg

SEQ ID NO: 2457 - DNA, 16 bp, Artificial Sequence
  synthetic [barcode part1]
tcggtctctacgcaac

SEQ ID NO: 2458 - DNA, 16 bp, Artificial Sequence
  synthetic [barcode part1]
attctcttaacgcacg

SEQ ID NO: 2459 - DNA, 16 bp, Artificial Sequence
  synthetic [barcode part1]
ccggtcttattggcgt

SEQ ID NO: 2460 - DNA, 16 bp, Artificial Sequence
  synthetic [barcode part1]
caacggtacgccttct

SEQ ID NO: 2461 - DNA, 16 bp, Artificial Sequence
  synthetic [barcode part1]
gatatcggatcggttc

SEQ ID NO: 2462 - DNA, 16 bp, Artificial Sequence
  synthetic [barcode part1]
cggagaggttagtatt

SEQ ID NO: 2463 - DNA, 16 bp, Artificial Sequence
  synthetic [barcode part1]
agtcaggcctacgaag

SEQ ID NO: 2464 - DNA, 16 bp, Artificial Sequence
  synthetic [barcode part1]
cgcgagtataagttcc

SEQ ID NO: 2465 - DNA, 16 bp, Artificial Sequence
  synthetic [barcode part1]
aaccaacggccttaac

SEQ ID NO: 2466 - DNA, 16 bp, Artificial Sequence
  synthetic [barcode part1]
tactggaccgtactcc

SEQ ID NO: 2467 - DNA, 16 bp, Artificial Sequence
  synthetic [barcode part1]
ccgacttcttacaggc

SEQ ID NO: 2468 - DNA, 16 bp, Artificial Sequence
  synthetic [barcode part1]
aacggaccgagattcg

SEQ ID NO: 2469 - DNA, 16 bp, Artificial Sequence
  synthetic [barcode part1]
tcgtaagacctggatc

SEQ ID NO: 2470 - DNA, 16 bp, Artificial Sequence
  synthetic [barcode part1]
agtgagattgacacgt

SEQ ID NO: 2471 - DNA, 16 bp, Artificial Sequence
  synthetic [barcode part1]
tctcaacacactcagt

SEQ ID NO: 2472 - DNA, 16 bp, Artificial Sequence
  synthetic [barcode part1]
gtatattggaccagag

SEQ ID NO: 2473 - DNA, 16 bp, Artificial Sequence
  synthetic [barcode part1]
atagtagacttggacg

SEQ ID NO: 2474 - DNA, 16 bp, Artificial Sequence
  synthetic [barcode part1]
cgattcaattctcgtg

SEQ ID NO: 2475 - DNA, 16 bp, Artificial Sequence
  synthetic [barcode part1]
tcgccagaatcgttag

SEQ ID NO: 2476 - DNA, 16 bp, Artificial Sequence
  synthetic [barcode part1]
taccaacaagaagtcg

SEQ ID NO: 2477 - DNA, 16 bp, Artificial Sequence
  synthetic [barcode part1]
accgacgtaagttcac

SEQ ID NO: 2478 - DNA, 16 bp, Artificial Sequence
  synthetic [barcode part1]
agtggaggtgtagtcc

SEQ ID NO: 2479 - DNA, 16 bp, Artificial Sequence
  synthetic [barcode part1]
caagtgttggtaagac

SEQ ID NO: 2480 - DNA, 16 bp, Artificial Sequence
  synthetic [barcode part1]
aggatcctagataggt

SEQ ID NO: 2481 - DNA, 16 bp, Artificial Sequence
  synthetic [barcode part1]
cgtcgaattcacgcct

SEQ ID NO: 2482 - DNA, 16 bp, Artificial Sequence
  synthetic [barcode part1]
cggatcgttctgtgtc

SEQ ID NO: 2483 - DNA, 16 bp, Artificial Sequence
  synthetic [barcode part1]
caccaaggacagttct

SEQ ID NO: 2484 - DNA, 16 bp, Artificial Sequence
  synthetic [barcode part1]
tagataccgcactggt

SEQ ID NO: 2485 - DNA, 16 bp, Artificial Sequence
  synthetic [barcode part1]
aattacagaccgagac

SEQ ID NO: 2486 - DNA, 16 bp, Artificial Sequence
  synthetic [barcode part1]
actagacgtgatctgc

SEQ ID NO: 2487 - DNA, 16 bp, Artificial Sequence
  synthetic [barcode part1]
tcacactggtgcaagt

SEQ ID NO: 2488 - DNA, 16 bp, Artificial Sequence
  synthetic [barcode part1]
tggcaataatccgacc

SEQ ID NO: 2489 - DNA, 16 bp, Artificial Sequence
  synthetic [barcode part1]
ccgaattacacctccg

SEQ ID NO: 2490 - DNA, 16 bp, Artificial Sequence
  synthetic [barcode part1]
agaccgagattccttg

SEQ ID NO: 2491 - DNA, 16 bp, Artificial Sequence
  synthetic [barcode part1]
gaccttcactacttcc

SEQ ID NO: 2492 - DNA, 16 bp, Artificial Sequence
  synthetic [barcode part1]
agtctccaagacgatc

SEQ ID NO: 2493 - DNA, 16 bp, Artificial Sequence
  synthetic [barcode part1]
cgtcaggttatattcc

SEQ ID NO: 2494 - DNA, 16 bp, Artificial Sequence
  synthetic [barcode part1]
aactctcagttcgtgt

SEQ ID NO: 2495 - DNA, 16 bp, Artificial Sequence
  synthetic [barcode part1]
gtactaccgttacgag

SEQ ID NO: 2496 - DNA, 16 bp, Artificial Sequence
  synthetic [barcode part1]
tgtgagtcctgaacac

SEQ ID NO: 2497 - DNA, 16 bp, Artificial Sequence
  synthetic [barcode part1]
agtgattgcgttctct

SEQ ID NO: 2498 - DNA, 16 bp, Artificial Sequence
  synthetic [barcode part1]
aatcgatccggaacct

SEQ ID NO: 2499 - DNA, 16 bp, Artificial Sequence
  synthetic [barcode part1]
tcggtcggattctaag

SEQ ID NO: 2500 - DNA, 16 bp, Artificial Sequence
  synthetic [barcode part1]
gcagtgccaattagtc

SEQ ID NO: 2501 - DNA, 16 bp, Artificial Sequence
  synthetic [barcode part1]
tactggaggtatagac

SEQ ID NO: 2502 - DNA, 16 bp, Artificial Sequence
  synthetic [barcode part1]
taacttctagtcacgc

SEQ ID NO: 2503 - DNA, 16 bp, Artificial Sequence
  synthetic [barcode part1]
gttaatacagaggacc

SEQ ID NO: 2504 - DNA, 16 bp, Artificial Sequence
  synthetic [barcode part1]
agtgaagtcggatact

SEQ ID NO: 2505 - DNA, 16 bp, Artificial Sequence
  synthetic [barcode part1]
caggttgaagacgcgt

SEQ ID NO: 2506 - DNA, 16 bp, Artificial Sequence
  synthetic [barcode part1]
tgtccactggagtctc

SEQ ID NO: 2507 - DNA, 16 bp, Artificial Sequence
  synthetic [barcode part1]
tcagtcaactgcagtg

SEQ ID NO: 2508 - DNA, 16 bp, Artificial Sequence
  synthetic [barcode part1]
acaggagttctgtgtc

SEQ ID NO: 2509 - DNA, 16 bp, Artificial Sequence
  synthetic [barcode part1]
taacgacgcgtaggac

SEQ ID NO: 2510 - DNA, 16 bp, Artificial Sequence
  synthetic [barcode part1]
caggattaatcctggc

SEQ ID NO: 2511 - DNA, 16 bp, Artificial Sequence
  synthetic [barcode part1]
gtcttgcgttcgaacc

SEQ ID NO: 2512 - DNA, 16 bp, Artificial Sequence
  synthetic [barcode part1]
ttcgtataatccggtc

SEQ ID NO: 2513 - DNA, 16 bp, Artificial Sequence
  synthetic [barcode part1]
acaagttcgaccttct

SEQ ID NO: 2514 - DNA, 16 bp, Artificial Sequence
  synthetic [barcode part1]
caacaacttggcgatc

SEQ ID NO: 2515 - DNA, 16 bp, Artificial Sequence
  synthetic [barcode part1]
ttagttcggtggcaac

SEQ ID NO: 2516 - DNA, 16 bp, Artificial Sequence
  synthetic [barcode part1]
cacttaccaccgtggt

SEQ ID NO: 2517 - DNA, 16 bp, Artificial Sequence
  synthetic [barcode part1]
cgtactcacaactcgc

SEQ ID NO: 2518 - DNA, 16 bp, Artificial Sequence
  synthetic [barcode part1]
tacgtgaacgattgcc

SEQ ID NO: 2519 - DNA, 16 bp, Artificial Sequence
  synthetic [barcode part1]
aacttcgcggacagag

SEQ ID NO: 2520 - DNA, 16 bp, Artificial Sequence
  synthetic [barcode part1]
cctcctacttgatctg

SEQ ID NO: 2521 - DNA, 16 bp, Artificial Sequence
  synthetic [barcode part1]
tcaaggtctatccgcc

SEQ ID NO: 2522 - DNA, 16 bp, Artificial Sequence
  synthetic [barcode part1]
agtacgcaatctctct

SEQ ID NO: 2523 - DNA, 16 bp, Artificial Sequence
  synthetic [barcode part1]
actggtgcgttagtgt

SEQ ID NO: 2524 - DNA, 16 bp, Artificial Sequence
  synthetic [barcode part1]
atccaacacactcttg

SEQ ID NO: 2525 - DNA, 16 bp, Artificial Sequence
  synthetic [barcode part1]
tatagagtctcgtgcg

SEQ ID NO: 2526 - DNA, 16 bp, Artificial Sequence
  synthetic [barcode part1]
atagtagtccggttcg

SEQ ID NO: 2527 - DNA, 16 bp, Artificial Sequence
  synthetic [barcode part1]
ttccaccacttgtaag

SEQ ID NO: 2528 - DNA, 16 bp, Artificial Sequence
  synthetic [barcode part1]
tacgcggatctgaatc

SEQ ID NO: 2529 - DNA, 16 bp, Artificial Sequence
  synthetic [barcode part1]
actactggtgtaagag

SEQ ID NO: 2530 - DNA, 16 bp, Artificial Sequence
  synthetic [barcode part1]
ttctagtgccaccttc

SEQ ID NO: 2531 - DNA, 16 bp, Artificial Sequence
  synthetic [barcode part1]
ccgacaagtaagaact

SEQ ID NO: 2532 - DNA, 16 bp, Artificial Sequence
  synthetic [barcode part1]
cgccaagttcacgttc

SEQ ID NO: 2533 - DNA, 16 bp, Artificial Sequence
  synthetic [barcode part1]
tcgaggttactacggt

SEQ ID NO: 2534 - DNA, 16 bp, Artificial Sequence
  synthetic [barcode part1]
gcggatcttcttggtc

SEQ ID NO: 2535 - DNA, 16 bp, Artificial Sequence
  synthetic [barcode part1]
tccactagaccgcact

SEQ ID NO: 2536 - DNA, 16 bp, Artificial Sequence
  synthetic [barcode part1]
cgttcggaggaatcag

SEQ ID NO: 2537 - DNA, 16 bp, Artificial Sequence
  synthetic [barcode part1]
gaagtagtgaggtggt

SEQ ID NO: 2538 - DNA, 16 bp, Artificial Sequence
  synthetic [barcode part1]
aataccaacgtcgcgt

SEQ ID NO: 2539 - DNA, 16 bp, Artificial Sequence
  synthetic [barcode part1]
gtgcgcgtatagtact

SEQ ID NO: 2540 - DNA, 16 bp, Artificial Sequence
  synthetic [barcode part1]
tcaaggttggaactcc

SEQ ID NO: 2541 - DNA, 16 bp, Artificial Sequence
  synthetic [barcode part1]
tggaataacgaccgcg

SEQ ID NO: 2542 - DNA, 16 bp, Artificial Sequence
  synthetic [barcode part1]
tctagacctcgtgaag

SEQ ID NO: 2543 - DNA, 16 bp, Artificial Sequence
  synthetic [barcode part1]
cgtgtccaataatcct

SEQ ID NO: 2544 - DNA, 16 bp, Artificial Sequence
  synthetic [barcode part1]
tcttgcgcggtaatcc

SEQ ID NO: 2545 - DNA, 16 bp, Artificial Sequence
  synthetic [barcode part1]
ccgtataagaactgag

SEQ ID NO: 2546 - DNA, 16 bp, Artificial Sequence
  synthetic [barcode part1]
atctatcggtactacc

SEQ ID NO: 2547 - DNA, 16 bp, Artificial Sequence
  synthetic [barcode part1]
gtaaggcgcgaatctg

SEQ ID NO: 2548 - DNA, 16 bp, Artificial Sequence
  synthetic [barcode part1]
tctgtatcggtaactc

SEQ ID NO: 2549 - DNA, 16 bp, Artificial Sequence
  synthetic [barcode part1]
tctatctctcgaagtg

SEQ ID NO: 2550 - DNA, 16 bp, Artificial Sequence
  synthetic [barcode part1]
ttcaaggtcctggaac

SEQ ID NO: 2551 - DNA, 16 bp, Artificial Sequence
  synthetic [barcode part1]
cacagtggacactgtt

SEQ ID NO: 2552 - DNA, 16 bp, Artificial Sequence
  synthetic [barcode part1]
cgattcctctcaatcc

SEQ ID NO: 2553 - DNA, 16 bp, Artificial Sequence
  synthetic [barcode part1]
tgaactgatcgtcgac

SEQ ID NO: 2554 - DNA, 16 bp, Artificial Sequence
  synthetic [barcode part1]
gttcctgattcggtgc

SEQ ID NO: 2555 - DNA, 16 bp, Artificial Sequence
  synthetic [barcode part1]
aaggtcgtaacttccg

SEQ ID NO: 2556 - DNA, 16 bp, Artificial Sequence
  synthetic [barcode part1]
gcactagtgtgttggt

SEQ ID NO: 2557 - DNA, 16 bp, Artificial Sequence
  synthetic [barcode part1]
cgcacgtattacagtg

SEQ ID NO: 2558 - DNA, 16 bp, Artificial Sequence
  synthetic [barcode part1]
gttcaggtcacagact

SEQ ID NO: 2559 - DNA, 16 bp, Artificial Sequence
  synthetic [barcode part1]
acgagacgcctgtaag

SEQ ID NO: 2560 - DNA, 16 bp, Artificial Sequence
  synthetic [barcode part1]
gtgacgaccacacaag

SEQ ID NO: 2561 - DNA, 16 bp, Artificial Sequence
  synthetic [barcode part1]
ttcggtcaactctctc

SEQ ID NO: 2562 - DNA, 16 bp, Artificial Sequence
  synthetic [barcode part1]
cggcgttgttcacttg

SEQ ID NO: 2563 - DNA, 16 bp, Artificial Sequence
  synthetic [barcode part1]
tgtatcttaggccgcc

SEQ ID NO: 2564 - DNA, 16 bp, Artificial Sequence
  synthetic [barcode part1]
gtgaggtagacaacag

SEQ ID NO: 2565 - DNA, 16 bp, Artificial Sequence
  synthetic [barcode part1]
gtgaccgtctcaactc

SEQ ID NO: 2566 - DNA, 16 bp, Artificial Sequence
  synthetic [barcode part1]
gtacctcgactgttgc

SEQ ID NO: 2567 - DNA, 16 bp, Artificial Sequence
  synthetic [barcode part1]
tcctcgtgaatacgag

SEQ ID NO: 2568 - DNA, 16 bp, Artificial Sequence
  synthetic [barcode part1]
cctcggatctgttcag

SEQ ID NO: 2569 - DNA, 16 bp, Artificial Sequence
  synthetic [barcode part1]
tcagacttggtggttg

SEQ ID NO: 2570 - DNA, 16 bp, Artificial Sequence
  synthetic [barcode part1]
ttcgaagattgcggtc

SEQ ID NO: 2571 - DNA, 16 bp, Artificial Sequence
  synthetic [barcode part1]
agaatacaggaacgcg

SEQ ID NO: 2572 - DNA, 16 bp, Artificial Sequence
  synthetic [barcode part1]
ttggtgtcctcaattg

SEQ ID NO: 2573 - DNA, 16 bp, Artificial Sequence
  synthetic [barcode part1]
tcttacgactggatct

SEQ ID NO: 2574 - DNA, 16 bp, Artificial Sequence
  synthetic [barcode part1]
aagtaccaagttcgcc

SEQ ID NO: 2575 - DNA, 16 bp, Artificial Sequence
  synthetic [barcode part1]
accgaaccgtctctgt

SEQ ID NO: 2576 - DNA, 16 bp, Artificial Sequence
  synthetic [barcode part1]
acaccagtgcgttagt

SEQ ID NO: 2577 - DNA, 16 bp, Artificial Sequence
  synthetic [barcode part1]
acttcgtactctccgt

SEQ ID NO: 2578 - DNA, 16 bp, Artificial Sequence
  synthetic [barcode part1]
gtcgacgtaagtctac

SEQ ID NO: 2579 - DNA, 16 bp, Artificial Sequence
  synthetic [barcode part1]
gaggatccaactgcag

SEQ ID NO: 2580 - DNA, 16 bp, Artificial Sequence
  synthetic [barcode part1]
ttggttgcacaacacg

SEQ ID NO: 2581 - DNA, 16 bp, Artificial Sequence
  synthetic [barcode part1]
cagacaggtagtaccg

SEQ ID NO: 2582 - DNA, 16 bp, Artificial Sequence
  synthetic [barcode part1]
cgtgtctacctggtac

SEQ ID NO: 2583 - DNA, 16 bp, Artificial Sequence
  synthetic [barcode part1]
tactcaggactacacg

SEQ ID NO: 2584 - DNA, 16 bp, Artificial Sequence
  synthetic [barcode part1]
tatacctgcgatctac

SEQ ID NO: 2585 - DNA, 16 bp, Artificial Sequence
  synthetic [barcode part1]
tgcacgacctgatcct

SEQ ID NO: 2586 - DNA, 16 bp, Artificial Sequence
  synthetic [barcode part1]
atagtacacgtcgcgt

SEQ ID NO: 2587 - DNA, 16 bp, Artificial Sequence
  synthetic [barcode part1]
gcgatcgttctggttc

SEQ ID NO: 2588 - DNA, 16 bp, Artificial Sequence
  synthetic [barcode part1]
acaactgaattcctcc

SEQ ID NO: 2589 - DNA, 16 bp, Artificial Sequence
  synthetic [barcode part1]
attccacgcggtcgtt

SEQ ID NO: 2590 - DNA, 16 bp, Artificial Sequence
  synthetic [barcode part1]
ataactattccggtcc

SEQ ID NO: 2591 - DNA, 16 bp, Artificial Sequence
  synthetic [barcode part1]
cagacgcactaggaac

SEQ ID NO: 2592 - DNA, 16 bp, Artificial Sequence
  synthetic [barcode part1]
gccaatacgaagaatc

SEQ ID NO: 2593 - DNA, 16 bp, Artificial Sequence
  synthetic [barcode part1]
ccggtgttaatcacag

SEQ ID NO: 2594 - DNA, 16 bp, Artificial Sequence
  synthetic [barcode part1]
ttcaacgagacgtaag

SEQ ID NO: 2595 - DNA, 16 bp, Artificial Sequence
  synthetic [barcode part1]
tcgcggataagttcac

SEQ ID NO: 2596 - DNA, 16 bp, Artificial Sequence
  synthetic [barcode part1]
atagtgtgtgtcgcgt

SEQ ID NO: 2597 - DNA, 16 bp, Artificial Sequence
  synthetic [barcode part1]
tatctgtaacactgcc

SEQ ID NO: 2598 - DNA, 16 bp, Artificial Sequence
  synthetic [barcode part1]
aggcagattgtaacac

SEQ ID NO: 2599 - DNA, 16 bp, Artificial Sequence
  synthetic [barcode part1]
agacaaggcctgtctt

SEQ ID NO: 2600 - DNA, 16 bp, Artificial Sequence
  synthetic [barcode part1]
cagatctcagagtaag

SEQ ID NO: 2601 - DNA, 16 bp, Artificial Sequence
  synthetic [barcode part1]
agtactggttgtggtc

SEQ ID NO: 2602 - DNA, 16 bp, Artificial Sequence
  synthetic [barcode part1]
accgtctaagtccacc

SEQ ID NO: 2603 - DNA, 16 bp, Artificial Sequence
  synthetic [barcode part1]
tgatcagatcggttgc

SEQ ID NO: 2604 - DNA, 16 bp, Artificial Sequence
  synthetic [barcode part1]
ccgttctatataaccg

SEQ ID NO: 2605 - DNA, 16 bp, Artificial Sequence
  synthetic [barcode part1]
gcgtctctcaacggtt

SEQ ID NO: 2606 - DNA, 16 bp, Artificial Sequence
  synthetic [barcode part1]
gatcgatctgaagtcc

SEQ ID NO: 2607 - DNA, 16 bp, Artificial Sequence
  synthetic [barcode part1]
ttgttcacctgtccac

SEQ ID NO: 2608 - DNA, 16 bp, Artificial Sequence
  synthetic [barcode part1]
cgaatctctcggatag

SEQ ID NO: 2609 - DNA, 16 bp, Artificial Sequence
  synthetic [barcode part1]
gttgtagaacgaacac

SEQ ID NO: 2610 - DNA, 16 bp, Artificial Sequence
  synthetic [barcode part1]
accgtatagagtaacg

SEQ ID NO: 2611 - DNA, 16 bp, Artificial Sequence
  synthetic [barcode part1]
tccgtacacacagaac

SEQ ID NO: 2612 - DNA, 16 bp, Artificial Sequence
  synthetic [barcode part1]
cctgaagttgatcggt

SEQ ID NO: 2613 - DNA, 16 bp, Artificial Sequence
  synthetic [barcode part1]
tcacaaggagtacctc

SEQ ID NO: 2614 - DNA, 16 bp, Artificial Sequence
  synthetic [barcode part1]
aggcacttgtcgcctt

SEQ ID NO: 2615 - DNA, 16 bp, Artificial Sequence
  synthetic [barcode part1]
tgcacttgacacgagt

SEQ ID NO: 2616 - DNA, 16 bp, Artificial Sequence
  synthetic [barcode part1]
taatcggttccaggac

SEQ ID NO: 2617 - DNA, 16 bp, Artificial Sequence
  synthetic [barcode part1]
aaccagtgtcacaacc

SEQ ID NO: 2618 - DNA, 16 bp, Artificial Sequence
  synthetic [barcode part1]
cagtgatctcttgtac

SEQ ID NO: 2619 - DNA, 16 bp, Artificial Sequence
  synthetic [barcode part1]
tgccaattcctccgag

SEQ ID NO: 2620 - DNA, 16 bp, Artificial Sequence
  synthetic [barcode part1]
tcgaccttattctgcc

SEQ ID NO: 2621 - DNA, 16 bp, Artificial Sequence
  synthetic [barcode part1]
ttatcgcacagacctt

SEQ ID NO: 2622 - DNA, 16 bp, Artificial Sequence
  synthetic [barcode part1]
agaactcaagtagacc

SEQ ID NO: 2623 - DNA, 16 bp, Artificial Sequence
  synthetic [barcode part1]
gagtgttgacaaggcc

SEQ ID NO: 2624 - DNA, 16 bp, Artificial Sequence
  synthetic [barcode part1]
tcaagtaaggcagtgt

SEQ ID NO: 2625 - DNA, 16 bp, Artificial Sequence
  synthetic [barcode part1]
ccaagtatcgtggatc

SEQ ID NO: 2626 - DNA, 16 bp, Artificial Sequence
  synthetic [barcode part1]
cggccaacaactaatc

SEQ ID NO: 2627 - DNA, 16 bp, Artificial Sequence
  synthetic [barcode part1]
accaacagtaaccgtc

SEQ ID NO: 2628 - DNA, 16 bp, Artificial Sequence
  synthetic [barcode part1]
actgcgacgcctatct

SEQ ID NO: 2629 - DNA, 16 bp, Artificial Sequence
  synthetic [barcode part1]
taagaccgcgtatacc

SEQ ID NO: 2630 - DNA, 16 bp, Artificial Sequence
  synthetic [barcode part1]
tgccgaacctgcactt

SEQ ID NO: 2631 - DNA, 16 bp, Artificial Sequence
  synthetic [barcode part1]
gcacggtgttagtatc

SEQ ID NO: 2632 - DNA, 16 bp, Artificial Sequence
  synthetic [barcode part1]
acgtccttagtctaac

SEQ ID NO: 2633 - DNA, 16 bp, Artificial Sequence
  synthetic [barcode part1]
atacctgttgtaggcg

SEQ ID NO: 2634 - DNA, 16 bp, Artificial Sequence
  synthetic [barcode part1]
tcagtgttgacacgtg

SEQ ID NO: 2635 - DNA, 16 bp, Artificial Sequence
  synthetic [barcode part1]
acctggaggtatctgt

SEQ ID NO: 2636 - DNA, 16 bp, Artificial Sequence
  synthetic [barcode part1]
agtggacaagtgagtg

SEQ ID NO: 2637 - DNA, 16 bp, Artificial Sequence
  synthetic [barcode part1]
tggtctaatctctacg

SEQ ID NO: 2638 - DNA, 16 bp, Artificial Sequence
  synthetic [barcode part1]
acaggttccaagtgtc

SEQ ID NO: 2639 - DNA, 16 bp, Artificial Sequence
  synthetic [barcode part1]
aggaagacagtgtcag

SEQ ID NO: 2640 - DNA, 16 bp, Artificial Sequence
  synthetic [barcode part1]
tcagaacgtccacctc

SEQ ID NO: 2641 - DNA, 16 bp, Artificial Sequence
  synthetic [barcode part1]
acctaactgatccgag

SEQ ID NO: 2642 - DNA, 16 bp, Artificial Sequence
  synthetic [barcode part1]
gacacacactgacgtt

SEQ ID NO: 2643 - DNA, 16 bp, Artificial Sequence
  synthetic [barcode part1]
tgtgatagtctgcctt

SEQ ID NO: 2644 - DNA, 16 bp, Artificial Sequence
  synthetic [barcode part1]
gcacgatcgattgtgt

SEQ ID NO: 2645 - DNA, 16 bp, Artificial Sequence
  synthetic [barcode part1]
cagagtgtatcctacg

SEQ ID NO: 2646 - DNA, 16 bp, Artificial Sequence
  synthetic [barcode part1]
ccaccttgagagttag

SEQ ID NO: 2647 - DNA, 16 bp, Artificial Sequence
  synthetic [barcode part1]
cggcggtagagatact

SEQ ID NO: 2648 - DNA, 16 bp, Artificial Sequence
  synthetic [barcode part1]
cgataacaatccggtc

SEQ ID NO: 2649 - DNA, 16 bp, Artificial Sequence
  synthetic [barcode part1]
ttggcctacttaagtc

SEQ ID NO: 2650 - DNA, 16 bp, Artificial Sequence
  synthetic [barcode part1]
gtgtgccaacgtattg

SEQ ID NO: 2651 - DNA, 16 bp, Artificial Sequence
  synthetic [barcode part1]
tgttggtgttgcacag

SEQ ID NO: 2652 - DNA, 16 bp, Artificial Sequence
  synthetic [barcode part1]
aagttagatcaacgcg

SEQ ID NO: 2653 - DNA, 16 bp, Artificial Sequence
  synthetic [barcode part1]
taggtcaagtcgttgc

SEQ ID NO: 2654 - DNA, 16 bp, Artificial Sequence
  synthetic [barcode part1]
cgcagaaggttattag

SEQ ID NO: 2655 - DNA, 16 bp, Artificial Sequence
  synthetic [barcode part1]
tgtccgccaggatctt

SEQ ID NO: 2656 - DNA, 16 bp, Artificial Sequence
  synthetic [barcode part1]
tgtccacaatattgcc

SEQ ID NO: 2657 - DNA, 16 bp, Artificial Sequence
  synthetic [barcode part1]
tgccgcagattgattg

SEQ ID NO: 2658 - DNA, 16 bp, Artificial Sequence
  synthetic [barcode part1]
aagagtgtccggcagt

SEQ ID NO: 2659 - DNA, 16 bp, Artificial Sequence
  synthetic [barcode part1]
actattctaggacggc

SEQ ID NO: 2660 - DNA, 16 bp, Artificial Sequence
  synthetic [barcode part1]
tctaatccgcaaccgc

SEQ ID NO: 2661 - DNA, 16 bp, Artificial Sequence
  synthetic [barcode part1]
cgacctcgtcaacact

SEQ ID NO: 2662 - DNA, 16 bp, Artificial Sequence
  synthetic [barcode part1]
tcaacgtcaaccacag

SEQ ID NO: 2663 - DNA, 16 bp, Artificial Sequence
  synthetic [barcode part1]
ttcggtctgtatagtc

SEQ ID NO: 2664 - DNA, 16 bp, Artificial Sequence
  synthetic [barcode part1]
cgaataactgcgatag

SEQ ID NO: 2665 - DNA, 16 bp, Artificial Sequence
  synthetic [barcode part1]
tctagttaccgtgtac

SEQ ID NO: 2666 - DNA, 16 bp, Artificial Sequence
  synthetic [barcode part1]
ttgaacctcttgcgcg

SEQ ID NO: 2667 - DNA, 16 bp, Artificial Sequence
  synthetic [barcode part1]
tgtggtattacttgcc

SEQ ID NO: 2668 - DNA, 16 bp, Artificial Sequence
  synthetic [barcode part1]
agttagtgccacggtt

SEQ ID NO: 2669 - DNA, 16 bp, Artificial Sequence
  synthetic [barcode part1]
cctccagacgccaatt

SEQ ID NO: 2670 - DNA, 16 bp, Artificial Sequence
  synthetic [barcode part1]
agtgataccgcgagtg

SEQ ID NO: 2671 - DNA, 16 bp, Artificial Sequence
  synthetic [barcode part1]
gttctgtacggttgtt

SEQ ID NO: 2672 - DNA, 16 bp, Artificial Sequence
  synthetic [barcode part1]
tggaccaggttcaact

SEQ ID NO: 2673 - DNA, 16 bp, Artificial Sequence
  synthetic [barcode part1]
tcgcctaaggccttac

SEQ ID NO: 2674 - DNA, 16 bp, Artificial Sequence
  synthetic [barcode part1]
cacgtctataggagtc

SEQ ID NO: 2675 - DNA, 16 bp, Artificial Sequence
  synthetic [barcode part1]
acgtacggtcacaact

SEQ ID NO: 2676 - DNA, 16 bp, Artificial Sequence
  synthetic [barcode part1]
gtgtcggagttatacc

SEQ ID NO: 2677 - DNA, 16 bp, Artificial Sequence
  synthetic [barcode part1]
taggcgtagagaccgt

SEQ ID NO: 2678 - DNA, 16 bp, Artificial Sequence
  synthetic [barcode part1]
gtcctaccttgacttc

SEQ ID NO: 2679 - DNA, 16 bp, Artificial Sequence
  synthetic [barcode part1]
gcacgacaactgagac

SEQ ID NO: 2680 - DNA, 16 bp, Artificial Sequence
  synthetic [barcode part1]
cctgttacgacaaggt

SEQ ID NO: 2681 - DNA, 16 bp, Artificial Sequence
  synthetic [barcode part1]
agtgtaagttcggtag

SEQ ID NO: 2682 - DNA, 16 bp, Artificial Sequence
  synthetic [barcode part1]
cgacgcactctatcac

SEQ ID NO: 2683 - DNA, 16 bp, Artificial Sequence
  synthetic [barcode part1]
agtccagaactcgact

SEQ ID NO: 2684 - DNA, 16 bp, Artificial Sequence
  synthetic [barcode part1]
atctagacgaggcggt

SEQ ID NO: 2685 - DNA, 16 bp, Artificial Sequence
  synthetic [barcode part1]
aggtctaacaggacgc

SEQ ID NO: 2686 - DNA, 16 bp, Artificial Sequence
  synthetic [barcode part1]
tggatctcctgagtag

SEQ ID NO: 2687 - DNA, 16 bp, Artificial Sequence
  synthetic [barcode part1]
tctgacttacggttgt

SEQ ID NO: 2688 - DNA, 16 bp, Artificial Sequence
  synthetic [barcode part1]
ttacgccgttcggtac

SEQ ID NO: 2689 - DNA, 16 bp, Artificial Sequence
  synthetic [barcode part1]
agacactagtatccgc

SEQ ID NO: 2690 - DNA, 16 bp, Artificial Sequence
  synthetic [barcode part1]
ataggaatagttcggc

SEQ ID NO: 2691 - DNA, 16 bp, Artificial Sequence
  synthetic [barcode part1]
agtcggaacaattgtg

SEQ ID NO: 2692 - DNA, 16 bp, Artificial Sequence
  synthetic [barcode part1]
aacgatctcgaaccac

SEQ ID NO: 2693 - DNA, 16 bp, Artificial Sequence
  synthetic [barcode part1]
aatcgtgattggtgcc

SEQ ID NO: 2694 - DNA, 16 bp, Artificial Sequence
  synthetic [barcode part1]
gaccagtaaccgatct

SEQ ID NO: 2695 - DNA, 16 bp, Artificial Sequence
  synthetic [barcode part1]
taaccggtacggtact

SEQ ID NO: 2696 - DNA, 16 bp, Artificial Sequence
  synthetic [barcode part1]
aagaagtctacgcggc

SEQ ID NO: 2697 - DNA, 16 bp, Artificial Sequence
  synthetic [barcode part1]
caaccgcgtaattgtg

SEQ ID NO: 2698 - DNA, 16 bp, Artificial Sequence
  synthetic [barcode part1]
gtaatcgacacactgc

SEQ ID NO: 2699 - DNA, 16 bp, Artificial Sequence
  synthetic [barcode part1]
gcaagacgtagactcg

SEQ ID NO: 2700 - DNA, 16 bp, Artificial Sequence
  synthetic [barcode part1]
gttagtgacttaggcc

SEQ ID NO: 2701 - DNA, 16 bp, Artificial Sequence
  synthetic [barcode part1]
gacagtcctgacagtt

SEQ ID NO: 2702 - DNA, 16 bp, Artificial Sequence
  synthetic [barcode part1]
gtgactagagattgac

SEQ ID NO: 2703 - DNA, 16 bp, Artificial Sequence
  synthetic [barcode part1]
agactgttcgtatctc

SEQ ID NO: 2704 - DNA, 16 bp, Artificial Sequence
  synthetic [barcode part1]
tatcggaggactgttc

SEQ ID NO: 2705 - DNA, 16 bp, Artificial Sequence
  synthetic [barcode part1]
cgttggaccacacctt

SEQ ID NO: 2706 - DNA, 16 bp, Artificial Sequence
  synthetic [barcode part1]
tccgtacggagtatac

SEQ ID NO: 2707 - DNA, 16 bp, Artificial Sequence
  synthetic [barcode part1]
agaacaattcgtcgcc

SEQ ID NO: 2708 - DNA, 16 bp, Artificial Sequence
  synthetic [barcode part1]
atcagtgttgtgcgac

SEQ ID NO: 2709 - DNA, 16 bp, Artificial Sequence
  synthetic [barcode part1]
tgttgcactgagatcg

SEQ ID NO: 2710 - DNA, 16 bp, Artificial Sequence
  synthetic [barcode part1]
gtatcttatcggatcc

SEQ ID NO: 2711 - DNA, 16 bp, Artificial Sequence
  synthetic [barcode part1]
actagatcaggccact

SEQ ID NO: 2712 - DNA, 16 bp, Artificial Sequence
  synthetic [barcode part1]
cactctaacgaatcct

SEQ ID NO: 2713 - DNA, 16 bp, Artificial Sequence
  synthetic [barcode part1]
cgtattgccagtcctg

SEQ ID NO: 2714 - DNA, 16 bp, Artificial Sequence
  synthetic [barcode part1]
gatagtatccaccgtg

SEQ ID NO: 2715 - DNA, 16 bp, Artificial Sequence
  synthetic [barcode part1]
ccagagaactaaggag

SEQ ID NO: 2716 - DNA, 16 bp, Artificial Sequence
  synthetic [barcode part1]
tcacgtcggatacaac

SEQ ID NO: 2717 - DNA, 16 bp, Artificial Sequence
  synthetic [barcode part1]
gagaagacgtagtgtg

SEQ ID NO: 2718 - DNA, 16 bp, Artificial Sequence
  synthetic [barcode part1]
tagatatctcctggtc

SEQ ID NO: 2719 - DNA, 16 bp, Artificial Sequence
  synthetic [barcode part1]
tggttaccagactcag

SEQ ID NO: 2720 - DNA, 16 bp, Artificial Sequence
  synthetic [barcode part1]
caatcttacgtcagtc

SEQ ID NO: 2721 - DNA, 16 bp, Artificial Sequence
  synthetic [barcode part1]
tgtgacaagactctgc

SEQ ID NO: 2722 - DNA, 16 bp, Artificial Sequence
  synthetic [barcode part1]
gaagtggaacactcgc

SEQ ID NO: 2723 - DNA, 16 bp, Artificial Sequence
  synthetic [barcode part1]
tctaatcgtcgatacc

SEQ ID NO: 2724 - DNA, 16 bp, Artificial Sequence
  synthetic [barcode part1]
tactccgttgtgaatc

SEQ ID NO: 2725 - DNA, 16 bp, Artificial Sequence
  synthetic [barcode part1]
ttgcgagactcaggtt

SEQ ID NO: 2726 - DNA, 16 bp, Artificial Sequence
  synthetic [barcode part1]
ccagtcttgtcaacgc

SEQ ID NO: 2727 - DNA, 16 bp, Artificial Sequence
  synthetic [barcode part1]
atccacctgccgtaac

SEQ ID NO: 2728 - DNA, 16 bp, Artificial Sequence
  synthetic [barcode part1]
tcgcgccttatatctc

SEQ ID NO: 2729 - DNA, 16 bp, Artificial Sequence
  synthetic [barcode part1]
agtaaccttggactgc

SEQ ID NO: 2730 - DNA, 16 bp, Artificial Sequence
  synthetic [barcode part1]
ataacgcggtcttgac

SEQ ID NO: 2731 - DNA, 16 bp, Artificial Sequence
  synthetic [barcode part1]
cgtaaggcgacttgag

SEQ ID NO: 2732 - DNA, 16 bp, Artificial Sequence
  synthetic [barcode part1]
tcgtcgcgtaggttct

SEQ ID NO: 2733 - DNA, 16 bp, Artificial Sequence
  synthetic [barcode part1]
tgtccacacgagtaac

SEQ ID NO: 2734 - DNA, 16 bp, Artificial Sequence
  synthetic [barcode part1]
cgcagtaaccttgagt

SEQ ID NO: 2735 - DNA, 16 bp, Artificial Sequence
  synthetic [barcode part1]
gaactctgaccttgag

SEQ ID NO: 2736 - DNA, 16 bp, Artificial Sequence
  synthetic [barcode part1]
aatatctccgtcactg

SEQ ID NO: 2737 - DNA, 16 bp, Artificial Sequence
  synthetic [barcode part1]
cgttattcgccggtac

SEQ ID NO: 2738 - DNA, 16 bp, Artificial Sequence
  synthetic [barcode part1]
gcaggtctcaagtatc

SEQ ID NO: 2739 - DNA, 16 bp, Artificial Sequence
  synthetic [barcode part1]
cgtagtatcgtctatc

SEQ ID NO: 2740 - DNA, 16 bp, Artificial Sequence
  synthetic [barcode part1]
aagacgcgtattctcg

SEQ ID NO: 2741 - DNA, 16 bp, Artificial Sequence
  synthetic [barcode part1]
tgtacactgtggtacg

SEQ ID NO: 2742 - DNA, 16 bp, Artificial Sequence
  synthetic [barcode part1]
ccgcctaagtactatt

SEQ ID NO: 2743 - DNA, 16 bp, Artificial Sequence
  synthetic [barcode part1]
ccttcgtcgagttacg

SEQ ID NO: 2744 - DNA, 16 bp, Artificial Sequence
  synthetic [barcode part1]
acgcgaataggtcacg

SEQ ID NO: 2745 - DNA, 16 bp, Artificial Sequence
  synthetic [barcode part1]
gtaacacgtcaatcgc

SEQ ID NO: 2746 - DNA, 16 bp, Artificial Sequence
  synthetic [barcode part1]
actacgtacgtaaccg

SEQ ID NO: 2747 - DNA, 16 bp, Artificial Sequence
  synthetic [barcode part1]
acgagagtgataatcc

SEQ ID NO: 2748 - DNA, 16 bp, Artificial Sequence
  synthetic [barcode part1]
agtaccttcacgtgag

SEQ ID NO: 2749 - DNA, 16 bp, Artificial Sequence
  synthetic [barcode part1]
tctagttgtcggtgcc

SEQ ID NO: 2750 - DNA, 16 bp, Artificial Sequence
  synthetic [barcode part1]
gtcgccttaggtgtct

SEQ ID NO: 2751 - DNA, 16 bp, Artificial Sequence
  synthetic [barcode part1]
tatcaggttcggtgac

SEQ ID NO: 2752 - DNA, 16 bp, Artificial Sequence
  synthetic [barcode part1]
tgtcgaacgtcttcgc

SEQ ID NO: 2753 - DNA, 16 bp, Artificial Sequence
  synthetic [barcode part1]
gcgtcggaaggtagtt

SEQ ID NO: 2754 - DNA, 16 bp, Artificial Sequence
  synthetic [barcode part1]
tctcaacacacggcct

SEQ ID NO: 2755 - DNA, 16 bp, Artificial Sequence
  synthetic [barcode part1]
cagtaacgaaggtatc

SEQ ID NO: 2756 - DNA, 16 bp, Artificial Sequence
  synthetic [barcode part1]
aacgccgtataacgtc

SEQ ID NO: 2757 - DNA, 16 bp, Artificial Sequence
  synthetic [barcode part1]
gtatcgatcttaccac

SEQ ID NO: 2758 - DNA, 16 bp, Artificial Sequence
  synthetic [barcode part1]
cggtcgtcctaattcg

SEQ ID NO: 2759 - DNA, 16 bp, Artificial Sequence
  synthetic [barcode part1]
acgtataggaggaggt

SEQ ID NO: 2760 - DNA, 16 bp, Artificial Sequence
  synthetic [barcode part1]
tgaactggacttgacc

SEQ ID NO: 2761 - DNA, 16 bp, Artificial Sequence
  synthetic [barcode part1]
ccgttctcacaagtcg

SEQ ID NO: 2762 - DNA, 16 bp, Artificial Sequence
  synthetic [barcode part1]
gcgcgacaatctcctt

SEQ ID NO: 2763 - DNA, 16 bp, Artificial Sequence
  synthetic [barcode part1]
ttaagtggcctgtggt

SEQ ID NO: 2764 - DNA, 16 bp, Artificial Sequence
  synthetic [barcode part1]
actctcgccactgaac

SEQ ID NO: 2765 - DNA, 16 bp, Artificial Sequence
  synthetic [barcode part1]
tattaggccgtgttct

SEQ ID NO: 2766 - DNA, 16 bp, Artificial Sequence
  synthetic [barcode part1]
actggaggttgacgtg

SEQ ID NO: 2767 - DNA, 16 bp, Artificial Sequence
  synthetic [barcode part1]
gtcaggtatctgacgt

SEQ ID NO: 2768 - DNA, 16 bp, Artificial Sequence
  synthetic [barcode part1]
cgttgtccttgcagac

SEQ ID NO: 2769 - DNA, 16 bp, Artificial Sequence
  synthetic [barcode part1]
accagttccttaggag

SEQ ID NO: 2770 - DNA, 16 bp, Artificial Sequence
  synthetic [barcode part1]
gaggttcacctgtcct

SEQ ID NO: 2771 - DNA, 16 bp, Artificial Sequence
  synthetic [barcode part1]
caccgtcgcaattatt

SEQ ID NO: 2772 - DNA, 16 bp, Artificial Sequence
  synthetic [barcode part1]
cacaactaatcacgcg

SEQ ID NO: 2773 - DNA, 16 bp, Artificial Sequence
  synthetic [barcode part1]
atacgacgttacgcac

SEQ ID NO: 2774 - DNA, 16 bp, Artificial Sequence
  synthetic [barcode part1]
gcggttgagaaccaac

SEQ ID NO: 2775 - DNA, 16 bp, Artificial Sequence
  synthetic [barcode part1]
cgacgtatcagacact

SEQ ID NO: 2776 - DNA, 16 bp, Artificial Sequence
  synthetic [barcode part1]
actcctaagattgcct

SEQ ID NO: 2777 - DNA, 16 bp, Artificial Sequence
  synthetic [barcode part1]
tataactcttccgacg

SEQ ID NO: 2778 - DNA, 16 bp, Artificial Sequence
  synthetic [barcode part1]
aggcgttaggcaacgt

SEQ ID NO: 2779 - DNA, 16 bp, Artificial Sequence
  synthetic [barcode part1]
gtaagtcgacttgtgc

SEQ ID NO: 2780 - DNA, 16 bp, Artificial Sequence
  synthetic [barcode part1]
tcaccgttccgagtac

SEQ ID NO: 2781 - DNA, 16 bp, Artificial Sequence
  synthetic [barcode part1]
tcacctgtgttgtggc

SEQ ID NO: 2782 - DNA, 16 bp, Artificial Sequence
  synthetic [barcode part1]
taatcctgagaccgac

SEQ ID NO: 2783 - DNA, 16 bp, Artificial Sequence
  synthetic [barcode part1]
agtcagtccaatcgac

SEQ ID NO: 2784 - DNA, 16 bp, Artificial Sequence
  synthetic [barcode part1]
aggtccggaactgaac

SEQ ID NO: 2785 - DNA, 16 bp, Artificial Sequence
  synthetic [barcode part1]
acgtcgataatcctct

SEQ ID NO: 2786 - DNA, 16 bp, Artificial Sequence
  synthetic [barcode part1]
ttgatcgccaagatcg

SEQ ID NO: 2787 - DNA, 16 bp, Artificial Sequence
  synthetic [barcode part1]
gaacttcttccaggag

SEQ ID NO: 2788 - DNA, 16 bp, Artificial Sequence
  synthetic [barcode part1]
tatcctacgagtatcc

SEQ ID NO: 2789 - DNA, 16 bp, Artificial Sequence
  synthetic [barcode part1]
cgtcacttctgtggac

SEQ ID NO: 2790 - DNA, 16 bp, Artificial Sequence
  synthetic [barcode part1]
tacagtcacacctgag

SEQ ID NO: 2791 - DNA, 16 bp, Artificial Sequence
  synthetic [barcode part1]
caactggcggttgatt

SEQ ID NO: 2792 - DNA, 16 bp, Artificial Sequence
  synthetic [barcode part1]
agacggtcttctagtg

SEQ ID NO: 2793 - DNA, 16 bp, Artificial Sequence
  synthetic [barcode part1]
aggtattatccgcggt

SEQ ID NO: 2794 - DNA, 16 bp, Artificial Sequence
  synthetic [barcode part1]
atctgacggttgtcag

SEQ ID NO: 2795 - DNA, 16 bp, Artificial Sequence
  synthetic [barcode part1]
gtgattaccggttctt

SEQ ID NO: 2796 - DNA, 16 bp, Artificial Sequence
  synthetic [barcode part1]
tcgcgactagtactag

SEQ ID NO: 2797 - DNA, 16 bp, Artificial Sequence
  synthetic [barcode part1]
atctcgaggccttaag

SEQ ID NO: 2798 - DNA, 16 bp, Artificial Sequence
  synthetic [barcode part1]
atacagtggttggagt

SEQ ID NO: 2799 - DNA, 16 bp, Artificial Sequence
  synthetic [barcode part1]
gcaaccagtgttgact

SEQ ID NO: 2800 - DNA, 16 bp, Artificial Sequence
  synthetic [barcode part1]
accggcggaactaagt

SEQ ID NO: 2801 - DNA, 16 bp, Artificial Sequence
  synthetic [barcode part1]
tacagtgttgttcacc

SEQ ID NO: 2802 - DNA, 16 bp, Artificial Sequence
  synthetic [barcode part1]
gcctcgatataacgtg

SEQ ID NO: 2803 - DNA, 16 bp, Artificial Sequence
  synthetic [barcode part1]
tcgccttgattgcgtg

SEQ ID NO: 2804 - DNA, 16 bp, Artificial Sequence
  synthetic [barcode part1]
cacaactagagatcag

SEQ ID NO: 2805 - DNA, 16 bp, Artificial Sequence
  synthetic [barcode part1]
caggaagtcaaggaac

SEQ ID NO: 2806 - DNA, 16 bp, Artificial Sequence
  synthetic [barcode part1]
aaggttcaggccttac

SEQ ID NO: 2807 - DNA, 16 bp, Artificial Sequence
  synthetic [barcode part1]
acgtacactggtcaac

SEQ ID NO: 2808 - DNA, 16 bp, Artificial Sequence
  synthetic [barcode part1]
gcgtcgaatcgttctc

SEQ ID NO: 2809 - DNA, 16 bp, Artificial Sequence
  synthetic [barcode part1]
cctatacgtgccttct

SEQ ID NO: 2810 - DNA, 16 bp, Artificial Sequence
  synthetic [barcode part1]
ttaaggccaggcagac

SEQ ID NO: 2811 - DNA, 16 bp, Artificial Sequence
  synthetic [barcode part1]
aagaagttcacgcaac

SEQ ID NO: 2812 - DNA, 16 bp, Artificial Sequence
  synthetic [barcode part1]
actctaccgagaggtt

SEQ ID NO: 2813 - DNA, 16 bp, Artificial Sequence
  synthetic [barcode part1]
ccaactcaagttggac

SEQ ID NO: 2814 - DNA, 16 bp, Artificial Sequence
  synthetic [barcode part1]
agaacgaggattcact

SEQ ID NO: 2815 - DNA, 16 bp, Artificial Sequence
  synthetic [barcode part1]
actgtgacgtctattc

SEQ ID NO: 2816 - DNA, 16 bp, Artificial Sequence
  synthetic [barcode part1]
tgtcctctggtaattg

SEQ ID NO: 2817 - DNA, 16 bp, Artificial Sequence
  synthetic [barcode part1]
gacgttatcctaaggc

SEQ ID NO: 2818 - DNA, 16 bp, Artificial Sequence
  synthetic [barcode part1]
aacgtgttggttgtgc

SEQ ID NO: 2819 - DNA, 16 bp, Artificial Sequence
  synthetic [barcode part1]
acgtgatattggcgtc

SEQ ID NO: 2820 - DNA, 16 bp, Artificial Sequence
  synthetic [barcode part1]
tcgtcgtagtagaacc

SEQ ID NO: 2821 - DNA, 16 bp, Artificial Sequence
  synthetic [barcode part1]
atcacctgacggaact

SEQ ID NO: 2822 - DNA, 16 bp, Artificial Sequence
  synthetic [barcode part1]
tcctaccgtcttatcg

SEQ ID NO: 2823 - DNA, 16 bp, Artificial Sequence
  synthetic [barcode part1]
gacgcgtctctgattc

SEQ ID NO: 2824 - DNA, 16 bp, Artificial Sequence
  synthetic [barcode part1]
agtgtacgaggaattc

SEQ ID NO: 2825 - DNA, 16 bp, Artificial Sequence
  synthetic [barcode part1]
caccaccgtgattatt

SEQ ID NO: 2826 - DNA, 16 bp, Artificial Sequence
  synthetic [barcode part1]
gacaaggtcaagtatc

SEQ ID NO: 2827 - DNA, 16 bp, Artificial Sequence
  synthetic [barcode part1]
tgtacaaggtgcacct

SEQ ID NO: 2828 - DNA, 16 bp, Artificial Sequence
  synthetic [barcode part1]
caactactctggtccg

SEQ ID NO: 2829 - DNA, 16 bp, Artificial Sequence
  synthetic [barcode part1]
gttgatcactggtcag

SEQ ID NO: 2830 - DNA, 16 bp, Artificial Sequence
  synthetic [barcode part1]
tactgcacacagtgtg

SEQ ID NO: 2831 - DNA, 16 bp, Artificial Sequence
  synthetic [barcode part1]
ttccgacttagtacac

SEQ ID NO: 2832 - DNA, 16 bp, Artificial Sequence
  synthetic [barcode part1]
ttgtacgatcggtacg

SEQ ID NO: 2833 - DNA, 16 bp, Artificial Sequence
  synthetic [barcode part1]
agtatcgcagtatcgc

SEQ ID NO: 2834 - DNA, 16 bp, Artificial Sequence
  synthetic [barcode part1]
tgtattaggcctcttg

SEQ ID NO: 2835 - DNA, 16 bp, Artificial Sequence
  synthetic [barcode part1]
tcaacgacgtccttgc

SEQ ID NO: 2836 - DNA, 16 bp, Artificial Sequence
  synthetic [barcode part1]
tctgtagttcactgtg

SEQ ID NO: 2837 - DNA, 16 bp, Artificial Sequence
  synthetic [barcode part1]
ttcacagaggtctacg

SEQ ID NO: 2838 - DNA, 16 bp, Artificial Sequence
  synthetic [barcode part1]
acacacacacacacac

SEQ ID NO: 2839 - DNA, 16 bp, Artificial Sequence
  synthetic [barcode part1]
acagtgtgtgttgtgc

SEQ ID NO: 2840 - DNA, 16 bp, Artificial Sequence
  synthetic [barcode part1]
ttagttcgtctagacc

SEQ ID NO: 2841 - DNA, 16 bp, Artificial Sequence
  synthetic [barcode part1]
gaccgcaccttctaac

SEQ ID NO: 2842 - DNA, 16 bp, Artificial Sequence
  synthetic [barcode part1]
acgccgtaataggcag

SEQ ID NO: 2843 - DNA, 16 bp, Artificial Sequence
  synthetic [barcode part1]
ccttaagttcgtctag

SEQ ID NO: 2844 - DNA, 16 bp, Artificial Sequence
  synthetic [barcode part1]
gaagttcagataggtc

SEQ ID NO: 2845 - DNA, 16 bp, Artificial Sequence
  synthetic [barcode part1]
cagtgcactagtacgt

SEQ ID NO: 2846 - DNA, 16 bp, Artificial Sequence
  synthetic [barcode part1]
cggattagaggcacac

SEQ ID NO: 2847 - DNA, 16 bp, Artificial Sequence
  synthetic [barcode part1]
agtccgccactattcg

SEQ ID NO: 2848 - DNA, 16 bp, Artificial Sequence
  synthetic [barcode part1]
tctaggactggttgac

SEQ ID NO: 2849 - DNA, 16 bp, Artificial Sequence
  synthetic [barcode part1]
cctcttgacaaggtag

SEQ ID NO: 2850 - DNA, 16 bp, Artificial Sequence
  synthetic [barcode part1]
cggaattcaacaccac

SEQ ID NO: 2851 - DNA, 16 bp, Artificial Sequence
  synthetic [barcode part1]
cctgatctaatacgtc

SEQ ID NO: 2852 - DNA, 16 bp, Artificial Sequence
  synthetic [barcode part1]
tggttgtaacgcactg

SEQ ID NO: 2853 - DNA, 16 bp, Artificial Sequence
  synthetic [barcode part1]
tccgtgtaccaccaac

SEQ ID NO: 2854 - DNA, 16 bp, Artificial Sequence
  synthetic [barcode part1]
gttaccacgtatcttg

SEQ ID NO: 2855 - DNA, 16 bp, Artificial Sequence
  synthetic [barcode part1]
gtaggtctcctcgact

SEQ ID NO: 2856 - DNA, 16 bp, Artificial Sequence
  synthetic [barcode part1]
cagatcttgagtgtcg

SEQ ID NO: 2857 - DNA, 16 bp, Artificial Sequence
  synthetic [barcode part1]
gaatcacgtctctatc

SEQ ID NO: 2858 - DNA, 16 bp, Artificial Sequence
  synthetic [barcode part1]
attctgttaccaacgc

SEQ ID NO: 2859 - DNA, 16 bp, Artificial Sequence
  synthetic [barcode part1]
caacgtgactactctt

SEQ ID NO: 2860 - DNA, 16 bp, Artificial Sequence
  synthetic [barcode part1]
tgaggactgtcttcag

SEQ ID NO: 2861 - DNA, 16 bp, Artificial Sequence
  synthetic [barcode part1]
attgttctcgtgaacc

SEQ ID NO: 2862 - DNA, 16 bp, Artificial Sequence
  synthetic [barcode part1]
tctggccaagaagtct

SEQ ID NO: 2863 - DNA, 16 bp, Artificial Sequence
  synthetic [barcode part1]
agatcaccactagacc

SEQ ID NO: 2864 - DNA, 16 bp, Artificial Sequence
  synthetic [barcode part1]
taccagtgaggaattg

SEQ ID NO: 2865 - DNA, 16 bp, Artificial Sequence
  synthetic [barcode part1]
ttactgtcactgcctc

SEQ ID NO: 2866 - DNA, 16 bp, Artificial Sequence
  synthetic [barcode part1]
gattgaaccgcgtgag

SEQ ID NO: 2867 - DNA, 16 bp, Artificial Sequence
  synthetic [barcode part1]
acgttgactggtgtac

SEQ ID NO: 2868 - DNA, 16 bp, Artificial Sequence
  synthetic [barcode part1]
atcgagtctatactcc

SEQ ID NO: 2869 - DNA, 16 bp, Artificial Sequence
  synthetic [barcode part1]
gaataccgatactcgc

SEQ ID NO: 2870 - DNA, 16 bp, Artificial Sequence
  synthetic [barcode part1]
tgactcaggactactg

SEQ ID NO: 2871 - DNA, 16 bp, Artificial Sequence
  synthetic [barcode part1]
tcgactcggcaataac

SEQ ID NO: 2872 - DNA, 16 bp, Artificial Sequence
  synthetic [barcode part1]
ttaatcacgactggcg

SEQ ID NO: 2873 - DNA, 16 bp, Artificial Sequence
  synthetic [barcode part1]
atcagaagtgtcggcg

SEQ ID NO: 2874 - DNA, 16 bp, Artificial Sequence
  synthetic [barcode part1]
gcgtgtggtgtatatc

SEQ ID NO: 2875 - DNA, 16 bp, Artificial Sequence
  synthetic [barcode part1]
gacggtcaatctgatc

SEQ ID NO: 2876 - DNA, 16 bp, Artificial Sequence
  synthetic [barcode part1]
gtcgttcctacggatc

SEQ ID NO: 2877 - DNA, 16 bp, Artificial Sequence
  synthetic [barcode part1]
agagaacgagtacctt

SEQ ID NO: 2878 - DNA, 16 bp, Artificial Sequence
  synthetic [barcode part1]
gcaacgataggaagtg

SEQ ID NO: 2879 - DNA, 16 bp, Artificial Sequence
  synthetic [barcode part1]
acctgtacttcactag

SEQ ID NO: 2880 - DNA, 16 bp, Artificial Sequence
  synthetic [barcode part1]
tcgcgcagaaggattg

SEQ ID NO: 2881 - DNA, 16 bp, Artificial Sequence
  synthetic [barcode part1]
cgtgacgttatccgtc

SEQ ID NO: 2882 - DNA, 16 bp, Artificial Sequence
  synthetic [barcode part1]
tggtgtaagagtgatc

SEQ ID NO: 2883 - DNA, 16 bp, Artificial Sequence
  synthetic [barcode part1]
ttccgcgagtccaact

SEQ ID NO: 2884 - DNA, 16 bp, Artificial Sequence
  synthetic [barcode part1]
cgcagaataataaccg

SEQ ID NO: 2885 - DNA, 16 bp, Artificial Sequence
  synthetic [barcode part1]
ccagtcttcacgtgac

SEQ ID NO: 2886 - DNA, 16 bp, Artificial Sequence
  synthetic [barcode part1]
gagaatactcgtgtcc

SEQ ID NO: 2887 - DNA, 16 bp, Artificial Sequence
  synthetic [barcode part1]
aagactccggacgaac

SEQ ID NO: 2888 - DNA, 16 bp, Artificial Sequence
  synthetic [barcode part1]
tcactgaatcgtcgag

SEQ ID NO: 2889 - DNA, 16 bp, Artificial Sequence
  synthetic [barcode part1]
tgaggaggtaccgatc

SEQ ID NO: 2890 - DNA, 16 bp, Artificial Sequence
  synthetic [barcode part1]
gttccaacctctcttg

SEQ ID NO: 2891 - DNA, 16 bp, Artificial Sequence
  synthetic [barcode part1]
actaacggccttctgc

SEQ ID NO: 2892 - DNA, 16 bp, Artificial Sequence
  synthetic [barcode part1]
acgacgttcagtcagt

SEQ ID NO: 2893 - DNA, 16 bp, Artificial Sequence
  synthetic [barcode part1]
tccttggacgtactgc

SEQ ID NO: 2894 - DNA, 16 bp, Artificial Sequence
  synthetic [barcode part1]
gtgtcgataatctcct

SEQ ID NO: 2895 - DNA, 16 bp, Artificial Sequence
  synthetic [barcode part1]
ccagttctcacacgac

SEQ ID NO: 2896 - DNA, 16 bp, Artificial Sequence
  synthetic [barcode part1]
gattgtgtcagtcttc

SEQ ID NO: 2897 - DNA, 16 bp, Artificial Sequence
  synthetic [barcode part1]
actagtcttggccaag

SEQ ID NO: 2898 - DNA, 16 bp, Artificial Sequence
  synthetic [barcode part1]
tggaactcgcagtatc

SEQ ID NO: 2899 - DNA, 16 bp, Artificial Sequence
  synthetic [barcode part1]
ttctacggtcagactt

SEQ ID NO: 2900 - DNA, 16 bp, Artificial Sequence
  synthetic [barcode part1]
gcgaaccttctcgatc

SEQ ID NO: 2901 - DNA, 16 bp, Artificial Sequence
  synthetic [barcode part1]
gagagtgtatctctgc

SEQ ID NO: 2902 - DNA, 16 bp, Artificial Sequence
  synthetic [barcode part1]
ttgtcttgactcacag

SEQ ID NO: 2903 - DNA, 16 bp, Artificial Sequence
  synthetic [barcode part1]
tacgcagtgtcttgtt

SEQ ID NO: 2904 - DNA, 16 bp, Artificial Sequence
  synthetic [barcode part1]
tgttgagatctggtgc

SEQ ID NO: 2905 - DNA, 16 bp, Artificial Sequence
  synthetic [barcode part1]
cgactcttaaccgtgc

SEQ ID NO: 2906 - DNA, 16 bp, Artificial Sequence
  synthetic [barcode part1]
acgttgacttcaccgc

SEQ ID NO: 2907 - DNA, 16 bp, Artificial Sequence
  synthetic [barcode part1]
aacaggcgtctcgaag

SEQ ID NO: 2908 - DNA, 16 bp, Artificial Sequence
  synthetic [barcode part1]
caagtacaagaactgc

SEQ ID NO: 2909 - DNA, 16 bp, Artificial Sequence
  synthetic [barcode part1]
atacttcgcgttcctc

SEQ ID NO: 2910 - DNA, 16 bp, Artificial Sequence
  synthetic [barcode part1]
atcagaagactcctcg

SEQ ID NO: 2911 - DNA, 16 bp, Artificial Sequence
  synthetic [barcode part1]
ttcctcgaacgcgttg

SEQ ID NO: 2912 - DNA, 16 bp, Artificial Sequence
  synthetic [barcode part1]
tagaccgtagtgacct

SEQ ID NO: 2913 - DNA, 16 bp, Artificial Sequence
  synthetic [barcode part1]
tcttctcactacgacc

SEQ ID NO: 2914 - DNA, 16 bp, Artificial Sequence
  synthetic [barcode part1]
gtctattcgttgcaac

SEQ ID NO: 2915 - DNA, 16 bp, Artificial Sequence
  synthetic [barcode part1]
gtacttggaatccacg

SEQ ID NO: 2916 - DNA, 16 bp, Artificial Sequence
  synthetic [barcode part1]
tggcacactaggtgtt

SEQ ID NO: 2917 - DNA, 16 bp, Artificial Sequence
  synthetic [barcode part1]
cgccttgttatcctgt

SEQ ID NO: 2918 - DNA, 16 bp, Artificial Sequence
  synthetic [barcode part1]
ttaggcgttgtggact

SEQ ID NO: 2919 - DNA, 16 bp, Artificial Sequence
  synthetic [barcode part1]
tctctggatactgatc

SEQ ID NO: 2920 - DNA, 16 bp, Artificial Sequence
  synthetic [barcode part1]
actcaacggttgtcag

SEQ ID NO: 2921 - DNA, 16 bp, Artificial Sequence
  synthetic [barcode part1]
gcctatcttgttcacc

SEQ ID NO: 2922 - DNA, 16 bp, Artificial Sequence
  synthetic [barcode part1]
gattgcgtaacgcact

SEQ ID NO: 2923 - DNA, 16 bp, Artificial Sequence
  synthetic [barcode part1]
acctactcacctgtct

SEQ ID NO: 2924 - DNA, 16 bp, Artificial Sequence
  synthetic [barcode part1]
agagagtcgaaggact

SEQ ID NO: 2925 - DNA, 16 bp, Artificial Sequence
  synthetic [barcode part1]
ataggaaccgaactac

SEQ ID NO: 2926 - DNA, 16 bp, Artificial Sequence
  synthetic [barcode part1]
attgtcgttcctacag

SEQ ID NO: 2927 - DNA, 16 bp, Artificial Sequence
  synthetic [barcode part1]
gtgattgcacgtgatc

SEQ ID NO: 2928 - DNA, 16 bp, Artificial Sequence
  synthetic [barcode part1]
gaactcaggcaacgac

SEQ ID NO: 2929 - DNA, 16 bp, Artificial Sequence
  synthetic [barcode part1]
cagattaggccactgt

SEQ ID NO: 2930 - DNA, 16 bp, Artificial Sequence
  synthetic [barcode part1]
accgaagtaacgtgcg

SEQ ID NO: 2931 - DNA, 16 bp, Artificial Sequence
  synthetic [barcode part1]
aagtggactgcggtgt

SEQ ID NO: 2932 - DNA, 16 bp, Artificial Sequence
  synthetic [barcode part1]
aaccacaggagagtcc

SEQ ID NO: 2933 - DNA, 16 bp, Artificial Sequence
  synthetic [barcode part1]
cctcagtggttcacac

SEQ ID NO: 2934 - DNA, 16 bp, Artificial Sequence
  synthetic [barcode part1]
tagaaggtggccacgt

SEQ ID NO: 2935 - DNA, 16 bp, Artificial Sequence
  synthetic [barcode part1]
cggagaagtactaatc

SEQ ID NO: 2936 - DNA, 16 bp, Artificial Sequence
  synthetic [barcode part1]
gatcttggtctgcctg

SEQ ID NO: 2937 - DNA, 16 bp, Artificial Sequence
  synthetic [barcode part1]
tacttaacctccggcg

SEQ ID NO: 2938 - DNA, 16 bp, Artificial Sequence
  synthetic [barcode part1]
gccagacagtgtgaac

SEQ ID NO: 2939 - DNA, 16 bp, Artificial Sequence
  synthetic [barcode part1]
actgcgatcgtagtgt

SEQ ID NO: 2940 - DNA, 16 bp, Artificial Sequence
  synthetic [barcode part1]
aacgttcgtcttctag

SEQ ID NO: 2941 - DNA, 16 bp, Artificial Sequence
  synthetic [barcode part1]
agatagacgcctgttc

SEQ ID NO: 2942 - DNA, 16 bp, Artificial Sequence
  synthetic [barcode part1]
atcgccgaagatatag

SEQ ID NO: 2943 - DNA, 16 bp, Artificial Sequence
  synthetic [barcode part1]
gttaagacaaccgtag

SEQ ID NO: 2944 - DNA, 16 bp, Artificial Sequence
  synthetic [barcode part1]
gccgacaacttcctac

SEQ ID NO: 2945 - DNA, 16 bp, Artificial Sequence
  synthetic [barcode part1]
cgtgaacttgtcttgt

SEQ ID NO: 2946 - DNA, 16 bp, Artificial Sequence
  synthetic [barcode part1]
aggacggagtaaggtt

SEQ ID NO: 2947 - DNA, 16 bp, Artificial Sequence
  synthetic [barcode part1]
acgcagaacagaagtg

SEQ ID NO: 2948 - DNA, 16 bp, Artificial Sequence
  synthetic [barcode part1]
actgactgatcgatcg

SEQ ID NO: 2949 - DNA, 16 bp, Artificial Sequence
  synthetic [barcode part1]
agtcgcctctgtactg

SEQ ID NO: 2950 - DNA, 16 bp, Artificial Sequence
  synthetic [barcode part1]
gttcggccgtattctg

SEQ ID NO: 2951 - DNA, 16 bp, Artificial Sequence
  synthetic [barcode part1]
gcctcgatatagtacg

SEQ ID NO: 2952 - DNA, 16 bp, Artificial Sequence
  synthetic [barcode part1]
tgattcctctcggtct

SEQ ID NO: 2953 - DNA, 16 bp, Artificial Sequence
  synthetic [barcode part1]
gcgaccaagaagatcc

SEQ ID NO: 2954 - DNA, 16 bp, Artificial Sequence
  synthetic [barcode part1]
cgaggtcgtattgtac

SEQ ID NO: 2955 - DNA, 16 bp, Artificial Sequence
  synthetic [barcode part1]
tgtaacctgcagactg

SEQ ID NO: 2956 - DNA, 16 bp, Artificial Sequence
  synthetic [barcode part1]
cgatctactgcgtctg

SEQ ID NO: 2957 - DNA, 16 bp, Artificial Sequence
  synthetic [barcode part1]
gtgcagtaccaacgtt

SEQ ID NO: 2958 - DNA, 16 bp, Artificial Sequence
  synthetic [barcode part1]
caccagactcgtacct

SEQ ID NO: 2959 - DNA, 16 bp, Artificial Sequence
  synthetic [barcode part1]
gagttgcgtaactcgt

SEQ ID NO: 2960 - DNA, 16 bp, Artificial Sequence
  synthetic [barcode part1]
cctggttagaatcgac

SEQ ID NO: 2961 - DNA, 16 bp, Artificial Sequence
  synthetic [barcode part1]
tctccacaggttattg

SEQ ID NO: 2962 - DNA, 16 bp, Artificial Sequence
  synthetic [barcode part1]
accacaacaggacttc

SEQ ID NO: 2963 - DNA, 16 bp, Artificial Sequence
  synthetic [barcode part1]
aacgcgacttgtatcg

SEQ ID NO: 2964 - DNA, 16 bp, Artificial Sequence
  synthetic [barcode part1]
ttggacgtacctgagt

SEQ ID NO: 2965 - DNA, 16 bp, Artificial Sequence
  synthetic [barcode part1]
gagtacttctattgcc

SEQ ID NO: 2966 - DNA, 16 bp, Artificial Sequence
  synthetic [barcode part1]
tacagacttcaggcac

SEQ ID NO: 2967 - DNA, 16 bp, Artificial Sequence
  synthetic [barcode part1]
gtagatcaattgcgcc

SEQ ID NO: 2968 - DNA, 16 bp, Artificial Sequence
  synthetic [barcode part1]
tgtaaccgtacgatcg

SEQ ID NO: 2969 - DNA, 16 bp, Artificial Sequence
  synthetic [barcode part1]
tgcagacgtagatcct

SEQ ID NO: 2970 - DNA, 16 bp, Artificial Sequence
  synthetic [barcode part1]
acgtctccaatccgac

SEQ ID NO: 2971 - DNA, 16 bp, Artificial Sequence
  synthetic [barcode part1]
aaggcgaggacctatc

SEQ ID NO: 2972 - DNA, 16 bp, Artificial Sequence
  synthetic [barcode part1]
aattgccagtgcggag

SEQ ID NO: 2973 - DNA, 16 bp, Artificial Sequence
  synthetic [barcode part1]
gttcgtatcgacacag

SEQ ID NO: 2974 - DNA, 16 bp, Artificial Sequence
  synthetic [barcode part1]
tagtagaggacctgcg

SEQ ID NO: 2975 - DNA, 16 bp, Artificial Sequence
  synthetic [barcode part1]
taggaggcacacaacc

SEQ ID NO: 2976 - DNA, 16 bp, Artificial Sequence
  synthetic [barcode part1]
tgtcagagaacgtggc

SEQ ID NO: 2977 - DNA, 16 bp, Artificial Sequence
  synthetic [barcode part1]
aggtctacctggtctc

SEQ ID NO: 2978 - DNA, 16 bp, Artificial Sequence
  synthetic [barcode part1]
caggcgttcaatacac

SEQ ID NO: 2979 - DNA, 16 bp, Artificial Sequence
  synthetic [barcode part1]
acaccttcgacaatct

SEQ ID NO: 2980 - DNA, 16 bp, Artificial Sequence
  synthetic [barcode part1]
agtgaggaaccgtgtc

SEQ ID NO: 2981 - DNA, 16 bp, Artificial Sequence
  synthetic [barcode part1]
tcagaacaggtaagtc

SEQ ID NO: 2982 - DNA, 16 bp, Artificial Sequence
  synthetic [barcode part1]
tggcgcagagaattgc

SEQ ID NO: 2983 - DNA, 16 bp, Artificial Sequence
  synthetic [barcode part1]
aattgccgtcctcacg

SEQ ID NO: 2984 - DNA, 16 bp, Artificial Sequence
  synthetic [barcode part1]
gccttctgtcaacgtg

SEQ ID NO: 2985 - DNA, 16 bp, Artificial Sequence
  synthetic [barcode part1]
aacgtcttctgtggag

SEQ ID NO: 2986 - DNA, 16 bp, Artificial Sequence
  synthetic [barcode part1]
tatccttaccgaactg

SEQ ID NO: 2987 - DNA, 16 bp, Artificial Sequence
  synthetic [barcode part1]
gtgcggttacaatcac

SEQ ID NO: 2988 - DNA, 16 bp, Artificial Sequence
  synthetic [barcode part1]
acggccaagttgagac

SEQ ID NO: 2989 - DNA, 16 bp, Artificial Sequence
  synthetic [barcode part1]
cgtaccggagaagttg

SEQ ID NO: 2990 - DNA, 16 bp, Artificial Sequence
  synthetic [barcode part1]
agaacgcctggactag

SEQ ID NO: 2991 - DNA, 16 bp, Artificial Sequence
  synthetic [barcode part1]
cggaattctgaagtcc

SEQ ID NO: 2992 - DNA, 16 bp, Artificial Sequence
  synthetic [barcode part1]
aacaccactccttctc

SEQ ID NO: 2993 - DNA, 16 bp, Artificial Sequence
  synthetic [barcode part1]
taagtcgtggcagttc

SEQ ID NO: 2994 - DNA, 16 bp, Artificial Sequence
  synthetic [barcode part1]
actagtaacggccgtt

SEQ ID NO: 2995 - DNA, 16 bp, Artificial Sequence
  synthetic [barcode part1]
cgagtgtcgatctcct

SEQ ID NO: 2996 - DNA, 16 bp, Artificial Sequence
  synthetic [barcode part1]
gattagatctgcagag

SEQ ID NO: 2997 - DNA, 16 bp, Artificial Sequence
  synthetic [barcode part1]
acgttgaccagtacac

SEQ ID NO: 2998 - DNA, 16 bp, Artificial Sequence
  synthetic [barcode part1]
gatcggtactacggtt

SEQ ID NO: 2999 - DNA, 16 bp, Artificial Sequence
  synthetic [barcode part1]
gttgatctgactgacg

SEQ ID NO: 3000 - DNA, 16 bp, Artificial Sequence
  synthetic [barcode part1]
tgcaacgttgtggtgt

SEQ ID NO: 3001 - DNA, 16 bp, Artificial Sequence
  synthetic [barcode part1]
cactaaggacgtggac

SEQ ID NO: 3002 - DNA, 16 bp, Artificial Sequence
  synthetic [barcode part1]
agtctgaggcctaatc

SEQ ID NO: 3003 - DNA, 16 bp, Artificial Sequence
  synthetic [barcode part1]
cgtactccaggaatac

SEQ ID NO: 3004 - DNA, 16 bp, Artificial Sequence
  synthetic [barcode part1]
cacgccagagatcaag

SEQ ID NO: 3005 - DNA, 16 bp, Artificial Sequence
  synthetic [barcode part1]
tcagtgacgtctctgc

SEQ ID NO: 3006 - DNA, 16 bp, Artificial Sequence
  synthetic [barcode part1]
actcttagacaactcc

SEQ ID NO: 3007 - DNA, 16 bp, Artificial Sequence
  synthetic [barcode part1]
gcctgcctactgtaac

SEQ ID NO: 3008 - DNA, 16 bp, Artificial Sequence
  synthetic [barcode part1]
acaatatcagtgccgc

SEQ ID NO: 3009 - DNA, 16 bp, Artificial Sequence
  synthetic [barcode part1]
cgttccgattcgtggt

SEQ ID NO: 3010 - DNA, 16 bp, Artificial Sequence
  synthetic [barcode part1]
cgtgaaccgaatacct

SEQ ID NO: 3011 - DNA, 16 bp, Artificial Sequence
  synthetic [barcode part1]
ccttcggaatccttct

SEQ ID NO: 3012 - DNA, 16 bp, Artificial Sequence
  synthetic [barcode part1]
tgtacttgagtcactc

SEQ ID NO: 3013 - DNA, 16 bp, Artificial Sequence
  synthetic [barcode part1]
aaccggatctgcgaag

SEQ ID NO: 3014 - DNA, 16 bp, Artificial Sequence
  synthetic [barcode part1]
atcacggcaggtaggt

SEQ ID NO: 3015 - DNA, 16 bp, Artificial Sequence
  synthetic [barcode part1]
actccgtattcagatc

SEQ ID NO: 3016 - DNA, 16 bp, Artificial Sequence
  synthetic [barcode part1]
tccaacctcagtcttc

SEQ ID NO: 3017 - DNA, 16 bp, Artificial Sequence
  synthetic [barcode part1]
gttctatcttacaggc

SEQ ID NO: 3018 - DNA, 16 bp, Artificial Sequence
  synthetic [barcode part1]
ccagtcttaaggagtc

SEQ ID NO: 3019 - DNA, 16 bp, Artificial Sequence
  synthetic [barcode part1]
gcgtagtaggaccagt

SEQ ID NO: 3020 - DNA, 16 bp, Artificial Sequence
  synthetic [barcode part1]
acaatcaaggaggtct

SEQ ID NO: 3021 - DNA, 16 bp, Artificial Sequence
  synthetic [barcode part1]
attgtggtccagagtc

SEQ ID NO: 3022 - DNA, 16 bp, Artificial Sequence
  synthetic [barcode part1]
atacgacaaggaactc

SEQ ID NO: 3023 - DNA, 16 bp, Artificial Sequence
  synthetic [barcode part1]
aaggagacgtgtgtag

SEQ ID NO: 3024 - DNA, 16 bp, Artificial Sequence
  synthetic [barcode part1]
gttgccgatatagaag

SEQ ID NO: 3025 - DNA, 16 bp, Artificial Sequence
  synthetic [barcode part1]
gataaggcggttcctt

SEQ ID NO: 3026 - DNA, 16 bp, Artificial Sequence
  synthetic [barcode part1]
gcaagtgaacggatag

SEQ ID NO: 3027 - DNA, 16 bp, Artificial Sequence
  synthetic [barcode part1]
aggatcgacgtgatcg

SEQ ID NO: 3028 - DNA, 16 bp, Artificial Sequence
  synthetic [barcode part1]
tagagtacgccttgtg

SEQ ID NO: 3029 - DNA, 16 bp, Artificial Sequence
  synthetic [barcode part1]
ataataccggttggcc

SEQ ID NO: 3030 - DNA, 16 bp, Artificial Sequence
  synthetic [barcode part1]
atacctgcgtctgaag

SEQ ID NO: 3031 - DNA, 16 bp, Artificial Sequence
  synthetic [barcode part1]
agactaacggtatacg

SEQ ID NO: 3032 - DNA, 16 bp, Artificial Sequence
  synthetic [barcode part1]
taccgaattaccggac

SEQ ID NO: 3033 - DNA, 16 bp, Artificial Sequence
  synthetic [barcode part1]
actcgatagaagtgtg

SEQ ID NO: 3034 - DNA, 16 bp, Artificial Sequence
  synthetic [barcode part1]
acggactagtctgtgt

SEQ ID NO: 3035 - DNA, 16 bp, Artificial Sequence
  synthetic [barcode part1]
ttcacgaatctgcgag

SEQ ID NO: 3036 - DNA, 16 bp, Artificial Sequence
  synthetic [barcode part1]
caaccgcctgttactg

SEQ ID NO: 3037 - DNA, 16 bp, Artificial Sequence
  synthetic [barcode part1]
agtcggatccacgaag

SEQ ID NO: 3038 - DNA, 16 bp, Artificial Sequence
  synthetic [barcode part1]
gattctcgccacttct

SEQ ID NO: 3039 - DNA, 16 bp, Artificial Sequence
  synthetic [barcode part1]
cgactagaccaatcgt

SEQ ID NO: 3040 - DNA, 16 bp, Artificial Sequence
  synthetic [barcode part1]
gtgaagacagtgatct

SEQ ID NO: 3041 - DNA, 16 bp, Artificial Sequence
  synthetic [barcode part1]
cagttaggtatcgcac

SEQ ID NO: 3042 - DNA, 16 bp, Artificial Sequence
  synthetic [barcode part1]
ttagataccgccttac

SEQ ID NO: 3043 - DNA, 16 bp, Artificial Sequence
  synthetic [barcode part1]
aacctcaagtaggtag

SEQ ID NO: 3044 - DNA, 16 bp, Artificial Sequence
  synthetic [barcode part1]
tgcggacagtattcac

SEQ ID NO: 3045 - DNA, 16 bp, Artificial Sequence
  synthetic [barcode part1]
ttgcgatatcgcaacg

SEQ ID NO: 3046 - DNA, 16 bp, Artificial Sequence
  synthetic [barcode part1]
cgtaacacgagattcc

SEQ ID NO: 3047 - DNA, 16 bp, Artificial Sequence
  synthetic [barcode part1]
tattccgccaccttgt

SEQ ID NO: 3048 - DNA, 16 bp, Artificial Sequence
  synthetic [barcode part1]
accactaggtcgttag

SEQ ID NO: 3049 - DNA, 16 bp, Artificial Sequence
  synthetic [barcode part1]
tctcgattgcaagtct

SEQ ID NO: 3050 - DNA, 16 bp, Artificial Sequence
  synthetic [barcode part1]
agagtggttatctcgc

SEQ ID NO: 3051 - DNA, 16 bp, Artificial Sequence
  synthetic [barcode part1]
cctggcagtaacttag

SEQ ID NO: 3052 - DNA, 16 bp, Artificial Sequence
  synthetic [barcode part1]
atagaggacgtgaggt

SEQ ID NO: 3053 - DNA, 16 bp, Artificial Sequence
  synthetic [barcode part1]
aagaagttcgtcgtcc

SEQ ID NO: 3054 - DNA, 16 bp, Artificial Sequence
  synthetic [barcode part1]
agaccacagtgactct

SEQ ID NO: 3055 - DNA, 16 bp, Artificial Sequence
  synthetic [barcode part1]
gagaggtaggtgtctc

SEQ ID NO: 3056 - DNA, 16 bp, Artificial Sequence
  synthetic [barcode part1]
caaggtcagttccagt

SEQ ID NO: 3057 - DNA, 16 bp, Artificial Sequence
  synthetic [barcode part1]
cagacagaacgaacag

SEQ ID NO: 3058 - DNA, 16 bp, Artificial Sequence
  synthetic [barcode part1]
tgattggcaactgacc

SEQ ID NO: 3059 - DNA, 16 bp, Artificial Sequence
  synthetic [barcode part1]
ataggtcttagtgcgc

SEQ ID NO: 3060 - DNA, 16 bp, Artificial Sequence
  synthetic [barcode part1]
agtaatcgagacgtgt

SEQ ID NO: 3061 - DNA, 16 bp, Artificial Sequence
  synthetic [barcode part1]
gtgattggaccggaac

SEQ ID NO: 3062 - DNA, 16 bp, Artificial Sequence
  synthetic [barcode part1]
tacacgaacaggatac

SEQ ID NO: 3063 - DNA, 16 bp, Artificial Sequence
  synthetic [barcode part1]
ccgatagtcgtgtcct

SEQ ID NO: 3064 - DNA, 16 bp, Artificial Sequence
  synthetic [barcode part1]
gccgacaatctctcac

SEQ ID NO: 3065 - DNA, 16 bp, Artificial Sequence
  synthetic [barcode part1]
gttccaatcgagatcg

SEQ ID NO: 3066 - DNA, 16 bp, Artificial Sequence
  synthetic [barcode part1]
tgtgcaatatcttgcc

SEQ ID NO: 3067 - DNA, 16 bp, Artificial Sequence
  synthetic [barcode part1]
tcaatctccaccgttc

SEQ ID NO: 3068 - DNA, 16 bp, Artificial Sequence
  synthetic [barcode part1]
actaacgtgagaggcc

SEQ ID NO: 3069 - DNA, 16 bp, Artificial Sequence
  synthetic [barcode part1]
tcgcgagaagtcagac

SEQ ID NO: 3070 - DNA, 16 bp, Artificial Sequence
  synthetic [barcode part1]
gagacacgttggatcg

SEQ ID NO: 3071 - DNA, 16 bp, Artificial Sequence
  synthetic [barcode part1]
cggcaattcggtagtt

SEQ ID NO: 3072 - DNA, 16 bp, Artificial Sequence
  synthetic [barcode part1]
cgtcctaatccgtgac

SEQ ID NO: 3073 - DNA, 16 bp, Artificial Sequence
  synthetic [barcode part1]
gtgacagattctccag

SEQ ID NO: 3074 - DNA, 16 bp, Artificial Sequence
  synthetic [barcode part1]
tgtggacctcaccgtt

SEQ ID NO: 3075 - DNA, 16 bp, Artificial Sequence
  synthetic [barcode part1]
cgaggttccaagatct

SEQ ID NO: 3076 - DNA, 16 bp, Artificial Sequence
  synthetic [barcode part1]
accgcctataacgagt

SEQ ID NO: 3077 - DNA, 16 bp, Artificial Sequence
  synthetic [barcode part1]
aggcaaggagtcttgc

SEQ ID NO: 3078 - DNA, 16 bp, Artificial Sequence
  synthetic [barcode part1]
gtactaccacttactg

SEQ ID NO: 3079 - DNA, 16 bp, Artificial Sequence
  synthetic [barcode part1]
tcttgataccgaggac

SEQ ID NO: 3080 - DNA, 16 bp, Artificial Sequence
  synthetic [barcode part1]
ataggtccgacctctc

SEQ ID NO: 3081 - DNA, 16 bp, Artificial Sequence
  synthetic [barcode part1]
ttgcctgttacctacc

SEQ ID NO: 3082 - DNA, 16 bp, Artificial Sequence
  synthetic [barcode part1]
aagtgattggcctctg

SEQ ID NO: 3083 - DNA, 16 bp, Artificial Sequence
  synthetic [barcode part1]
tgcaggaatacaggag

SEQ ID NO: 3084 - DNA, 16 bp, Artificial Sequence
  synthetic [barcode part1]
gcctatcaggtaagtc

SEQ ID NO: 3085 - DNA, 16 bp, Artificial Sequence
  synthetic [barcode part1]
tcttccgagtgtgtcg

SEQ ID NO: 3086 - DNA, 16 bp, Artificial Sequence
  synthetic [barcode part1]
cagaactccttggaac

SEQ ID NO: 3087 - DNA, 16 bp, Artificial Sequence
  synthetic [barcode part1]
tgtagactccggatac

SEQ ID NO: 3088 - DNA, 16 bp, Artificial Sequence
  synthetic [barcode part1]
cggatatcggcaagac

SEQ ID NO: 3089 - DNA, 16 bp, Artificial Sequence
  synthetic [barcode part1]
acgattcttgtgttcg

SEQ ID NO: 3090 - DNA, 16 bp, Artificial Sequence
  synthetic [barcode part1]
tcgacaataccggatc

SEQ ID NO: 3091 - DNA, 16 bp, Artificial Sequence
  synthetic [barcode part1]
gaatcctccaggattg

SEQ ID NO: 3092 - DNA, 16 bp, Artificial Sequence
  synthetic [barcode part1]
tctggccgtaccagtt

SEQ ID NO: 3093 - DNA, 16 bp, Artificial Sequence
  synthetic [barcode part1]
atccagactcgttatc

SEQ ID NO: 3094 - DNA, 16 bp, Artificial Sequence
  synthetic [barcode part1]
gtaacaagatacaccg

SEQ ID NO: 3095 - DNA, 16 bp, Artificial Sequence
  synthetic [barcode part1]
tgactacaagtcgaag

SEQ ID NO: 3096 - DNA, 16 bp, Artificial Sequence
  synthetic [barcode part1]
tgagtcttagacgtcg

SEQ ID NO: 3097 - DNA, 16 bp, Artificial Sequence
  synthetic [barcode part1]
gacacacaagaccggt

SEQ ID NO: 3098 - DNA, 16 bp, Artificial Sequence
  synthetic [barcode part1]
taatcgaatcggccgt

SEQ ID NO: 3099 - DNA, 16 bp, Artificial Sequence
  synthetic [barcode part1]
gagacctaacaccgtt

SEQ ID NO: 3100 - DNA, 16 bp, Artificial Sequence
  synthetic [barcode part1]
gcaaccgcaattacac

SEQ ID NO: 3101 - DNA, 16 bp, Artificial Sequence
  synthetic [barcode part1]
tctgactccaacctct

SEQ ID NO: 3102 - DNA, 16 bp, Artificial Sequence
  synthetic [barcode part1]
gtgtgtatacacacgc

SEQ ID NO: 3103 - DNA, 16 bp, Artificial Sequence
  synthetic [barcode part1]
cagaacgaacgacaag

SEQ ID NO: 3104 - DNA, 16 bp, Artificial Sequence
  synthetic [barcode part1]
tgcaccgcaattgtag

SEQ ID NO: 3105 - DNA, 16 bp, Artificial Sequence
  synthetic [barcode part1]
gaggagttactctgtc

SEQ ID NO: 3106 - DNA, 16 bp, Artificial Sequence
  synthetic [barcode part1]
agatatccaccgtctt

SEQ ID NO: 3107 - DNA, 16 bp, Artificial Sequence
  synthetic [barcode part1]
cggttctcgtagttgc

SEQ ID NO: 3108 - DNA, 16 bp, Artificial Sequence
  synthetic [barcode part1]
cgaactaccttgcacc

SEQ ID NO: 3109 - DNA, 16 bp, Artificial Sequence
  synthetic [barcode part1]
aacttggaacctggtc

SEQ ID NO: 3110 - DNA, 16 bp, Artificial Sequence
  synthetic [barcode part1]
gcagatcctagtgtgt

SEQ ID NO: 3111 - DNA, 16 bp, Artificial Sequence
  synthetic [barcode part1]
acactgtgtctgtccg

SEQ ID NO: 3112 - DNA, 16 bp, Artificial Sequence
  synthetic [barcode part1]
gcgtcaagaagtgatt

SEQ ID NO: 3113 - DNA, 16 bp, Artificial Sequence
  synthetic [barcode part1]
gtcaactagagaggag

SEQ ID NO: 3114 - DNA, 16 bp, Artificial Sequence
  synthetic [barcode part1]
cctggaagaccttagt

SEQ ID NO: 3115 - DNA, 16 bp, Artificial Sequence
  synthetic [barcode part1]
acgcgatcagtacact

SEQ ID NO: 3116 - DNA, 16 bp, Artificial Sequence
  synthetic [barcode part1]
attagatactctcgcc

SEQ ID NO: 3117 - DNA, 16 bp, Artificial Sequence
  synthetic [barcode part1]
tagagaagttgacgtc

SEQ ID NO: 3118 - DNA, 16 bp, Artificial Sequence
  synthetic [barcode part1]
gtgccacagacaagtg

SEQ ID NO: 3119 - DNA, 16 bp, Artificial Sequence
  synthetic [barcode part1]
ttcagtccgcgtggtt

SEQ ID NO: 3120 - DNA, 16 bp, Artificial Sequence
  synthetic [barcode part1]
gcgaagacgtaagaac

SEQ ID NO: 3121 - DNA, 16 bp, Artificial Sequence
  synthetic [barcode part1]
tggagaagactcctct

SEQ ID NO: 3122 - DNA, 16 bp, Artificial Sequence
  synthetic [barcode part1]
cggaatcagagttcct

SEQ ID NO: 3123 - DNA, 16 bp, Artificial Sequence
  synthetic [barcode part1]
ccgtggttaatcaacg

SEQ ID NO: 3124 - DNA, 16 bp, Artificial Sequence
  synthetic [barcode part1]
ccacgttgtctagtgc

SEQ ID NO: 3125 - DNA, 16 bp, Artificial Sequence
  synthetic [barcode part1]
tgcaactctctcgacg

SEQ ID NO: 3126 - DNA, 16 bp, Artificial Sequence
  synthetic [barcode part1]
tcttacactcttgcgc

SEQ ID NO: 3127 - DNA, 16 bp, Artificial Sequence
  synthetic [barcode part1]
atccgtacgataagag

SEQ ID NO: 3128 - DNA, 16 bp, Artificial Sequence
  synthetic [barcode part1]
tatcggatctgtgttc

SEQ ID NO: 3129 - DNA, 16 bp, Artificial Sequence
  synthetic [barcode part1]
ccagtatcacgatcag

SEQ ID NO: 3130 - DNA, 16 bp, Artificial Sequence
  synthetic [barcode part1]
aggtgaggtcctgaac

SEQ ID NO: 3131 - DNA, 16 bp, Artificial Sequence
  synthetic [barcode part1]
agacgcaccgaactag

SEQ ID NO: 3132 - DNA, 16 bp, Artificial Sequence
  synthetic [barcode part1]
tgacctctgacgtacc

SEQ ID NO: 3133 - DNA, 16 bp, Artificial Sequence
  synthetic [barcode part1]
aaccttggacgaatag

SEQ ID NO: 3134 - DNA, 16 bp, Artificial Sequence
  synthetic [barcode part1]
gtgcaagaatacggag

SEQ ID NO: 3135 - DNA, 16 bp, Artificial Sequence
  synthetic [barcode part1]
cggcgagtagatatcg

SEQ ID NO: 3136 - DNA, 16 bp, Artificial Sequence
  synthetic [barcode part1]
atccgttaagtcctgt

SEQ ID NO: 3137 - DNA, 16 bp, Artificial Sequence
  synthetic [barcode part1]
gcaattattggcctct

SEQ ID NO: 3138 - DNA, 16 bp, Artificial Sequence
  synthetic [barcode part1]
ttcgattgtgcgtcgc

SEQ ID NO: 3139 - DNA, 16 bp, Artificial Sequence
  synthetic [barcode part1]
ttcgccaaggaattgc

SEQ ID NO: 3140 - DNA, 16 bp, Artificial Sequence
  synthetic [barcode part1]
tccttccgagaagagt

SEQ ID NO: 3141 - DNA, 16 bp, Artificial Sequence
  synthetic [barcode part1]
aatacaggaacgcgag

SEQ ID NO: 3142 - DNA, 16 bp, Artificial Sequence
  synthetic [barcode part1]
gatactcactcgagtg

SEQ ID NO: 3143 - DNA, 16 bp, Artificial Sequence
  synthetic [barcode part1]
tctcgacaactgtgcc

SEQ ID NO: 3144 - DNA, 16 bp, Artificial Sequence
  synthetic [barcode part1]
atcacctgcgacaagt

SEQ ID NO: 3145 - DNA, 16 bp, Artificial Sequence
  synthetic [barcode part1]
cgcgttgtatacaacg

SEQ ID NO: 3146 - DNA, 16 bp, Artificial Sequence
  synthetic [barcode part1]
tcacgtcacgatccac

SEQ ID NO: 3147 - DNA, 16 bp, Artificial Sequence
  synthetic [barcode part1]
atcgcctcctggatac

SEQ ID NO: 3148 - DNA, 16 bp, Artificial Sequence
  synthetic [barcode part1]
tgccttagacacttgt

SEQ ID NO: 3149 - DNA, 16 bp, Artificial Sequence
  synthetic [barcode part1]
tgatacctcgtctgcg

SEQ ID NO: 3150 - DNA, 16 bp, Artificial Sequence
  synthetic [barcode part1]
ttgcgtctccgacaac

SEQ ID NO: 3151 - DNA, 16 bp, Artificial Sequence
  synthetic [barcode part1]
tcagagtcagacaggc

SEQ ID NO: 3152 - DNA, 16 bp, Artificial Sequence
  synthetic [barcode part1]
cggcgtattctaccac

SEQ ID NO: 3153 - DNA, 16 bp, Artificial Sequence
  synthetic [barcode part1]
tgtagaactccacgtg

SEQ ID NO: 3154 - DNA, 16 bp, Artificial Sequence
  synthetic [barcode part1]
acggcaatctatagag

SEQ ID NO: 3155 - DNA, 16 bp, Artificial Sequence
  synthetic [barcode part1]
atcagtctcgactgag

SEQ ID NO: 3156 - DNA, 16 bp, Artificial Sequence
  synthetic [barcode part1]
gccttctacgttgacg

SEQ ID NO: 3157 - DNA, 16 bp, Artificial Sequence
  synthetic [barcode part1]
cctactaatacggtct

SEQ ID NO: 3158 - DNA, 16 bp, Artificial Sequence
  synthetic [barcode part1]
aagtcggattggcacg

SEQ ID NO: 3159 - DNA, 16 bp, Artificial Sequence
  synthetic [barcode part1]
tacggcacctaggatt

SEQ ID NO: 3160 - DNA, 16 bp, Artificial Sequence
  synthetic [barcode part1]
tcacgcctgtcgagtt

SEQ ID NO: 3161 - DNA, 16 bp, Artificial Sequence
  synthetic [barcode part1]
gataggaggtccacgt

SEQ ID NO: 3162 - DNA, 16 bp, Artificial Sequence
  synthetic [barcode part1]
acgccaagaggtgact

SEQ ID NO: 3163 - DNA, 16 bp, Artificial Sequence
  synthetic [barcode part1]
tgatcactgaagaacg

SEQ ID NO: 3164 - DNA, 16 bp, Artificial Sequence
  synthetic [barcode part1]
taggagaaccgatact

SEQ ID NO: 3165 - DNA, 16 bp, Artificial Sequence
  synthetic [barcode part1]
gacgccaactagttac

SEQ ID NO: 3166 - DNA, 16 bp, Artificial Sequence
  synthetic [barcode part1]
agtagatcaggatctg

SEQ ID NO: 3167 - DNA, 16 bp, Artificial Sequence
  synthetic [barcode part1]
aacgttccggaaggtg

SEQ ID NO: 3168 - DNA, 16 bp, Artificial Sequence
  synthetic [barcode part1]
gtgtcctgtatctctc

SEQ ID NO: 3169 - DNA, 16 bp, Artificial Sequence
  synthetic [barcode part1]
cgagtatcttcactac

SEQ ID NO: 3170 - DNA, 16 bp, Artificial Sequence
  synthetic [barcode part1]
ttaacgcctaattccg

SEQ ID NO: 3171 - DNA, 16 bp, Artificial Sequence
  synthetic [barcode part1]
ttactactgtccgaac

SEQ ID NO: 3172 - DNA, 16 bp, Artificial Sequence
  synthetic [barcode part1]
tacgaacgaacggcac

SEQ ID NO: 3173 - DNA, 16 bp, Artificial Sequence
  synthetic [barcode part1]
tattacctccacagac

SEQ ID NO: 3174 - DNA, 16 bp, Artificial Sequence
  synthetic [barcode part1]
tctagtgtaggttgcg

SEQ ID NO: 3175 - DNA, 16 bp, Artificial Sequence
  synthetic [barcode part1]
gcgccaaggagtaatc

SEQ ID NO: 3176 - DNA, 16 bp, Artificial Sequence
  synthetic [barcode part1]
aaccgcagtataccgt

SEQ ID NO: 3177 - DNA, 16 bp, Artificial Sequence
  synthetic [barcode part1]
cgttgttattcggact

SEQ ID NO: 3178 - DNA, 16 bp, Artificial Sequence
  synthetic [barcode part1]
ttcttacagacgcgag

SEQ ID NO: 3179 - DNA, 16 bp, Artificial Sequence
  synthetic [barcode part1]
ttgacctgttctccgt

SEQ ID NO: 3180 - DNA, 16 bp, Artificial Sequence
  synthetic [barcode part1]
tgatacgatcgttctc

SEQ ID NO: 3181 - DNA, 16 bp, Artificial Sequence
  synthetic [barcode part1]
accgtatcgtgagttg

SEQ ID NO: 3182 - DNA, 16 bp, Artificial Sequence
  synthetic [barcode part1]
tcggtaacgcctctac

SEQ ID NO: 3183 - DNA, 16 bp, Artificial Sequence
  synthetic [barcode part1]
agaaggattaggaccg

SEQ ID NO: 3184 - DNA, 16 bp, Artificial Sequence
  synthetic [barcode part1]
gcctgaatagacgtct

SEQ ID NO: 3185 - DNA, 16 bp, Artificial Sequence
  synthetic [barcode part1]
tcaagactcgcgatac

SEQ ID NO: 3186 - DNA, 16 bp, Artificial Sequence
  synthetic [barcode part1]
accgagatcctaactg

SEQ ID NO: 3187 - DNA, 16 bp, Artificial Sequence
  synthetic [barcode part1]
accgcgactgtaatac

SEQ ID NO: 3188 - DNA, 16 bp, Artificial Sequence
  synthetic [barcode part1]
cgccaacagaattaag

SEQ ID NO: 3189 - DNA, 16 bp, Artificial Sequence
  synthetic [barcode part1]
taaccgaccagaatcc

SEQ ID NO: 3190 - DNA, 16 bp, Artificial Sequence
  synthetic [barcode part1]
ttggtgttggtgtacg

SEQ ID NO: 3191 - DNA, 16 bp, Artificial Sequence
  synthetic [barcode part1]
gatacctctgtgcaag

SEQ ID NO: 3192 - DNA, 16 bp, Artificial Sequence
  synthetic [barcode part1]
tctaggaaggaggaac

SEQ ID NO: 3193 - DNA, 16 bp, Artificial Sequence
  synthetic [barcode part1]
cctgatccgtacaacc

SEQ ID NO: 3194 - DNA, 16 bp, Artificial Sequence
  synthetic [barcode part1]
gcgtgatccttaactt

SEQ ID NO: 3195 - DNA, 16 bp, Artificial Sequence
  synthetic [barcode part1]
tgtcctcaagaacgtg

SEQ ID NO: 3196 - DNA, 16 bp, Artificial Sequence
  synthetic [barcode part1]
tatctcggtgaactct

SEQ ID NO: 3197 - DNA, 16 bp, Artificial Sequence
  synthetic [barcode part1]
tcaatctcgtcgatac

SEQ ID NO: 3198 - DNA, 16 bp, Artificial Sequence
  synthetic [barcode part1]
gtgccgtgtgaacaag

SEQ ID NO: 3199 - DNA, 16 bp, Artificial Sequence
  synthetic [barcode part1]
aggcctactcaatctt

SEQ ID NO: 3200 - DNA, 16 bp, Artificial Sequence
  synthetic [barcode part1]
cgactcctgcaatcgt

SEQ ID NO: 3201 - DNA, 16 bp, Artificial Sequence
  synthetic [barcode part1]
gtcaactggaacttcg

SEQ ID NO: 3202 - DNA, 16 bp, Artificial Sequence
  synthetic [barcode part1]
gacctctcacgtcaac

SEQ ID NO: 3203 - DNA, 16 bp, Artificial Sequence
  synthetic [barcode part1]
tccggttcgtaaccac

SEQ ID NO: 3204 - DNA, 16 bp, Artificial Sequence
  synthetic [barcode part1]
tcactgaagtcgtcag

SEQ ID NO: 3205 - DNA, 16 bp, Artificial Sequence
  synthetic [barcode part1]
tccaattcggcacacc

SEQ ID NO: 3206 - DNA, 16 bp, Artificial Sequence
  synthetic [barcode part1]
caatagtgtcgtcggt

SEQ ID NO: 3207 - DNA, 16 bp, Artificial Sequence
  synthetic [barcode part1]
ccgataaccgtactcc

SEQ ID NO: 3208 - DNA, 16 bp, Artificial Sequence
  synthetic [barcode part1]
ttagtgcggaattgag

SEQ ID NO: 3209 - DNA, 16 bp, Artificial Sequence
  synthetic [barcode part1]
ttgacgtggttcctcg

SEQ ID NO: 3210 - DNA, 16 bp, Artificial Sequence
  synthetic [barcode part1]
taggtgcgcacttagt

SEQ ID NO: 3211 - DNA, 16 bp, Artificial Sequence
  synthetic [barcode part1]
caagaaggagactggt

SEQ ID NO: 3212 - DNA, 16 bp, Artificial Sequence
  synthetic [barcode part1]
gtatcgactgagtgtc

SEQ ID NO: 3213 - DNA, 16 bp, Artificial Sequence
  synthetic [barcode part1]
aggagtgacgacttgc

SEQ ID NO: 3214 - DNA, 16 bp, Artificial Sequence
  synthetic [barcode part1]
tcgatcaggtctcaag

SEQ ID NO: 3215 - DNA, 16 bp, Artificial Sequence
  synthetic [barcode part1]
tcggaaccaagatcct

SEQ ID NO: 3216 - DNA, 16 bp, Artificial Sequence
  synthetic [barcode part1]
attgttcggcacctgc

SEQ ID NO: 3217 - DNA, 16 bp, Artificial Sequence
  synthetic [barcode part1]
ttcgcaagtgatagag

SEQ ID NO: 3218 - DNA, 16 bp, Artificial Sequence
  synthetic [barcode part1]
tctgccgcacagactt

SEQ ID NO: 3219 - DNA, 16 bp, Artificial Sequence
  synthetic [barcode part1]
ttctgcaggaggtgtt

SEQ ID NO: 3220 - DNA, 16 bp, Artificial Sequence
  synthetic [barcode part1]
actaagagtacaccag

SEQ ID NO: 3221 - DNA, 16 bp, Artificial Sequence
  synthetic [barcode part1]
cagtatcacgacactg

SEQ ID NO: 3222 - DNA, 16 bp, Artificial Sequence
  synthetic [barcode part1]
tcagagtgagtggacc

SEQ ID NO: 3223 - DNA, 16 bp, Artificial Sequence
  synthetic [barcode part1]
gatagtctgcacctcc

SEQ ID NO: 3224 - DNA, 16 bp, Artificial Sequence
  synthetic [barcode part1]
tgcggtatatctacct

SEQ ID NO: 3225 - DNA, 16 bp, Artificial Sequence
  synthetic [barcode part1]
agttgtagaaggacct

SEQ ID NO: 3226 - DNA, 16 bp, Artificial Sequence
  synthetic [barcode part1]
gcgcgttaacagtgag

SEQ ID NO: 3227 - DNA, 16 bp, Artificial Sequence
  synthetic [barcode part1]
ttacacgataccgacg

SEQ ID NO: 3228 - DNA, 16 bp, Artificial Sequence
  synthetic [barcode part1]
caattcctgtagtcgt

SEQ ID NO: 3229 - DNA, 16 bp, Artificial Sequence
  synthetic [barcode part1]
agttcggttgacgact

SEQ ID NO: 3230 - DNA, 16 bp, Artificial Sequence
  synthetic [barcode part1]
ccgcagattaccgttc

SEQ ID NO: 3231 - DNA, 16 bp, Artificial Sequence
  synthetic [barcode part1]
tagaatctggcaccgt

SEQ ID NO: 3232 - DNA, 16 bp, Artificial Sequence
  synthetic [barcode part1]
cagttccttccagttc

SEQ ID NO: 3233 - DNA, 16 bp, Artificial Sequence
  synthetic [barcode part1]
tcactatcgaagtggc

SEQ ID NO: 3234 - DNA, 16 bp, Artificial Sequence
  synthetic [barcode part1]
gcgagttccagatact

SEQ ID NO: 3235 - DNA, 16 bp, Artificial Sequence
  synthetic [barcode part1]
gaagttacggtctctg

SEQ ID NO: 3236 - DNA, 16 bp, Artificial Sequence
  synthetic [barcode part1]
gcggtcaggttaagac

SEQ ID NO: 3237 - DNA, 16 bp, Artificial Sequence
  synthetic [barcode part1]
cgtagttctctgccag

SEQ ID NO: 3238 - DNA, 16 bp, Artificial Sequence
  synthetic [barcode part1]
actcctgtggactacc

SEQ ID NO: 3239 - DNA, 16 bp, Artificial Sequence
  synthetic [barcode part1]
tggatactgataaggc

SEQ ID NO: 3240 - DNA, 16 bp, Artificial Sequence
  synthetic [barcode part1]
gacgaacgagttccag

SEQ ID NO: 3241 - DNA, 16 bp, Artificial Sequence
  synthetic [barcode part1]
tcgaagtactctaggc

SEQ ID NO: 3242 - DNA, 16 bp, Artificial Sequence
  synthetic [barcode part1]
ccgagtgacgatagac

SEQ ID NO: 3243 - DNA, 16 bp, Artificial Sequence
  synthetic [barcode part1]
cgatcggtcaattgac

SEQ ID NO: 3244 - DNA, 16 bp, Artificial Sequence
  synthetic [barcode part1]
aaccacttaccgagtg

SEQ ID NO: 3245 - DNA, 16 bp, Artificial Sequence
  synthetic [barcode part1]
cctacgcagttgtcgt

SEQ ID NO: 3246 - DNA, 16 bp, Artificial Sequence
  synthetic [barcode part1]
gcgtatacacacacac

SEQ ID NO: 3247 - DNA, 16 bp, Artificial Sequence
  synthetic [barcode part1]
caatcgtctcaacttg

SEQ ID NO: 3248 - DNA, 16 bp, Artificial Sequence
  synthetic [barcode part1]
actgcggataagtaac

SEQ ID NO: 3249 - DNA, 16 bp, Artificial Sequence
  synthetic [barcode part1]
gacctattactacctg

SEQ ID NO: 3250 - DNA, 16 bp, Artificial Sequence
  synthetic [barcode part1]
cacaacttccttggcg

SEQ ID NO: 3251 - DNA, 16 bp, Artificial Sequence
  synthetic [barcode part1]
gtgtcaggtacgatct

SEQ ID NO: 3252 - DNA, 16 bp, Artificial Sequence
  synthetic [barcode part1]
aggtggaacgacactc

SEQ ID NO: 3253 - DNA, 16 bp, Artificial Sequence
  synthetic [barcode part1]
gacttcttcaggtact

SEQ ID NO: 3254 - DNA, 16 bp, Artificial Sequence
  synthetic [barcode part1]
cgaccgatacagtatc

SEQ ID NO: 3255 - DNA, 16 bp, Artificial Sequence
  synthetic [barcode part1]
tcgactcaagtatctc

SEQ ID NO: 3256 - DNA, 16 bp, Artificial Sequence
  synthetic [barcode part1]
gttgccgtggtaattg

SEQ ID NO: 3257 - DNA, 16 bp, Artificial Sequence
  synthetic [barcode part1]
aggtatagttggatcg

SEQ ID NO: 3258 - DNA, 16 bp, Artificial Sequence
  synthetic [barcode part1]
gtcactatccttacag

SEQ ID NO: 3259 - DNA, 16 bp, Artificial Sequence
  synthetic [barcode part1]
gtgtagtccttaatcc

SEQ ID NO: 3260 - DNA, 16 bp, Artificial Sequence
  synthetic [barcode part1]
cgattaccttaatccg

SEQ ID NO: 3261 - DNA, 16 bp, Artificial Sequence
  synthetic [barcode part1]
attccgtacaggacgt

SEQ ID NO: 3262 - DNA, 16 bp, Artificial Sequence
  synthetic [barcode part1]
tgtaggtgaacggtgc

SEQ ID NO: 3263 - DNA, 16 bp, Artificial Sequence
  synthetic [barcode part1]
gtatcgtcgagtggag

SEQ ID NO: 3264 - DNA, 16 bp, Artificial Sequence
  synthetic [barcode part1]
acacgccaagtcgaag

SEQ ID NO: 3265 - DNA, 16 bp, Artificial Sequence
  synthetic [barcode part1]
aagtagtgcacaatcg

SEQ ID NO: 3266 - DNA, 16 bp, Artificial Sequence
  synthetic [barcode part1]
ttatagattcggcctc

SEQ ID NO: 3267 - DNA, 16 bp, Artificial Sequence
  synthetic [barcode part1]
aatctcggaacggacg

SEQ ID NO: 3268 - DNA, 16 bp, Artificial Sequence
  synthetic [barcode part1]
gatagagagttgcact

SEQ ID NO: 3269 - DNA, 16 bp, Artificial Sequence
  synthetic [barcode part1]
tggtacacttcaccgc

SEQ ID NO: 3270 - DNA, 16 bp, Artificial Sequence
  synthetic [barcode part1]
aacgttcttcgatctg

SEQ ID NO: 3271 - DNA, 16 bp, Artificial Sequence
  synthetic [barcode part1]
agacttatcgcacggt

SEQ ID NO: 3272 - DNA, 16 bp, Artificial Sequence
  synthetic [barcode part1]
gtgtcaatctcactac

SEQ ID NO: 3273 - DNA, 16 bp, Artificial Sequence
  synthetic [barcode part1]
gagtggattcaaggcc

SEQ ID NO: 3274 - DNA, 16 bp, Artificial Sequence
  synthetic [barcode part1]
caggttactggactac

SEQ ID NO: 3275 - DNA, 16 bp, Artificial Sequence
  synthetic [barcode part1]
attcgactcaacggtg

SEQ ID NO: 3276 - DNA, 16 bp, Artificial Sequence
  synthetic [barcode part1]
tgagaggcagtacgtc

SEQ ID NO: 3277 - DNA, 16 bp, Artificial Sequence
  synthetic [barcode part1]
aggttaccaagtcgtc

SEQ ID NO: 3278 - DNA, 16 bp, Artificial Sequence
  synthetic [barcode part1]
tgactgtgttcagacg

SEQ ID NO: 3279 - DNA, 16 bp, Artificial Sequence
  synthetic [barcode part1]
ccacgtcaatagttct

SEQ ID NO: 3280 - DNA, 16 bp, Artificial Sequence
  synthetic [barcode part1]
acgtgcaatcgactgt

SEQ ID NO: 3281 - DNA, 16 bp, Artificial Sequence
  synthetic [barcode part1]
tgactcaacctccacg

SEQ ID NO: 3282 - DNA, 16 bp, Artificial Sequence
  synthetic [barcode part1]
atcctgttcacacagt

SEQ ID NO: 3283 - DNA, 16 bp, Artificial Sequence
  synthetic [barcode part1]
tacacacgttgcaacg

SEQ ID NO: 3284 - DNA, 16 bp, Artificial Sequence
  synthetic [barcode part1]
cggactctattacttg

SEQ ID NO: 3285 - DNA, 16 bp, Artificial Sequence
  synthetic [barcode part1]
tatctcgacgagttct

SEQ ID NO: 3286 - DNA, 16 bp, Artificial Sequence
  synthetic [barcode part1]
gttaggcactcctatt

SEQ ID NO: 3287 - DNA, 16 bp, Artificial Sequence
  synthetic [barcode part1]
gagtctaccaccgttc

SEQ ID NO: 3288 - DNA, 16 bp, Artificial Sequence
  synthetic [barcode part1]
cactaggcctgatagt

SEQ ID NO: 3289 - DNA, 16 bp, Artificial Sequence
  synthetic [barcode part1]
tccgtgtatcgtcgac

SEQ ID NO: 3290 - DNA, 16 bp, Artificial Sequence
  synthetic [barcode part1]
tgtcgagtctgcgtct

SEQ ID NO: 3291 - DNA, 16 bp, Artificial Sequence
  synthetic [barcode part1]
cgttacctagacttac

SEQ ID NO: 3292 - DNA, 16 bp, Artificial Sequence
  synthetic [barcode part1]
aaccgattgtgcgtac

SEQ ID NO: 3293 - DNA, 16 bp, Artificial Sequence
  synthetic [barcode part1]
tcgagtacttgagtgc

SEQ ID NO: 3294 - DNA, 16 bp, Artificial Sequence
  synthetic [barcode part1]
ataagacggcgtccag

SEQ ID NO: 3295 - DNA, 16 bp, Artificial Sequence
  synthetic [barcode part1]
aactcgtcaggacgag

SEQ ID NO: 3296 - DNA, 16 bp, Artificial Sequence
  synthetic [barcode part1]
tctgtcaatcgcctct

SEQ ID NO: 3297 - DNA, 16 bp, Artificial Sequence
  synthetic [barcode part1]
tgagaggcaactgcac

SEQ ID NO: 3298 - DNA, 16 bp, Artificial Sequence
  synthetic [barcode part1]
tagagtcctgagatcc

SEQ ID NO: 3299 - DNA, 16 bp, Artificial Sequence
  synthetic [barcode part1]
gactgtggccgatatt

SEQ ID NO: 3300 - DNA, 16 bp, Artificial Sequence
  synthetic [barcode part1]
ttcaacctgcacaact

SEQ ID NO: 3301 - DNA, 16 bp, Artificial Sequence
  synthetic [barcode part1]
attcgccgaatagacc

SEQ ID NO: 3302 - DNA, 16 bp, Artificial Sequence
  synthetic [barcode part1]
cagaggacacgtaacc

SEQ ID NO: 3303 - DNA, 16 bp, Artificial Sequence
  synthetic [barcode part1]
ccgttcagtgatattc

SEQ ID NO: 3304 - DNA, 16 bp, Artificial Sequence
  synthetic [barcode part1]
acaaggagagacacgt

SEQ ID NO: 3305 - DNA, 16 bp, Artificial Sequence
  synthetic [barcode part1]
cagattcttgtggacg

SEQ ID NO: 3306 - DNA, 16 bp, Artificial Sequence
  synthetic [barcode part1]
gaacaggagatcctgc

SEQ ID NO: 3307 - DNA, 16 bp, Artificial Sequence
  synthetic [barcode part1]
cgtagagtcaacgacg

SEQ ID NO: 3308 - DNA, 16 bp, Artificial Sequence
  synthetic [barcode part1]
tgaaggatctcctggt

SEQ ID NO: 3309 - DNA, 16 bp, Artificial Sequence
  synthetic [barcode part1]
gcggatcggttatatc

SEQ ID NO: 3310 - DNA, 16 bp, Artificial Sequence
  synthetic [barcode part1]
ttgtatcaacggttcc

SEQ ID NO: 3311 - DNA, 16 bp, Artificial Sequence
  synthetic [barcode part1]
agtggtcaccgaactt

SEQ ID NO: 3312 - DNA, 16 bp, Artificial Sequence
  synthetic [barcode part1]
acttactggtaggtgc

SEQ ID NO: 3313 - DNA, 16 bp, Artificial Sequence
  synthetic [barcode part1]
cgtcgttgacgtgttc

SEQ ID NO: 3314 - DNA, 16 bp, Artificial Sequence
  synthetic [barcode part1]
acgcctcgttgagtct

SEQ ID NO: 3315 - DNA, 16 bp, Artificial Sequence
  synthetic [barcode part1]
cagattgttcctgcgc

SEQ ID NO: 3316 - DNA, 16 bp, Artificial Sequence
  synthetic [barcode part1]
ccgaagtcgttgtagt

SEQ ID NO: 3317 - DNA, 16 bp, Artificial Sequence
  synthetic [barcode part1]
attagagatcaacgcg

SEQ ID NO: 3318 - DNA, 16 bp, Artificial Sequence
  synthetic [barcode part1]
gcgttaagtgtagtcc

SEQ ID NO: 3319 - DNA, 16 bp, Artificial Sequence
  synthetic [barcode part1]
caaggaccttggtgag

SEQ ID NO: 3320 - DNA, 16 bp, Artificial Sequence
  synthetic [barcode part1]
attcttgatagtccgc

SEQ ID NO: 3321 - DNA, 16 bp, Artificial Sequence
  synthetic [barcode part1]
aatactacggtcgacc

SEQ ID NO: 3322 - DNA, 16 bp, Artificial Sequence
  synthetic [barcode part1]
aagacggaacacctgc

SEQ ID NO: 3323 - DNA, 16 bp, Artificial Sequence
  synthetic [barcode part1]
tggtacgacgtgatct

SEQ ID NO: 3324 - DNA, 16 bp, Artificial Sequence
  synthetic [barcode part1]
attccacacgagacgt

SEQ ID NO: 3325 - DNA, 16 bp, Artificial Sequence
  synthetic [barcode part1]
tccggttatatcaacc

SEQ ID NO: 3326 - DNA, 16 bp, Artificial Sequence
  synthetic [barcode part1]
cagttgtgagtacctg

SEQ ID NO: 3327 - DNA, 16 bp, Artificial Sequence
  synthetic [barcode part1]
tccttctgttggttgc

SEQ ID NO: 3328 - DNA, 16 bp, Artificial Sequence
  synthetic [barcode part1]
tcgtgttccaccgagt

SEQ ID NO: 3329 - DNA, 16 bp, Artificial Sequence
  synthetic [barcode part1]
acgtcggtgtaagttc

SEQ ID NO: 3330 - DNA, 16 bp, Artificial Sequence
  synthetic [barcode part1]
gtccgtcgtcctaagt

SEQ ID NO: 3331 - DNA, 16 bp, Artificial Sequence
  synthetic [barcode part1]
caccacgactatagtg

SEQ ID NO: 3332 - DNA, 16 bp, Artificial Sequence
  synthetic [barcode part1]
atatctctcggatcac

SEQ ID NO: 3333 - DNA, 16 bp, Artificial Sequence
  synthetic [barcode part1]
gcactgcgtgatattg

SEQ ID NO: 3334 - DNA, 16 bp, Artificial Sequence
  synthetic [barcode part1]
cggcacagatctatac

SEQ ID NO: 3335 - DNA, 16 bp, Artificial Sequence
  synthetic [barcode part1]
tctggcgcagaagtag

SEQ ID NO: 3336 - DNA, 16 bp, Artificial Sequence
  synthetic [barcode part1]
cgcaggcagtaggatt

SEQ ID NO: 3337 - DNA, 16 bp, Artificial Sequence
  synthetic [barcode part1]
acaaggactggcggtt

SEQ ID NO: 3338 - DNA, 16 bp, Artificial Sequence
  synthetic [barcode part1]
gtgtgttgcggaacag

SEQ ID NO: 3339 - DNA, 16 bp, Artificial Sequence
  synthetic [barcode part1]
gaccttcgtgcaatcc

SEQ ID NO: 3340 - DNA, 16 bp, Artificial Sequence
  synthetic [barcode part1]
gtgtatcctcggtctg

SEQ ID NO: 3341 - DNA, 16 bp, Artificial Sequence
  synthetic [barcode part1]
gacggataacgtcacg

SEQ ID NO: 3342 - DNA, 16 bp, Artificial Sequence
  synthetic [barcode part1]
aattcctgcgtctggc

SEQ ID NO: 3343 - DNA, 16 bp, Artificial Sequence
  synthetic [barcode part1]
acgaggatctctgtac

SEQ ID NO: 3344 - DNA, 16 bp, Artificial Sequence
  synthetic [barcode part1]
cctatcaccgaatact

SEQ ID NO: 3345 - DNA, 16 bp, Artificial Sequence
  synthetic [barcode part1]
gagacaaggacttact

SEQ ID NO: 3346 - DNA, 16 bp, Artificial Sequence
  synthetic [barcode part1]
cagagtcttggaacct

SEQ ID NO: 3347 - DNA, 16 bp, Artificial Sequence
  synthetic [barcode part1]
caatccttccttcggt

SEQ ID NO: 3348 - DNA, 16 bp, Artificial Sequence
  synthetic [barcode part1]
gacttgttggaacaag

SEQ ID NO: 3349 - DNA, 16 bp, Artificial Sequence
  synthetic [barcode part1]
tccgtaatcgtgaacg

SEQ ID NO: 3350 - DNA, 16 bp, Artificial Sequence
  synthetic [barcode part1]
aggattctcgcaacac

SEQ ID NO: 3351 - DNA, 16 bp, Artificial Sequence
  synthetic [barcode part1]
cgacttctaaccgcac

SEQ ID NO: 3352 - DNA, 16 bp, Artificial Sequence
  synthetic [barcode part1]
aagaaggccagtcaag

SEQ ID NO: 3353 - DNA, 16 bp, Artificial Sequence
  synthetic [barcode part1]
agtctgactagatcgc

SEQ ID NO: 3354 - DNA, 16 bp, Artificial Sequence
  synthetic [barcode part1]
actacgaaggttctgc

SEQ ID NO: 3355 - DNA, 16 bp, Artificial Sequence
  synthetic [barcode part1]
cagaacttgcggtatc

SEQ ID NO: 3356 - DNA, 16 bp, Artificial Sequence
  synthetic [barcode part1]
tcttgcgttgacaatc

SEQ ID NO: 3357 - DNA, 16 bp, Artificial Sequence
  synthetic [barcode part1]
taatagtgtgcaaggc

SEQ ID NO: 3358 - DNA, 16 bp, Artificial Sequence
  synthetic [barcode part1]
tgttggagtccttgcc

SEQ ID NO: 3359 - DNA, 16 bp, Artificial Sequence
  synthetic [barcode part1]
accgtcggattatcag

SEQ ID NO: 3360 - DNA, 16 bp, Artificial Sequence
  synthetic [barcode part1]
acgaccaggagaacct

SEQ ID NO: 3361 - DNA, 16 bp, Artificial Sequence
  synthetic [barcode part1]
gttccaatcttcctcg

SEQ ID NO: 3362 - DNA, 16 bp, Artificial Sequence
  synthetic [barcode part1]
tgaagtacactctgcg

SEQ ID NO: 3363 - DNA, 16 bp, Artificial Sequence
  synthetic [barcode part1]
accttgatctcctctg

SEQ ID NO: 3364 - DNA, 16 bp, Artificial Sequence
  synthetic [barcode part1]
gttcaggcactcaagt

SEQ ID NO: 3365 - DNA, 16 bp, Artificial Sequence
  synthetic [barcode part1]
aatctggcgcaggaac

SEQ ID NO: 3366 - DNA, 16 bp, Artificial Sequence
  synthetic [barcode part1]
aattggactcggtctg

SEQ ID NO: 3367 - DNA, 16 bp, Artificial Sequence
  synthetic [barcode part1]
cgcaagactagaccag

SEQ ID NO: 3368 - DNA, 16 bp, Artificial Sequence
  synthetic [barcode part1]
ttgaacaggcagaact

SEQ ID NO: 3369 - DNA, 16 bp, Artificial Sequence
  synthetic [barcode part1]
aggcctctggtattag

SEQ ID NO: 3370 - DNA, 16 bp, Artificial Sequence
  synthetic [barcode part1]
ttggaacacagtgtcc

SEQ ID NO: 3371 - DNA, 16 bp, Artificial Sequence
  synthetic [barcode part1]
tcacctcctaggtgtg

SEQ ID NO: 3372 - DNA, 16 bp, Artificial Sequence
  synthetic [barcode part1]
tgccggttaactgtag

SEQ ID NO: 3373 - DNA, 16 bp, Artificial Sequence
  synthetic [barcode part1]
gtgacgagtgattgcg

SEQ ID NO: 3374 - DNA, 16 bp, Artificial Sequence
  synthetic [barcode part1]
gtgttctattaccggt

SEQ ID NO: 3375 - DNA, 16 bp, Artificial Sequence
  synthetic [barcode part1]
gtcgtagaggtaagtt

SEQ ID NO: 3376 - DNA, 16 bp, Artificial Sequence
  synthetic [barcode part1]
gcctacgtatagactg

SEQ ID NO: 3377 - DNA, 16 bp, Artificial Sequence
  synthetic [barcode part1]
taacggtagaggcgtc

SEQ ID NO: 3378 - DNA, 16 bp, Artificial Sequence
  synthetic [barcode part1]
gacgagattcctgatc

SEQ ID NO: 3379 - DNA, 16 bp, Artificial Sequence
  synthetic [barcode part1]
ttatattcgccagacc

SEQ ID NO: 3380 - DNA, 16 bp, Artificial Sequence
  synthetic [barcode part1]
caagtctaagttcgcg

SEQ ID NO: 3381 - DNA, 16 bp, Artificial Sequence
  synthetic [barcode part1]
cagagttaatctcggc

SEQ ID NO: 3382 - DNA, 16 bp, Artificial Sequence
  synthetic [barcode part1]
gtcacgagtagacggt

SEQ ID NO: 3383 - DNA, 16 bp, Artificial Sequence
  synthetic [barcode part1]
atcagtagtggccgtt

SEQ ID NO: 3384 - DNA, 16 bp, Artificial Sequence
  synthetic [barcode part1]
acaccgcacaatatcg

SEQ ID NO: 3385 - DNA, 16 bp, Artificial Sequence
  synthetic [barcode part1]
tcaacagtgccgaatc

SEQ ID NO: 3386 - DNA, 16 bp, Artificial Sequence
  synthetic [barcode part1]
ttcgaggtcagtcagt

SEQ ID NO: 3387 - DNA, 16 bp, Artificial Sequence
  synthetic [barcode part1]
atcttcagtccaacac

SEQ ID NO: 3388 - DNA, 16 bp, Artificial Sequence
  synthetic [barcode part1]
tctctaatctcctggc

SEQ ID NO: 3389 - DNA, 16 bp, Artificial Sequence
  synthetic [barcode part1]
gagataacagagtggc

SEQ ID NO: 3390 - DNA, 16 bp, Artificial Sequence
  synthetic [barcode part1]
tggtccttgtaattgc

SEQ ID NO: 3391 - DNA, 16 bp, Artificial Sequence
  synthetic [barcode part1]
aatcttcgtcggagac

SEQ ID NO: 3392 - DNA, 16 bp, Artificial Sequence
  synthetic [barcode part1]
atcagtccgtagtgtg

SEQ ID NO: 3393 - DNA, 16 bp, Artificial Sequence
  synthetic [barcode part1]
ttactacgcagtggac

SEQ ID NO: 3394 - DNA, 16 bp, Artificial Sequence
  synthetic [barcode part1]
gtcgtgagacactgtt

SEQ ID NO: 3395 - DNA, 16 bp, Artificial Sequence
  synthetic [barcode part1]
actggagagaactgag

SEQ ID NO: 3396 - DNA, 16 bp, Artificial Sequence
  synthetic [barcode part1]
tgtacgtaccacaacg

SEQ ID NO: 3397 - DNA, 16 bp, Artificial Sequence
  synthetic [barcode part1]
caccgagatagtctac

SEQ ID NO: 3398 - DNA, 16 bp, Artificial Sequence
  synthetic [barcode part1]
tcagtgtggttcctcg

SEQ ID NO: 3399 - DNA, 16 bp, Artificial Sequence
  synthetic [barcode part1]
taagtcaggcctgact

SEQ ID NO: 3400 - DNA, 16 bp, Artificial Sequence
  synthetic [barcode part1]
aagaccgcgcaagttg

SEQ ID NO: 3401 - DNA, 16 bp, Artificial Sequence
  synthetic [barcode part1]
tgagttccttggacag

SEQ ID NO: 3402 - DNA, 16 bp, Artificial Sequence
  synthetic [barcode part1]
cctctgttcaccagag

SEQ ID NO: 3403 - DNA, 16 bp, Artificial Sequence
  synthetic [barcode part1]
tgtgtcttccaacagt

SEQ ID NO: 3404 - DNA, 16 bp, Artificial Sequence
  synthetic [barcode part1]
gagacactacgtcttg

SEQ ID NO: 3405 - DNA, 16 bp, Artificial Sequence
  synthetic [barcode part1]
gagagaactaggatcg

SEQ ID NO: 3406 - DNA, 16 bp, Artificial Sequence
  synthetic [barcode part1]
ttcgagatagtcggtc

SEQ ID NO: 3407 - DNA, 16 bp, Artificial Sequence
  synthetic [barcode part1]
taggcgtctctattgt

SEQ ID NO: 3408 - DNA, 16 bp, Artificial Sequence
  synthetic [barcode part1]
tctcctgagactagag

SEQ ID NO: 3409 - DNA, 16 bp, Artificial Sequence
  synthetic [barcode part1]
cgaccaattggaacct

SEQ ID NO: 3410 - DNA, 16 bp, Artificial Sequence
  synthetic [barcode part1]
gaattgtgtccggtgt

SEQ ID NO: 3411 - DNA, 16 bp, Artificial Sequence
  synthetic [barcode part1]
aggtcttctccagaag

SEQ ID NO: 3412 - DNA, 16 bp, Artificial Sequence
  synthetic [barcode part1]
gcgaaggactattagt

SEQ ID NO: 3413 - DNA, 16 bp, Artificial Sequence
  synthetic [barcode part1]
gttgtcaccaagtcag

SEQ ID NO: 3414 - DNA, 16 bp, Artificial Sequence
  synthetic [barcode part1]
gaactacacctaacgc

SEQ ID NO: 3415 - DNA, 16 bp, Artificial Sequence
  synthetic [barcode part1]
attctgtacaaccacc

SEQ ID NO: 3416 - DNA, 16 bp, Artificial Sequence
  synthetic [barcode part1]
tctcctcttggagtct

SEQ ID NO: 3417 - DNA, 16 bp, Artificial Sequence
  synthetic [barcode part1]
aggtactaacgtccac

SEQ ID NO: 3418 - DNA, 16 bp, Artificial Sequence
  synthetic [barcode part1]
ttccacaccggcgatt

SEQ ID NO: 3419 - DNA, 16 bp, Artificial Sequence
  synthetic [barcode part1]
aacaccaacacacgtc

SEQ ID NO: 3420 - DNA, 16 bp, Artificial Sequence
  synthetic [barcode part1]
cctaacttcggaaggt

SEQ ID NO: 3421 - DNA, 16 bp, Artificial Sequence
  synthetic [barcode part1]
actcagtggttaccag

SEQ ID NO: 3422 - DNA, 16 bp, Artificial Sequence
  synthetic [barcode part1]
gaattgttccggtggt

SEQ ID NO: 3423 - DNA, 16 bp, Artificial Sequence
  synthetic [barcode part1]
caaccaatcgatcgac

SEQ ID NO: 3424 - DNA, 16 bp, Artificial Sequence
  synthetic [barcode part1]
gtcgtaacaggattcc

SEQ ID NO: 3425 - DNA, 16 bp, Artificial Sequence
  synthetic [barcode part1]
cactctccgacagttg

SEQ ID NO: 3426 - DNA, 16 bp, Artificial Sequence
  synthetic [barcode part1]
acggagagtattcctc

SEQ ID NO: 3427 - DNA, 16 bp, Artificial Sequence
  synthetic [barcode part1]
tacgcgacactagtgt

SEQ ID NO: 3428 - DNA, 16 bp, Artificial Sequence
  synthetic [barcode part1]
accgttatagtgaccg

SEQ ID NO: 3429 - DNA, 16 bp, Artificial Sequence
  synthetic [barcode part1]
atcgcggttacttgcc

SEQ ID NO: 3430 - DNA, 16 bp, Artificial Sequence
  synthetic [barcode part1]
tgtacttgagtacggc

SEQ ID NO: 3431 - DNA, 16 bp, Artificial Sequence
  synthetic [barcode part1]
cgttaccgtaagacac

SEQ ID NO: 3432 - DNA, 16 bp, Artificial Sequence
  synthetic [barcode part1]
accaccgagttatcag

SEQ ID NO: 3433 - DNA, 16 bp, Artificial Sequence
  synthetic [barcode part1]
accgaacggtacgagt

SEQ ID NO: 3434 - DNA, 16 bp, Artificial Sequence
  synthetic [barcode part1]
aactctgcgttcgtcg

SEQ ID NO: 3435 - DNA, 16 bp, Artificial Sequence
  synthetic [barcode part1]
attgcagacctatctc

SEQ ID NO: 3436 - DNA, 16 bp, Artificial Sequence
  synthetic [barcode part1]
aatcttcaatccgtgc

SEQ ID NO: 3437 - DNA, 16 bp, Artificial Sequence
  synthetic [barcode part1]
agaggcaacaagaacc

SEQ ID NO: 3438 - DNA, 16 bp, Artificial Sequence
  synthetic [barcode part1]
tacaggtctatcctac

SEQ ID NO: 3439 - DNA, 16 bp, Artificial Sequence
  synthetic [barcode part1]
gaacgtgccagatcag

SEQ ID NO: 3440 - DNA, 16 bp, Artificial Sequence
  synthetic [barcode part1]
gcgtagaggactgttg

SEQ ID NO: 3441 - DNA, 16 bp, Artificial Sequence
  synthetic [barcode part1]
tccgattaccggcact

SEQ ID NO: 3442 - DNA, 16 bp, Artificial Sequence
  synthetic [barcode part1]
ttcagttactacacgc

SEQ ID NO: 3443 - DNA, 16 bp, Artificial Sequence
  synthetic [barcode part1]
tctgcgcgactgttgt

SEQ ID NO: 3444 - DNA, 16 bp, Artificial Sequence
  synthetic [barcode part1]
cgtatcctcgtattcc

SEQ ID NO: 3445 - DNA, 16 bp, Artificial Sequence
  synthetic [barcode part1]
acttcttgtgtcagtg

SEQ ID NO: 3446 - DNA, 16 bp, Artificial Sequence
  synthetic [barcode part1]
tatcacgtgtaacgcg

SEQ ID NO: 3447 - DNA, 16 bp, Artificial Sequence
  synthetic [barcode part1]
taggatatctgcagag

SEQ ID NO: 3448 - DNA, 16 bp, Artificial Sequence
  synthetic [barcode part1]
cagatacactaccttc

SEQ ID NO: 3449 - DNA, 16 bp, Artificial Sequence
  synthetic [barcode part1]
gacttgtacttcactg

SEQ ID NO: 3450 - DNA, 16 bp, Artificial Sequence
  synthetic [barcode part1]
gtccaatccgaactag

SEQ ID NO: 3451 - DNA, 16 bp, Artificial Sequence
  synthetic [barcode part1]
acgattggagaccgac

SEQ ID NO: 3452 - DNA, 16 bp, Artificial Sequence
  synthetic [barcode part1]
ttccgtgtagtagttc

SEQ ID NO: 3453 - DNA, 16 bp, Artificial Sequence
  synthetic [barcode part1]
tccactcgttctggag

SEQ ID NO: 3454 - DNA, 16 bp, Artificial Sequence
  synthetic [barcode part1]
agaaccttctggaacc

SEQ ID NO: 3455 - DNA, 16 bp, Artificial Sequence
  synthetic [barcode part1]
gccaacaacctaggtt

SEQ ID NO: 3456 - DNA, 16 bp, Artificial Sequence
  synthetic [barcode part1]
tagagaacgtacggcc

SEQ ID NO: 3457 - DNA, 16 bp, Artificial Sequence
  synthetic [barcode part1]
cggatacaccgtctct

SEQ ID NO: 3458 - DNA, 16 bp, Artificial Sequence
  synthetic [barcode part1]
tcttgttagacggcag

SEQ ID NO: 3459 - DNA, 16 bp, Artificial Sequence
  synthetic [barcode part1]
atacgaacgtcaagtg

SEQ ID NO: 3460 - DNA, 16 bp, Artificial Sequence
  synthetic [barcode part1]
cggcacacgtattaac

SEQ ID NO: 3461 - DNA, 16 bp, Artificial Sequence
  synthetic [barcode part1]
agtagagaggaaccgt

SEQ ID NO: 3462 - DNA, 16 bp, Artificial Sequence
  synthetic [barcode part1]
actgtacctaggtacg

SEQ ID NO: 3463 - DNA, 16 bp, Artificial Sequence
  synthetic [barcode part1]
cacaatcaaggtggcg

SEQ ID NO: 3464 - DNA, 16 bp, Artificial Sequence
  synthetic [barcode part1]
gtatcgagactcgtac

SEQ ID NO: 3465 - DNA, 16 bp, Artificial Sequence
  synthetic [barcode part1]
agacactgttctgttc

SEQ ID NO: 3466 - DNA, 16 bp, Artificial Sequence
  synthetic [barcode part1]
tcgtcgcacttgtggt

SEQ ID NO: 3467 - DNA, 16 bp, Artificial Sequence
  synthetic [barcode part1]
attgacgttgccgtcc

SEQ ID NO: 3468 - DNA, 16 bp, Artificial Sequence
  synthetic [barcode part1]
actcttaacttgacgc

SEQ ID NO: 3469 - DNA, 16 bp, Artificial Sequence
  synthetic [barcode part1]
ttctaactctcgtcgc

SEQ ID NO: 3470 - DNA, 16 bp, Artificial Sequence
  synthetic [barcode part1]
ccgattcgtgattatc

SEQ ID NO: 3471 - DNA, 16 bp, Artificial Sequence
  synthetic [barcode part1]
tattgagtggaggtgt

SEQ ID NO: 3472 - DNA, 16 bp, Artificial Sequence
  synthetic [barcode part1]
tcggttagagacttcg

SEQ ID NO: 3473 - DNA, 16 bp, Artificial Sequence
  synthetic [barcode part1]
gacgtatcacgtaacc

SEQ ID NO: 3474 - DNA, 16 bp, Artificial Sequence
  synthetic [barcode part1]
tagactggatcactgc

SEQ ID NO: 3475 - DNA, 16 bp, Artificial Sequence
  synthetic [barcode part1]
cgcgatatccagaact

SEQ ID NO: 3476 - DNA, 16 bp, Artificial Sequence
  synthetic [barcode part1]
gtaccggttctaccac

SEQ ID NO: 3477 - DNA, 16 bp, Artificial Sequence
  synthetic [barcode part1]
gcaaggatacacttcc

SEQ ID NO: 3478 - DNA, 16 bp, Artificial Sequence
  synthetic [barcode part1]
tactgttacgaccgcc

SEQ ID NO: 3479 - DNA, 16 bp, Artificial Sequence
  synthetic [barcode part1]
cgtattcagtgcgagt

SEQ ID NO: 3480 - DNA, 16 bp, Artificial Sequence
  synthetic [barcode part1]
agtaaggtggccttct

SEQ ID NO: 3481 - DNA, 16 bp, Artificial Sequence
  synthetic [barcode part1]
actgtcctccgagtac

SEQ ID NO: 3482 - DNA, 16 bp, Artificial Sequence
  synthetic [barcode part1]
cgaggtaagtgtaccg

SEQ ID NO: 3483 - DNA, 16 bp, Artificial Sequence
  synthetic [barcode part1]
aaggcacaatccgacg

SEQ ID NO: 3484 - DNA, 16 bp, Artificial Sequence
  synthetic [barcode part1]
ccttcttgttgtgacc

SEQ ID NO: 3485 - DNA, 16 bp, Artificial Sequence
  synthetic [barcode part1]
aacgtcaggttgactc

SEQ ID NO: 3486 - DNA, 16 bp, Artificial Sequence
  synthetic [barcode part1]
tgttctggcgaatctt

SEQ ID NO: 3487 - DNA, 16 bp, Artificial Sequence
  synthetic [barcode part1]
tgtaccttgaaggcgt

SEQ ID NO: 3488 - DNA, 16 bp, Artificial Sequence
  synthetic [barcode part1]
acacggaacaagaacg

SEQ ID NO: 3489 - DNA, 16 bp, Artificial Sequence
  synthetic [barcode part1]
caagtcagactcgatc

SEQ ID NO: 3490 - DNA, 16 bp, Artificial Sequence
  synthetic [barcode part1]
tattccgacgagtctt

SEQ ID NO: 3491 - DNA, 16 bp, Artificial Sequence
  synthetic [barcode part1]
atcctagtgacgtcag

SEQ ID NO: 3492 - DNA, 16 bp, Artificial Sequence
  synthetic [barcode part1]
actctaccggagagtt

SEQ ID NO: 3493 - DNA, 16 bp, Artificial Sequence
  synthetic [barcode part1]
gccttacaggtgttcc

SEQ ID NO: 3494 - DNA, 16 bp, Artificial Sequence
  synthetic [barcode part1]
cctaccgatcactctt

SEQ ID NO: 3495 - DNA, 16 bp, Artificial Sequence
  synthetic [barcode part1]
accacctgacgtctac

SEQ ID NO: 3496 - DNA, 16 bp, Artificial Sequence
  synthetic [barcode part1]
ccttgcgttagaccgt

SEQ ID NO: 3497 - DNA, 16 bp, Artificial Sequence
  synthetic [barcode part1]
gtgactagttacgtgc

SEQ ID NO: 3498 - DNA, 16 bp, Artificial Sequence
  synthetic [barcode part1]
acgtcctgacctgatc

SEQ ID NO: 3499 - DNA, 16 bp, Artificial Sequence
  synthetic [barcode part1]
actccgtaatagtggc

SEQ ID NO: 3500 - DNA, 16 bp, Artificial Sequence
  synthetic [barcode part1]
tcgtcacgatagaacc

SEQ ID NO: 3501 - DNA, 16 bp, Artificial Sequence
  synthetic [barcode part1]
tggtgagagactcgtg

SEQ ID NO: 3502 - DNA, 16 bp, Artificial Sequence
  synthetic [barcode part1]
tagtgaacggatactg

SEQ ID NO: 3503 - DNA, 16 bp, Artificial Sequence
  synthetic [barcode part1]
cgcagtggtgatattc

SEQ ID NO: 3504 - DNA, 16 bp, Artificial Sequence
  synthetic [barcode part1]
ccgcgaagaactgaac

SEQ ID NO: 3505 - DNA, 16 bp, Artificial Sequence
  synthetic [barcode part1]
atcagatacggagact

SEQ ID NO: 3506 - DNA, 16 bp, Artificial Sequence
  synthetic [barcode part1]
tccgatctggttgcac

SEQ ID NO: 3507 - DNA, 16 bp, Artificial Sequence
  synthetic [barcode part1]
tgcgataagtaggtac

SEQ ID NO: 3508 - DNA, 16 bp, Artificial Sequence
  synthetic [barcode part1]
gacaccaaccacagtt

SEQ ID NO: 3509 - DNA, 16 bp, Artificial Sequence
  synthetic [barcode part1]
gaatagtcgacgagag

SEQ ID NO: 3510 - DNA, 16 bp, Artificial Sequence
  synthetic [barcode part1]
tgcaatagtagacggt

SEQ ID NO: 3511 - DNA, 16 bp, Artificial Sequence
  synthetic [barcode part1]
tcttggcgcgtctaac

SEQ ID NO: 3512 - DNA, 16 bp, Artificial Sequence
  synthetic [barcode part1]
gagtgaccacagatcg

SEQ ID NO: 3513 - DNA, 16 bp, Artificial Sequence
  synthetic [barcode part1]
cgtccgtcaaggtctt

SEQ ID NO: 3514 - DNA, 16 bp, Artificial Sequence
  synthetic [barcode part1]
tatcttgcgagtgttc

SEQ ID NO: 3515 - DNA, 16 bp, Artificial Sequence
  synthetic [barcode part1]
actgcgaataggcggt

SEQ ID NO: 3516 - DNA, 16 bp, Artificial Sequence
  synthetic [barcode part1]
acgtggacaccaagtg

SEQ ID NO: 3517 - DNA, 16 bp, Artificial Sequence
  synthetic [barcode part1]
cggccagtcaattagt

SEQ ID NO: 3518 - DNA, 16 bp, Artificial Sequence
  synthetic [barcode part1]
tctacgtacacggagt

SEQ ID NO: 3519 - DNA, 16 bp, Artificial Sequence
  synthetic [barcode part1]
gttagtctgtgacgtg

SEQ ID NO: 3520 - DNA, 16 bp, Artificial Sequence
  synthetic [barcode part1]
tgacctaggtgacttg

SEQ ID NO: 3521 - DNA, 16 bp, Artificial Sequence
  synthetic [barcode part1]
acaccggtataccaac

SEQ ID NO: 3522 - DNA, 16 bp, Artificial Sequence
  synthetic [barcode part1]
ccacttaccacgacgt

SEQ ID NO: 3523 - DNA, 16 bp, Artificial Sequence
  synthetic [barcode part1]
gagtggtacgtgactg

SEQ ID NO: 3524 - DNA, 16 bp, Artificial Sequence
  synthetic [barcode part1]
tctgaccgcactagtc

SEQ ID NO: 3525 - DNA, 16 bp, Artificial Sequence
  synthetic [barcode part1]
aaccgttcttgtatcg

SEQ ID NO: 3526 - DNA, 16 bp, Artificial Sequence
  synthetic [barcode part1]
gttgtctaggcctatt

SEQ ID NO: 3527 - DNA, 16 bp, Artificial Sequence
  synthetic [barcode part1]
gatacctcggatctag

SEQ ID NO: 3528 - DNA, 16 bp, Artificial Sequence
  synthetic [barcode part1]
tctaatcgtatcgacc

SEQ ID NO: 3529 - DNA, 16 bp, Artificial Sequence
  synthetic [barcode part1]
gcaagtcctccactgt

SEQ ID NO: 3530 - DNA, 16 bp, Artificial Sequence
  synthetic [barcode part1]
tgttcttgactgtcag

SEQ ID NO: 3531 - DNA, 16 bp, Artificial Sequence
  synthetic [barcode part1]
ttgtcttgcgcaaccg

SEQ ID NO: 3532 - DNA, 16 bp, Artificial Sequence
  synthetic [barcode part1]
atcacgatatccgttc

SEQ ID NO: 3533 - DNA, 16 bp, Artificial Sequence
  synthetic [barcode part1]
acgattagaggaacct

SEQ ID NO: 3534 - DNA, 16 bp, Artificial Sequence
  synthetic [barcode part1]
aatcacgtgatacgcc

SEQ ID NO: 3535 - DNA, 16 bp, Artificial Sequence
  synthetic [barcode part1]
gcgtgtatctcttcct

SEQ ID NO: 3536 - DNA, 16 bp, Artificial Sequence
  synthetic [barcode part1]
gcaattccagaggcag

SEQ ID NO: 3537 - DNA, 16 bp, Artificial Sequence
  synthetic [barcode part1]
tgtacgatacttcacc

SEQ ID NO: 3538 - DNA, 16 bp, Artificial Sequence
  synthetic [barcode part1]
aacaattccggcaacc

SEQ ID NO: 3539 - DNA, 16 bp, Artificial Sequence
  synthetic [barcode part1]
ttggacttcttacgtg

SEQ ID NO: 3540 - DNA, 16 bp, Artificial Sequence
  synthetic [barcode part1]
cacgtagaggtacctt

SEQ ID NO: 3541 - DNA, 16 bp, Artificial Sequence
  synthetic [barcode part1]
cgcgatcttaagtgtg

SEQ ID NO: 3542 - DNA, 16 bp, Artificial Sequence
  synthetic [barcode part1]
agaagttcgacgtgcg

SEQ ID NO: 3543 - DNA, 16 bp, Artificial Sequence
  synthetic [barcode part1]
gcactggtgtactaac

SEQ ID NO: 3544 - DNA, 16 bp, Artificial Sequence
  synthetic [barcode part1]
ccttgtgaattcaacc

SEQ ID NO: 3545 - DNA, 16 bp, Artificial Sequence
  synthetic [barcode part1]
gcactgcctattcgtg

SEQ ID NO: 3546 - DNA, 16 bp, Artificial Sequence
  synthetic [barcode part1]
gtgagttgccaggaac

SEQ ID NO: 3547 - DNA, 16 bp, Artificial Sequence
  synthetic [barcode part1]
ttgtcaccttgagtgt

SEQ ID NO: 3548 - DNA, 16 bp, Artificial Sequence
  synthetic [barcode part1]
gcagacaacttactcg

SEQ ID NO: 3549 - DNA, 16 bp, Artificial Sequence
  synthetic [barcode part1]
gtaggagaagagtgtc

SEQ ID NO: 3550 - DNA, 16 bp, Artificial Sequence
  synthetic [barcode part1]
tgcctaattaggtgcg

SEQ ID NO: 3551 - DNA, 16 bp, Artificial Sequence
  synthetic [barcode part1]
gatatagaccttcgcg

SEQ ID NO: 3552 - DNA, 16 bp, Artificial Sequence
  synthetic [barcode part1]
gagattagtactcgag

SEQ ID NO: 3553 - DNA, 16 bp, Artificial Sequence
  synthetic [barcode part1]
tgcagttaatcacgcg

SEQ ID NO: 3554 - DNA, 16 bp, Artificial Sequence
  synthetic [barcode part1]
ccacgaacaagtctgt

SEQ ID NO: 3555 - DNA, 16 bp, Artificial Sequence
  synthetic [barcode part1]
gacacgaaggtgtaag

SEQ ID NO: 3556 - DNA, 16 bp, Artificial Sequence
  synthetic [barcode part1]
agtgcacgaccaaggt

SEQ ID NO: 3557 - DNA, 16 bp, Artificial Sequence
  synthetic [barcode part1]
tattcgtgaatcctgc

SEQ ID NO: 3558 - DNA, 16 bp, Artificial Sequence
  synthetic [barcode part1]
caagtgcaatcgcact

SEQ ID NO: 3559 - DNA, 16 bp, Artificial Sequence
  synthetic [barcode part1]
cacgccaattgatacg

SEQ ID NO: 3560 - DNA, 16 bp, Artificial Sequence
  synthetic [barcode part1]
caagattacgccacgt

SEQ ID NO: 3561 - DNA, 16 bp, Artificial Sequence
  synthetic [barcode part1]
tcgaggccttgttcac

SEQ ID NO: 3562 - DNA, 16 bp, Artificial Sequence
  synthetic [barcode part1]
gagtggtgactgtacg

SEQ ID NO: 3563 - DNA, 16 bp, Artificial Sequence
  synthetic [barcode part1]
gtgcagtccaactcct

SEQ ID NO: 3564 - DNA, 16 bp, Artificial Sequence
  synthetic [barcode part1]
acaggagacacagaac

SEQ ID NO: 3565 - DNA, 16 bp, Artificial Sequence
  synthetic [barcode part1]
gtagttcctaccgaag

SEQ ID NO: 3566 - DNA, 16 bp, Artificial Sequence
  synthetic [barcode part1]
atattcctcctgtgcc

SEQ ID NO: 3567 - DNA, 16 bp, Artificial Sequence
  synthetic [barcode part1]
aagtcgtggcaattcc

SEQ ID NO: 3568 - DNA, 16 bp, Artificial Sequence
  synthetic [barcode part1]
cctaaggtcctctctt

SEQ ID NO: 3569 - DNA, 16 bp, Artificial Sequence
  synthetic [barcode part1]
gactgcagtgtcaact

SEQ ID NO: 3570 - DNA, 16 bp, Artificial Sequence
  synthetic [barcode part1]
gcacagattacactcg

SEQ ID NO: 3571 - DNA, 16 bp, Artificial Sequence
  synthetic [barcode part1]
tggtgtattaggtgcc

SEQ ID NO: 3572 - DNA, 16 bp, Artificial Sequence
  synthetic [barcode part1]
gtcaagttcgttggac

SEQ ID NO: 3573 - DNA, 16 bp, Artificial Sequence
  synthetic [barcode part1]
cgtctattcgcctact

SEQ ID NO: 3574 - DNA, 16 bp, Artificial Sequence
  synthetic [barcode part1]
acgaggataacttgac

SEQ ID NO: 3575 - DNA, 16 bp, Artificial Sequence
  synthetic [barcode part1]
gtgtacttgcctcacg

SEQ ID NO: 3576 - DNA, 16 bp, Artificial Sequence
  synthetic [barcode part1]
tgaacaccaacagaac

SEQ ID NO: 3577 - DNA, 16 bp, Artificial Sequence
  synthetic [barcode part1]
tcggcgtccttgattg

SEQ ID NO: 3578 - DNA, 16 bp, Artificial Sequence
  synthetic [barcode part1]
tgcgtctctgtattcc

SEQ ID NO: 3579 - DNA, 16 bp, Artificial Sequence
  synthetic [barcode part1]
gtactggagaggtcgt

SEQ ID NO: 3580 - DNA, 16 bp, Artificial Sequence
  synthetic [barcode part1]
tgaccaagtactgtgc

SEQ ID NO: 3581 - DNA, 16 bp, Artificial Sequence
  synthetic [barcode part1]
taccaactgacgtacg

SEQ ID NO: 3582 - DNA, 16 bp, Artificial Sequence
  synthetic [barcode part1]
tctctccgatcaacct

SEQ ID NO: 3583 - DNA, 16 bp, Artificial Sequence
  synthetic [barcode part1]
tccgatcgtactgacc

SEQ ID NO: 3584 - DNA, 16 bp, Artificial Sequence
  synthetic [barcode part1]
tcgtaggttgtacggt

SEQ ID NO: 3585 - DNA, 16 bp, Artificial Sequence
  synthetic [barcode part1]
agtgtcaacaccacac

SEQ ID NO: 3586 - DNA, 16 bp, Artificial Sequence
  synthetic [barcode part1]
tcagttggtcacaacg

SEQ ID NO: 3587 - DNA, 16 bp, Artificial Sequence
  synthetic [barcode part1]
gatagtaacggtggag

SEQ ID NO: 3588 - DNA, 16 bp, Artificial Sequence
  synthetic [barcode part1]
gtgatcaattggcgtc

SEQ ID NO: 3589 - DNA, 16 bp, Artificial Sequence
  synthetic [barcode part1]
acagtcaagaactgac

SEQ ID NO: 3590 - DNA, 16 bp, Artificial Sequence
  synthetic [barcode part1]
gtctcgcgagtgttct

SEQ ID NO: 3591 - DNA, 16 bp, Artificial Sequence
  synthetic [barcode part1]
tctgatccgcggttgt

SEQ ID NO: 3592 - DNA, 16 bp, Artificial Sequence
  synthetic [barcode part1]
ccaattcctgccactt

SEQ ID NO: 3593 - DNA, 16 bp, Artificial Sequence
  synthetic [barcode part1]
aagaccgaaggactag

SEQ ID NO: 3594 - DNA, 16 bp, Artificial Sequence
  synthetic [barcode part1]
tgatcaggtactacgc

SEQ ID NO: 3595 - DNA, 16 bp, Artificial Sequence
  synthetic [barcode part1]
cgaacactgtggatct

SEQ ID NO: 3596 - DNA, 16 bp, Artificial Sequence
  synthetic [barcode part1]
tgactggaccgtgatt

SEQ ID NO: 3597 - DNA, 16 bp, Artificial Sequence
  synthetic [barcode part1]
gcggccgatatattac

SEQ ID NO: 3598 - DNA, 16 bp, Artificial Sequence
  synthetic [barcode part1]
gtcagtaatagaacgc

SEQ ID NO: 3599 - DNA, 16 bp, Artificial Sequence
  synthetic [barcode part1]
agagtctaggccttac

SEQ ID NO: 3600 - DNA, 16 bp, Artificial Sequence
  synthetic [barcode part1]
ttgcgcctattggatt

SEQ ID NO: 3601 - DNA, 16 bp, Artificial Sequence
  synthetic [barcode part1]
aagtaacgtgcgaccg

SEQ ID NO: 3602 - DNA, 16 bp, Artificial Sequence
  synthetic [barcode part1]
acttattggtgccact

SEQ ID NO: 3603 - DNA, 16 bp, Artificial Sequence
  synthetic [barcode part1]
cggtaatactgagtcc

SEQ ID NO: 3604 - DNA, 16 bp, Artificial Sequence
  synthetic [barcode part1]
caagaccgagatctct

SEQ ID NO: 3605 - DNA, 16 bp, Artificial Sequence
  synthetic [barcode part1]
caataccggacagacg

SEQ ID NO: 3606 - DNA, 16 bp, Artificial Sequence
  synthetic [barcode part1]
tcggcagttcgtactc

SEQ ID NO: 3607 - DNA, 16 bp, Artificial Sequence
  synthetic [barcode part1]
gaagttctcgtaacgc

SEQ ID NO: 3608 - DNA, 16 bp, Artificial Sequence
  synthetic [barcode part1]
tctattgtcctgtcgc

SEQ ID NO: 3609 - DNA, 16 bp, Artificial Sequence
  synthetic [barcode part1]
tctgccttggaatccg

SEQ ID NO: 3610 - DNA, 16 bp, Artificial Sequence
  synthetic [barcode part1]
gtggagattgagtcgc

SEQ ID NO: 3611 - DNA, 16 bp, Artificial Sequence
  synthetic [barcode part1]
tctgtcgactagagac

SEQ ID NO: 3612 - DNA, 16 bp, Artificial Sequence
  synthetic [barcode part1]
tcggaacgcctgtctt

SEQ ID NO: 3613 - DNA, 16 bp, Artificial Sequence
  synthetic [barcode part1]
caccggttaactacag

SEQ ID NO: 3614 - DNA, 16 bp, Artificial Sequence
  synthetic [barcode part1]
actgccggtacagaag

SEQ ID NO: 3615 - DNA, 16 bp, Artificial Sequence
  synthetic [barcode part1]
taacttcgtatcgacc

SEQ ID NO: 3616 - DNA, 16 bp, Artificial Sequence
  synthetic [barcode part1]
ttacggtgcactgtag

SEQ ID NO: 3617 - DNA, 16 bp, Artificial Sequence
  synthetic [barcode part1]
tatagtacgaggcctc

SEQ ID NO: 3618 - DNA, 16 bp, Artificial Sequence
  synthetic [barcode part1]
gttcgtactagacgtg

SEQ ID NO: 3619 - DNA, 16 bp, Artificial Sequence
  synthetic [barcode part1]
ttcaccgtcaatacac

SEQ ID NO: 3620 - DNA, 16 bp, Artificial Sequence
  synthetic [barcode part1]
tacggataggtagtac

SEQ ID NO: 3621 - DNA, 16 bp, Artificial Sequence
  synthetic [barcode part1]
ttcactgtcgagtact

SEQ ID NO: 3622 - DNA, 16 bp, Artificial Sequence
  synthetic [barcode part1]
acctattcgagacttc

SEQ ID NO: 3623 - DNA, 16 bp, Artificial Sequence
  synthetic [barcode part1]
tcgtagataaggaacc

SEQ ID NO: 3624 - DNA, 16 bp, Artificial Sequence
  synthetic [barcode part1]
ttgatccacggttact

SEQ ID NO: 3625 - DNA, 16 bp, Artificial Sequence
  synthetic [barcode part1]
gacgtgtcgtacgatt

SEQ ID NO: 3626 - DNA, 16 bp, Artificial Sequence
  synthetic [barcode part1]
tggtggaaggtaacag

SEQ ID NO: 3627 - DNA, 16 bp, Artificial Sequence
  synthetic [barcode part1]
aggtggactcggaatc

SEQ ID NO: 3628 - DNA, 16 bp, Artificial Sequence
  synthetic [barcode part1]
actcacctcgcagtac

SEQ ID NO: 3629 - DNA, 16 bp, Artificial Sequence
  synthetic [barcode part1]
acacgcctattggtag

SEQ ID NO: 3630 - DNA, 16 bp, Artificial Sequence
  synthetic [barcode part1]
cacagtagtcttaggc

SEQ ID NO: 3631 - DNA, 16 bp, Artificial Sequence
  synthetic [barcode part1]
attgacaagtggtggt

SEQ ID NO: 3632 - DNA, 16 bp, Artificial Sequence
  synthetic [barcode part1]
cctcgtagacttgacc

SEQ ID NO: 3633 - DNA, 16 bp, Artificial Sequence
  synthetic [barcode part1]
cagtgatctaagtcgc

SEQ ID NO: 3634 - DNA, 16 bp, Artificial Sequence
  synthetic [barcode part1]
gcactgccaagtagag

SEQ ID NO: 3635 - DNA, 16 bp, Artificial Sequence
  synthetic [barcode part1]
gcgtgtagtgcgtatt

SEQ ID NO: 3636 - DNA, 16 bp, Artificial Sequence
  synthetic [barcode part1]
gttcagacctggatac

SEQ ID NO: 3637 - DNA, 16 bp, Artificial Sequence
  synthetic [barcode part1]
ccactcaagattccgc

SEQ ID NO: 3638 - DNA, 16 bp, Artificial Sequence
  synthetic [barcode part1]
gactcggactatcaac

SEQ ID NO: 3639 - DNA, 16 bp, Artificial Sequence
  synthetic [barcode part1]
gacacacacgtactgt

SEQ ID NO: 3640 - DNA, 16 bp, Artificial Sequence
  synthetic [barcode part1]
agtgccacgtgatact

SEQ ID NO: 3641 - DNA, 16 bp, Artificial Sequence
  synthetic [barcode part1]
gcgagtcttctcagtc

SEQ ID NO: 3642 - DNA, 16 bp, Artificial Sequence
  synthetic [barcode part1]
ataggaacgacaactc

SEQ ID NO: 3643 - DNA, 16 bp, Artificial Sequence
  synthetic [barcode part1]
caccttacgaagtggt

SEQ ID NO: 3644 - DNA, 16 bp, Artificial Sequence
  synthetic [barcode part1]
atcttgcagtacacct

SEQ ID NO: 3645 - DNA, 16 bp, Artificial Sequence
  synthetic [barcode part1]
gagttctacgtacacg

SEQ ID NO: 3646 - DNA, 16 bp, Artificial Sequence
  synthetic [barcode part1]
ttgaagaggttgcgcg

SEQ ID NO: 3647 - DNA, 16 bp, Artificial Sequence
  synthetic [barcode part1]
agtaccttgtctcgcg

SEQ ID NO: 3648 - DNA, 16 bp, Artificial Sequence
  synthetic [barcode part1]
cgtaggttaggtacct

SEQ ID NO: 3649 - DNA, 16 bp, Artificial Sequence
  synthetic [barcode part1]
tcgttagtgtacttcg

SEQ ID NO: 3650 - DNA, 16 bp, Artificial Sequence
  synthetic [barcode part1]
aattggacacctcacg

SEQ ID NO: 3651 - DNA, 16 bp, Artificial Sequence
  synthetic [barcode part1]
gtacttgtcaccttag

SEQ ID NO: 3652 - DNA, 16 bp, Artificial Sequence
  synthetic [barcode part1]
gagatcgcgtaccaag

SEQ ID NO: 3653 - DNA, 16 bp, Artificial Sequence
  synthetic [barcode part1]
gagaccagactacgtg

SEQ ID NO: 3654 - DNA, 16 bp, Artificial Sequence
  synthetic [barcode part1]
tcttgtgacacggagt

SEQ ID NO: 3655 - DNA, 16 bp, Artificial Sequence
  synthetic [barcode part1]
cgaaccgttagatcac

SEQ ID NO: 3656 - DNA, 16 bp, Artificial Sequence
  synthetic [barcode part1]
tataagtcctaccacc

SEQ ID NO: 3657 - DNA, 16 bp, Artificial Sequence
  synthetic [barcode part1]
actacggacggtactt

SEQ ID NO: 3658 - DNA, 16 bp, Artificial Sequence
  synthetic [barcode part1]
tattagtgtgccgacg

SEQ ID NO: 3659 - DNA, 16 bp, Artificial Sequence
  synthetic [barcode part1]
gacgacctagtaatcc

SEQ ID NO: 3660 - DNA, 16 bp, Artificial Sequence
  synthetic [barcode part1]
aacctggtctctgcgt

SEQ ID NO: 3661 - DNA, 16 bp, Artificial Sequence
  synthetic [barcode part1]
gcggttagattctctt

SEQ ID NO: 3662 - DNA, 16 bp, Artificial Sequence
  synthetic [barcode part1]
tggtcagtggtactgt

SEQ ID NO: 3663 - DNA, 16 bp, Artificial Sequence
  synthetic [barcode part1]
tgcacggtgaagagtc

SEQ ID NO: 3664 - DNA, 16 bp, Artificial Sequence
  synthetic [barcode part1]
agattcgtgaaggatc

SEQ ID NO: 3665 - DNA, 16 bp, Artificial Sequence
  synthetic [barcode part1]
tcgtaccactcaatac

SEQ ID NO: 3666 - DNA, 16 bp, Artificial Sequence
  synthetic [barcode part1]
cgtgaacagacctact

SEQ ID NO: 3667 - DNA, 16 bp, Artificial Sequence
  synthetic [barcode part1]
agaacctgcaggcaac

SEQ ID NO: 3668 - DNA, 16 bp, Artificial Sequence
  synthetic [barcode part1]
cgacgtcttacaacag

SEQ ID NO: 3669 - DNA, 16 bp, Artificial Sequence
  synthetic [barcode part1]
taaccgaccgactaac

SEQ ID NO: 3670 - DNA, 16 bp, Artificial Sequence
  synthetic [barcode part1]
tatctcaactcgcaac

SEQ ID NO: 3671 - DNA, 16 bp, Artificial Sequence
  synthetic [barcode part1]
aagtccacactccacc

SEQ ID NO: 3672 - DNA, 16 bp, Artificial Sequence
  synthetic [barcode part1]
acttccgcgaatcgtc

SEQ ID NO: 3673 - DNA, 16 bp, Artificial Sequence
  synthetic [barcode part1]
tctaacgttacacctg

SEQ ID NO: 3674 - DNA, 16 bp, Artificial Sequence
  synthetic [barcode part1]
agaccacacgattcgt

SEQ ID NO: 3675 - DNA, 16 bp, Artificial Sequence
  synthetic [barcode part1]
tctaactactacgcac

SEQ ID NO: 3676 - DNA, 16 bp, Artificial Sequence
  synthetic [barcode part1]
taggtacagaacaacc

SEQ ID NO: 3677 - DNA, 16 bp, Artificial Sequence
  synthetic [barcode part1]
gagacgtattatcgag

SEQ ID NO: 3678 - DNA, 16 bp, Artificial Sequence
  synthetic [barcode part1]
gcctgtgttctcagtg

SEQ ID NO: 3679 - DNA, 16 bp, Artificial Sequence
  synthetic [barcode part1]
gtcggtgtcgttgttc

SEQ ID NO: 3680 - DNA, 16 bp, Artificial Sequence
  synthetic [barcode part1]
cagttaccaagaggcg

SEQ ID NO: 3681 - DNA, 16 bp, Artificial Sequence
  synthetic [barcode part1]
gtcgtccacagactct

SEQ ID NO: 3682 - DNA, 16 bp, Artificial Sequence
  synthetic [barcode part1]
gacaacggtgatagag

SEQ ID NO: 3683 - DNA, 16 bp, Artificial Sequence
  synthetic [barcode part1]
gcctgtgtacgaattg

SEQ ID NO: 3684 - DNA, 16 bp, Artificial Sequence
  synthetic [barcode part1]
acgttacgccttgaag

SEQ ID NO: 3685 - DNA, 16 bp, Artificial Sequence
  synthetic [barcode part1]
gacctaatcctcacgc

SEQ ID NO: 3686 - DNA, 16 bp, Artificial Sequence
  synthetic [barcode part1]
cgcacggtccaatctt

SEQ ID NO: 3687 - DNA, 16 bp, Artificial Sequence
  synthetic [barcode part1]
caccgcaattgatcag

SEQ ID NO: 3688 - DNA, 16 bp, Artificial Sequence
  synthetic [barcode part1]
agtgtggttcgtactg

SEQ ID NO: 3689 - DNA, 16 bp, Artificial Sequence
  synthetic [barcode part1]
gatctccgtacaattc

SEQ ID NO: 3690 - DNA, 16 bp, Artificial Sequence
  synthetic [barcode part1]
ttacttctgcggaccg

SEQ ID NO: 3691 - DNA, 16 bp, Artificial Sequence
  synthetic [barcode part1]
tgagacctctcaaggt

SEQ ID NO: 3692 - DNA, 16 bp, Artificial Sequence
  synthetic [barcode part1]
ataccaagaggcaact

SEQ ID NO: 3693 - DNA, 16 bp, Artificial Sequence
  synthetic [barcode part1]
gtaattaggttcctcc

SEQ ID NO: 3694 - DNA, 16 bp, Artificial Sequence
  synthetic [barcode part1]
tatatctctcggcagt

SEQ ID NO: 3695 - DNA, 16 bp, Artificial Sequence
  synthetic [barcode part1]
gactagttggcgttac

SEQ ID NO: 3696 - DNA, 16 bp, Artificial Sequence
  synthetic [barcode part1]
tctcgacgagatagtc

SEQ ID NO: 3697 - DNA, 16 bp, Artificial Sequence
  synthetic [barcode part1]
cggtattgtctacttg

SEQ ID NO: 3698 - DNA, 16 bp, Artificial Sequence
  synthetic [barcode part1]
ttgattacggccaacg

SEQ ID NO: 3699 - DNA, 16 bp, Artificial Sequence
  synthetic [barcode part1]
taggaggcgtaattac

SEQ ID NO: 3700 - DNA, 16 bp, Artificial Sequence
  synthetic [barcode part1]
agagataatccgacac

SEQ ID NO: 3701 - DNA, 16 bp, Artificial Sequence
  synthetic [barcode part1]
acggacactatctacg

SEQ ID NO: 3702 - DNA, 16 bp, Artificial Sequence
  synthetic [barcode part1]
cggatacgagataact

SEQ ID NO: 3703 - DNA, 16 bp, Artificial Sequence
  synthetic [barcode part1]
cactaacggaagattg

SEQ ID NO: 3704 - DNA, 16 bp, Artificial Sequence
  synthetic [barcode part1]
gacgatcggaggtact

SEQ ID NO: 3705 - DNA, 16 bp, Artificial Sequence
  synthetic [barcode part1]
gttagacgacagttcc

SEQ ID NO: 3706 - DNA, 16 bp, Artificial Sequence
  synthetic [barcode part1]
caggttggaggacact

SEQ ID NO: 3707 - DNA, 16 bp, Artificial Sequence
  synthetic [barcode part1]
gtaacggtcacgcaag

SEQ ID NO: 3708 - DNA, 16 bp, Artificial Sequence
  synthetic [barcode part1]
gaaccttcttcaggag

SEQ ID NO: 3709 - DNA, 16 bp, Artificial Sequence
  synthetic [barcode part1]
attccgtggatcgagt

SEQ ID NO: 3710 - DNA, 16 bp, Artificial Sequence
  synthetic [barcode part1]
gtgtggtaagaccggt

SEQ ID NO: 3711 - DNA, 16 bp, Artificial Sequence
  synthetic [barcode part1]
cctgttaggaacgact

SEQ ID NO: 3712 - DNA, 16 bp, Artificial Sequence
  synthetic [barcode part1]
tatcggaatccgacac

SEQ ID NO: 3713 - DNA, 16 bp, Artificial Sequence
  synthetic [barcode part1]
gaatatccgtcgtctt

SEQ ID NO: 3714 - DNA, 16 bp, Artificial Sequence
  synthetic [barcode part1]
gtagttgcgtagtcac

SEQ ID NO: 3715 - DNA, 16 bp, Artificial Sequence
  synthetic [barcode part1]
tggacagttgtctgtg

SEQ ID NO: 3716 - DNA, 16 bp, Artificial Sequence
  synthetic [barcode part1]
ttgagtgtgagtgtcc

SEQ ID NO: 3717 - DNA, 16 bp, Artificial Sequence
  synthetic [barcode part1]
gtgaactctctcaatc

SEQ ID NO: 3718 - DNA, 16 bp, Artificial Sequence
  synthetic [barcode part1]
atagtccacttctacg

SEQ ID NO: 3719 - DNA, 16 bp, Artificial Sequence
  synthetic [barcode part1]
cagttgatctccttcc

SEQ ID NO: 3720 - DNA, 16 bp, Artificial Sequence
  synthetic [barcode part1]
gagattcttacctacc

SEQ ID NO: 3721 - DNA, 16 bp, Artificial Sequence
  synthetic [barcode part1]
tacgaacggtacctac

SEQ ID NO: 3722 - DNA, 16 bp, Artificial Sequence
  synthetic [barcode part1]
cgcactctgaaccact

SEQ ID NO: 3723 - DNA, 16 bp, Artificial Sequence
  synthetic [barcode part1]
tattaacgagagaccg

SEQ ID NO: 3724 - DNA, 16 bp, Artificial Sequence
  synthetic [barcode part1]
tcaagtgtgaggtggc

SEQ ID NO: 3725 - DNA, 16 bp, Artificial Sequence
  synthetic [barcode part1]
tgtgatcaagaaccag

SEQ ID NO: 3726 - DNA, 16 bp, Artificial Sequence
  synthetic [barcode part1]
ttgtgcaaccagtacg

SEQ ID NO: 3727 - DNA, 16 bp, Artificial Sequence
  synthetic [barcode part1]
acgtacacttctctcc

SEQ ID NO: 3728 - DNA, 16 bp, Artificial Sequence
  synthetic [barcode part1]
tctacgtagaacgcgt

SEQ ID NO: 3729 - DNA, 16 bp, Artificial Sequence
  synthetic [barcode part1]
cgtatagacctcctgc

SEQ ID NO: 3730 - DNA, 16 bp, Artificial Sequence
  synthetic [barcode part1]
cgaatcttgccactcg

SEQ ID NO: 3731 - DNA, 16 bp, Artificial Sequence
  synthetic [barcode part1]
tgatcaccactccgtg

SEQ ID NO: 3732 - DNA, 16 bp, Artificial Sequence
  synthetic [barcode part1]
tgtattcctgcgtctc

SEQ ID NO: 3733 - DNA, 16 bp, Artificial Sequence
  synthetic [barcode part1]
agattgtcctgcactt

SEQ ID NO: 3734 - DNA, 16 bp, Artificial Sequence
  synthetic [barcode part1]
gactacgcctcgatct

SEQ ID NO: 3735 - DNA, 16 bp, Artificial Sequence
  synthetic [barcode part1]
ttatcgcaggtctgtt

SEQ ID NO: 3736 - DNA, 16 bp, Artificial Sequence
  synthetic [barcode part1]
gaggaactccgtagac

SEQ ID NO: 3737 - DNA, 16 bp, Artificial Sequence
  synthetic [barcode part1]
gtgatcaatcacgcac

SEQ ID NO: 3738 - DNA, 16 bp, Artificial Sequence
  synthetic [barcode part1]
gtcagagaccgtgtag

SEQ ID NO: 3739 - DNA, 16 bp, Artificial Sequence
  synthetic [barcode part1]
tcctaaccgactcctt

SEQ ID NO: 3740 - DNA, 16 bp, Artificial Sequence
  synthetic [barcode part1]
actaacagacgcgtct

SEQ ID NO: 3741 - DNA, 16 bp, Artificial Sequence
  synthetic [barcode part1]
tcactgccagacgttc

SEQ ID NO: 3742 - DNA, 16 bp, Artificial Sequence
  synthetic [barcode part1]
aaccggtagagtctct

SEQ ID NO: 3743 - DNA, 16 bp, Artificial Sequence
  synthetic [barcode part1]
caagtcaacgtaagac

SEQ ID NO: 3744 - DNA, 16 bp, Artificial Sequence
  synthetic [barcode part1]
tactggttggttgcag

SEQ ID NO: 3745 - DNA, 16 bp, Artificial Sequence
  synthetic [barcode part1]
tctcttcctcttcctc

SEQ ID NO: 3746 - DNA, 16 bp, Artificial Sequence
  synthetic [barcode part1]
acggcaccaattaacc

SEQ ID NO: 3747 - DNA, 16 bp, Artificial Sequence
  synthetic [barcode part1]
agagagagaagaggag

SEQ ID NO: 3748 - DNA, 16 bp, Artificial Sequence
  synthetic [barcode part1]
caatccactgtgtccg

SEQ ID NO: 3749 - DNA, 16 bp, Artificial Sequence
  synthetic [barcode part1]
ttcagagattgcgacc

SEQ ID NO: 3750 - DNA, 16 bp, Artificial Sequence
  synthetic [barcode part1]
gccagtaatccagact

SEQ ID NO: 3751 - DNA, 16 bp, Artificial Sequence
  synthetic [barcode part1]
gtataacgagagacct

SEQ ID NO: 3752 - DNA, 16 bp, Artificial Sequence
  synthetic [barcode part1]
tagatagtgtccgtcg

SEQ ID NO: 3753 - DNA, 16 bp, Artificial Sequence
  synthetic [barcode part1]
caggcaattgtggcag

SEQ ID NO: 3754 - DNA, 16 bp, Artificial Sequence
  synthetic [barcode part1]
cgttgttagtgtgtct

SEQ ID NO: 3755 - DNA, 16 bp, Artificial Sequence
  synthetic [barcode part1]
cgtgacgcactataac

SEQ ID NO: 3756 - DNA, 16 bp, Artificial Sequence
  synthetic [barcode part1]
tgtcctgaacgagatc

SEQ ID NO: 3757 - DNA, 16 bp, Artificial Sequence
  synthetic [barcode part1]
ccaagtgtgagtgtct

SEQ ID NO: 3758 - DNA, 16 bp, Artificial Sequence
  synthetic [barcode part1]
cacctcacgttatctc

SEQ ID NO: 3759 - DNA, 16 bp, Artificial Sequence
  synthetic [barcode part1]
aattcggtcggtagtc

SEQ ID NO: 3760 - DNA, 16 bp, Artificial Sequence
  synthetic [barcode part1]
gtcgttccttgaatac

SEQ ID NO: 3761 - DNA, 16 bp, Artificial Sequence
  synthetic [barcode part1]
cgagtatcggtccttc

SEQ ID NO: 3762 - DNA, 16 bp, Artificial Sequence
  synthetic [barcode part1]
cagagtctcagagtct

SEQ ID NO: 3763 - DNA, 16 bp, Artificial Sequence
  synthetic [barcode part1]
agagtaaggtgaggtc

SEQ ID NO: 3764 - DNA, 16 bp, Artificial Sequence
  synthetic [barcode part1]
tacacttgagtgtggc

SEQ ID NO: 3765 - DNA, 16 bp, Artificial Sequence
  synthetic [barcode part1]
tacgttggaggtcgag

SEQ ID NO: 3766 - DNA, 16 bp, Artificial Sequence
  synthetic [barcode part1]
gcgtaataccagtacc

SEQ ID NO: 3767 - DNA, 16 bp, Artificial Sequence
  synthetic [barcode part1]
cagtgcagtacagtct

SEQ ID NO: 3768 - DNA, 16 bp, Artificial Sequence
  synthetic [barcode part1]
actcgtagttgttctg

SEQ ID NO: 3769 - DNA, 16 bp, Artificial Sequence
  synthetic [barcode part1]
aggtaaggcagtatct

SEQ ID NO: 3770 - DNA, 16 bp, Artificial Sequence
  synthetic [barcode part1]
tagacgtaccagaggc

SEQ ID NO: 3771 - DNA, 16 bp, Artificial Sequence
  synthetic [barcode part1]
cagatacaatccgtgc

SEQ ID NO: 3772 - DNA, 16 bp, Artificial Sequence
  synthetic [barcode part1]
taactctcacgtaacc

SEQ ID NO: 3773 - DNA, 16 bp, Artificial Sequence
  synthetic [barcode part1]
gtctgaagttctactc

SEQ ID NO: 3774 - DNA, 16 bp, Artificial Sequence
  synthetic [barcode part1]
gttacgttgcaccaag

SEQ ID NO: 3775 - DNA, 16 bp, Artificial Sequence
  synthetic [barcode part1]
ataggaacgactcggc

SEQ ID NO: 3776 - DNA, 16 bp, Artificial Sequence
  synthetic [barcode part1]
gactgcagttggtgtt

SEQ ID NO: 3777 - DNA, 16 bp, Artificial Sequence
  synthetic [barcode part1]
gacctctgtgcctaac

SEQ ID NO: 3778 - DNA, 16 bp, Artificial Sequence
  synthetic [barcode part1]
agtactgactgcagtc

SEQ ID NO: 3779 - DNA, 16 bp, Artificial Sequence
  synthetic [barcode part1]
gtcgcaggacgaatac

SEQ ID NO: 3780 - DNA, 16 bp, Artificial Sequence
  synthetic [barcode part1]
caaggtgatagttgtg

SEQ ID NO: 3781 - DNA, 16 bp, Artificial Sequence
  synthetic [barcode part1]
tgcgatagacgaacgc

SEQ ID NO: 3782 - DNA, 16 bp, Artificial Sequence
  synthetic [barcode part1]
aactctcttaggcgtt

SEQ ID NO: 3783 - DNA, 16 bp, Artificial Sequence
  synthetic [barcode part1]
gagattcgtaggtaac

SEQ ID NO: 3784 - DNA, 16 bp, Artificial Sequence
  synthetic [barcode part1]
tgtgcagacctcctgt

SEQ ID NO: 3785 - DNA, 16 bp, Artificial Sequence
  synthetic [barcode part1]
acggaacagacagtag

SEQ ID NO: 3786 - DNA, 16 bp, Artificial Sequence
  synthetic [barcode part1]
ttcgccagttatcctc

SEQ ID NO: 3787 - DNA, 16 bp, Artificial Sequence
  synthetic [barcode part1]
tgttcagagaacaacg

SEQ ID NO: 3788 - DNA, 16 bp, Artificial Sequence
  synthetic [barcode part1]
gtcggtagacaacggt

SEQ ID NO: 3789 - DNA, 16 bp, Artificial Sequence
  synthetic [barcode part1]
gaaccttgcactacag

SEQ ID NO: 3790 - DNA, 16 bp, Artificial Sequence
  synthetic [barcode part1]
agaactcgacgaatac

SEQ ID NO: 3791 - DNA, 16 bp, Artificial Sequence
  synthetic [barcode part1]
gtctgtagttagagag

SEQ ID NO: 3792 - DNA, 16 bp, Artificial Sequence
  synthetic [barcode part1]
tcggagtctatctgtt

SEQ ID NO: 3793 - DNA, 16 bp, Artificial Sequence
  synthetic [barcode part1]
tactgtccttgtgagt

SEQ ID NO: 3794 - DNA, 16 bp, Artificial Sequence
  synthetic [barcode part1]
gcaaccagttggtact

SEQ ID NO: 3795 - DNA, 16 bp, Artificial Sequence
  synthetic [barcode part1]
gataaccggagacacc

SEQ ID NO: 3796 - DNA, 16 bp, Artificial Sequence
  synthetic [barcode part1]
tgacaattgcgtctct

SEQ ID NO: 3797 - DNA, 16 bp, Artificial Sequence
  synthetic [barcode part1]
cgaaggtattctcacg

SEQ ID NO: 3798 - DNA, 16 bp, Artificial Sequence
  synthetic [barcode part1]
tgcaagtcactcgaac

SEQ ID NO: 3799 - DNA, 16 bp, Artificial Sequence
  synthetic [barcode part1]
tgtgtggtcgtcacct

SEQ ID NO: 3800 - DNA, 16 bp, Artificial Sequence
  synthetic [barcode part1]
tattcgttgtccgtcc

SEQ ID NO: 3801 - DNA, 16 bp, Artificial Sequence
  synthetic [barcode part1]
acgagttcgcagattc

SEQ ID NO: 3802 - DNA, 16 bp, Artificial Sequence
  synthetic [barcode part1]
agaagactctacgagt

SEQ ID NO: 3803 - DNA, 16 bp, Artificial Sequence
  synthetic [barcode part1]
gtggtcaaccagtact

SEQ ID NO: 3804 - DNA, 16 bp, Artificial Sequence
  synthetic [barcode part1]
gtatcaccaggcgaag

SEQ ID NO: 3805 - DNA, 16 bp, Artificial Sequence
  synthetic [barcode part1]
tacgtggcggaaggtt

SEQ ID NO: 3806 - DNA, 16 bp, Artificial Sequence
  synthetic [barcode part1]
cgatatcgtccactcg

SEQ ID NO: 3807 - DNA, 16 bp, Artificial Sequence
  synthetic [barcode part1]
actcttacagagacgc

SEQ ID NO: 3808 - DNA, 16 bp, Artificial Sequence
  synthetic [barcode part1]
gatcactactcttgtg

SEQ ID NO: 3809 - DNA, 16 bp, Artificial Sequence
  synthetic [barcode part1]
tccagaagttgcaacc

SEQ ID NO: 3810 - DNA, 16 bp, Artificial Sequence
  synthetic [barcode part1]
aaggacgacaatccgc

SEQ ID NO: 3811 - DNA, 16 bp, Artificial Sequence
  synthetic [barcode part1]
tctcttaagacacctg

SEQ ID NO: 3812 - DNA, 16 bp, Artificial Sequence
  synthetic [barcode part1]
gtgccaactccactgt

SEQ ID NO: 3813 - DNA, 16 bp, Artificial Sequence
  synthetic [barcode part1]
ttgatagaggcacagt

SEQ ID NO: 3814 - DNA, 16 bp, Artificial Sequence
  synthetic [barcode part1]
accaacgagactaagt

SEQ ID NO: 3815 - DNA, 16 bp, Artificial Sequence
  synthetic [barcode part1]
atactctaatccggtc

SEQ ID NO: 3816 - DNA, 16 bp, Artificial Sequence
  synthetic [barcode part1]
actgttgcaacctgag

SEQ ID NO: 3817 - DNA, 16 bp, Artificial Sequence
  synthetic [barcode part1]
cggataccttcgtcgt

SEQ ID NO: 3818 - DNA, 16 bp, Artificial Sequence
  synthetic [barcode part1]
gccacttgagtagtac

SEQ ID NO: 3819 - DNA, 16 bp, Artificial Sequence
  synthetic [barcode part1]
tcacaggatccagact

SEQ ID NO: 3820 - DNA, 16 bp, Artificial Sequence
  synthetic [barcode part1]
tcagtccaggtacctc

SEQ ID NO: 3821 - DNA, 16 bp, Artificial Sequence
  synthetic [barcode part1]
taagttggtacctcct

SEQ ID NO: 3822 - DNA, 16 bp, Artificial Sequence
  synthetic [barcode part1]
gtgtaggattcagtag

SEQ ID NO: 3823 - DNA, 16 bp, Artificial Sequence
  synthetic [barcode part1]
cggtgtcgtaatactg

SEQ ID NO: 3824 - DNA, 16 bp, Artificial Sequence
  synthetic [barcode part1]
gagacgatctaggcac

SEQ ID NO: 3825 - DNA, 16 bp, Artificial Sequence
  synthetic [barcode part1]
agtatagtaagtcgcg

SEQ ID NO: 3826 - DNA, 16 bp, Artificial Sequence
  synthetic [barcode part1]
cgaacgaccacgatag

SEQ ID NO: 3827 - DNA, 16 bp, Artificial Sequence
  synthetic [barcode part1]
cactgtccaggtctac

SEQ ID NO: 3828 - DNA, 16 bp, Artificial Sequence
  synthetic [barcode part1]
aatatacggtctctcc

SEQ ID NO: 3829 - DNA, 16 bp, Artificial Sequence
  synthetic [barcode part1]
tagtgtccgcctatcg

SEQ ID NO: 3830 - DNA, 16 bp, Artificial Sequence
  synthetic [barcode part1]
ttgacggtagaagtgt

SEQ ID NO: 3831 - DNA, 16 bp, Artificial Sequence
  synthetic [barcode part1]
gtacctcgatctgacc

SEQ ID NO: 3832 - DNA, 16 bp, Artificial Sequence
  synthetic [barcode part1]
ccagacaggtattcgt

SEQ ID NO: 3833 - DNA, 16 bp, Artificial Sequence
  synthetic [barcode part1]
ttcgaaggtgcgtatc

SEQ ID NO: 3834 - DNA, 16 bp, Artificial Sequence
  synthetic [barcode part1]
ttgtgagttacacggc

SEQ ID NO: 3835 - DNA, 16 bp, Artificial Sequence
  synthetic [barcode part1]
gaacgttcttgttacc

SEQ ID NO: 3836 - DNA, 16 bp, Artificial Sequence
  synthetic [barcode part1]
gtcggcgtaggaagtt

SEQ ID NO: 3837 - DNA, 16 bp, Artificial Sequence
  synthetic [barcode part1]
tgcctaacttcgccag

SEQ ID NO: 3838 - DNA, 16 bp, Artificial Sequence
  synthetic [barcode part1]
aatatactcggaaggc

SEQ ID NO: 3839 - DNA, 16 bp, Artificial Sequence
  synthetic [barcode part1]
tgtcctctcagaccag

SEQ ID NO: 3840 - DNA, 16 bp, Artificial Sequence
  synthetic [barcode part1]
caagtcggattaccgt

SEQ ID NO: 3841 - DNA, 16 bp, Artificial Sequence
  synthetic [barcode part1]
attcgaggatagaacc

SEQ ID NO: 3842 - DNA, 16 bp, Artificial Sequence
  synthetic [barcode part1]
ttcgtacctagtgact

SEQ ID NO: 3843 - DNA, 16 bp, Artificial Sequence
  synthetic [barcode part1]
ttactgtccgcaggtc

SEQ ID NO: 3844 - DNA, 16 bp, Artificial Sequence
  synthetic [barcode part1]
taacgcgcagtgaggt

SEQ ID NO: 3845 - DNA, 16 bp, Artificial Sequence
  synthetic [barcode part1]
cacgtcggagaagttg

SEQ ID NO: 3846 - DNA, 16 bp, Artificial Sequence
  synthetic [barcode part1]
tcaacacgactaagag

SEQ ID NO: 3847 - DNA, 16 bp, Artificial Sequence
  synthetic [barcode part1]
cacagagaacttagtg

SEQ ID NO: 3848 - DNA, 16 bp, Artificial Sequence
  synthetic [barcode part1]
caggacacaccgatag

SEQ ID NO: 3849 - DNA, 16 bp, Artificial Sequence
  synthetic [barcode part1]
tcgaatcgcaccttcg

SEQ ID NO: 3850 - DNA, 16 bp, Artificial Sequence
  synthetic [barcode part1]
cctagaactgactgac

SEQ ID NO: 3851 - DNA, 16 bp, Artificial Sequence
  synthetic [barcode part1]
tctctaacggtacgcc

SEQ ID NO: 3852 - DNA, 16 bp, Artificial Sequence
  synthetic [barcode part1]
aactagacttgcgaag

SEQ ID NO: 3853 - DNA, 16 bp, Artificial Sequence
  synthetic [barcode part1]
tcgtctgactctaggc

SEQ ID NO: 3854 - DNA, 16 bp, Artificial Sequence
  synthetic [barcode part1]
gtagagaacgccttct

SEQ ID NO: 3855 - DNA, 16 bp, Artificial Sequence
  synthetic [barcode part1]
cacttgaggaataacg

SEQ ID NO: 3856 - DNA, 16 bp, Artificial Sequence
  synthetic [barcode part1]
accgcctacttacggt

SEQ ID NO: 3857 - DNA, 16 bp, Artificial Sequence
  synthetic [barcode part1]
aggaccactagacgtg

SEQ ID NO: 3858 - DNA, 16 bp, Artificial Sequence
  synthetic [barcode part1]
agattcgtaaggaacc

SEQ ID NO: 3859 - DNA, 16 bp, Artificial Sequence
  synthetic [barcode part1]
ccaattgtctcttccg

SEQ ID NO: 3860 - DNA, 16 bp, Artificial Sequence
  synthetic [barcode part1]
gcacacaagaactcct

SEQ ID NO: 3861 - DNA, 16 bp, Artificial Sequence
  synthetic [barcode part1]
tgcgcggacagttatt

SEQ ID NO: 3862 - DNA, 16 bp, Artificial Sequence
  synthetic [barcode part1]
gttctcggtgatctgc

SEQ ID NO: 3863 - DNA, 16 bp, Artificial Sequence
  synthetic [barcode part1]
attcaggtctgttacc

SEQ ID NO: 3864 - DNA, 16 bp, Artificial Sequence
  synthetic [barcode part1]
tctatacgttatcggc

SEQ ID NO: 3865 - DNA, 16 bp, Artificial Sequence
  synthetic [barcode part1]
attcgtgatcaggaag

SEQ ID NO: 3866 - DNA, 16 bp, Artificial Sequence
  synthetic [barcode part1]
cggagataagttatcg

SEQ ID NO: 3867 - DNA, 16 bp, Artificial Sequence
  synthetic [barcode part1]
cctgcgttgtatctct

SEQ ID NO: 3868 - DNA, 16 bp, Artificial Sequence
  synthetic [barcode part1]
acgttctgactgttgt

SEQ ID NO: 3869 - DNA, 16 bp, Artificial Sequence
  synthetic [barcode part1]
tcttgtattgagtcgc

SEQ ID NO: 3870 - DNA, 16 bp, Artificial Sequence
  synthetic [barcode part1]
tactatcgtgaggtgc

SEQ ID NO: 3871 - DNA, 16 bp, Artificial Sequence
  synthetic [barcode part1]
gtgtcctaatccaatc

SEQ ID NO: 3872 - DNA, 16 bp, Artificial Sequence
  synthetic [barcode part1]
cactgtctagaagacc

SEQ ID NO: 3873 - DNA, 16 bp, Artificial Sequence
  synthetic [barcode part1]
cagaatagtgaggcag

SEQ ID NO: 3874 - DNA, 16 bp, Artificial Sequence
  synthetic [barcode part1]
tccacctgttcacttg

SEQ ID NO: 3875 - DNA, 16 bp, Artificial Sequence
  synthetic [barcode part1]
ccgcgaacagagaatc

SEQ ID NO: 3876 - DNA, 16 bp, Artificial Sequence
  synthetic [barcode part1]
tcctgtgagtcaccac

SEQ ID NO: 3877 - DNA, 16 bp, Artificial Sequence
  synthetic [barcode part1]
accagaccgaactgtt

SEQ ID NO: 3878 - DNA, 16 bp, Artificial Sequence
  synthetic [barcode part1]
aactcgtggtggagtg

SEQ ID NO: 3879 - DNA, 16 bp, Artificial Sequence
  synthetic [barcode part1]
gtccgtggaagtagtg

SEQ ID NO: 3880 - DNA, 16 bp, Artificial Sequence
  synthetic [barcode part1]
aattggcgacctcaac

SEQ ID NO: 3881 - DNA, 16 bp, Artificial Sequence
  synthetic [barcode part1]
tggaatcggtcaactc

SEQ ID NO: 3882 - DNA, 16 bp, Artificial Sequence
  synthetic [barcode part1]
gtactggtggcgaagt

SEQ ID NO: 3883 - DNA, 16 bp, Artificial Sequence
  synthetic [barcode part1]
aacgttcaagtgtccg

SEQ ID NO: 3884 - DNA, 16 bp, Artificial Sequence
  synthetic [barcode part1]
aacttaggcgttctct

SEQ ID NO: 3885 - DNA, 16 bp, Artificial Sequence
  synthetic [barcode part1]
tacaacaggacgaact

SEQ ID NO: 3886 - DNA, 16 bp, Artificial Sequence
  synthetic [barcode part1]
gttagtggaacgtctc

SEQ ID NO: 3887 - DNA, 16 bp, Artificial Sequence
  synthetic [barcode part1]
aggacgaacgagttcc

SEQ ID NO: 3888 - DNA, 16 bp, Artificial Sequence
  synthetic [barcode part1]
gtcttagatcacggtg

SEQ ID NO: 3889 - DNA, 16 bp, Artificial Sequence
  synthetic [barcode part1]
tgactgagtaccgtac

SEQ ID NO: 3890 - DNA, 16 bp, Artificial Sequence
  synthetic [barcode part1]
gtgacgactattaccg

SEQ ID NO: 3891 - DNA, 16 bp, Artificial Sequence
  synthetic [barcode part1]
caggacaggattagag

SEQ ID NO: 3892 - DNA, 16 bp, Artificial Sequence
  synthetic [barcode part1]
attctcaatccggtac

SEQ ID NO: 3893 - DNA, 16 bp, Artificial Sequence
  synthetic [barcode part1]
gtcaagtacaaggatc

SEQ ID NO: 3894 - DNA, 16 bp, Artificial Sequence
  synthetic [barcode part1]
acgcctcttggcagtt

SEQ ID NO: 3895 - DNA, 16 bp, Artificial Sequence
  synthetic [barcode part1]
ccgtaggttactgtcc

SEQ ID NO: 3896 - DNA, 16 bp, Artificial Sequence
  synthetic [barcode part1]
tgaagtccagtactgc

SEQ ID NO: 3897 - DNA, 16 bp, Artificial Sequence
  synthetic [barcode part1]
acaaggccaggtactg

SEQ ID NO: 3898 - DNA, 16 bp, Artificial Sequence
  synthetic [barcode part1]
gtccgtcttacgacgt

SEQ ID NO: 3899 - DNA, 16 bp, Artificial Sequence
  synthetic [barcode part1]
actggttgtgttgcag

SEQ ID NO: 3900 - DNA, 16 bp, Artificial Sequence
  synthetic [barcode part1]
attgatacgaggaacc

SEQ ID NO: 3901 - DNA, 16 bp, Artificial Sequence
  synthetic [barcode part1]
tacacacggagagaag

SEQ ID NO: 3902 - DNA, 16 bp, Artificial Sequence
  synthetic [barcode part1]
tctccgtacttctgtg

SEQ ID NO: 3903 - DNA, 16 bp, Artificial Sequence
  synthetic [barcode part1]
cagattacgcgcctct

SEQ ID NO: 3904 - DNA, 16 bp, Artificial Sequence
  synthetic [barcode part1]
tcagacgcgagacagt

SEQ ID NO: 3905 - DNA, 16 bp, Artificial Sequence
  synthetic [barcode part1]
cgcgatacactacagt

SEQ ID NO: 3906 - DNA, 16 bp, Artificial Sequence
  synthetic [barcode part1]
aagactactcttggcg

SEQ ID NO: 3907 - DNA, 16 bp, Artificial Sequence
  synthetic [barcode part1]
gtcttgataaccggtg

SEQ ID NO: 3908 - DNA, 16 bp, Artificial Sequence
  synthetic [barcode part1]
cacgcgtagttaatcg

SEQ ID NO: 3909 - DNA, 16 bp, Artificial Sequence
  synthetic [barcode part1]
cggcagtgtgttcttc

SEQ ID NO: 3910 - DNA, 16 bp, Artificial Sequence
  synthetic [barcode part1]
actggattgagttgcc

SEQ ID NO: 3911 - DNA, 16 bp, Artificial Sequence
  synthetic [barcode part1]
cgcgtgagagttagac

SEQ ID NO: 3912 - DNA, 16 bp, Artificial Sequence
  synthetic [barcode part1]
acgtactaacgtaccg

SEQ ID NO: 3913 - DNA, 16 bp, Artificial Sequence
  synthetic [barcode part1]
tccgttctacctactg

SEQ ID NO: 3914 - DNA, 16 bp, Artificial Sequence
  synthetic [barcode part1]
cagaacggtccaagtg

SEQ ID NO: 3915 - DNA, 16 bp, Artificial Sequence
  synthetic [barcode part1]
gttcactctgtccact

SEQ ID NO: 3916 - DNA, 16 bp, Artificial Sequence
  synthetic [barcode part1]
aggagatcttggcctt

SEQ ID NO: 3917 - DNA, 16 bp, Artificial Sequence
  synthetic [barcode part1]
cagacagttgtgatag

SEQ ID NO: 3918 - DNA, 16 bp, Artificial Sequence
  synthetic [barcode part1]
tcgtactgaactgtct

SEQ ID NO: 3919 - DNA, 16 bp, Artificial Sequence
  synthetic [barcode part1]
tgcgaatacctacgac

SEQ ID NO: 3920 - DNA, 16 bp, Artificial Sequence
  synthetic [barcode part1]
tcctgaacgcctactg

SEQ ID NO: 3921 - DNA, 16 bp, Artificial Sequence
  synthetic [barcode part1]
gtagaattgtccagag

SEQ ID NO: 3922 - DNA, 16 bp, Artificial Sequence
  synthetic [barcode part1]
gagtcgtatagtccgt

SEQ ID NO: 3923 - DNA, 16 bp, Artificial Sequence
  synthetic [barcode part1]
cgttcaacgcaagttg

SEQ ID NO: 3924 - DNA, 16 bp, Artificial Sequence
  synthetic [barcode part1]
gtaacggtcgttactg

SEQ ID NO: 3925 - DNA, 16 bp, Artificial Sequence
  synthetic [barcode part1]
gtcaaggaaggaatcg

SEQ ID NO: 3926 - DNA, 16 bp, Artificial Sequence
  synthetic [barcode part1]
accacggcctacttac

SEQ ID NO: 3927 - DNA, 16 bp, Artificial Sequence
  synthetic [barcode part1]
cctgaccgtattgatt

SEQ ID NO: 3928 - DNA, 16 bp, Artificial Sequence
  synthetic [barcode part1]
agttggcgaccttagt

SEQ ID NO: 3929 - DNA, 16 bp, Artificial Sequence
  synthetic [barcode part1]
attggcactgtgcaac

SEQ ID NO: 3930 - DNA, 16 bp, Artificial Sequence
  synthetic [barcode part1]
cgtacgacttaatcct

SEQ ID NO: 3931 - DNA, 16 bp, Artificial Sequence
  synthetic [barcode part1]
cgtgacgcacttactc

SEQ ID NO: 3932 - DNA, 16 bp, Artificial Sequence
  synthetic [barcode part1]
tgacgttcctaagacg

SEQ ID NO: 3933 - DNA, 16 bp, Artificial Sequence
  synthetic [barcode part1]
aactacgcgtacagtc

SEQ ID NO: 3934 - DNA, 16 bp, Artificial Sequence
  synthetic [barcode part1]
tcactatccacttcgc

SEQ ID NO: 3935 - DNA, 16 bp, Artificial Sequence
  synthetic [barcode part1]
gcgcaacttctgatcc

SEQ ID NO: 3936 - DNA, 16 bp, Artificial Sequence
  synthetic [barcode part1]
gagttatcgccagact

SEQ ID NO: 3937 - DNA, 16 bp, Artificial Sequence
  synthetic [barcode part1]
tccactgcgattcttc

SEQ ID NO: 3938 - DNA, 16 bp, Artificial Sequence
  synthetic [barcode part1]
tgcgatacctacttac

SEQ ID NO: 3939 - DNA, 16 bp, Artificial Sequence
  synthetic [barcode part1]
tctgtacttctcgcgt

SEQ ID NO: 3940 - DNA, 16 bp, Artificial Sequence
  synthetic [barcode part1]
ccgcgtccttatattc

SEQ ID NO: 3941 - DNA, 16 bp, Artificial Sequence
  synthetic [barcode part1]
aagtccgtctaactct

SEQ ID NO: 3942 - DNA, 16 bp, Artificial Sequence
  synthetic [barcode part1]
gtactgacagtaagac

SEQ ID NO: 3943 - DNA, 16 bp, Artificial Sequence
  synthetic [barcode part1]
aaccgcggatcagaac

SEQ ID NO: 3944 - DNA, 16 bp, Artificial Sequence
  synthetic [barcode part1]
tgcgatacgttcgtcc

SEQ ID NO: 3945 - DNA, 16 bp, Artificial Sequence
  synthetic [barcode part1]
ttacgttggacacgac

SEQ ID NO: 3946 - DNA, 16 bp, Artificial Sequence
  synthetic [barcode part1]
tggatctgaacttgcg

SEQ ID NO: 3947 - DNA, 16 bp, Artificial Sequence
  synthetic [barcode part1]
ttagttcgtggttacc

SEQ ID NO: 3948 - DNA, 16 bp, Artificial Sequence
  synthetic [barcode part1]
ataccaggagacggtc

SEQ ID NO: 3949 - DNA, 16 bp, Artificial Sequence
  synthetic [barcode part1]
caattccgaccaaggt

SEQ ID NO: 3950 - DNA, 16 bp, Artificial Sequence
  synthetic [barcode part1]
gtattctggttcggcc

SEQ ID NO: 3951 - DNA, 16 bp, Artificial Sequence
  synthetic [barcode part1]
acaccaactaggtgtc

SEQ ID NO: 3952 - DNA, 16 bp, Artificial Sequence
  synthetic [barcode part1]
gacttactccgagtag

SEQ ID NO: 3953 - DNA, 16 bp, Artificial Sequence
  synthetic [barcode part1]
cgcgtactataacacg

SEQ ID NO: 3954 - DNA, 16 bp, Artificial Sequence
  synthetic [barcode part1]
aaggtagtccgtcact

SEQ ID NO: 3955 - DNA, 16 bp, Artificial Sequence
  synthetic [barcode part1]
aaccaattgcgcgtgt

SEQ ID NO: 3956 - DNA, 16 bp, Artificial Sequence
  synthetic [barcode part1]
ttgtatacacacggcg

SEQ ID NO: 3957 - DNA, 16 bp, Artificial Sequence
  synthetic [barcode part1]
cacctctccgaatcag

SEQ ID NO: 3958 - DNA, 16 bp, Artificial Sequence
  synthetic [barcode part1]
attgattaccgcgacg

SEQ ID NO: 3959 - DNA, 16 bp, Artificial Sequence
  synthetic [barcode part1]
agtgatatccactgcg

SEQ ID NO: 3960 - DNA, 16 bp, Artificial Sequence
  synthetic [barcode part1]
acgttagagttcgtgc

SEQ ID NO: 3961 - DNA, 16 bp, Artificial Sequence
  synthetic [barcode part1]
gcaacgaccgtacaag

SEQ ID NO: 3962 - DNA, 16 bp, Artificial Sequence
  synthetic [barcode part1]
gagacttgagtcctac

SEQ ID NO: 3963 - DNA, 16 bp, Artificial Sequence
  synthetic [barcode part1]
gagaaccttctgatcg

SEQ ID NO: 3964 - DNA, 16 bp, Artificial Sequence
  synthetic [barcode part1]
taatactccgtccgcg

SEQ ID NO: 3965 - DNA, 16 bp, Artificial Sequence
  synthetic [barcode part1]
tgacgagtagacaccg

SEQ ID NO: 3966 - DNA, 16 bp, Artificial Sequence
  synthetic [barcode part1]
cgtgcacttagtcaag

SEQ ID NO: 3967 - DNA, 16 bp, Artificial Sequence
  synthetic [barcode part1]
actctagactgaccag

SEQ ID NO: 3968 - DNA, 16 bp, Artificial Sequence
  synthetic [barcode part1]
tctgacctagtgcacc

SEQ ID NO: 3969 - DNA, 16 bp, Artificial Sequence
  synthetic [barcode part1]
tcctgacgcgcaattc

SEQ ID NO: 3970 - DNA, 16 bp, Artificial Sequence
  synthetic [barcode part1]
tcagtagaggttgtcc

SEQ ID NO: 3971 - DNA, 16 bp, Artificial Sequence
  synthetic [barcode part1]
acacacttccagtccg

SEQ ID NO: 3972 - DNA, 16 bp, Artificial Sequence
  synthetic [barcode part1]
gtgtaaccacgtgatc

SEQ ID NO: 3973 - DNA, 16 bp, Artificial Sequence
  synthetic [barcode part1]
taaccgaaccgtgatc

SEQ ID NO: 3974 - DNA, 16 bp, Artificial Sequence
  synthetic [barcode part1]
aacttgcgatagagtg

SEQ ID NO: 3975 - DNA, 16 bp, Artificial Sequence
  synthetic [barcode part1]
agatcggaatcgagag

SEQ ID NO: 3976 - DNA, 16 bp, Artificial Sequence
  synthetic [barcode part1]
ttagacggcagattcc

SEQ ID NO: 3977 - DNA, 16 bp, Artificial Sequence
  synthetic [barcode part1]
tggaccactaggttgt

SEQ ID NO: 3978 - DNA, 16 bp, Artificial Sequence
  synthetic [barcode part1]
tgcaacactcactcgc

SEQ ID NO: 3979 - DNA, 16 bp, Artificial Sequence
  synthetic [barcode part1]
cagttagtccttcctc

SEQ ID NO: 3980 - DNA, 16 bp, Artificial Sequence
  synthetic [barcode part1]
gtcctggactatagtg

SEQ ID NO: 3981 - DNA, 16 bp, Artificial Sequence
  synthetic [barcode part1]
tccaccaagaacaacc

SEQ ID NO: 3982 - DNA, 16 bp, Artificial Sequence
  synthetic [barcode part1]
caagactagaagaggc

SEQ ID NO: 3983 - DNA, 16 bp, Artificial Sequence
  synthetic [barcode part1]
tgaacacctagtacgc

SEQ ID NO: 3984 - DNA, 16 bp, Artificial Sequence
  synthetic [barcode part1]
cgagactgttgcagtt

SEQ ID NO: 3985 - DNA, 16 bp, Artificial Sequence
  synthetic [barcode part1]
acaacgtacactgcac

SEQ ID NO: 3986 - DNA, 16 bp, Artificial Sequence
  synthetic [barcode part1]
tcacaggcgaggagtt

SEQ ID NO: 3987 - DNA, 16 bp, Artificial Sequence
  synthetic [barcode part1]
taatccggtgaaggcg

SEQ ID NO: 3988 - DNA, 16 bp, Artificial Sequence
  synthetic [barcode part1]
cacagagaccggattg

SEQ ID NO: 3989 - DNA, 16 bp, Artificial Sequence
  synthetic [barcode part1]
ccgaccttagaggatt

SEQ ID NO: 3990 - DNA, 16 bp, Artificial Sequence
  synthetic [barcode part1]
tggtccgttcaacaag

SEQ ID NO: 3991 - DNA, 16 bp, Artificial Sequence
  synthetic [barcode part1]
gcgtaatcacagttgc

SEQ ID NO: 3992 - DNA, 16 bp, Artificial Sequence
  synthetic [barcode part1]
tcctgactcagatatc

SEQ ID NO: 3993 - DNA, 16 bp, Artificial Sequence
  synthetic [barcode part1]
tgcaatcctctgccag

SEQ ID NO: 3994 - DNA, 16 bp, Artificial Sequence
  synthetic [barcode part1]
agaaggaaggaccttg

SEQ ID NO: 3995 - DNA, 16 bp, Artificial Sequence
  synthetic [barcode part1]
gtactgtgcagtgttg

SEQ ID NO: 3996 - DNA, 16 bp, Artificial Sequence
  synthetic [barcode part1]
tcaattcgtagtcgtc

SEQ ID NO: 3997 - DNA, 16 bp, Artificial Sequence
  synthetic [barcode part1]
agacttcaggaggaag

SEQ ID NO: 3998 - DNA, 16 bp, Artificial Sequence
  synthetic [barcode part1]
gtaaccggtcggtatt

SEQ ID NO: 3999 - DNA, 16 bp, Artificial Sequence
  synthetic [barcode part1]
acggacaccgtagtag

SEQ ID NO: 4000 - DNA, 16 bp, Artificial Sequence
  synthetic [barcode part1]
cacgcacagttctaag

SEQ ID NO: 4001 - DNA, 16 bp, Artificial Sequence
  synthetic [barcode part1]
ttctcgcggtaatccg

SEQ ID NO: 4002 - DNA, 16 bp, Artificial Sequence
  synthetic [barcode part1]
tgtgttctctgacagt

SEQ ID NO: 4003 - DNA, 16 bp, Artificial Sequence
  synthetic [barcode part1]
gaatcaagtgcgccag

SEQ ID NO: 4004 - DNA, 16 bp, Artificial Sequence
  synthetic [barcode part1]
aaggacgtgtctctac

SEQ ID NO: 4005 - DNA, 16 bp, Artificial Sequence
  synthetic [barcode part1]
tacctcgaatatctgc

SEQ ID NO: 4006 - DNA, 16 bp, Artificial Sequence
  synthetic [barcode part1]
gaggtgaatctcactc

SEQ ID NO: 4007 - DNA, 16 bp, Artificial Sequence
  synthetic [barcode part1]
accttcgtagaccacc

SEQ ID NO: 4008 - DNA, 16 bp, Artificial Sequence
  synthetic [barcode part1]
ttagattccttcgcag

SEQ ID NO: 4009 - DNA, 16 bp, Artificial Sequence
  synthetic [barcode part1]
tcctagtaggaaccgt

SEQ ID NO: 4010 - DNA, 16 bp, Artificial Sequence
  synthetic [barcode part1]
gtgaacctaatctcct

SEQ ID NO: 4011 - DNA, 16 bp, Artificial Sequence
  synthetic [barcode part1]
ccttgtgaaccactgc

SEQ ID NO: 4012 - DNA, 16 bp, Artificial Sequence
  synthetic [barcode part1]
atctctgatccagtgt

SEQ ID NO: 4013 - DNA, 16 bp, Artificial Sequence
  synthetic [barcode part1]
tggtacgacacgactt

SEQ ID NO: 4014 - DNA, 16 bp, Artificial Sequence
  synthetic [barcode part1]
tcactcgagacagatc

SEQ ID NO: 4015 - DNA, 16 bp, Artificial Sequence
  synthetic [barcode part1]
tagtgatcttccacgt

SEQ ID NO: 4016 - DNA, 16 bp, Artificial Sequence
  synthetic [barcode part1]
gaccgtgaaggttgac

SEQ ID NO: 4017 - DNA, 16 bp, Artificial Sequence
  synthetic [barcode part1]
ttgccaccttaagtac

SEQ ID NO: 4018 - DNA, 16 bp, Artificial Sequence
  synthetic [barcode part1]
cctgcacctaacaatt

SEQ ID NO: 4019 - DNA, 16 bp, Artificial Sequence
  synthetic [barcode part1]
taccgtcctatcactc

SEQ ID NO: 4020 - DNA, 16 bp, Artificial Sequence
  synthetic [barcode part1]
ttacgttaggcgcaac

SEQ ID NO: 4021 - DNA, 16 bp, Artificial Sequence
  synthetic [barcode part1]
tgtacaggaactgaac

SEQ ID NO: 4022 - DNA, 16 bp, Artificial Sequence
  synthetic [barcode part1]
ttcgtcgtgtaagttc

SEQ ID NO: 4023 - DNA, 16 bp, Artificial Sequence
  synthetic [barcode part1]
tacacaatcaccacct

SEQ ID NO: 4024 - DNA, 16 bp, Artificial Sequence
  synthetic [barcode part1]
cgtggaacaataactg

SEQ ID NO: 4025 - DNA, 16 bp, Artificial Sequence
  synthetic [barcode part1]
actcgcgtataggttg

SEQ ID NO: 4026 - DNA, 16 bp, Artificial Sequence
  synthetic [barcode part1]
cagttcctctcctaac

SEQ ID NO: 4027 - DNA, 16 bp, Artificial Sequence
  synthetic [barcode part1]
aggtatctctactacc

SEQ ID NO: 4028 - DNA, 16 bp, Artificial Sequence
  synthetic [barcode part1]
gaggaactgttgacgc

SEQ ID NO: 4029 - DNA, 16 bp, Artificial Sequence
  synthetic [barcode part1]
acctggattcagacgt

SEQ ID NO: 4030 - DNA, 16 bp, Artificial Sequence
  synthetic [barcode part1]
acggagacgacttgac

SEQ ID NO: 4031 - DNA, 16 bp, Artificial Sequence
  synthetic [barcode part1]
gcgacacactgattac

SEQ ID NO: 4032 - DNA, 16 bp, Artificial Sequence
  synthetic [barcode part1]
tcactcgcacctattc

SEQ ID NO: 4033 - DNA, 16 bp, Artificial Sequence
  synthetic [barcode part1]
tacgttcgttcggcgt

SEQ ID NO: 4034 - DNA, 16 bp, Artificial Sequence
  synthetic [barcode part1]
acctgccggtactgtt

SEQ ID NO: 4035 - DNA, 16 bp, Artificial Sequence
  synthetic [barcode part1]
aacgcgcgtgttaatc

SEQ ID NO: 4036 - DNA, 16 bp, Artificial Sequence
  synthetic [barcode part1]
ttcaacctcgacctct

SEQ ID NO: 4037 - DNA, 16 bp, Artificial Sequence
  synthetic [barcode part1]
attcactctgtgacac

SEQ ID NO: 4038 - DNA, 16 bp, Artificial Sequence
  synthetic [barcode part1]
aataaggcgtgaactc

SEQ ID NO: 4039 - DNA, 16 bp, Artificial Sequence
  synthetic [barcode part1]
tggagaggaagtcaac

SEQ ID NO: 4040 - DNA, 16 bp, Artificial Sequence
  synthetic [barcode part1]
aacacactgcagtcac

SEQ ID NO: 4041 - DNA, 16 bp, Artificial Sequence
  synthetic [barcode part1]
tcgtctgcctaagacc

SEQ ID NO: 4042 - DNA, 16 bp, Artificial Sequence
  synthetic [barcode part1]
tagtctcgagactggt

SEQ ID NO: 4043 - DNA, 16 bp, Artificial Sequence
  synthetic [barcode part1]
tggtgtacgactctcc

SEQ ID NO: 4044 - DNA, 16 bp, Artificial Sequence
  synthetic [barcode part1]
tgtacctcgttaggtt

SEQ ID NO: 4045 - DNA, 16 bp, Artificial Sequence
  synthetic [barcode part1]
cgagtgacttatccag

SEQ ID NO: 4046 - DNA, 16 bp, Artificial Sequence
  synthetic [barcode part1]
gatcgatccggaattc

SEQ ID NO: 4047 - DNA, 16 bp, Artificial Sequence
  synthetic [barcode part1]
agtcggatctgattcg

SEQ ID NO: 4048 - DNA, 16 bp, Artificial Sequence
  synthetic [barcode part1]
gtggtatattggtcgc

SEQ ID NO: 4049 - DNA, 16 bp, Artificial Sequence
  synthetic [barcode part1]
atactccacgtggagt

SEQ ID NO: 4050 - DNA, 16 bp, Artificial Sequence
  synthetic [barcode part1]
aggcaacacgtggttg

SEQ ID NO: 4051 - DNA, 16 bp, Artificial Sequence
  synthetic [barcode part1]
tataggaaccgaatcg

SEQ ID NO: 4052 - DNA, 16 bp, Artificial Sequence
  synthetic [barcode part1]
atccaaccaacaaccg

SEQ ID NO: 4053 - DNA, 16 bp, Artificial Sequence
  synthetic [barcode part1]
tgcaccttattggatc

SEQ ID NO: 4054 - DNA, 16 bp, Artificial Sequence
  synthetic [barcode part1]
tactctgcaggacagt

SEQ ID NO: 4055 - DNA, 16 bp, Artificial Sequence
  synthetic [barcode part1]
atcctgcgagtgttcc

SEQ ID NO: 4056 - DNA, 16 bp, Artificial Sequence
  synthetic [barcode part1]
ttctcgaggttgaggt

SEQ ID NO: 4057 - DNA, 16 bp, Artificial Sequence
  synthetic [barcode part1]
ttacgagaccttctac

SEQ ID NO: 4058 - DNA, 16 bp, Artificial Sequence
  synthetic [barcode part1]
acttgtggccgttctg

SEQ ID NO: 4059 - DNA, 16 bp, Artificial Sequence
  synthetic [barcode part1]
gactctatccgtccag

SEQ ID NO: 4060 - DNA, 16 bp, Artificial Sequence
  synthetic [barcode part1]
agtcagttgcagtacc

SEQ ID NO: 4061 - DNA, 16 bp, Artificial Sequence
  synthetic [barcode part1]
ttatcacctgtctcgc

SEQ ID NO: 4062 - DNA, 16 bp, Artificial Sequence
  synthetic [barcode part1]
gataagatacgttggc

SEQ ID NO: 4063 - DNA, 16 bp, Artificial Sequence
  synthetic [barcode part1]
gagactccacttgcct

SEQ ID NO: 4064 - DNA, 16 bp, Artificial Sequence
  synthetic [barcode part1]
tgtggcgttgtgatac

SEQ ID NO: 4065 - DNA, 16 bp, Artificial Sequence
  synthetic [barcode part1]
tggagtgttgtgcgag

SEQ ID NO: 4066 - DNA, 16 bp, Artificial Sequence
  synthetic [barcode part1]
gcgccagtagtgaagt

SEQ ID NO: 4067 - DNA, 16 bp, Artificial Sequence
  synthetic [barcode part1]
tacgactctcctggtg

SEQ ID NO: 4068 - DNA, 16 bp, Artificial Sequence
  synthetic [barcode part1]
agtcctattatccacg

SEQ ID NO: 4069 - DNA, 16 bp, Artificial Sequence
  synthetic [barcode part1]
agaatccttcgttcac

SEQ ID NO: 4070 - DNA, 16 bp, Artificial Sequence
  synthetic [barcode part1]
cgtcttcactaggtcg

SEQ ID NO: 4071 - DNA, 16 bp, Artificial Sequence
  synthetic [barcode part1]
gttacggcaggcaagt

SEQ ID NO: 4072 - DNA, 16 bp, Artificial Sequence
  synthetic [barcode part1]
tgcagttctggtgtag

SEQ ID NO: 4073 - DNA, 16 bp, Artificial Sequence
  synthetic [barcode part1]
gaggtcttgaagtcct

SEQ ID NO: 4074 - DNA, 16 bp, Artificial Sequence
  synthetic [barcode part1]
tattccttcggatcag

SEQ ID NO: 4075 - DNA, 16 bp, Artificial Sequence
  synthetic [barcode part1]
cagaactattggccac

SEQ ID NO: 4076 - DNA, 16 bp, Artificial Sequence
  synthetic [barcode part1]
tacgtggtcgttgcct

SEQ ID NO: 4077 - DNA, 16 bp, Artificial Sequence
  synthetic [barcode part1]
gtgatcttccggtaag

SEQ ID NO: 4078 - DNA, 16 bp, Artificial Sequence
  synthetic [barcode part1]
caagtctgatagaacg

SEQ ID NO: 4079 - DNA, 16 bp, Artificial Sequence
  synthetic [barcode part1]
ttggaggcgtattaag

SEQ ID NO: 4080 - DNA, 16 bp, Artificial Sequence
  synthetic [barcode part1]
agtgtatccagagagt

SEQ ID NO: 4081 - DNA, 16 bp, Artificial Sequence
  synthetic [barcode part1]
tactcagacgtccaag

SEQ ID NO: 4082 - DNA, 16 bp, Artificial Sequence
  synthetic [barcode part1]
caggattggaacttcc

SEQ ID NO: 4083 - DNA, 16 bp, Artificial Sequence
  synthetic [barcode part1]
tacaacgcctggaatc

SEQ ID NO: 4084 - DNA, 16 bp, Artificial Sequence
  synthetic [barcode part1]
actgcggagtgagtac

SEQ ID NO: 4085 - DNA, 16 bp, Artificial Sequence
  synthetic [barcode part1]
actaggtccgttagac

SEQ ID NO: 4086 - DNA, 16 bp, Artificial Sequence
  synthetic [barcode part1]
gaggagtgagttgaac

SEQ ID NO: 4087 - DNA, 16 bp, Artificial Sequence
  synthetic [barcode part1]
ttgactcggaccaagt

SEQ ID NO: 4088 - DNA, 16 bp, Artificial Sequence
  synthetic [barcode part1]
ccttaacgtcgaaggt

SEQ ID NO: 4089 - DNA, 16 bp, Artificial Sequence
  synthetic [barcode part1]
atcaccactcctgcag

SEQ ID NO: 4090 - DNA, 16 bp, Artificial Sequence
  synthetic [barcode part1]
acagtcaacactgacc

SEQ ID NO: 4091 - DNA, 16 bp, Artificial Sequence
  synthetic [barcode part1]
agactattggaggtgt

SEQ ID NO: 4092 - DNA, 16 bp, Artificial Sequence
  synthetic [barcode part1]
tgcagataacaagacc

SEQ ID NO: 4093 - DNA, 16 bp, Artificial Sequence
  synthetic [barcode part1]
gttggccaagatcttg

SEQ ID NO: 4094 - DNA, 16 bp, Artificial Sequence
  synthetic [barcode part1]
caagtctactctactg

SEQ ID NO: 4095 - DNA, 16 bp, Artificial Sequence
  synthetic [barcode part1]
tgcaagtctcactatc

SEQ ID NO: 4096 - DNA, 16 bp, Artificial Sequence
  synthetic [barcode part1]
ccacttgccgcaatac

SEQ ID NO: 4097 - DNA, 16 bp, Artificial Sequence
  synthetic [barcode part1]
cactaacagagaatcg

SEQ ID NO: 4098 - DNA, 16 bp, Artificial Sequence
  synthetic [barcode part1]
gttggcgacttctcac

SEQ ID NO: 4099 - DNA, 16 bp, Artificial Sequence
  synthetic [barcode part1]
gtctactcgtccactt

SEQ ID NO: 4100 - DNA, 16 bp, Artificial Sequence
  synthetic [barcode part1]
cagtgattacagagac

SEQ ID NO: 4101 - DNA, 16 bp, Artificial Sequence
  synthetic [barcode part1]
gtagttgccggttctc

SEQ ID NO: 4102 - DNA, 16 bp, Artificial Sequence
  synthetic [barcode part1]
ttgttactggagtggc

SEQ ID NO: 4103 - DNA, 16 bp, Artificial Sequence
  synthetic [barcode part1]
gtgttacgccttagag

SEQ ID NO: 4104 - DNA, 16 bp, Artificial Sequence
  synthetic [barcode part1]
tcggttacttcgagag

SEQ ID NO: 4105 - DNA, 16 bp, Artificial Sequence
  synthetic [barcode part1]
tcgagtgtccgtcgtt

SEQ ID NO: 4106 - DNA, 16 bp, Artificial Sequence
  synthetic [barcode part1]
aacagaggcgttcggt

SEQ ID NO: 4107 - DNA, 16 bp, Artificial Sequence
  synthetic [barcode part1]
gtagataggcagacag

SEQ ID NO: 4108 - DNA, 16 bp, Artificial Sequence
  synthetic [barcode part1]
gtggcactaactaacc

SEQ ID NO: 4109 - DNA, 16 bp, Artificial Sequence
  synthetic [barcode part1]
tagtcttaccacgtac

SEQ ID NO: 4110 - DNA, 16 bp, Artificial Sequence
  synthetic [barcode part1]
tattagaacggtccgc

SEQ ID NO: 4111 - DNA, 16 bp, Artificial Sequence
  synthetic [barcode part1]
ttggactgtcaggttg

SEQ ID NO: 4112 - DNA, 16 bp, Artificial Sequence
  synthetic [barcode part1]
tactgcactgagactg

SEQ ID NO: 4113 - DNA, 16 bp, Artificial Sequence
  synthetic [barcode part1]
cggatactagtgaagt

SEQ ID NO: 4114 - DNA, 16 bp, Artificial Sequence
  synthetic [barcode part1]
tagactattccgcact

SEQ ID NO: 4115 - DNA, 16 bp, Artificial Sequence
  synthetic [barcode part1]
agaggtcggaattgag

SEQ ID NO: 4116 - DNA, 16 bp, Artificial Sequence
  synthetic [barcode part1]
caacttcgccacacgt

SEQ ID NO: 4117 - DNA, 16 bp, Artificial Sequence
  synthetic [barcode part1]
accacctgcagattcc

SEQ ID NO: 4118 - DNA, 16 bp, Artificial Sequence
  synthetic [barcode part1]
gactcctgcgtagttc

SEQ ID NO: 4119 - DNA, 16 bp, Artificial Sequence
  synthetic [barcode part1]
tcacctgaataccgcc

SEQ ID NO: 4120 - DNA, 16 bp, Artificial Sequence
  synthetic [barcode part1]
tctcaacttctgccgt

SEQ ID NO: 4121 - DNA, 16 bp, Artificial Sequence
  synthetic [barcode part1]
gtgcaaggcaatccag

SEQ ID NO: 4122 - DNA, 16 bp, Artificial Sequence
  synthetic [barcode part1]
ttgcgaagtagaacac

SEQ ID NO: 4123 - DNA, 16 bp, Artificial Sequence
  synthetic [barcode part1]
gatacgcacgccaatt

SEQ ID NO: 4124 - DNA, 16 bp, Artificial Sequence
  synthetic [barcode part1]
attcgtcagtgtcact

SEQ ID NO: 4125 - DNA, 16 bp, Artificial Sequence
  synthetic [barcode part1]
agagtccagacagatt

SEQ ID NO: 4126 - DNA, 16 bp, Artificial Sequence
  synthetic [barcode part1]
ataacttacgaggacg

SEQ ID NO: 4127 - DNA, 16 bp, Artificial Sequence
  synthetic [barcode part1]
tgatcaggtaccgtac

SEQ ID NO: 4128 - DNA, 16 bp, Artificial Sequence
  synthetic [barcode part1]
tgtgactcagtaagag

SEQ ID NO: 4129 - DNA, 16 bp, Artificial Sequence
  synthetic [barcode part1]
agatccagacgtgttc

SEQ ID NO: 4130 - DNA, 16 bp, Artificial Sequence
  synthetic [barcode part1]
tctctgagttggtgtt

SEQ ID NO: 4131 - DNA, 16 bp, Artificial Sequence
  synthetic [barcode part1]
gacagtcgtgtctcct

SEQ ID NO: 4132 - DNA, 16 bp, Artificial Sequence
  synthetic [barcode part1]
agtcttccttcgtcgt

SEQ ID NO: 4133 - DNA, 16 bp, Artificial Sequence
  synthetic [barcode part1]
tccaacaggcaatctg

SEQ ID NO: 4134 - DNA, 16 bp, Artificial Sequence
  synthetic [barcode part1]
caagtctcgttcagag

SEQ ID NO: 4135 - DNA, 16 bp, Artificial Sequence
  synthetic [barcode part1]
cgtaacacaggtggac

SEQ ID NO: 4136 - DNA, 16 bp, Artificial Sequence
  synthetic [barcode part1]
aatccttaatctgcgc

SEQ ID NO: 4137 - DNA, 16 bp, Artificial Sequence
  synthetic [barcode part1]
atctgagaggtctgtc

SEQ ID NO: 4138 - DNA, 16 bp, Artificial Sequence
  synthetic [barcode part1]
cgttaagtgtcagacc

SEQ ID NO: 4139 - DNA, 16 bp, Artificial Sequence
  synthetic [barcode part1]
gttcgtagttgaagag

SEQ ID NO: 4140 - DNA, 16 bp, Artificial Sequence
  synthetic [barcode part1]
gtgtgattctctcaac

SEQ ID NO: 4141 - DNA, 16 bp, Artificial Sequence
  synthetic [barcode part1]
ttgcgtaatcggtacg

SEQ ID NO: 4142 - DNA, 16 bp, Artificial Sequence
  synthetic [barcode part1]
tacggcactgtagtgt

SEQ ID NO: 4143 - DNA, 16 bp, Artificial Sequence
  synthetic [barcode part1]
tccacgtagtcgttgc

SEQ ID NO: 4144 - DNA, 16 bp, Artificial Sequence
  synthetic [barcode part1]
acaagtccggcagaac

SEQ ID NO: 4145 - DNA, 16 bp, Artificial Sequence
  synthetic [barcode part1]
taggttcgcagattcg

SEQ ID NO: 4146 - DNA, 16 bp, Artificial Sequence
  synthetic [barcode part1]
tcttgttgcctgcgag

SEQ ID NO: 4147 - DNA, 16 bp, Artificial Sequence
  synthetic [barcode part1]
attaatccgtggcgtg

SEQ ID NO: 4148 - DNA, 16 bp, Artificial Sequence
  synthetic [barcode part1]
tccgttcgcgaataag

SEQ ID NO: 4149 - DNA, 16 bp, Artificial Sequence
  synthetic [barcode part1]
ttcctcctcagttggt

SEQ ID NO: 4150 - DNA, 16 bp, Artificial Sequence
  synthetic [barcode part1]
attctctccgaggaag

SEQ ID NO: 4151 - DNA, 16 bp, Artificial Sequence
  synthetic [barcode part1]
gttaaccggttggttg

SEQ ID NO: 4152 - DNA, 16 bp, Artificial Sequence
  synthetic [barcode part1]
acgaagaggaggtgtt

SEQ ID NO: 4153 - DNA, 16 bp, Artificial Sequence
  synthetic [barcode part1]
cctgagagtcgcaatt

SEQ ID NO: 4154 - DNA, 16 bp, Artificial Sequence
  synthetic [barcode part1]
tgactagactgcgatc

SEQ ID NO: 4155 - DNA, 16 bp, Artificial Sequence
  synthetic [barcode part1]
tgtactggaggaaccg

SEQ ID NO: 4156 - DNA, 16 bp, Artificial Sequence
  synthetic [barcode part1]
aggcaagtcgcagtac

SEQ ID NO: 4157 - DNA, 16 bp, Artificial Sequence
  synthetic [barcode part1]
cgtcctgacaggtctt

SEQ ID NO: 4158 - DNA, 16 bp, Artificial Sequence
  synthetic [barcode part1]
aactcgttagacgtcg

SEQ ID NO: 4159 - DNA, 16 bp, Artificial Sequence
  synthetic [barcode part1]
acttgcaggaggtcag

SEQ ID NO: 4160 - DNA, 16 bp, Artificial Sequence
  synthetic [barcode part1]
gaaggcggcaacttgt

SEQ ID NO: 4161 - DNA, 16 bp, Artificial Sequence
  synthetic [barcode part1]
acactcttgatctggt

SEQ ID NO: 4162 - DNA, 16 bp, Artificial Sequence
  synthetic [barcode part1]
tggactacgtgaaggc

SEQ ID NO: 4163 - DNA, 16 bp, Artificial Sequence
  synthetic [barcode part1]
agatcacacaagaacc

SEQ ID NO: 4164 - DNA, 16 bp, Artificial Sequence
  synthetic [barcode part1]
accagttaggaccttg

SEQ ID NO: 4165 - DNA, 16 bp, Artificial Sequence
  synthetic [barcode part1]
tgcacgattgttacct

SEQ ID NO: 4166 - DNA, 16 bp, Artificial Sequence
  synthetic [barcode part1]
gactagttaaccggtc

SEQ ID NO: 4167 - DNA, 16 bp, Artificial Sequence
  synthetic [barcode part1]
ccgatctataaggtgc

SEQ ID NO: 4168 - DNA, 16 bp, Artificial Sequence
  synthetic [barcode part1]
ttaactcggtgtactc

SEQ ID NO: 4169 - DNA, 16 bp, Artificial Sequence
  synthetic [barcode part1]
tcacaaggcctctcac

SEQ ID NO: 4170 - DNA, 16 bp, Artificial Sequence
  synthetic [barcode part1]
acagtaactgttgccg

SEQ ID NO: 4171 - DNA, 16 bp, Artificial Sequence
  synthetic [barcode part1]
ccaagtacacttaggc

SEQ ID NO: 4172 - DNA, 16 bp, Artificial Sequence
  synthetic [barcode part1]
acgttcactattccag

SEQ ID NO: 4173 - DNA, 16 bp, Artificial Sequence
  synthetic [barcode part1]
gacgatcgactcgatt

SEQ ID NO: 4174 - DNA, 16 bp, Artificial Sequence
  synthetic [barcode part1]
gacgtattgcgatcac

SEQ ID NO: 4175 - DNA, 16 bp, Artificial Sequence
  synthetic [barcode part1]
cacttgatacaggtcg

SEQ ID NO: 4176 - DNA, 16 bp, Artificial Sequence
  synthetic [barcode part1]
gtacctccgatctgac

SEQ ID NO: 4177 - DNA, 16 bp, Artificial Sequence
  synthetic [barcode part1]
caccttgaacagaacc

SEQ ID NO: 4178 - DNA, 16 bp, Artificial Sequence
  synthetic [barcode part1]
acttcgactaggactg

SEQ ID NO: 4179 - DNA, 16 bp, Artificial Sequence
  synthetic [barcode part1]
atctccgacagagatc

SEQ ID NO: 4180 - DNA, 16 bp, Artificial Sequence
  synthetic [barcode part1]
ttccgactgtatcggc

SEQ ID NO: 4181 - DNA, 16 bp, Artificial Sequence
  synthetic [barcode part1]
caactcaggtgcagag

SEQ ID NO: 4182 - DNA, 16 bp, Artificial Sequence
  synthetic [barcode part1]
cacttcacagacactt

SEQ ID NO: 4183 - DNA, 16 bp, Artificial Sequence
  synthetic [barcode part1]
aaccaacaccagttgc

SEQ ID NO: 4184 - DNA, 16 bp, Artificial Sequence
  synthetic [barcode part1]
agagtcgtgtatcaag

SEQ ID NO: 4185 - DNA, 16 bp, Artificial Sequence
  synthetic [barcode part1]
cgtagaggccactaag

SEQ ID NO: 4186 - DNA, 16 bp, Artificial Sequence
  synthetic [barcode part1]
cacgtgatactctact

SEQ ID NO: 4187 - DNA, 16 bp, Artificial Sequence
  synthetic [barcode part1]
acggaacacttcgttg

SEQ ID NO: 4188 - DNA, 16 bp, Artificial Sequence
  synthetic [barcode part1]
actagtgtgagtccac

SEQ ID NO: 4189 - DNA, 16 bp, Artificial Sequence
  synthetic [barcode part1]
tatctcaccgcaggtc

SEQ ID NO: 4190 - DNA, 16 bp, Artificial Sequence
  synthetic [barcode part1]
gcagaggtcaggttgt

SEQ ID NO: 4191 - DNA, 16 bp, Artificial Sequence
  synthetic [barcode part1]
tgacgcacgaccttct

SEQ ID NO: 4192 - DNA, 16 bp, Artificial Sequence
  synthetic [barcode part1]
aacaccaagtcctgac

SEQ ID NO: 4193 - DNA, 16 bp, Artificial Sequence
  synthetic [barcode part1]
ttaaccgtgtagtgcg

SEQ ID NO: 4194 - DNA, 16 bp, Artificial Sequence
  synthetic [barcode part1]
tacacactcaggactg

SEQ ID NO: 4195 - DNA, 16 bp, Artificial Sequence
  synthetic [barcode part1]
agaatagacggattcc

SEQ ID NO: 4196 - DNA, 16 bp, Artificial Sequence
  synthetic [barcode part1]
gtctctgcgttgaacc

SEQ ID NO: 4197 - DNA, 16 bp, Artificial Sequence
  synthetic [barcode part1]
ttacgttatccagtgc

SEQ ID NO: 4198 - DNA, 16 bp, Artificial Sequence
  synthetic [barcode part1]
acaagagtcggattgt

SEQ ID NO: 4199 - DNA, 16 bp, Artificial Sequence
  synthetic [barcode part1]
cgcgacactataacac

SEQ ID NO: 4200 - DNA, 16 bp, Artificial Sequence
  synthetic [barcode part1]
atctgtcacctgcctt

SEQ ID NO: 4201 - DNA, 16 bp, Artificial Sequence
  synthetic [barcode part1]
tacgtaggtgagatac

SEQ ID NO: 4202 - DNA, 16 bp, Artificial Sequence
  synthetic [barcode part1]
ttctgagtctaaggcg

SEQ ID NO: 4203 - DNA, 16 bp, Artificial Sequence
  synthetic [barcode part1]
tgtgaggatatcctcg

SEQ ID NO: 4204 - DNA, 16 bp, Artificial Sequence
  synthetic [barcode part1]
cagtactgtgagtaag

SEQ ID NO: 4205 - DNA, 16 bp, Artificial Sequence
  synthetic [barcode part1]
acttgacctgacagtg

SEQ ID NO: 4206 - DNA, 16 bp, Artificial Sequence
  synthetic [barcode part1]
gtcaggaagttctctg

SEQ ID NO: 4207 - DNA, 16 bp, Artificial Sequence
  synthetic [barcode part1]
tgttcgacagtagaag

SEQ ID NO: 4208 - DNA, 16 bp, Artificial Sequence
  synthetic [barcode part1]
aacttggcctctatac

SEQ ID NO: 4209 - DNA, 16 bp, Artificial Sequence
  synthetic [barcode part1]
tggtactcgtcacaag

SEQ ID NO: 4210 - DNA, 16 bp, Artificial Sequence
  synthetic [barcode part1]
gtagtgcagagaaggt

SEQ ID NO: 4211 - DNA, 16 bp, Artificial Sequence
  synthetic [barcode part1]
tctaactgcgtaccgc

SEQ ID NO: 4212 - DNA, 16 bp, Artificial Sequence
  synthetic [barcode part1]
cgacgacgaagtgtac

SEQ ID NO: 4213 - DNA, 16 bp, Artificial Sequence
  synthetic [barcode part1]
aggattctaggacctc

SEQ ID NO: 4214 - DNA, 16 bp, Artificial Sequence
  synthetic [barcode part1]
tgagagaggtcctctt

SEQ ID NO: 4215 - DNA, 16 bp, Artificial Sequence
  synthetic [barcode part1]
gtctccacgttagacc

SEQ ID NO: 4216 - DNA, 16 bp, Artificial Sequence
  synthetic [barcode part1]
gagtactgtccacaac

SEQ ID NO: 4217 - DNA, 16 bp, Artificial Sequence
  synthetic [barcode part1]
atagttacgcacgacc

SEQ ID NO: 4218 - DNA, 16 bp, Artificial Sequence
  synthetic [barcode part1]
cacctactaaggcctc

SEQ ID NO: 4219 - DNA, 16 bp, Artificial Sequence
  synthetic [barcode part1]
ttcactaccgagtatc

SEQ ID NO: 4220 - DNA, 16 bp, Artificial Sequence
  synthetic [barcode part1]
caaccgactggttagt

SEQ ID NO: 4221 - DNA, 16 bp, Artificial Sequence
  synthetic [barcode part1]
cctctgtgttcggtag

SEQ ID NO: 4222 - DNA, 16 bp, Artificial Sequence
  synthetic [barcode part1]
aactattaggcacgag

SEQ ID NO: 4223 - DNA, 16 bp, Artificial Sequence
  synthetic [barcode part1]
tggtatcacttcggag

SEQ ID NO: 4224 - DNA, 16 bp, Artificial Sequence
  synthetic [barcode part1]
cagtagtcacggagac

SEQ ID NO: 4225 - DNA, 16 bp, Artificial Sequence
  synthetic [barcode part1]
aacctaacggtccagt

SEQ ID NO: 4226 - DNA, 16 bp, Artificial Sequence
  synthetic [barcode part1]
gattggttacggtacc

SEQ ID NO: 4227 - DNA, 16 bp, Artificial Sequence
  synthetic [barcode part1]
tcctcaaggaagacct

SEQ ID NO: 4228 - DNA, 16 bp, Artificial Sequence
  synthetic [barcode part1]
gtctagtgattcgacg

SEQ ID NO: 4229 - DNA, 16 bp, Artificial Sequence
  synthetic [barcode part1]
aacgttggtgtcacac

SEQ ID NO: 4230 - DNA, 16 bp, Artificial Sequence
  synthetic [barcode part1]
tccacgtcaacgactc

SEQ ID NO: 4231 - DNA, 16 bp, Artificial Sequence
  synthetic [barcode part1]
acagaggaccaggttc

SEQ ID NO: 4232 - DNA, 16 bp, Artificial Sequence
  synthetic [barcode part1]
tgtaagtggtggagtt

SEQ ID NO: 4233 - DNA, 16 bp, Artificial Sequence
  synthetic [barcode part1]
gcaagacggatagtag

SEQ ID NO: 4234 - DNA, 16 bp, Artificial Sequence
  synthetic [barcode part1]
cgaacttaacgtccag

SEQ ID NO: 4235 - DNA, 16 bp, Artificial Sequence
  synthetic [barcode part1]
cacaggaactattgag

SEQ ID NO: 4236 - DNA, 16 bp, Artificial Sequence
  synthetic [barcode part1]
tcctgactgcaagtcc

SEQ ID NO: 4237 - DNA, 16 bp, Artificial Sequence
  synthetic [barcode part1]
tctagactaggcctag

SEQ ID NO: 4238 - DNA, 16 bp, Artificial Sequence
  synthetic [barcode part1]
ttctcggaaggaactc

SEQ ID NO: 4239 - DNA, 16 bp, Artificial Sequence
  synthetic [barcode part1]
caagaggaaccaagac

SEQ ID NO: 4240 - DNA, 16 bp, Artificial Sequence
  synthetic [barcode part1]
gtaagtacgaggcctg

SEQ ID NO: 4241 - DNA, 16 bp, Artificial Sequence
  synthetic [barcode part1]
cgttagtaatcgagag

SEQ ID NO: 4242 - DNA, 16 bp, Artificial Sequence
  synthetic [barcode part1]
aacgccacgcaatact

SEQ ID NO: 4243 - DNA, 16 bp, Artificial Sequence
  synthetic [barcode part1]
taatcgccgtcctacg

SEQ ID NO: 4244 - DNA, 16 bp, Artificial Sequence
  synthetic [barcode part1]
atcggatccgttgaac

SEQ ID NO: 4245 - DNA, 16 bp, Artificial Sequence
  synthetic [barcode part1]
tggaggtaacggttcg

SEQ ID NO: 4246 - DNA, 16 bp, Artificial Sequence
  synthetic [barcode part1]
agaacgcgtcgtcaag

SEQ ID NO: 4247 - DNA, 16 bp, Artificial Sequence
  synthetic [barcode part1]
aactcgagactcagtc

SEQ ID NO: 4248 - DNA, 16 bp, Artificial Sequence
  synthetic [barcode part1]
cctcgcactggtgatt

SEQ ID NO: 4249 - DNA, 16 bp, Artificial Sequence
  synthetic [barcode part1]
gacttacacaggtctg

SEQ ID NO: 4250 - DNA, 16 bp, Artificial Sequence
  synthetic [barcode part1]
gttcaagacgatagac

SEQ ID NO: 4251 - DNA, 16 bp, Artificial Sequence
  synthetic [barcode part1]
cacaatcgcgtagttg

SEQ ID NO: 4252 - DNA, 16 bp, Artificial Sequence
  synthetic [barcode part1]
tgacacacctcactgc

SEQ ID NO: 4253 - DNA, 16 bp, Artificial Sequence
  synthetic [barcode part1]
tccgagactaactggt

SEQ ID NO: 4254 - DNA, 16 bp, Artificial Sequence
  synthetic [barcode part1]
gcgcgataaccttctc

SEQ ID NO: 4255 - DNA, 16 bp, Artificial Sequence
  synthetic [barcode part1]
atctatcggcgtcacc

SEQ ID NO: 4256 - DNA, 16 bp, Artificial Sequence
  synthetic [barcode part1]
atctccgaggtcactc

SEQ ID NO: 4257 - DNA, 16 bp, Artificial Sequence
  synthetic [barcode part1]
tacgtgttcaggactg

SEQ ID NO: 4258 - DNA, 16 bp, Artificial Sequence
  synthetic [barcode part1]
tctgattatcacgtgc

SEQ ID NO: 4259 - DNA, 16 bp, Artificial Sequence
  synthetic [barcode part1]
tgtctgtaacaccgtt

SEQ ID NO: 4260 - DNA, 16 bp, Artificial Sequence
  synthetic [barcode part1]
gaccacggtattaacc

SEQ ID NO: 4261 - DNA, 16 bp, Artificial Sequence
  synthetic [barcode part1]
gacactgaccacaact

SEQ ID NO: 4262 - DNA, 16 bp, Artificial Sequence
  synthetic [barcode part1]
cagaggtattcctacg

SEQ ID NO: 4263 - DNA, 16 bp, Artificial Sequence
  synthetic [barcode part1]
acaccgaaggagtcgt

SEQ ID NO: 4264 - DNA, 16 bp, Artificial Sequence
  synthetic [barcode part1]
gaggtgtagaacacag

SEQ ID NO: 4265 - DNA, 16 bp, Artificial Sequence
  synthetic [barcode part1]
tgacgcaagttcacgt

SEQ ID NO: 4266 - DNA, 16 bp, Artificial Sequence
  synthetic [barcode part1]
gtgaagatcttcgcgt

SEQ ID NO: 4267 - DNA, 16 bp, Artificial Sequence
  synthetic [barcode part1]
cggcggatagatactg

SEQ ID NO: 4268 - DNA, 16 bp, Artificial Sequence
  synthetic [barcode part1]
gaacacggtataggag

SEQ ID NO: 4269 - DNA, 16 bp, Artificial Sequence
  synthetic [barcode part1]
gacctggaaggtgtac

SEQ ID NO: 4270 - DNA, 16 bp, Artificial Sequence
  synthetic [barcode part1]
tggaacgatctaagtg

SEQ ID NO: 4271 - DNA, 16 bp, Artificial Sequence
  synthetic [barcode part1]
ttactgcagacctgtt

SEQ ID NO: 4272 - DNA, 16 bp, Artificial Sequence
  synthetic [barcode part1]
cggaagttaagttacg

SEQ ID NO: 4273 - DNA, 16 bp, Artificial Sequence
  synthetic [barcode part1]
acggagtgtgatagag

SEQ ID NO: 4274 - DNA, 16 bp, Artificial Sequence
  synthetic [barcode part1]
gacaggacacgagttc

SEQ ID NO: 4275 - DNA, 16 bp, Artificial Sequence
  synthetic [barcode part1]
tgttaggatctccgcc

SEQ ID NO: 4276 - DNA, 16 bp, Artificial Sequence
  synthetic [barcode part1]
tggcgtggtattcaac

SEQ ID NO: 4277 - DNA, 16 bp, Artificial Sequence
  synthetic [barcode part1]
tggtgcgagttgtatc

SEQ ID NO: 4278 - DNA, 16 bp, Artificial Sequence
  synthetic [barcode part1]
gtgacgttcgagactt

SEQ ID NO: 4279 - DNA, 16 bp, Artificial Sequence
  synthetic [barcode part1]
tggtggaacgaacctg

SEQ ID NO: 4280 - DNA, 16 bp, Artificial Sequence
  synthetic [barcode part1]
aggtgaccagtaagag

SEQ ID NO: 4281 - DNA, 16 bp, Artificial Sequence
  synthetic [barcode part1]
ttagtctgtaaccgtc

SEQ ID NO: 4282 - DNA, 16 bp, Artificial Sequence
  synthetic [barcode part1]
gatagattcgtccacg

SEQ ID NO: 4283 - DNA, 16 bp, Artificial Sequence
  synthetic [barcode part1]
gtcacctctacggatc

SEQ ID NO: 4284 - DNA, 16 bp, Artificial Sequence
  synthetic [barcode part1]
acgatctgtccttgcg

SEQ ID NO: 4285 - DNA, 16 bp, Artificial Sequence
  synthetic [barcode part1]
tattaaggttcctgcc

SEQ ID NO: 4286 - DNA, 16 bp, Artificial Sequence
  synthetic [barcode part1]
gaactgtgcgagagtc

SEQ ID NO: 4287 - DNA, 16 bp, Artificial Sequence
  synthetic [barcode part1]
acactgacctctgacc

SEQ ID NO: 4288 - DNA, 16 bp, Artificial Sequence
  synthetic [barcode part1]
cggttggttaagatcc

SEQ ID NO: 4289 - DNA, 16 bp, Artificial Sequence
  synthetic [barcode part1]
tggagagaggatcaac

SEQ ID NO: 4290 - DNA, 16 bp, Artificial Sequence
  synthetic [barcode part1]
cctagtctcttggttc

SEQ ID NO: 4291 - DNA, 16 bp, Artificial Sequence
  synthetic [barcode part1]
ttaacctgtctgagtc

SEQ ID NO: 4292 - DNA, 16 bp, Artificial Sequence
  synthetic [barcode part1]
gacactggtcacagtt

SEQ ID NO: 4293 - DNA, 16 bp, Artificial Sequence
  synthetic [barcode part1]
tggcgtgtacagattc

SEQ ID NO: 4294 - DNA, 16 bp, Artificial Sequence
  synthetic [barcode part1]
cgacagattgtcctag

SEQ ID NO: 4295 - DNA, 16 bp, Artificial Sequence
  synthetic [barcode part1]
tatctcgacagactct

SEQ ID NO: 4296 - DNA, 16 bp, Artificial Sequence
  synthetic [barcode part1]
tcgttgtatctacggt

SEQ ID NO: 4297 - DNA, 16 bp, Artificial Sequence
  synthetic [barcode part1]
cacttcgaccttatcc

SEQ ID NO: 4298 - DNA, 16 bp, Artificial Sequence
  synthetic [barcode part1]
ccgacgtgtgtattag

SEQ ID NO: 4299 - DNA, 16 bp, Artificial Sequence
  synthetic [barcode part1]
gagttgcgcagaggtt

SEQ ID NO: 4300 - DNA, 16 bp, Artificial Sequence
  synthetic [barcode part1]
cacactactaactctg

SEQ ID NO: 4301 - DNA, 16 bp, Artificial Sequence
  synthetic [barcode part1]
tggcgtaactgttctt

SEQ ID NO: 4302 - DNA, 16 bp, Artificial Sequence
  synthetic [barcode part1]
cggttatcggatctag

SEQ ID NO: 4303 - DNA, 16 bp, Artificial Sequence
  synthetic [barcode part1]
gtggattccttactac

SEQ ID NO: 4304 - DNA, 16 bp, Artificial Sequence
  synthetic [barcode part1]
gagtgacaacctatag

SEQ ID NO: 4305 - DNA, 16 bp, Artificial Sequence
  synthetic [barcode part1]
gccgaacgagtacaac

SEQ ID NO: 4306 - DNA, 16 bp, Artificial Sequence
  synthetic [barcode part1]
gaacgttcggaataac

SEQ ID NO: 4307 - DNA, 16 bp, Artificial Sequence
  synthetic [barcode part1]
cgtgaacaggtctgtt

SEQ ID NO: 4308 - DNA, 16 bp, Artificial Sequence
  synthetic [barcode part1]
gaatcgtcgttgaacc

SEQ ID NO: 4309 - DNA, 16 bp, Artificial Sequence
  synthetic [barcode part1]
tctaggagtcggttac

SEQ ID NO: 4310 - DNA, 16 bp, Artificial Sequence
  synthetic [barcode part1]
tgaggacttcgacgag

SEQ ID NO: 4311 - DNA, 16 bp, Artificial Sequence
  synthetic [barcode part1]
ttaggaacggtctctg

SEQ ID NO: 4312 - DNA, 16 bp, Artificial Sequence
  synthetic [barcode part1]
agacgcactctatacg

SEQ ID NO: 4313 - DNA, 16 bp, Artificial Sequence
  synthetic [barcode part1]
gtccgcctattataac

SEQ ID NO: 4314 - DNA, 16 bp, Artificial Sequence
  synthetic [barcode part1]
tgtaacggtgacgttc

SEQ ID NO: 4315 - DNA, 16 bp, Artificial Sequence
  synthetic [barcode part1]
taggactcagttggtc

SEQ ID NO: 4316 - DNA, 16 bp, Artificial Sequence
  synthetic [barcode part1]
gatcacggttacacgt

SEQ ID NO: 4317 - DNA, 16 bp, Artificial Sequence
  synthetic [barcode part1]
gtaccaggtgcaactt

SEQ ID NO: 4318 - DNA, 16 bp, Artificial Sequence
  synthetic [barcode part1]
cgcaacctatagatcg

SEQ ID NO: 4319 - DNA, 16 bp, Artificial Sequence
  synthetic [barcode part1]
ccagtagtgaggacgt

SEQ ID NO: 4320 - DNA, 16 bp, Artificial Sequence
  synthetic [barcode part1]
acttggactgcgaatc

SEQ ID NO: 4321 - DNA, 16 bp, Artificial Sequence
  synthetic [barcode part1]
aatctgcgtagacctg

SEQ ID NO: 4322 - DNA, 16 bp, Artificial Sequence
  synthetic [barcode part1]
tgagatcgtcagttgc

SEQ ID NO: 4323 - DNA, 16 bp, Artificial Sequence
  synthetic [barcode part1]
cgtctgtatagtatcc

SEQ ID NO: 4324 - DNA, 16 bp, Artificial Sequence
  synthetic [barcode part1]
ttgaagtaggcggatt

SEQ ID NO: 4325 - DNA, 16 bp, Artificial Sequence
  synthetic [barcode part1]
cgtgcaagtgatcgtt

SEQ ID NO: 4326 - DNA, 16 bp, Artificial Sequence
  synthetic [barcode part1]
cgaattggcgtctctc

SEQ ID NO: 4327 - DNA, 16 bp, Artificial Sequence
  synthetic [barcode part1]
tcacagacagacctac

SEQ ID NO: 4328 - DNA, 16 bp, Artificial Sequence
  synthetic [barcode part1]
cgaacgactattcgtg

SEQ ID NO: 4329 - DNA, 16 bp, Artificial Sequence
  synthetic [barcode part1]
tctacttccactcgtg

SEQ ID NO: 4330 - DNA, 16 bp, Artificial Sequence
  synthetic [barcode part1]
cctaaggtacacacgt

SEQ ID NO: 4331 - DNA, 16 bp, Artificial Sequence
  synthetic [barcode part1]
acggaaccgaagtaag

SEQ ID NO: 4332 - DNA, 16 bp, Artificial Sequence
  synthetic [barcode part1]
cggtaataccaccaac

SEQ ID NO: 4333 - DNA, 16 bp, Artificial Sequence
  synthetic [barcode part1]
taggatattcgcgaag

SEQ ID NO: 4334 - DNA, 16 bp, Artificial Sequence
  synthetic [barcode part1]
gtcacctcgttcagac

SEQ ID NO: 4335 - DNA, 16 bp, Artificial Sequence
  synthetic [barcode part1]
atcgagtatctccgcc

SEQ ID NO: 4336 - DNA, 16 bp, Artificial Sequence
  synthetic [barcode part1]
ataggcggaacctcag

SEQ ID NO: 4337 - DNA, 16 bp, Artificial Sequence
  synthetic [barcode part1]
acctgccacttatcct

SEQ ID NO: 4338 - DNA, 16 bp, Artificial Sequence
  synthetic [barcode part1]
gtccaagacgacaggt

SEQ ID NO: 4339 - DNA, 16 bp, Artificial Sequence
  synthetic [barcode part1]
actcaactacgagaag

SEQ ID NO: 4340 - DNA, 16 bp, Artificial Sequence
  synthetic [barcode part1]
acaaggagacctgatt

SEQ ID NO: 4341 - DNA, 16 bp, Artificial Sequence
  synthetic [barcode part1]
tgtcttacctgttgcc

SEQ ID NO: 4342 - DNA, 16 bp, Artificial Sequence
  synthetic [barcode part1]
ccgatctagtggtaac

SEQ ID NO: 4343 - DNA, 16 bp, Artificial Sequence
  synthetic [barcode part1]
agtcgcctagaggtag

SEQ ID NO: 4344 - DNA, 16 bp, Artificial Sequence
  synthetic [barcode part1]
cctaatcaccgcgtgt

SEQ ID NO: 4345 - DNA, 16 bp, Artificial Sequence
  synthetic [barcode part1]
tggccagtagttaacc

SEQ ID NO: 4346 - DNA, 16 bp, Artificial Sequence
  synthetic [barcode part1]
taggagaattgcacgt

SEQ ID NO: 4347 - DNA, 16 bp, Artificial Sequence
  synthetic [barcode part1]
ccttcagactggtgtc

SEQ ID NO: 4348 - DNA, 16 bp, Artificial Sequence
  synthetic [barcode part1]
tagtagagtggcgaag

SEQ ID NO: 4349 - DNA, 16 bp, Artificial Sequence
  synthetic [barcode part1]
aactgtgtcttagtcc

SEQ ID NO: 4350 - DNA, 16 bp, Artificial Sequence
  synthetic [barcode part1]
ttcggaggtcacaact

SEQ ID NO: 4351 - DNA, 16 bp, Artificial Sequence
  synthetic [barcode part1]
atctaggcgaacactc

SEQ ID NO: 4352 - DNA, 16 bp, Artificial Sequence
  synthetic [barcode part1]
agtgttcgcgattacg

SEQ ID NO: 4353 - DNA, 16 bp, Artificial Sequence
  synthetic [barcode part1]
ttatattactcggcgc

SEQ ID NO: 4354 - DNA, 16 bp, Artificial Sequence
  synthetic [barcode part1]
ttcgacaggtaactcg

SEQ ID NO: 4355 - DNA, 16 bp, Artificial Sequence
  synthetic [barcode part1]
gatcacttcgtattcg

SEQ ID NO: 4356 - DNA, 16 bp, Artificial Sequence
  synthetic [barcode part1]
ttacgcaaggaagttg

SEQ ID NO: 4357 - DNA, 16 bp, Artificial Sequence
  synthetic [barcode part1]
atctgccagaccttgc

SEQ ID NO: 4358 - DNA, 16 bp, Artificial Sequence
  synthetic [barcode part1]
gaactgcggtaatcct

SEQ ID NO: 4359 - DNA, 16 bp, Artificial Sequence
  synthetic [barcode part1]
ttgcgtcaacgtgaac

SEQ ID NO: 4360 - DNA, 16 bp, Artificial Sequence
  synthetic [barcode part1]
aggcgccttatctcgt

SEQ ID NO: 4361 - DNA, 16 bp, Artificial Sequence
  synthetic [barcode part1]
tgaaccggaaggcgtt

SEQ ID NO: 4362 - DNA, 16 bp, Artificial Sequence
  synthetic [barcode part1]
tcacagttcgaccaag

SEQ ID NO: 4363 - DNA, 16 bp, Artificial Sequence
  synthetic [barcode part1]
tcttgcgtagtctaac

SEQ ID NO: 4364 - DNA, 16 bp, Artificial Sequence
  synthetic [barcode part1]
tacggcacgcctactt

SEQ ID NO: 4365 - DNA, 16 bp, Artificial Sequence
  synthetic [barcode part1]
gttaagacgcggtcag

SEQ ID NO: 4366 - DNA, 16 bp, Artificial Sequence
  synthetic [barcode part1]
gttataggtctgcctt

SEQ ID NO: 4367 - DNA, 16 bp, Artificial Sequence
  synthetic [barcode part1]
agatcggcgtgtaacg

SEQ ID NO: 4368 - DNA, 16 bp, Artificial Sequence
  synthetic [barcode part1]
tgcgtggaagtattcc

SEQ ID NO: 4369 - DNA, 16 bp, Artificial Sequence
  synthetic [barcode part1]
caactgttcgtacgag

SEQ ID NO: 4370 - DNA, 16 bp, Artificial Sequence
  synthetic [barcode part1]
atcgcgatccaaggtt

SEQ ID NO: 4371 - DNA, 16 bp, Artificial Sequence
  synthetic [barcode part1]
aacagaggcgtaactt

SEQ ID NO: 4372 - DNA, 16 bp, Artificial Sequence
  synthetic [barcode part1]
tccaccgttcctaact

SEQ ID NO: 4373 - DNA, 16 bp, Artificial Sequence
  synthetic [barcode part1]
agtcacgaaggaatct

SEQ ID NO: 4374 - DNA, 16 bp, Artificial Sequence
  synthetic [barcode part1]
aggagacacagaacac

SEQ ID NO: 4375 - DNA, 16 bp, Artificial Sequence
  synthetic [barcode part1]
tcggtcctgttctgtt

SEQ ID NO: 4376 - DNA, 16 bp, Artificial Sequence
  synthetic [barcode part1]
ataggtcgtgcagttc

SEQ ID NO: 4377 - DNA, 16 bp, Artificial Sequence
  synthetic [barcode part1]
tagtaaggcagtggag

SEQ ID NO: 4378 - DNA, 16 bp, Artificial Sequence
  synthetic [barcode part1]
tgaggagacgtatcgc

SEQ ID NO: 4379 - DNA, 16 bp, Artificial Sequence
  synthetic [barcode part1]
actatctggtacttgc

SEQ ID NO: 4380 - DNA, 16 bp, Artificial Sequence
  synthetic [barcode part1]
agtgcacgagatcggt

SEQ ID NO: 4381 - DNA, 16 bp, Artificial Sequence
  synthetic [barcode part1]
cctaccgactattcct

SEQ ID NO: 4382 - DNA, 16 bp, Artificial Sequence
  synthetic [barcode part1]
tgttcaggttgagaag

SEQ ID NO: 4383 - DNA, 16 bp, Artificial Sequence
  synthetic [barcode part1]
atcttgtcaccaacac

SEQ ID NO: 4384 - DNA, 16 bp, Artificial Sequence
  synthetic [barcode part1]
gcaagtctcagacgtt

SEQ ID NO: 4385 - DNA, 16 bp, Artificial Sequence
  synthetic [barcode part1]
gtccaagttcactact

SEQ ID NO: 4386 - DNA, 16 bp, Artificial Sequence
  synthetic [barcode part1]
cctggttgccgtatac

SEQ ID NO: 4387 - DNA, 16 bp, Artificial Sequence
  synthetic [barcode part1]
atcaggtgtagtccac

SEQ ID NO: 4388 - DNA, 16 bp, Artificial Sequence
  synthetic [barcode part1]
caaggtcaactctggt

SEQ ID NO: 4389 - DNA, 16 bp, Artificial Sequence
  synthetic [barcode part1]
tcgtgaggtgatcgtt

SEQ ID NO: 4390 - DNA, 16 bp, Artificial Sequence
  synthetic [barcode part1]
ttaacggtagatcgcc

SEQ ID NO: 4391 - DNA, 16 bp, Artificial Sequence
  synthetic [barcode part1]
accggtaacttcttgt

SEQ ID NO: 4392 - DNA, 16 bp, Artificial Sequence
  synthetic [barcode part1]
caggttaggaagtgcc

SEQ ID NO: 4393 - DNA, 16 bp, Artificial Sequence
  synthetic [barcode part1]
tcgcaggaagtcgaac

SEQ ID NO: 4394 - DNA, 16 bp, Artificial Sequence
  synthetic [barcode part1]
gcaatcactggaggac

SEQ ID NO: 4395 - DNA, 16 bp, Artificial Sequence
  synthetic [barcode part1]
taccggaaggcacagt

SEQ ID NO: 4396 - DNA, 16 bp, Artificial Sequence
  synthetic [barcode part1]
cagatcgtcgaactgt

SEQ ID NO: 4397 - DNA, 16 bp, Artificial Sequence
  synthetic [barcode part1]
ataccagtggcggaac

SEQ ID NO: 4398 - DNA, 16 bp, Artificial Sequence
  synthetic [barcode part1]
actgcgcctgatatag

SEQ ID NO: 4399 - DNA, 16 bp, Artificial Sequence
  synthetic [barcode part1]
gcctactattccggac

SEQ ID NO: 4400 - DNA, 16 bp, Artificial Sequence
  synthetic [barcode part1]
gttcctagttcaacgt

SEQ ID NO: 4401 - DNA, 16 bp, Artificial Sequence
  synthetic [barcode part1]
agaccgaattgtgtag

SEQ ID NO: 4402 - DNA, 16 bp, Artificial Sequence
  synthetic [barcode part1]
ttggaataggcaggtt

SEQ ID NO: 4403 - DNA, 16 bp, Artificial Sequence
  synthetic [barcode part1]
ttcacgaatcttaccg

SEQ ID NO: 4404 - DNA, 16 bp, Artificial Sequence
  synthetic [barcode part1]
gaagaacctgcgtggt

SEQ ID NO: 4405 - DNA, 16 bp, Artificial Sequence
  synthetic [barcode part1]
gtgccgagaagtgatc

SEQ ID NO: 4406 - DNA, 16 bp, Artificial Sequence
  synthetic [barcode part1]
gattacggtacaccac

SEQ ID NO: 4407 - DNA, 16 bp, Artificial Sequence
  synthetic [barcode part1]
ttctgttgtgagttcg

SEQ ID NO: 4408 - DNA, 16 bp, Artificial Sequence
  synthetic [barcode part1]
cgcgtcagatcttctg

SEQ ID NO: 4409 - DNA, 16 bp, Artificial Sequence
  synthetic [barcode part1]
cgtaatccttctggcg

SEQ ID NO: 4410 - DNA, 16 bp, Artificial Sequence
  synthetic [barcode part1]
agtacctataggacag

SEQ ID NO: 4411 - DNA, 16 bp, Artificial Sequence
  synthetic [barcode part1]
acgtgttagtggcgag

SEQ ID NO: 4412 - DNA, 16 bp, Artificial Sequence
  synthetic [barcode part1]
cctctgtctgtacttg

SEQ ID NO: 4413 - DNA, 16 bp, Artificial Sequence
  synthetic [barcode part1]
aagttactccgcgcct

SEQ ID NO: 4414 - DNA, 16 bp, Artificial Sequence
  synthetic [barcode part1]
gttctgcgtgatcgtc

SEQ ID NO: 4415 - DNA, 16 bp, Artificial Sequence
  synthetic [barcode part1]
cgtacggttcgattcc

SEQ ID NO: 4416 - DNA, 16 bp, Artificial Sequence
  synthetic [barcode part1]
tacgtccgaactgtcc

SEQ ID NO: 4417 - DNA, 16 bp, Artificial Sequence
  synthetic [barcode part1]
tgtagacctcgttatc

SEQ ID NO: 4418 - DNA, 16 bp, Artificial Sequence
  synthetic [barcode part1]
tccgaagtgtacgtgt

SEQ ID NO: 4419 - DNA, 16 bp, Artificial Sequence
  synthetic [barcode part1]
tataaggcgcaggaag

SEQ ID NO: 4420 - DNA, 16 bp, Artificial Sequence
  synthetic [barcode part1]
attctggccttcttcg

SEQ ID NO: 4421 - DNA, 16 bp, Artificial Sequence
  synthetic [barcode part1]
tcgtatcgcctctgtt

SEQ ID NO: 4422 - DNA, 16 bp, Artificial Sequence
  synthetic [barcode part1]
taggtacacacttggc

SEQ ID NO: 4423 - DNA, 16 bp, Artificial Sequence
  synthetic [barcode part1]
aggcactcctattgtt

SEQ ID NO: 4424 - DNA, 16 bp, Artificial Sequence
  synthetic [barcode part1]
tctcagaggtattgcg

SEQ ID NO: 4425 - DNA, 16 bp, Artificial Sequence
  synthetic [barcode part1]
cgttctcgtatcttcg

SEQ ID NO: 4426 - DNA, 16 bp, Artificial Sequence
  synthetic [barcode part1]
aaccaacgaggaagac

SEQ ID NO: 4427 - DNA, 16 bp, Artificial Sequence
  synthetic [barcode part1]
ccgtccacctagagtt

SEQ ID NO: 4428 - DNA, 16 bp, Artificial Sequence
  synthetic [barcode part1]
atcgcgacacttgcct

SEQ ID NO: 4429 - DNA, 16 bp, Artificial Sequence
  synthetic [barcode part1]
gatcctacactgtgag

SEQ ID NO: 4430 - DNA, 16 bp, Artificial Sequence
  synthetic [barcode part1]
tggcagaacttcactg

SEQ ID NO: 4431 - DNA, 16 bp, Artificial Sequence
  synthetic [barcode part1]
caacacgtgcgttagt

SEQ ID NO: 4432 - DNA, 16 bp, Artificial Sequence
  synthetic [barcode part1]
gtcctcacgttaggtc

SEQ ID NO: 4433 - DNA, 16 bp, Artificial Sequence
  synthetic [barcode part1]
gacaggattagtgtac

SEQ ID NO: 4434 - DNA, 16 bp, Artificial Sequence
  synthetic [barcode part1]
gcctctgtgtcagact

SEQ ID NO: 4435 - DNA, 16 bp, Artificial Sequence
  synthetic [barcode part1]
gtgatcagtattggcc

SEQ ID NO: 4436 - DNA, 16 bp, Artificial Sequence
  synthetic [barcode part1]
atataggattcggcag

SEQ ID NO: 4437 - DNA, 16 bp, Artificial Sequence
  synthetic [barcode part1]
aactggttggtgttgc

SEQ ID NO: 4438 - DNA, 16 bp, Artificial Sequence
  synthetic [barcode part1]
ccttaacgcgtccagt

SEQ ID NO: 4439 - DNA, 16 bp, Artificial Sequence
  synthetic [barcode part1]
caactgagtcacaacc

SEQ ID NO: 4440 - DNA, 16 bp, Artificial Sequence
  synthetic [barcode part1]
agtgtcgttccttcct

SEQ ID NO: 4441 - DNA, 16 bp, Artificial Sequence
  synthetic [barcode part1]
agacactgaataacgc

SEQ ID NO: 4442 - DNA, 16 bp, Artificial Sequence
  synthetic [barcode part1]
gcgttagaatccacgt

SEQ ID NO: 4443 - DNA, 16 bp, Artificial Sequence
  synthetic [barcode part1]
gagattactgagtgtg

SEQ ID NO: 4444 - DNA, 16 bp, Artificial Sequence
  synthetic [barcode part1]
atctgagagacggtgc

SEQ ID NO: 4445 - DNA, 16 bp, Artificial Sequence
  synthetic [barcode part1]
agttcttagtcacacc

SEQ ID NO: 4446 - DNA, 16 bp, Artificial Sequence
  synthetic [barcode part1]
caattggtcgaggttc

SEQ ID NO: 4447 - DNA, 16 bp, Artificial Sequence
  synthetic [barcode part1]
acgaatatatcgcgag

SEQ ID NO: 4448 - DNA, 16 bp, Artificial Sequence
  synthetic [barcode part1]
gatcgttatccttgtg

SEQ ID NO: 4449 - DNA, 16 bp, Artificial Sequence
  synthetic [barcode part1]
tcaataggtggcctgt

SEQ ID NO: 4450 - DNA, 16 bp, Artificial Sequence
  synthetic [barcode part1]
ttgcacaacacaccag

SEQ ID NO: 4451 - DNA, 16 bp, Artificial Sequence
  synthetic [barcode part1]
atccgccaacaagtgt

SEQ ID NO: 4452 - DNA, 16 bp, Artificial Sequence
  synthetic [barcode part1]
tccgcagtcaccttag

SEQ ID NO: 4453 - DNA, 16 bp, Artificial Sequence
  synthetic [barcode part1]
atccaagttgtctcac

SEQ ID NO: 4454 - DNA, 16 bp, Artificial Sequence
  synthetic [barcode part1]
aacgttccgttccacg

SEQ ID NO: 4455 - DNA, 16 bp, Artificial Sequence
  synthetic [barcode part1]
agattgacgtgactag

SEQ ID NO: 4456 - DNA, 16 bp, Artificial Sequence
  synthetic [barcode part1]
acttcaccgttccact

SEQ ID NO: 4457 - DNA, 16 bp, Artificial Sequence
  synthetic [barcode part1]
agtacctgtggaatag

SEQ ID NO: 4458 - DNA, 16 bp, Artificial Sequence
  synthetic [barcode part1]
caacacttgaacgaag

SEQ ID NO: 4459 - DNA, 16 bp, Artificial Sequence
  synthetic [barcode part1]
cacctcggtgataagt

SEQ ID NO: 4460 - DNA, 16 bp, Artificial Sequence
  synthetic [barcode part1]
tccgtaatcacagacg

SEQ ID NO: 4461 - DNA, 16 bp, Artificial Sequence
  synthetic [barcode part1]
aattgtggactgaggt

SEQ ID NO: 4462 - DNA, 16 bp, Artificial Sequence
  synthetic [barcode part1]
gatacggtcaccgaag

SEQ ID NO: 4463 - DNA, 16 bp, Artificial Sequence
  synthetic [barcode part1]
acaatccacctgacag

SEQ ID NO: 4464 - DNA, 16 bp, Artificial Sequence
  synthetic [barcode part1]
attcggagatacctgc

SEQ ID NO: 4465 - DNA, 16 bp, Artificial Sequence
  synthetic [barcode part1]
acctgcgtagtccttg

SEQ ID NO: 4466 - DNA, 16 bp, Artificial Sequence
  synthetic [barcode part1]
cacgtaagtcttctac

SEQ ID NO: 4467 - DNA, 16 bp, Artificial Sequence
  synthetic [barcode part1]
tccaccgagagattgt

SEQ ID NO: 4468 - DNA, 16 bp, Artificial Sequence
  synthetic [barcode part1]
gatatcgacaccacac

SEQ ID NO: 4469 - DNA, 16 bp, Artificial Sequence
  synthetic [barcode part1]
taacgtggtcgtcctc

SEQ ID NO: 4470 - DNA, 16 bp, Artificial Sequence
  synthetic [barcode part1]
tagactggatcgtcac

SEQ ID NO: 4471 - DNA, 16 bp, Artificial Sequence
  synthetic [barcode part1]
tactactcaccggtgc

SEQ ID NO: 4472 - DNA, 16 bp, Artificial Sequence
  synthetic [barcode part1]
cactcgtcttggaacc

SEQ ID NO: 4473 - DNA, 16 bp, Artificial Sequence
  synthetic [barcode part1]
agtcaacactgtggtc

SEQ ID NO: 4474 - DNA, 16 bp, Artificial Sequence
  synthetic [barcode part1]
ttgaggttctattcgc

SEQ ID NO: 4475 - DNA, 16 bp, Artificial Sequence
  synthetic [barcode part1]
tccaccggtataactt

SEQ ID NO: 4476 - DNA, 16 bp, Artificial Sequence
  synthetic [barcode part1]
gtactgaggaggtcac

SEQ ID NO: 4477 - DNA, 16 bp, Artificial Sequence
  synthetic [barcode part1]
tcggaagttagtacag

SEQ ID NO: 4478 - DNA, 16 bp, Artificial Sequence
  synthetic [barcode part1]
cctgattccttctggt

SEQ ID NO: 4479 - DNA, 16 bp, Artificial Sequence
  synthetic [barcode part1]
agagattggtcggaag

SEQ ID NO: 4480 - DNA, 16 bp, Artificial Sequence
  synthetic [barcode part1]
ccgtgactataacacg

SEQ ID NO: 4481 - DNA, 16 bp, Artificial Sequence
  synthetic [barcode part1]
gtgaaccgacttgtgt

SEQ ID NO: 4482 - DNA, 16 bp, Artificial Sequence
  synthetic [barcode part1]
aattagtgtgccgcac

SEQ ID NO: 4483 - DNA, 16 bp, Artificial Sequence
  synthetic [barcode part1]
tcaaggtggcggatac

SEQ ID NO: 4484 - DNA, 16 bp, Artificial Sequence
  synthetic [barcode part1]
ttacaccaggtcgcct

SEQ ID NO: 4485 - DNA, 16 bp, Artificial Sequence
  synthetic [barcode part1]
tcttgagaacgttgcg

SEQ ID NO: 4486 - DNA, 16 bp, Artificial Sequence
  synthetic [barcode part1]
cgcaatacagacaggc

SEQ ID NO: 4487 - DNA, 16 bp, Artificial Sequence
  synthetic [barcode part1]
tagaggaacgccgact

SEQ ID NO: 4488 - DNA, 16 bp, Artificial Sequence
  synthetic [barcode part1]
aaggcaccaatccgag

SEQ ID NO: 4489 - DNA, 16 bp, Artificial Sequence
  synthetic [barcode part1]
gaggaacttcaacctc

SEQ ID NO: 4490 - DNA, 16 bp, Artificial Sequence
  synthetic [barcode part1]
ataggcgttgtctgtg

SEQ ID NO: 4491 - DNA, 16 bp, Artificial Sequence
  synthetic [barcode part1]
ttcaaggaacttcggc

SEQ ID NO: 4492 - DNA, 16 bp, Artificial Sequence
  synthetic [barcode part1]
actgactgactagtcg

SEQ ID NO: 4493 - DNA, 16 bp, Artificial Sequence
  synthetic [barcode part1]
tacactggttgacgtg

SEQ ID NO: 4494 - DNA, 16 bp, Artificial Sequence
  synthetic [barcode part1]
cagtacacggtcttcc

SEQ ID NO: 4495 - DNA, 16 bp, Artificial Sequence
  synthetic [barcode part1]
aagtgtctctgagtgc

SEQ ID NO: 4496 - DNA, 16 bp, Artificial Sequence
  synthetic [barcode part1]
gcacttctcaagtcgc

SEQ ID NO: 4497 - DNA, 16 bp, Artificial Sequence
  synthetic [barcode part1]
cacggtactcgaagtt

SEQ ID NO: 4498 - DNA, 16 bp, Artificial Sequence
  synthetic [barcode part1]
gtacgcctattgacag

SEQ ID NO: 4499 - DNA, 16 bp, Artificial Sequence
  synthetic [barcode part1]
ccgttcggtaacacct

SEQ ID NO: 4500 - DNA, 16 bp, Artificial Sequence
  synthetic [barcode part1]
actgtgagagtaagtc

SEQ ID NO: 4501 - DNA, 16 bp, Artificial Sequence
  synthetic [barcode part1]
tagtaaggcgacagag

SEQ ID NO: 4502 - DNA, 16 bp, Artificial Sequence
  synthetic [barcode part1]
tgcgtgacttaactct

SEQ ID NO: 4503 - DNA, 16 bp, Artificial Sequence
  synthetic [barcode part1]
acgagtcagaagttgt

SEQ ID NO: 4504 - DNA, 16 bp, Artificial Sequence
  synthetic [barcode part1]
tcaattcagtgcgttc

SEQ ID NO: 4505 - DNA, 16 bp, Artificial Sequence
  synthetic [barcode part1]
gtacgcgttctaagac

SEQ ID NO: 4506 - DNA, 16 bp, Artificial Sequence
  synthetic [barcode part1]
ttccagacttacctag

SEQ ID NO: 4507 - DNA, 16 bp, Artificial Sequence
  synthetic [barcode part1]
tggaaccactgactgt

SEQ ID NO: 4508 - DNA, 16 bp, Artificial Sequence
  synthetic [barcode part1]
ttcgtcgccttcaatc

SEQ ID NO: 4509 - DNA, 16 bp, Artificial Sequence
  synthetic [barcode part1]
cgcgcaagtgattatc

SEQ ID NO: 4510 - DNA, 16 bp, Artificial Sequence
  synthetic [barcode part1]
gtcaactccgaagttg

SEQ ID NO: 4511 - DNA, 16 bp, Artificial Sequence
  synthetic [barcode part1]
gttgacttgcaacacg

SEQ ID NO: 4512 - DNA, 16 bp, Artificial Sequence
  synthetic [barcode part1]
tggcgaacctgagtag

SEQ ID NO: 4513 - DNA, 16 bp, Artificial Sequence
  synthetic [barcode part1]
gacgttgtacgtacgt

SEQ ID NO: 4514 - DNA, 16 bp, Artificial Sequence
  synthetic [barcode part1]
tgtcgaattcacgttc

SEQ ID NO: 4515 - DNA, 16 bp, Artificial Sequence
  synthetic [barcode part1]
ttctctcagagaggac

SEQ ID NO: 4516 - DNA, 16 bp, Artificial Sequence
  synthetic [barcode part1]
atagaacgcctgtaag

SEQ ID NO: 4517 - DNA, 16 bp, Artificial Sequence
  synthetic [barcode part1]
cctaaggtcaactggt

SEQ ID NO: 4518 - DNA, 16 bp, Artificial Sequence
  synthetic [barcode part1]
taagtacgcgcgactt

SEQ ID NO: 4519 - DNA, 16 bp, Artificial Sequence
  synthetic [barcode part1]
cgcgcctatctaacac

SEQ ID NO: 4520 - DNA, 16 bp, Artificial Sequence
  synthetic [barcode part1]
gtagtcgcacgcaatt

SEQ ID NO: 4521 - DNA, 16 bp, Artificial Sequence
  synthetic [barcode part1]
cctaactcgtggtcgt

SEQ ID NO: 4522 - DNA, 16 bp, Artificial Sequence
  synthetic [barcode part1]
gactcaggacttgact

SEQ ID NO: 4523 - DNA, 16 bp, Artificial Sequence
  synthetic [barcode part1]
gacaggagaccgtatc

SEQ ID NO: 4524 - DNA, 16 bp, Artificial Sequence
  synthetic [barcode part1]
tgcgttcgtaagaacc

SEQ ID NO: 4525 - DNA, 16 bp, Artificial Sequence
  synthetic [barcode part1]
cagtgatctctacgcc

SEQ ID NO: 4526 - DNA, 16 bp, Artificial Sequence
  synthetic [barcode part1]
gcggtatcggttaact

SEQ ID NO: 4527 - DNA, 16 bp, Artificial Sequence
  synthetic [barcode part1]
agtgattgaagtgcgt

SEQ ID NO: 4528 - DNA, 16 bp, Artificial Sequence
  synthetic [barcode part1]
caagtactcaggtacc

SEQ ID NO: 4529 - DNA, 16 bp, Artificial Sequence
  synthetic [barcode part1]
gaggtcttccaaggtt

SEQ ID NO: 4530 - DNA, 16 bp, Artificial Sequence
  synthetic [barcode part1]
caatcgaattacggcc

SEQ ID NO: 4531 - DNA, 16 bp, Artificial Sequence
  synthetic [barcode part1]
cacgcgatccaattcc

SEQ ID NO: 4532 - DNA, 16 bp, Artificial Sequence
  synthetic [barcode part1]
ccgtctagtaggtaac

SEQ ID NO: 4533 - DNA, 16 bp, Artificial Sequence
  synthetic [barcode part1]
atagagaagttcgacc

SEQ ID NO: 4534 - DNA, 16 bp, Artificial Sequence
  synthetic [barcode part1]
cgattcctcaactctc

SEQ ID NO: 4535 - DNA, 16 bp, Artificial Sequence
  synthetic [barcode part1]
gcgattaggccttctc

SEQ ID NO: 4536 - DNA, 16 bp, Artificial Sequence
  synthetic [barcode part1]
tcctgtcaacagaacg

SEQ ID NO: 4537 - DNA, 16 bp, Artificial Sequence
  synthetic [barcode part1]
cctacctaacactgcg

SEQ ID NO: 4538 - DNA, 16 bp, Artificial Sequence
  synthetic [barcode part1]
cgtggattctatcact

SEQ ID NO: 4539 - DNA, 16 bp, Artificial Sequence
  synthetic [barcode part1]
gttgtgaattcgttcc

SEQ ID NO: 4540 - DNA, 16 bp, Artificial Sequence
  synthetic [barcode part1]
agtctagtgcaagaac

SEQ ID NO: 4541 - DNA, 16 bp, Artificial Sequence
  synthetic [barcode part1]
tgattggtgactggtc

SEQ ID NO: 4542 - DNA, 16 bp, Artificial Sequence
  synthetic [barcode part1]
taatctcgtcggcacc

SEQ ID NO: 4543 - DNA, 16 bp, Artificial Sequence
  synthetic [barcode part1]
acgtaggcagagatag

SEQ ID NO: 4544 - DNA, 16 bp, Artificial Sequence
  synthetic [barcode part1]
tctctagacgtgttgt

SEQ ID NO: 4545 - DNA, 16 bp, Artificial Sequence
  synthetic [barcode part1]
tactggagacagtctc

SEQ ID NO: 4546 - DNA, 16 bp, Artificial Sequence
  synthetic [barcode part1]
gaggtaagtggtgagt

SEQ ID NO: 4547 - DNA, 16 bp, Artificial Sequence
  synthetic [barcode part1]
acttagacaggtgcct

SEQ ID NO: 4548 - DNA, 16 bp, Artificial Sequence
  synthetic [barcode part1]
atacacagtaccgcgt

SEQ ID NO: 4549 - DNA, 16 bp, Artificial Sequence
  synthetic [barcode part1]
aatactagacctcggc

SEQ ID NO: 4550 - DNA, 16 bp, Artificial Sequence
  synthetic [barcode part1]
gcctaagtgtcgcctt

SEQ ID NO: 4551 - DNA, 16 bp, Artificial Sequence
  synthetic [barcode part1]
cctgattgccaatact

SEQ ID NO: 4552 - DNA, 16 bp, Artificial Sequence
  synthetic [barcode part1]
caacggattcgaatag

SEQ ID NO: 4553 - DNA, 16 bp, Artificial Sequence
  synthetic [barcode part1]
gacgtatagaggattc

SEQ ID NO: 4554 - DNA, 16 bp, Artificial Sequence
  synthetic [barcode part1]
tgtgtgaattcctcac

SEQ ID NO: 4555 - DNA, 16 bp, Artificial Sequence
  synthetic [barcode part1]
gtcctgttctgacttc

SEQ ID NO: 4556 - DNA, 16 bp, Artificial Sequence
  synthetic [barcode part1]
gtatcagtcagtgtgc

SEQ ID NO: 4557 - DNA, 16 bp, Artificial Sequence
  synthetic [barcode part1]
gtagtatcggtcgact

SEQ ID NO: 4558 - DNA, 16 bp, Artificial Sequence
  synthetic [barcode part1]
tatccgtgacagacgt

SEQ ID NO: 4559 - DNA, 16 bp, Artificial Sequence
  synthetic [barcode part1]
acgtctctcaatagtc

SEQ ID NO: 4560 - DNA, 16 bp, Artificial Sequence
  synthetic [barcode part1]
tgtgtacgtacacacg

SEQ ID NO: 4561 - DNA, 16 bp, Artificial Sequence
  synthetic [barcode part1]
gcaaggaccgagttac

SEQ ID NO: 4562 - DNA, 16 bp, Artificial Sequence
  synthetic [barcode part1]
ccggtgtggagaattg

SEQ ID NO: 4563 - DNA, 16 bp, Artificial Sequence
  synthetic [barcode part1]
attggcagatagtgac

SEQ ID NO: 4564 - DNA, 16 bp, Artificial Sequence
  synthetic [barcode part1]
agttctccgtgccagt

SEQ ID NO: 4565 - DNA, 16 bp, Artificial Sequence
  synthetic [barcode part1]
acgttcctggcctaac

SEQ ID NO: 4566 - DNA, 16 bp, Artificial Sequence
  synthetic [barcode part1]
cgtgtagaacgatagt

SEQ ID NO: 4567 - DNA, 16 bp, Artificial Sequence
  synthetic [barcode part1]
aggcctatagaggatt

SEQ ID NO: 4568 - DNA, 16 bp, Artificial Sequence
  synthetic [barcode part1]
cggatagtgtctgttg

SEQ ID NO: 4569 - DNA, 16 bp, Artificial Sequence
  synthetic [barcode part1]
cgtataccgtgatacg

SEQ ID NO: 4570 - DNA, 16 bp, Artificial Sequence
  synthetic [barcode part1]
tcactcaagtaggcgt

SEQ ID NO: 4571 - DNA, 16 bp, Artificial Sequence
  synthetic [barcode part1]
gtgttcaattcgcgag

SEQ ID NO: 4572 - DNA, 16 bp, Artificial Sequence
  synthetic [barcode part1]
actcctggaaccgttc

SEQ ID NO: 4573 - DNA, 16 bp, Artificial Sequence
  synthetic [barcode part1]
aaggaacggatatcct

SEQ ID NO: 4574 - DNA, 16 bp, Artificial Sequence
  synthetic [barcode part1]
agttgtgtggtcacac

SEQ ID NO: 4575 - DNA, 16 bp, Artificial Sequence
  synthetic [barcode part1]
ttcttccgagacttcc

SEQ ID NO: 4576 - DNA, 16 bp, Artificial Sequence
  synthetic [barcode part1]
cagattggaagacgcc

SEQ ID NO: 4577 - DNA, 16 bp, Artificial Sequence
  synthetic [barcode part1]
aattcctgcgtaatcc

SEQ ID NO: 4578 - DNA, 16 bp, Artificial Sequence
  synthetic [barcode part1]
acttctataggtcacc

SEQ ID NO: 4579 - DNA, 16 bp, Artificial Sequence
  synthetic [barcode part1]
cgacaatctcttgtac

SEQ ID NO: 4580 - DNA, 16 bp, Artificial Sequence
  synthetic [barcode part1]
aatccaggtgcctctc

SEQ ID NO: 4581 - DNA, 16 bp, Artificial Sequence
  synthetic [barcode part1]
agtccggtcttgtgtc

SEQ ID NO: 4582 - DNA, 16 bp, Artificial Sequence
  synthetic [barcode part1]
ttataacacgcgcacg

SEQ ID NO: 4583 - DNA, 16 bp, Artificial Sequence
  synthetic [barcode part1]
agtctctaacttgcgt

SEQ ID NO: 4584 - DNA, 16 bp, Artificial Sequence
  synthetic [barcode part1]
tggaatcgaccagttc

SEQ ID NO: 4585 - DNA, 16 bp, Artificial Sequence
  synthetic [barcode part1]
aacttctgccgagaac

SEQ ID NO: 4586 - DNA, 16 bp, Artificial Sequence
  synthetic [barcode part1]
gaggttcactccaagt

SEQ ID NO: 4587 - DNA, 16 bp, Artificial Sequence
  synthetic [barcode part1]
tggcgaatacttgaag

SEQ ID NO: 4588 - DNA, 16 bp, Artificial Sequence
  synthetic [barcode part1]
tgaagtacgccttacg

SEQ ID NO: 4589 - DNA, 16 bp, Artificial Sequence
  synthetic [barcode part1]
cgagtgactatctgtg

SEQ ID NO: 4590 - DNA, 16 bp, Artificial Sequence
  synthetic [barcode part1]
aagtgatagttgcgtg

SEQ ID NO: 4591 - DNA, 16 bp, Artificial Sequence
  synthetic [barcode part1]
gtattatctgtccacg

SEQ ID NO: 4592 - DNA, 16 bp, Artificial Sequence
  synthetic [barcode part1]
aatatacaccggcacc

SEQ ID NO: 4593 - DNA, 16 bp, Artificial Sequence
  synthetic [barcode part1]
tcacgccaagttactt

SEQ ID NO: 4594 - DNA, 16 bp, Artificial Sequence
  synthetic [barcode part1]
ccaagaggttagagag

SEQ ID NO: 4595 - DNA, 16 bp, Artificial Sequence
  synthetic [barcode part1]
tcgaactgttaccgag

SEQ ID NO: 4596 - DNA, 16 bp, Artificial Sequence
  synthetic [barcode part1]
acaactcggcacagag

SEQ ID NO: 4597 - DNA, 16 bp, Artificial Sequence
  synthetic [barcode part1]
tggtaggatctcactg

SEQ ID NO: 4598 - DNA, 16 bp, Artificial Sequence
  synthetic [barcode part1]
tcttcctcttcaaggc

SEQ ID NO: 4599 - DNA, 16 bp, Artificial Sequence
  synthetic [barcode part1]
tcaacgttggtgtacg

SEQ ID NO: 4600 - DNA, 16 bp, Artificial Sequence
  synthetic [barcode part1]
tcttgaggagtggacg

SEQ ID NO: 4601 - DNA, 16 bp, Artificial Sequence
  synthetic [barcode part1]
agaatacgtgcgagag

SEQ ID NO: 4602 - DNA, 16 bp, Artificial Sequence
  synthetic [barcode part1]
actcaagtctaccgcc

SEQ ID NO: 4603 - DNA, 16 bp, Artificial Sequence
  synthetic [barcode part1]
gaacgcaaccgtcaag

SEQ ID NO: 4604 - DNA, 16 bp, Artificial Sequence
  synthetic [barcode part1]
acagtacaccagtcac

SEQ ID NO: 4605 - DNA, 16 bp, Artificial Sequence
  synthetic [barcode part1]
taactgacgcgtacgt

SEQ ID NO: 4606 - DNA, 16 bp, Artificial Sequence
  synthetic [barcode part1]
aactgtgcgtacgatc

SEQ ID NO: 4607 - DNA, 16 bp, Artificial Sequence
  synthetic [barcode part1]
ccgtatcttcagtggc

SEQ ID NO: 4608 - DNA, 16 bp, Artificial Sequence
  synthetic [barcode part1]
gtaactagacctcctt

SEQ ID NO: 4609 - DNA, 16 bp, Artificial Sequence
  synthetic [barcode part1]
ttgcacacacacagtg

SEQ ID NO: 4610 - DNA, 16 bp, Artificial Sequence
  synthetic [barcode part1]
gaggatatcgttgagt

SEQ ID NO: 4611 - DNA, 16 bp, Artificial Sequence
  synthetic [barcode part1]
gagaggcctacgtagt

SEQ ID NO: 4612 - DNA, 16 bp, Artificial Sequence
  synthetic [barcode part1]
aacagaatcgacacac

SEQ ID NO: 4613 - DNA, 16 bp, Artificial Sequence
  synthetic [barcode part1]
aactcagaccagactc

SEQ ID NO: 4614 - DNA, 16 bp, Artificial Sequence
  synthetic [barcode part1]
tggcagtgactcgatt

SEQ ID NO: 4615 - DNA, 16 bp, Artificial Sequence
  synthetic [barcode part1]
tctaggaactaaccgc

SEQ ID NO: 4616 - DNA, 16 bp, Artificial Sequence
  synthetic [barcode part1]
cggatacgattgcact

SEQ ID NO: 4617 - DNA, 16 bp, Artificial Sequence
  synthetic [barcode part1]
attcgcaattgtctcg

SEQ ID NO: 4618 - DNA, 16 bp, Artificial Sequence
  synthetic [barcode part1]
tccgatcacgtactgc

SEQ ID NO: 4619 - DNA, 16 bp, Artificial Sequence
  synthetic [barcode part1]
atcagtacaggagact

SEQ ID NO: 4620 - DNA, 16 bp, Artificial Sequence
  synthetic [barcode part1]
gcgttgaattgagagt

SEQ ID NO: 4621 - DNA, 16 bp, Artificial Sequence
  synthetic [barcode part1]
cctgatagtctccacg

SEQ ID NO: 4622 - DNA, 16 bp, Artificial Sequence
  synthetic [barcode part1]
tcttggcaaggattgc

SEQ ID NO: 4623 - DNA, 16 bp, Artificial Sequence
  synthetic [barcode part1]
acctcacctactatcc

SEQ ID NO: 4624 - DNA, 16 bp, Artificial Sequence
  synthetic [barcode part1]
gattgaattgccaccg

SEQ ID NO: 4625 - DNA, 16 bp, Artificial Sequence
  synthetic [barcode part1]
ttccggcctgatacgt

SEQ ID NO: 4626 - DNA, 16 bp, Artificial Sequence
  synthetic [barcode part1]
gtgatcagtataccgc

SEQ ID NO: 4627 - DNA, 16 bp, Artificial Sequence
  synthetic [barcode part1]
atccagtgtacaagag

SEQ ID NO: 4628 - DNA, 16 bp, Artificial Sequence
  synthetic [barcode part1]
aacttctccggcgtac

SEQ ID NO: 4629 - DNA, 16 bp, Artificial Sequence
  synthetic [barcode part1]
ccgtcttctagacgtg

SEQ ID NO: 4630 - DNA, 16 bp, Artificial Sequence
  synthetic [barcode part1]
agacacgattggaccg

SEQ ID NO: 4631 - DNA, 16 bp, Artificial Sequence
  synthetic [barcode part1]
caacggttcctgtatt

SEQ ID NO: 4632 - DNA, 16 bp, Artificial Sequence
  synthetic [barcode part1]
cgcctgatataagtcg

SEQ ID NO: 4633 - DNA, 16 bp, Artificial Sequence
  synthetic [barcode part1]
ttcctggtagtgtgcc

SEQ ID NO: 4634 - DNA, 16 bp, Artificial Sequence
  synthetic [barcode part1]
tgaacactggtcctcc

SEQ ID NO: 4635 - DNA, 16 bp, Artificial Sequence
  synthetic [barcode part1]
aaggtctccgcctatc

SEQ ID NO: 4636 - DNA, 16 bp, Artificial Sequence
  synthetic [barcode part1]
tgaacaacaggtggag

SEQ ID NO: 4637 - DNA, 16 bp, Artificial Sequence
  synthetic [barcode part1]
gagagtctgtgtggtg

SEQ ID NO: 4638 - DNA, 16 bp, Artificial Sequence
  synthetic [barcode part1]
tggcgaatcgcaagtg

SEQ ID NO: 4639 - DNA, 16 bp, Artificial Sequence
  synthetic [barcode part1]
tcacgatcctcagaag

SEQ ID NO: 4640 - DNA, 16 bp, Artificial Sequence
  synthetic [barcode part1]
cgtcggtctaaccttg

SEQ ID NO: 4641 - DNA, 16 bp, Artificial Sequence
  synthetic [barcode part1]
ccttcaccgttgaacg

SEQ ID NO: 4642 - DNA, 16 bp, Artificial Sequence
  synthetic [barcode part1]
gcctggatatcactcc

SEQ ID NO: 4643 - DNA, 16 bp, Artificial Sequence
  synthetic [barcode part1]
gtaagaattggtgacc

SEQ ID NO: 4644 - DNA, 16 bp, Artificial Sequence
  synthetic [barcode part1]
atattactggacggag

SEQ ID NO: 4645 - DNA, 16 bp, Artificial Sequence
  synthetic [barcode part1]
gagtctgcaggagact

SEQ ID NO: 4646 - DNA, 16 bp, Artificial Sequence
  synthetic [barcode part1]
tagaacaccgcacgag

SEQ ID NO: 4647 - DNA, 16 bp, Artificial Sequence
  synthetic [barcode part1]
tacgagtgtaggttcc

SEQ ID NO: 4648 - DNA, 16 bp, Artificial Sequence
  synthetic [barcode part1]
aggtctaagacactcc

SEQ ID NO: 4649 - DNA, 16 bp, Artificial Sequence
  synthetic [barcode part1]
ccttcgacgcgtaatc

SEQ ID NO: 4650 - DNA, 16 bp, Artificial Sequence
  synthetic [barcode part1]
atctactggatctcac

SEQ ID NO: 4651 - DNA, 16 bp, Artificial Sequence
  synthetic [barcode part1]
aagatctgcggatagt

SEQ ID NO: 4652 - DNA, 16 bp, Artificial Sequence
  synthetic [barcode part1]
gcaccacaatattgcg

SEQ ID NO: 4653 - DNA, 16 bp, Artificial Sequence
  synthetic [barcode part1]
tgtccgtccacaacac

SEQ ID NO: 4654 - DNA, 16 bp, Artificial Sequence
  synthetic [barcode part1]
tgattcggacgcgaag

SEQ ID NO: 4655 - DNA, 16 bp, Artificial Sequence
  synthetic [barcode part1]
attccttccgagagag

SEQ ID NO: 4656 - DNA, 16 bp, Artificial Sequence
  synthetic [barcode part1]
acggactgatcgtgtt

SEQ ID NO: 4657 - DNA, 16 bp, Artificial Sequence
  synthetic [barcode part1]
taccgccttatacagt

SEQ ID NO: 4658 - DNA, 16 bp, Artificial Sequence
  synthetic [barcode part1]
cagactatagtccgac

SEQ ID NO: 4659 - DNA, 16 bp, Artificial Sequence
  synthetic [barcode part1]
aggactgcagtaagag

SEQ ID NO: 4660 - DNA, 16 bp, Artificial Sequence
  synthetic [barcode part1]
accgagaatcagtgcg

SEQ ID NO: 4661 - DNA, 16 bp, Artificial Sequence
  synthetic [barcode part1]
cgcaggccttgttgtt

SEQ ID NO: 4662 - DNA, 16 bp, Artificial Sequence
  synthetic [barcode part1]
gtggatcgtcactcct

SEQ ID NO: 4663 - DNA, 16 bp, Artificial Sequence
  synthetic [barcode part1]
tggtcctagttaggac

SEQ ID NO: 4664 - DNA, 16 bp, Artificial Sequence
  synthetic [barcode part1]
tgcggacttatcctgc

SEQ ID NO: 4665 - DNA, 16 bp, Artificial Sequence
  synthetic [barcode part1]
cctcagtaattacacc

SEQ ID NO: 4666 - DNA, 16 bp, Artificial Sequence
  synthetic [barcode part1]
tactggttggtacacg

SEQ ID NO: 4667 - DNA, 16 bp, Artificial Sequence
  synthetic [barcode part1]
accaagtactcttgtc

SEQ ID NO: 4668 - DNA, 16 bp, Artificial Sequence
  synthetic [barcode part1]
gcacctcctgacaact

SEQ ID NO: 4669 - DNA, 16 bp, Artificial Sequence
  synthetic [barcode part1]
ttccttcctaactggc

SEQ ID NO: 4670 - DNA, 16 bp, Artificial Sequence
  synthetic [barcode part1]
gtcgtagaggtggact

SEQ ID NO: 4671 - DNA, 16 bp, Artificial Sequence
  synthetic [barcode part1]
caccgacgagactaag

SEQ ID NO: 4672 - DNA, 16 bp, Artificial Sequence
  synthetic [barcode part1]
caacacgcggttcctt

SEQ ID NO: 4673 - DNA, 16 bp, Artificial Sequence
  synthetic [barcode part1]
gcagttaagagttgac

SEQ ID NO: 4674 - DNA, 16 bp, Artificial Sequence
  synthetic [barcode part1]
attgtcgttccgcgtg

SEQ ID NO: 4675 - DNA, 16 bp, Artificial Sequence
  synthetic [barcode part1]
cggttgcactcttcag

SEQ ID NO: 4676 - DNA, 16 bp, Artificial Sequence
  synthetic [barcode part1]
attcacgaggacggtg

SEQ ID NO: 4677 - DNA, 16 bp, Artificial Sequence
  synthetic [barcode part1]
caccggacgttcttac

SEQ ID NO: 4678 - DNA, 16 bp, Artificial Sequence
  synthetic [barcode part1]
taggttgcctccacac

SEQ ID NO: 4679 - DNA, 16 bp, Artificial Sequence
  synthetic [barcode part1]
gtgccaagtactcagt

SEQ ID NO: 4680 - DNA, 16 bp, Artificial Sequence
  synthetic [barcode part1]
atcgtcctgttactcc

SEQ ID NO: 4681 - DNA, 16 bp, Artificial Sequence
  synthetic [barcode part1]
tggtcgcgtaggatag

SEQ ID NO: 4682 - DNA, 16 bp, Artificial Sequence
  synthetic [barcode part1]
aacgtggtaagttacg

SEQ ID NO: 4683 - DNA, 16 bp, Artificial Sequence
  synthetic [barcode part1]
tcttactggattcacg

SEQ ID NO: 4684 - DNA, 16 bp, Artificial Sequence
  synthetic [barcode part1]
aggtaatacacgatcg

SEQ ID NO: 4685 - DNA, 16 bp, Artificial Sequence
  synthetic [barcode part1]
ttgcctgtgttacggc

SEQ ID NO: 4686 - DNA, 16 bp, Artificial Sequence
  synthetic [barcode part1]
gacttcaattccggag

SEQ ID NO: 4687 - DNA, 16 bp, Artificial Sequence
  synthetic [barcode part1]
agaatacgttaccgag

SEQ ID NO: 4688 - DNA, 16 bp, Artificial Sequence
  synthetic [barcode part1]
tacgagttggacactc

SEQ ID NO: 4689 - DNA, 16 bp, Artificial Sequence
  synthetic [barcode part1]
tcacctggtgagtaac

SEQ ID NO: 4690 - DNA, 16 bp, Artificial Sequence
  synthetic [barcode part1]
agaactctattcgtcc

SEQ ID NO: 4691 - DNA, 16 bp, Artificial Sequence
  synthetic [barcode part1]
caacagtctccacgtc

SEQ ID NO: 4692 - DNA, 16 bp, Artificial Sequence
  synthetic [barcode part1]
acgtggtatcgacgtt

SEQ ID NO: 4693 - DNA, 16 bp, Artificial Sequence
  synthetic [barcode part1]
tcgaacttacacttcg

SEQ ID NO: 4694 - DNA, 16 bp, Artificial Sequence
  synthetic [barcode part1]
tcgactccgagtctac

SEQ ID NO: 4695 - DNA, 16 bp, Artificial Sequence
  synthetic [barcode part1]
gtattggactgagaac

SEQ ID NO: 4696 - DNA, 16 bp, Artificial Sequence
  synthetic [barcode part1]
tgtgttgacaccagtg

SEQ ID NO: 4697 - DNA, 16 bp, Artificial Sequence
  synthetic [barcode part1]
tgtggcgtgcctattc

SEQ ID NO: 4698 - DNA, 16 bp, Artificial Sequence
  synthetic [barcode part1]
gattattggtggtccg

SEQ ID NO: 4699 - DNA, 16 bp, Artificial Sequence
  synthetic [barcode part1]
tgttgaccacagtcag

SEQ ID NO: 4700 - DNA, 16 bp, Artificial Sequence
  synthetic [barcode part1]
acgtgaggcctagtag

SEQ ID NO: 4701 - DNA, 16 bp, Artificial Sequence
  synthetic [barcode part1]
ttatcgtgtctcgtcc

SEQ ID NO: 4702 - DNA, 16 bp, Artificial Sequence
  synthetic [barcode part1]
tctatcaagttcgcac

SEQ ID NO: 4703 - DNA, 16 bp, Artificial Sequence
  synthetic [barcode part1]
gttggcgataattgcc

SEQ ID NO: 4704 - DNA, 16 bp, Artificial Sequence
  synthetic [barcode part1]
gcacagaggattaccg

SEQ ID NO: 4705 - DNA, 16 bp, Artificial Sequence
  synthetic [barcode part1]
actctgcgaacacctc

SEQ ID NO: 4706 - DNA, 16 bp, Artificial Sequence
  synthetic [barcode part1]
ttagacggcgataggc

SEQ ID NO: 4707 - DNA, 16 bp, Artificial Sequence
  synthetic [barcode part1]
cagttggcaaccagtt

SEQ ID NO: 4708 - DNA, 16 bp, Artificial Sequence
  synthetic [barcode part1]
tccagaactaggatcc

SEQ ID NO: 4709 - DNA, 16 bp, Artificial Sequence
  synthetic [barcode part1]
ttatctgcaggattcc

SEQ ID NO: 4710 - DNA, 16 bp, Artificial Sequence
  synthetic [barcode part1]
ttcggagtcgagactt

SEQ ID NO: 4711 - DNA, 16 bp, Artificial Sequence
  synthetic [barcode part1]
tcctcgacgattgcac

SEQ ID NO: 4712 - DNA, 16 bp, Artificial Sequence
  synthetic [barcode part1]
acctaacaatcgccag

SEQ ID NO: 4713 - DNA, 16 bp, Artificial Sequence
  synthetic [barcode part1]
gtgaggatacactctc

SEQ ID NO: 4714 - DNA, 16 bp, Artificial Sequence
  synthetic [barcode part1]
cggactccactattcg

SEQ ID NO: 4715 - DNA, 16 bp, Artificial Sequence
  synthetic [barcode part1]
gtacgtacaacactgc

SEQ ID NO: 4716 - DNA, 16 bp, Artificial Sequence
  synthetic [barcode part1]
gtgcgaagaaccgttg

SEQ ID NO: 4717 - DNA, 16 bp, Artificial Sequence
  synthetic [barcode part1]
gagtgaggtgacgttc

SEQ ID NO: 4718 - DNA, 16 bp, Artificial Sequence
  synthetic [barcode part1]
taagaggacaccgatt

SEQ ID NO: 4719 - DNA, 16 bp, Artificial Sequence
  synthetic [barcode part1]
aggtctatatcggtgc

SEQ ID NO: 4720 - DNA, 16 bp, Artificial Sequence
  synthetic [barcode part1]
ttacggatagagagtc

SEQ ID NO: 4721 - DNA, 16 bp, Artificial Sequence
  synthetic [barcode part1]
taaggtctcctaaggc

SEQ ID NO: 4722 - DNA, 16 bp, Artificial Sequence
  synthetic [barcode part1]
acgatctgaacgtaag

SEQ ID NO: 4723 - DNA, 16 bp, Artificial Sequence
  synthetic [barcode part1]
tatcaggttgccagac

SEQ ID NO: 4724 - DNA, 16 bp, Artificial Sequence
  synthetic [barcode part1]
tgcaagtaacactcgc

SEQ ID NO: 4725 - DNA, 16 bp, Artificial Sequence
  synthetic [barcode part1]
gcaatcaccgactctc

SEQ ID NO: 4726 - DNA, 16 bp, Artificial Sequence
  synthetic [barcode part1]
tgatctgatccggtag

SEQ ID NO: 4727 - DNA, 16 bp, Artificial Sequence
  synthetic [barcode part1]
gcgcgactcctaatct

SEQ ID NO: 4728 - DNA, 16 bp, Artificial Sequence
  synthetic [barcode part1]
aacaaggcacgtcggt

SEQ ID NO: 4729 - DNA, 16 bp, Artificial Sequence
  synthetic [barcode part1]
aaggacggtctaacgc

SEQ ID NO: 4730 - DNA, 16 bp, Artificial Sequence
  synthetic [barcode part1]
tgatctctaacgcact

SEQ ID NO: 4731 - DNA, 16 bp, Artificial Sequence
  synthetic [barcode part1]
gcaaggatcctatacc

SEQ ID NO: 4732 - DNA, 16 bp, Artificial Sequence
  synthetic [barcode part1]
acactgagtcagaggc

SEQ ID NO: 4733 - DNA, 16 bp, Artificial Sequence
  synthetic [barcode part1]
tacgcgatcgttactt

SEQ ID NO: 4734 - DNA, 16 bp, Artificial Sequence
  synthetic [barcode part1]
ttactctaccgccttg

SEQ ID NO: 4735 - DNA, 16 bp, Artificial Sequence
  synthetic [barcode part1]
gtcttccgagatcaag

SEQ ID NO: 4736 - DNA, 16 bp, Artificial Sequence
  synthetic [barcode part1]
cgtggtgcctacttac

SEQ ID NO: 4737 - DNA, 16 bp, Artificial Sequence
  synthetic [barcode part1]
agtaaccgaggtgcac

SEQ ID NO: 4738 - DNA, 16 bp, Artificial Sequence
  synthetic [barcode part1]
ttcgcctctcgaagtg

SEQ ID NO: 4739 - DNA, 16 bp, Artificial Sequence
  synthetic [barcode part1]
tcgccgtctatcttgt

SEQ ID NO: 4740 - DNA, 16 bp, Artificial Sequence
  synthetic [barcode part1]
gacgacactcggatag

SEQ ID NO: 4741 - DNA, 16 bp, Artificial Sequence
  synthetic [barcode part1]
gagttgtatctctacc

SEQ ID NO: 4742 - DNA, 16 bp, Artificial Sequence
  synthetic [barcode part1]
cctactgcgtattaac

SEQ ID NO: 4743 - DNA, 16 bp, Artificial Sequence
  synthetic [barcode part1]
gtgcagtactgacact

SEQ ID NO: 4744 - DNA, 16 bp, Artificial Sequence
  synthetic [barcode part1]
gatccttaacttgcgt

SEQ ID NO: 4745 - DNA, 16 bp, Artificial Sequence
  synthetic [barcode part1]
gtatcttgttgtcgac

SEQ ID NO: 4746 - DNA, 16 bp, Artificial Sequence
  synthetic [barcode part1]
gtcgtctactcgcaac

SEQ ID NO: 4747 - DNA, 16 bp, Artificial Sequence
  synthetic [barcode part1]
atactcgttacctcag

SEQ ID NO: 4748 - DNA, 16 bp, Artificial Sequence
  synthetic [barcode part1]
gtagttgccggagaac

SEQ ID NO: 4749 - DNA, 16 bp, Artificial Sequence
  synthetic [barcode part1]
tgcacaagacgtgttc

SEQ ID NO: 4750 - DNA, 16 bp, Artificial Sequence
  synthetic [barcode part1]
ttggtgtgatcctccg

SEQ ID NO: 4751 - DNA, 16 bp, Artificial Sequence
  synthetic [barcode part1]
tataaggaccgccgag

SEQ ID NO: 4752 - DNA, 16 bp, Artificial Sequence
  synthetic [barcode part1]
tgcctgttcgtaacgc

SEQ ID NO: 4753 - DNA, 16 bp, Artificial Sequence
  synthetic [barcode part1]
tgttactctgcgtaac

SEQ ID NO: 4754 - DNA, 16 bp, Artificial Sequence
  synthetic [barcode part1]
cgaaggatagttgtac

SEQ ID NO: 4755 - DNA, 16 bp, Artificial Sequence
  synthetic [barcode part1]
gataacacggaacgag

SEQ ID NO: 4756 - DNA, 16 bp, Artificial Sequence
  synthetic [barcode part1]
ccgtaccactcaacgt

SEQ ID NO: 4757 - DNA, 16 bp, Artificial Sequence
  synthetic [barcode part1]
gtcgagataacgcgtg

SEQ ID NO: 4758 - DNA, 16 bp, Artificial Sequence
  synthetic [barcode part1]
aaggtcgtcggtgtag

SEQ ID NO: 4759 - DNA, 16 bp, Artificial Sequence
  synthetic [barcode part1]
tcagactcctctatag

SEQ ID NO: 4760 - DNA, 16 bp, Artificial Sequence
  synthetic [barcode part1]
aagagtactcaacgac

SEQ ID NO: 4761 - DNA, 16 bp, Artificial Sequence
  synthetic [barcode part1]
gcagttaccgaaggac

SEQ ID NO: 4762 - DNA, 16 bp, Artificial Sequence
  synthetic [barcode part1]
taggcactggcgaagt

SEQ ID NO: 4763 - DNA, 16 bp, Artificial Sequence
  synthetic [barcode part1]
cagaggttgagttgcg

SEQ ID NO: 4764 - DNA, 16 bp, Artificial Sequence
  synthetic [barcode part1]
tgtcagtcaacacacg

SEQ ID NO: 4765 - DNA, 16 bp, Artificial Sequence
  synthetic [barcode part1]
acttcttgtaccaacg

SEQ ID NO: 4766 - DNA, 16 bp, Artificial Sequence
  synthetic [barcode part1]
ttatcggcgacaactg

SEQ ID NO: 4767 - DNA, 16 bp, Artificial Sequence
  synthetic [barcode part1]
caagtactgcaggttc

SEQ ID NO: 4768 - DNA, 16 bp, Artificial Sequence
  synthetic [barcode part1]
cgtattgttgacttcg

SEQ ID NO: 4769 - DNA, 16 bp, Artificial Sequence
  synthetic [barcode part1]
gattattcggaccacg

SEQ ID NO: 4770 - DNA, 16 bp, Artificial Sequence
  synthetic [barcode part1]
gaggaacgacacactc

SEQ ID NO: 4771 - DNA, 16 bp, Artificial Sequence
  synthetic [barcode part1]
atactggcacgagttc

SEQ ID NO: 4772 - DNA, 16 bp, Artificial Sequence
  synthetic [barcode part1]
cgtaagtcggaataac

SEQ ID NO: 4773 - DNA, 16 bp, Artificial Sequence
  synthetic [barcode part1]
ttcgtacgtcactagt

SEQ ID NO: 4774 - DNA, 16 bp, Artificial Sequence
  synthetic [barcode part1]
aaggagtagacacctt

SEQ ID NO: 4775 - DNA, 16 bp, Artificial Sequence
  synthetic [barcode part1]
tcctagttggcgaagt

SEQ ID NO: 4776 - DNA, 16 bp, Artificial Sequence
  synthetic [barcode part1]
cacctatatctcaggt

SEQ ID NO: 4777 - DNA, 16 bp, Artificial Sequence
  synthetic [barcode part1]
gacgtagattcctacg

SEQ ID NO: 4778 - DNA, 16 bp, Artificial Sequence
  synthetic [barcode part1]
actcgtattggacacg

SEQ ID NO: 4779 - DNA, 16 bp, Artificial Sequence
  synthetic [barcode part1]
aggtagacacttgcct

SEQ ID NO: 4780 - DNA, 16 bp, Artificial Sequence
  synthetic [barcode part1]
gtagtgcggaattcct

SEQ ID NO: 4781 - DNA, 16 bp, Artificial Sequence
  synthetic [barcode part1]
tctccactgttggacg

SEQ ID NO: 4782 - DNA, 16 bp, Artificial Sequence
  synthetic [barcode part1]
accggtgagattggac

SEQ ID NO: 4783 - DNA, 16 bp, Artificial Sequence
  synthetic [barcode part1]
agtccaatcagtggtc

SEQ ID NO: 4784 - DNA, 16 bp, Artificial Sequence
  synthetic [barcode part1]
caataaggttcacgag

SEQ ID NO: 4785 - DNA, 16 bp, Artificial Sequence
  synthetic [barcode part1]
tcgagagagagatcag

SEQ ID NO: 4786 - DNA, 16 bp, Artificial Sequence
  synthetic [barcode part1]
tgatatacgcgttggc

SEQ ID NO: 4787 - DNA, 16 bp, Artificial Sequence
  synthetic [barcode part1]
tgtagactaggcgttc

SEQ ID NO: 4788 - DNA, 16 bp, Artificial Sequence
  synthetic [barcode part1]
atacttacttaccgcg

SEQ ID NO: 4789 - DNA, 16 bp, Artificial Sequence
  synthetic [barcode part1]
tcctcacaagtcgtcg

SEQ ID NO: 4790 - DNA, 16 bp, Artificial Sequence
  synthetic [barcode part1]
gattaacgtcgcggtt

SEQ ID NO: 4791 - DNA, 16 bp, Artificial Sequence
  synthetic [barcode part1]
cactgagatctggtgt

SEQ ID NO: 4792 - DNA, 16 bp, Artificial Sequence
  synthetic [barcode part1]
ataccttgaaggcacc

SEQ ID NO: 4793 - DNA, 16 bp, Artificial Sequence
  synthetic [barcode part1]
tcttggaacttgttcg

SEQ ID NO: 4794 - DNA, 16 bp, Artificial Sequence
  synthetic [barcode part1]
tctcctgacttctcag

SEQ ID NO: 4795 - DNA, 16 bp, Artificial Sequence
  synthetic [barcode part1]
gcagtataatcggtcc

SEQ ID NO: 4796 - DNA, 16 bp, Artificial Sequence
  synthetic [barcode part1]
gtgtccgtacttgaag

SEQ ID NO: 4797 - DNA, 16 bp, Artificial Sequence
  synthetic [barcode part1]
ttcaccgacgcgattc

SEQ ID NO: 4798 - DNA, 16 bp, Artificial Sequence
  synthetic [barcode part1]
gtaacaacactccacg

SEQ ID NO: 4799 - DNA, 16 bp, Artificial Sequence
  synthetic [barcode part1]
tactacgtacgacgtg

SEQ ID NO: 4800 - DNA, 16 bp, Artificial Sequence
  synthetic [barcode part1]
aagtgcgactatcaag

SEQ ID NO: 4801 - DNA, 16 bp, Artificial Sequence
  synthetic [barcode part1]
tggttagactagtcgc

SEQ ID NO: 4802 - DNA, 16 bp, Artificial Sequence
  synthetic [barcode part1]
atcgttcagatccact

SEQ ID NO: 4803 - DNA, 16 bp, Artificial Sequence
  synthetic [barcode part1]
aaccggtcggtattgt

SEQ ID NO: 4804 - DNA, 16 bp, Artificial Sequence
  synthetic [barcode part1]
cgaggcgaatagtaag

SEQ ID NO: 4805 - DNA, 16 bp, Artificial Sequence
  synthetic [barcode part1]
cactactgtccaagtt

SEQ ID NO: 4806 - DNA, 16 bp, Artificial Sequence
  synthetic [barcode part1]
gtgcagtggccttctt

SEQ ID NO: 4807 - DNA, 16 bp, Artificial Sequence
  synthetic [barcode part1]
cagtataggccgtgtt

SEQ ID NO: 4808 - DNA, 16 bp, Artificial Sequence
  synthetic [barcode part1]
aggagactggacttgc

SEQ ID NO: 4809 - DNA, 16 bp, Artificial Sequence
  synthetic [barcode part1]
acagtcgaactcttct

SEQ ID NO: 4810 - DNA, 16 bp, Artificial Sequence
  synthetic [barcode part1]
tcttcggcgtggttac

SEQ ID NO: 4811 - DNA, 16 bp, Artificial Sequence
  synthetic [barcode part1]
aacgacgttatagacg

SEQ ID NO: 4812 - DNA, 16 bp, Artificial Sequence
  synthetic [barcode part1]
agaggatcctgatcct

SEQ ID NO: 4813 - DNA, 16 bp, Artificial Sequence
  synthetic [barcode part1]
acaggacctacgaacg

SEQ ID NO: 4814 - DNA, 16 bp, Artificial Sequence
  synthetic [barcode part1]
aggagtcttctccaag

SEQ ID NO: 4815 - DNA, 16 bp, Artificial Sequence
  synthetic [barcode part1]
caagttgtcagtgacc

SEQ ID NO: 4816 - DNA, 16 bp, Artificial Sequence
  synthetic [barcode part1]
ccgagtaggtgagact

SEQ ID NO: 4817 - DNA, 16 bp, Artificial Sequence
  synthetic [barcode part1]
cggacctagtaagacg

SEQ ID NO: 4818 - DNA, 16 bp, Artificial Sequence
  synthetic [barcode part1]
gcactggattggagac

SEQ ID NO: 4819 - DNA, 16 bp, Artificial Sequence
  synthetic [barcode part1]
cgagattccgagattc

SEQ ID NO: 4820 - DNA, 16 bp, Artificial Sequence
  synthetic [barcode part1]
gttaacgcacctcgtc

SEQ ID NO: 4821 - DNA, 16 bp, Artificial Sequence
  synthetic [barcode part1]
ccagacaggcggaatt

SEQ ID NO: 4822 - DNA, 16 bp, Artificial Sequence
  synthetic [barcode part1]
tattctatccggacgt

SEQ ID NO: 4823 - DNA, 16 bp, Artificial Sequence
  synthetic [barcode part1]
tctatatctaggccgt

SEQ ID NO: 4824 - DNA, 16 bp, Artificial Sequence
  synthetic [barcode part1]
agaggattccgacctt

SEQ ID NO: 4825 - DNA, 16 bp, Artificial Sequence
  synthetic [barcode part1]
tctggaaggaatctcc

SEQ ID NO: 4826 - DNA, 16 bp, Artificial Sequence
  synthetic [barcode part1]
tcgtactctgccgagt

SEQ ID NO: 4827 - DNA, 16 bp, Artificial Sequence
  synthetic [barcode part1]
tccaccgatacgacct

SEQ ID NO: 4828 - DNA, 16 bp, Artificial Sequence
  synthetic [barcode part1]
tatcaggatagtccgc

SEQ ID NO: 4829 - DNA, 16 bp, Artificial Sequence
  synthetic [barcode part1]
gcgcctatattgcctg

SEQ ID NO: 4830 - DNA, 16 bp, Artificial Sequence
  synthetic [barcode part1]
taccgcggttgattag

SEQ ID NO: 4831 - DNA, 16 bp, Artificial Sequence
  synthetic [barcode part1]
tcggttcttgcgtgac

SEQ ID NO: 4832 - DNA, 16 bp, Artificial Sequence
  synthetic [barcode part1]
cggtgtggttgtcttc

SEQ ID NO: 4833 - DNA, 16 bp, Artificial Sequence
  synthetic [barcode part1]
attgcactagttcctg

SEQ ID NO: 4834 - DNA, 16 bp, Artificial Sequence
  synthetic [barcode part1]
ccgatcgtcgattaag

SEQ ID NO: 4835 - DNA, 16 bp, Artificial Sequence
  synthetic [barcode part1]
caatacgttctactgc

SEQ ID NO: 4836 - DNA, 16 bp, Artificial Sequence
  synthetic [barcode part1]
aatctcggtgaacaag

SEQ ID NO: 4837 - DNA, 16 bp, Artificial Sequence
  synthetic [barcode part1]
acctaggtatccgagt

SEQ ID NO: 4838 - DNA, 16 bp, Artificial Sequence
  synthetic [barcode part1]
tctgaccaccgtgtac

SEQ ID NO: 4839 - DNA, 16 bp, Artificial Sequence
  synthetic [barcode part1]
tgacttgactcttgtg

SEQ ID NO: 4840 - DNA, 16 bp, Artificial Sequence
  synthetic [barcode part1]
aagtgtcggacagtgc

SEQ ID NO: 4841 - DNA, 16 bp, Artificial Sequence
  synthetic [barcode part1]
gtggacagagttccag

SEQ ID NO: 4842 - DNA, 16 bp, Artificial Sequence
  synthetic [barcode part1]
atcttgtatctaggcc

SEQ ID NO: 4843 - DNA, 16 bp, Artificial Sequence
  synthetic [barcode part1]
gcactaacttcgttac

SEQ ID NO: 4844 - DNA, 16 bp, Artificial Sequence
  synthetic [barcode part1]
gtcaggtgaacgcagt

SEQ ID NO: 4845 - DNA, 16 bp, Artificial Sequence
  synthetic [barcode part1]
gcgtctgagtaagacg

SEQ ID NO: 4846 - DNA, 16 bp, Artificial Sequence
  synthetic [barcode part1]
acaattattctccggc

SEQ ID NO: 4847 - DNA, 16 bp, Artificial Sequence
  synthetic [barcode part1]
tgcctcgattcgcagt

SEQ ID NO: 4848 - DNA, 16 bp, Artificial Sequence
  synthetic [barcode part1]
aagaacgtggatcact

SEQ ID NO: 4849 - DNA, 16 bp, Artificial Sequence
  synthetic [barcode part1]
ttagaagagttcgcag

SEQ ID NO: 4850 - DNA, 16 bp, Artificial Sequence
  synthetic [barcode part1]
tccttgacggttgcgt

SEQ ID NO: 4851 - DNA, 16 bp, Artificial Sequence
  synthetic [barcode part1]
cgtgacactcggaatt

SEQ ID NO: 4852 - DNA, 16 bp, Artificial Sequence
  synthetic [barcode part1]
agtaaggacgcaatct

SEQ ID NO: 4853 - DNA, 16 bp, Artificial Sequence
  synthetic [barcode part1]
tcgacggacaattcac

SEQ ID NO: 4854 - DNA, 16 bp, Artificial Sequence
  synthetic [barcode part1]
tattaaggcgaagacc

SEQ ID NO: 4855 - DNA, 16 bp, Artificial Sequence
  synthetic [barcode part1]
ccgacaggagttattc

SEQ ID NO: 4856 - DNA, 16 bp, Artificial Sequence
  synthetic [barcode part1]
acgtcctaccggattc

SEQ ID NO: 4857 - DNA, 16 bp, Artificial Sequence
  synthetic [barcode part1]
gcaactactaaggaac

SEQ ID NO: 4858 - DNA, 16 bp, Artificial Sequence
  synthetic [barcode part1]
aaccgtggattcttct

SEQ ID NO: 4859 - DNA, 16 bp, Artificial Sequence
  synthetic [barcode part1]
gtgatctgcaacctag

SEQ ID NO: 4860 - DNA, 16 bp, Artificial Sequence
  synthetic [barcode part1]
gatagtcgtgtagaac

SEQ ID NO: 4861 - DNA, 16 bp, Artificial Sequence
  synthetic [barcode part1]
gcctattgttctaggt

SEQ ID NO: 4862 - DNA, 16 bp, Artificial Sequence
  synthetic [barcode part1]
gttgacaattcctcac

SEQ ID NO: 4863 - DNA, 16 bp, Artificial Sequence
  synthetic [barcode part1]
gtagtgcgccaattgt

SEQ ID NO: 4864 - DNA, 16 bp, Artificial Sequence
  synthetic [barcode part1]
gtgtggattgtgttcg

SEQ ID NO: 4865 - DNA, 16 bp, Artificial Sequence
  synthetic [barcode part1]
ccttcgtgtctggtag

SEQ ID NO: 4866 - DNA, 16 bp, Artificial Sequence
  synthetic [barcode part1]
gagaacaggtggcctt

SEQ ID NO: 4867 - DNA, 16 bp, Artificial Sequence
  synthetic [barcode part1]
aacggttcaacttggc

SEQ ID NO: 4868 - DNA, 16 bp, Artificial Sequence
  synthetic [barcode part1]
tgtgactacacggttg

SEQ ID NO: 4869 - DNA, 16 bp, Artificial Sequence
  synthetic [barcode part1]
gtattgcacaacaccg

SEQ ID NO: 4870 - DNA, 16 bp, Artificial Sequence
  synthetic [barcode part1]
gattcgatatacctcc

SEQ ID NO: 4871 - DNA, 16 bp, Artificial Sequence
  synthetic [barcode part1]
tcgacctaggcacttc

SEQ ID NO: 4872 - DNA, 16 bp, Artificial Sequence
  synthetic [barcode part1]
ccacttagtaggcagt

SEQ ID NO: 4873 - DNA, 16 bp, Artificial Sequence
  synthetic [barcode part1]
agtctctgagacgact

SEQ ID NO: 4874 - DNA, 16 bp, Artificial Sequence
  synthetic [barcode part1]
tcctagtgcgtctggt

SEQ ID NO: 4875 - DNA, 16 bp, Artificial Sequence
  synthetic [barcode part1]
gccgatattatcgtct

SEQ ID NO: 4876 - DNA, 16 bp, Artificial Sequence
  synthetic [barcode part1]
aggcaccttgttctgc

SEQ ID NO: 4877 - DNA, 16 bp, Artificial Sequence
  synthetic [barcode part1]
cgtaactattgttccg

SEQ ID NO: 4878 - DNA, 16 bp, Artificial Sequence
  synthetic [barcode part1]
gtgcaatctaaggaac

SEQ ID NO: 4879 - DNA, 16 bp, Artificial Sequence
  synthetic [barcode part1]
tccaatcgcactaact

SEQ ID NO: 4880 - DNA, 16 bp, Artificial Sequence
  synthetic [barcode part1]
tccggtggaattgttg

SEQ ID NO: 4881 - DNA, 16 bp, Artificial Sequence
  synthetic [barcode part1]
tggaaggtagtacgcc

SEQ ID NO: 4882 - DNA, 16 bp, Artificial Sequence
  synthetic [barcode part1]
tatacgcgaccaactg

SEQ ID NO: 4883 - DNA, 16 bp, Artificial Sequence
  synthetic [barcode part1]
cgtgaaggtcgagttg

SEQ ID NO: 4884 - DNA, 16 bp, Artificial Sequence
  synthetic [barcode part1]
cacacaatcgttgttc

SEQ ID NO: 4885 - DNA, 16 bp, Artificial Sequence
  synthetic [barcode part1]
acgatctcgaactgtg

SEQ ID NO: 4886 - DNA, 16 bp, Artificial Sequence
  synthetic [barcode part1]
gtcgagacgcaatcag

SEQ ID NO: 4887 - DNA, 16 bp, Artificial Sequence
  synthetic [barcode part1]
agtcgtgaccggtatt

SEQ ID NO: 4888 - DNA, 16 bp, Artificial Sequence
  synthetic [barcode part1]
cagagtgaacgtattg

SEQ ID NO: 4889 - DNA, 16 bp, Artificial Sequence
  synthetic [barcode part1]
accagatcggattacc

SEQ ID NO: 4890 - DNA, 16 bp, Artificial Sequence
  synthetic [barcode part1]
aatacaggacacggag

SEQ ID NO: 4891 - DNA, 16 bp, Artificial Sequence
  synthetic [barcode part1]
tacggtacttaggacc

SEQ ID NO: 4892 - DNA, 16 bp, Artificial Sequence
  synthetic [barcode part1]
tgtcgaacgtcagatc

SEQ ID NO: 4893 - DNA, 16 bp, Artificial Sequence
  synthetic [barcode part1]
tggagaaccggttctt

SEQ ID NO: 4894 - DNA, 16 bp, Artificial Sequence
  synthetic [barcode part1]
tggccgaactaactac

SEQ ID NO: 4895 - DNA, 16 bp, Artificial Sequence
  synthetic [barcode part1]
atcgaggtacgcagtg

SEQ ID NO: 4896 - DNA, 16 bp, Artificial Sequence
  synthetic [barcode part1]
gtgcagaatcttcacg

SEQ ID NO: 4897 - DNA, 16 bp, Artificial Sequence
  synthetic [barcode part1]
accaacgtctaacctt

SEQ ID NO: 4898 - DNA, 16 bp, Artificial Sequence
  synthetic [barcode part1]
cgatacttgccacaag

SEQ ID NO: 4899 - DNA, 16 bp, Artificial Sequence
  synthetic [barcode part1]
gatctggagttgtcgt

SEQ ID NO: 4900 - DNA, 16 bp, Artificial Sequence
  synthetic [barcode part1]
gtgttcacaagtgtcg

SEQ ID NO: 4901 - DNA, 16 bp, Artificial Sequence
  synthetic [barcode part1]
gatcctctcagtacgc

SEQ ID NO: 4902 - DNA, 16 bp, Artificial Sequence
  synthetic [barcode part1]
tcacgaacttaacctc

SEQ ID NO: 4903 - DNA, 16 bp, Artificial Sequence
  synthetic [barcode part1]
cagtatacctcgccgt

SEQ ID NO: 4904 - DNA, 16 bp, Artificial Sequence
  synthetic [barcode part1]
ttgacgacaccagatc

SEQ ID NO: 4905 - DNA, 16 bp, Artificial Sequence
  synthetic [barcode part1]
ttgcctcaagacaacg

SEQ ID NO: 4906 - DNA, 16 bp, Artificial Sequence
  synthetic [barcode part1]
aatatacgaccgagac

SEQ ID NO: 4907 - DNA, 16 bp, Artificial Sequence
  synthetic [barcode part1]
aagtccgcagaggact

SEQ ID NO: 4908 - DNA, 16 bp, Artificial Sequence
  synthetic [barcode part1]
accacctgatatccgc

SEQ ID NO: 4909 - DNA, 16 bp, Artificial Sequence
  synthetic [barcode part1]
taacggcgtacttctt

SEQ ID NO: 4910 - DNA, 16 bp, Artificial Sequence
  synthetic [barcode part1]
tgaggtcttgaggtct

SEQ ID NO: 4911 - DNA, 16 bp, Artificial Sequence
  synthetic [barcode part1]
tcgccgtcttatcgtt

SEQ ID NO: 4912 - DNA, 16 bp, Artificial Sequence
  synthetic [barcode part1]
tctgagactctccttc

SEQ ID NO: 4913 - DNA, 16 bp, Artificial Sequence
  synthetic [barcode part1]
ttgttgtggcgttcgc

SEQ ID NO: 4914 - DNA, 16 bp, Artificial Sequence
  synthetic [barcode part1]
gccgacaacttagatc

SEQ ID NO: 4915 - DNA, 16 bp, Artificial Sequence
  synthetic [barcode part1]
caggtgtgttgttctt

SEQ ID NO: 4916 - DNA, 16 bp, Artificial Sequence
  synthetic [barcode part1]
gttattaggccaccag

SEQ ID NO: 4917 - DNA, 16 bp, Artificial Sequence
  synthetic [barcode part1]
ttattcggataggcgc

SEQ ID NO: 4918 - DNA, 16 bp, Artificial Sequence
  synthetic [barcode part1]
tcgcgtctatcggact

SEQ ID NO: 4919 - DNA, 16 bp, Artificial Sequence
  synthetic [barcode part1]
cgcaccagactagaag

SEQ ID NO: 4920 - DNA, 16 bp, Artificial Sequence
  synthetic [barcode part1]
tgcctggtacactaag

SEQ ID NO: 4921 - DNA, 16 bp, Artificial Sequence
  synthetic [barcode part1]
cgatctctgtaaccgc

SEQ ID NO: 4922 - DNA, 16 bp, Artificial Sequence
  synthetic [barcode part1]
gtatctgtccaggtag

SEQ ID NO: 4923 - DNA, 16 bp, Artificial Sequence
  synthetic [barcode part1]
tctaactgttacgtgc

SEQ ID NO: 4924 - DNA, 16 bp, Artificial Sequence
  synthetic [barcode part1]
gccacttctataagtc

SEQ ID NO: 4925 - DNA, 16 bp, Artificial Sequence
  synthetic [barcode part1]
cgagaagtgcgattgc

SEQ ID NO: 4926 - DNA, 16 bp, Artificial Sequence
  synthetic [barcode part1]
gtgaacgtggatagag

SEQ ID NO: 4927 - DNA, 16 bp, Artificial Sequence
  synthetic [barcode part1]
acactgactgacgtac

SEQ ID NO: 4928 - DNA, 16 bp, Artificial Sequence
  synthetic [barcode part1]
tgtggcaggacaggtt

SEQ ID NO: 4929 - DNA, 16 bp, Artificial Sequence
  synthetic [barcode part1]
agtggtcgcacagagt

SEQ ID NO: 4930 - DNA, 16 bp, Artificial Sequence
  synthetic [barcode part1]
caacgtaacacagtcc

SEQ ID NO: 4931 - DNA, 16 bp, Artificial Sequence
  synthetic [barcode part1]
agagacgtaccaggtc

SEQ ID NO: 4932 - DNA, 16 bp, Artificial Sequence
  synthetic [barcode part1]
aactggtcgcgatatc

SEQ ID NO: 4933 - DNA, 16 bp, Artificial Sequence
  synthetic [barcode part1]
agacgccaagtggtac

SEQ ID NO: 4934 - DNA, 16 bp, Artificial Sequence
  synthetic [barcode part1]
gcaacacttggtcagt

SEQ ID NO: 4935 - DNA, 16 bp, Artificial Sequence
  synthetic [barcode part1]
attgtgcagaggccag

SEQ ID NO: 4936 - DNA, 16 bp, Artificial Sequence
  synthetic [barcode part1]
gtacgttgcagttgtg

SEQ ID NO: 4937 - DNA, 16 bp, Artificial Sequence
  synthetic [barcode part1]
agtcttcggtccacgt

SEQ ID NO: 4938 - DNA, 16 bp, Artificial Sequence
  synthetic [barcode part1]
ttccaagtgagactcg

SEQ ID NO: 4939 - DNA, 16 bp, Artificial Sequence
  synthetic [barcode part1]
cgtggatctcgtcact

SEQ ID NO: 4940 - DNA, 16 bp, Artificial Sequence
  synthetic [barcode part1]
gtaccttgccagacct

SEQ ID NO: 4941 - DNA, 16 bp, Artificial Sequence
  synthetic [barcode part1]
tggacttccgtctcag

SEQ ID NO: 4942 - DNA, 16 bp, Artificial Sequence
  synthetic [barcode part1]
gtgatcacaatacgcc

SEQ ID NO: 4943 - DNA, 16 bp, Artificial Sequence
  synthetic [barcode part1]
accgagaaggaagttg

SEQ ID NO: 4944 - DNA, 16 bp, Artificial Sequence
  synthetic [barcode part1]
tcggtattctcttgag

SEQ ID NO: 4945 - DNA, 16 bp, Artificial Sequence
  synthetic [barcode part1]
gcgtattataggacag

SEQ ID NO: 4946 - DNA, 16 bp, Artificial Sequence
  synthetic [barcode part1]
gcgacgttcttaagac

SEQ ID NO: 4947 - DNA, 16 bp, Artificial Sequence
  synthetic [barcode part1]
aatctgagactgccgt

SEQ ID NO: 4948 - DNA, 16 bp, Artificial Sequence
  synthetic [barcode part1]
gtgacagacgattgcg

SEQ ID NO: 4949 - DNA, 16 bp, Artificial Sequence
  synthetic [barcode part1]
actgacactgcacaac

SEQ ID NO: 4950 - DNA, 16 bp, Artificial Sequence
  synthetic [barcode part1]
aacctggtgtacttct

SEQ ID NO: 4951 - DNA, 16 bp, Artificial Sequence
  synthetic [barcode part1]
actgtggaggcgaact

SEQ ID NO: 4952 - DNA, 16 bp, Artificial Sequence
  synthetic [barcode part1]
aatcacgcaattgcgc

SEQ ID NO: 4953 - DNA, 16 bp, Artificial Sequence
  synthetic [barcode part1]
actgaggcacaattag

SEQ ID NO: 4954 - DNA, 16 bp, Artificial Sequence
  synthetic [barcode part1]
tcaacctgacgtactt

SEQ ID NO: 4955 - DNA, 16 bp, Artificial Sequence
  synthetic [barcode part1]
gaaggtcgcgtgttag

SEQ ID NO: 4956 - DNA, 16 bp, Artificial Sequence
  synthetic [barcode part1]
tctaataccacgttcg

SEQ ID NO: 4957 - DNA, 16 bp, Artificial Sequence
  synthetic [barcode part1]
tgcgatacggaatctc

SEQ ID NO: 4958 - DNA, 16 bp, Artificial Sequence
  synthetic [barcode part1]
cgtggcagtctacttc

SEQ ID NO: 4959 - DNA, 16 bp, Artificial Sequence
  synthetic [barcode part1]
aagtcaacgtggccag

SEQ ID NO: 4960 - DNA, 16 bp, Artificial Sequence
  synthetic [barcode part1]
aggtacggatcgtcag

SEQ ID NO: 4961 - DNA, 16 bp, Artificial Sequence
  synthetic [barcode part1]
aagaggtctcgatcct

SEQ ID NO: 4962 - DNA, 16 bp, Artificial Sequence
  synthetic [barcode part1]
atattacaggtaggcg

SEQ ID NO: 4963 - DNA, 16 bp, Artificial Sequence
  synthetic [barcode part1]
tggttgacgactaacc

SEQ ID NO: 4964 - DNA, 16 bp, Artificial Sequence
  synthetic [barcode part1]
gactgcgatcagtatc

SEQ ID NO: 4965 - DNA, 16 bp, Artificial Sequence
  synthetic [barcode part1]
acggttgcgtacagtt

SEQ ID NO: 4966 - DNA, 16 bp, Artificial Sequence
  synthetic [barcode part1]
acgtcaggtcactcct

SEQ ID NO: 4967 - DNA, 16 bp, Artificial Sequence
  synthetic [barcode part1]
ccaacaactactggac

SEQ ID NO: 4968 - DNA, 16 bp, Artificial Sequence
  synthetic [barcode part1]
tgtggacggcaaggtt

SEQ ID NO: 4969 - DNA, 16 bp, Artificial Sequence
  synthetic [barcode part1]
tcctctcctggttagt

SEQ ID NO: 4970 - DNA, 16 bp, Artificial Sequence
  synthetic [barcode part1]
gcaacgaagacgtctg

SEQ ID NO: 4971 - DNA, 16 bp, Artificial Sequence
  synthetic [barcode part1]
acaggtgacctcagag

SEQ ID NO: 4972 - DNA, 16 bp, Artificial Sequence
  synthetic [barcode part1]
gactggatatcctgtg

SEQ ID NO: 4973 - DNA, 16 bp, Artificial Sequence
  synthetic [barcode part1]
tacagacaggtaacac

SEQ ID NO: 4974 - DNA, 16 bp, Artificial Sequence
  synthetic [barcode part1]
gactgcaacacgttgt

SEQ ID NO: 4975 - DNA, 16 bp, Artificial Sequence
  synthetic [barcode part1]
actgaactgttggacc

SEQ ID NO: 4976 - DNA, 16 bp, Artificial Sequence
  synthetic [barcode part1]
gtaggaatagtctggt

SEQ ID NO: 4977 - DNA, 16 bp, Artificial Sequence
  synthetic [barcode part1]
accgaattagaagtgc

SEQ ID NO: 4978 - DNA, 16 bp, Artificial Sequence
  synthetic [barcode part1]
caaccaagtaccgtac

SEQ ID NO: 4979 - DNA, 16 bp, Artificial Sequence
  synthetic [barcode part1]
tgacgttagatagacg

SEQ ID NO: 4980 - DNA, 16 bp, Artificial Sequence
  synthetic [barcode part1]
ttgtcgttgtctgagt

SEQ ID NO: 4981 - DNA, 16 bp, Artificial Sequence
  synthetic [barcode part1]
ttgatctggtacactc

SEQ ID NO: 4982 - DNA, 16 bp, Artificial Sequence
  synthetic [barcode part1]
aagtacagtcgagttg

SEQ ID NO: 4983 - DNA, 16 bp, Artificial Sequence
  synthetic [barcode part1]
ccaacaggtgattcgt

SEQ ID NO: 4984 - DNA, 16 bp, Artificial Sequence
  synthetic [barcode part1]
tacttgttgagactcc

SEQ ID NO: 4985 - DNA, 16 bp, Artificial Sequence
  synthetic [barcode part1]
gatcctcgtacttggc

SEQ ID NO: 4986 - DNA, 16 bp, Artificial Sequence
  synthetic [barcode part1]
agttcctacgcaactt

SEQ ID NO: 4987 - DNA, 16 bp, Artificial Sequence
  synthetic [barcode part1]
ccttgtcactctactg

SEQ ID NO: 4988 - DNA, 16 bp, Artificial Sequence
  synthetic [barcode part1]
ccagataagtaaggtc

SEQ ID NO: 4989 - DNA, 16 bp, Artificial Sequence
  synthetic [barcode part1]
agtggtccttccacgt

SEQ ID NO: 4990 - DNA, 16 bp, Artificial Sequence
  synthetic [barcode part1]
agtacggtctggtgag

SEQ ID NO: 4991 - DNA, 16 bp, Artificial Sequence
  synthetic [barcode part1]
aggaacgtactcttgc

SEQ ID NO: 4992 - DNA, 16 bp, Artificial Sequence
  synthetic [barcode part1]
tgacggcacactcttc

SEQ ID NO: 4993 - DNA, 16 bp, Artificial Sequence
  synthetic [barcode part1]
acgcagtccaattctt

SEQ ID NO: 4994 - DNA, 16 bp, Artificial Sequence
  synthetic [barcode part1]
tagtcctcgcaattgt

SEQ ID NO: 4995 - DNA, 16 bp, Artificial Sequence
  synthetic [barcode part1]
aacgttctattccgtg

SEQ ID NO: 4996 - DNA, 16 bp, Artificial Sequence
  synthetic [barcode part1]
aggagtgaggtcgttc

SEQ ID NO: 4997 - DNA, 16 bp, Artificial Sequence
  synthetic [barcode part1]
agtgttgtcagttggc

SEQ ID NO: 4998 - DNA, 16 bp, Artificial Sequence
  synthetic [barcode part1]
cagtgcctgcctattg

SEQ ID NO: 4999 - DNA, 16 bp, Artificial Sequence
  synthetic [barcode part1]
atctcaggtcacaacg

SEQ ID NO: 5000 - DNA, 16 bp, Artificial Sequence
  synthetic [barcode part1]
cgagaggactgacact

SEQ ID NO: 5001 - DNA, 16 bp, Artificial Sequence
  synthetic [barcode part1]
aggatcgacgtccaag

SEQ ID NO: 5002 - DNA, 16 bp, Artificial Sequence
  synthetic [barcode part1]
gttcgccttatccact

SEQ ID NO: 5003 - DNA, 16 bp, Artificial Sequence
  synthetic [barcode part1]
agtctcctcttatcgc

SEQ ID NO: 5004 - DNA, 16 bp, Artificial Sequence
  synthetic [barcode part1]
gaccaagagtgtgtcg

SEQ ID NO: 5005 - DNA, 16 bp, Artificial Sequence
  synthetic [barcode part1]
tcacgccgtctagtgt

SEQ ID NO: 5006 - DNA, 16 bp, Artificial Sequence
  synthetic [barcode part1]
gcagagagttattgac

SEQ ID NO: 5007 - DNA, 16 bp, Artificial Sequence
  synthetic [barcode part1]
ccaactacttctctcg

SEQ ID NO: 5008 - DNA, 16 bp, Artificial Sequence
  synthetic [barcode part1]
acctgaatccaagtgc

SEQ ID NO: 5009 - DNA, 16 bp, Artificial Sequence
  synthetic [barcode part1]
cgttgtcgaatcgaac

SEQ ID NO: 5010 - DNA, 16 bp, Artificial Sequence
  synthetic [barcode part1]
gaggatatctggtagt

SEQ ID NO: 5011 - DNA, 16 bp, Artificial Sequence
  synthetic [barcode part1]
tgtacggtaccttgtt

SEQ ID NO: 5012 - DNA, 16 bp, Artificial Sequence
  synthetic [barcode part1]
cctaagacagtcaacc

SEQ ID NO: 5013 - DNA, 16 bp, Artificial Sequence
  synthetic [barcode part1]
aaccaactgacactgc

SEQ ID NO: 5014 - DNA, 16 bp, Artificial Sequence
  synthetic [barcode part1]
gcaccgtcgaatagag

SEQ ID NO: 5015 - DNA, 16 bp, Artificial Sequence
  synthetic [barcode part1]
aatccgtacgaatccg

SEQ ID NO: 5016 - DNA, 16 bp, Artificial Sequence
  synthetic [barcode part1]
tcaacgagagtacaac

SEQ ID NO: 5017 - DNA, 16 bp, Artificial Sequence
  synthetic [barcode part1]
ccgacctgaatcaagt

SEQ ID NO: 5018 - DNA, 16 bp, Artificial Sequence
  synthetic [barcode part1]
gattcaggaggatatc

SEQ ID NO: 5019 - DNA, 16 bp, Artificial Sequence
  synthetic [barcode part1]
tattcggacgcagttg

SEQ ID NO: 5020 - DNA, 16 bp, Artificial Sequence
  synthetic [barcode part1]
tcgatcagaccgattg

SEQ ID NO: 5021 - DNA, 16 bp, Artificial Sequence
  synthetic [barcode part1]
tactgttcctgacctc

SEQ ID NO: 5022 - DNA, 16 bp, Artificial Sequence
  synthetic [barcode part1]
acgtaaccttcctggc

SEQ ID NO: 5023 - DNA, 16 bp, Artificial Sequence
  synthetic [barcode part1]
ataacgtccaaccggt

SEQ ID NO: 5024 - DNA, 16 bp, Artificial Sequence
  synthetic [barcode part1]
tgtatagtaccggcgt

SEQ ID NO: 5025 - DNA, 16 bp, Artificial Sequence
  synthetic [barcode part1]
acttccgtgagttatc

SEQ ID NO: 5026 - DNA, 16 bp, Artificial Sequence
  synthetic [barcode part1]
gtcgccacaattcaag

SEQ ID NO: 5027 - DNA, 16 bp, Artificial Sequence
  synthetic [barcode part1]
gtgaccacaacacact

SEQ ID NO: 5028 - DNA, 16 bp, Artificial Sequence
  synthetic [barcode part1]
gtcgaattagatcgcc

SEQ ID NO: 5029 - DNA, 16 bp, Artificial Sequence
  synthetic [barcode part1]
accttacgaaccaggt

SEQ ID NO: 5030 - DNA, 16 bp, Artificial Sequence
  synthetic [barcode part1]
tggaaccgatcaacct

SEQ ID NO: 5031 - DNA, 16 bp, Artificial Sequence
  synthetic [barcode part1]
aacgtgccttcaactt

SEQ ID NO: 5032 - DNA, 16 bp, Artificial Sequence
  synthetic [barcode part1]
cgaatataccaggagt

SEQ ID NO: 5033 - DNA, 16 bp, Artificial Sequence
  synthetic [barcode part1]
ttcgccgacgtgatct

SEQ ID NO: 5034 - DNA, 16 bp, Artificial Sequence
  synthetic [barcode part1]
acctatctaggatcct

SEQ ID NO: 5035 - DNA, 16 bp, Artificial Sequence
  synthetic [barcode part1]
gtatcgttacctgttg

SEQ ID NO: 5036 - DNA, 16 bp, Artificial Sequence
  synthetic [barcode part1]
ttgtacttaggccgcc

SEQ ID NO: 5037 - DNA, 16 bp, Artificial Sequence
  synthetic [barcode part1]
tgtattccagaggcac

SEQ ID NO: 5038 - DNA, 16 bp, Artificial Sequence
  synthetic [barcode part1]
atacgtgattgaccgc

SEQ ID NO: 5039 - DNA, 16 bp, Artificial Sequence
  synthetic [barcode part1]
gaattgtgaacgcagt

SEQ ID NO: 5040 - DNA, 16 bp, Artificial Sequence
  synthetic [barcode part1]
aggacactcttacgtg

SEQ ID NO: 5041 - DNA, 16 bp, Artificial Sequence
  synthetic [barcode part1]
tatccgtagtggacgt

SEQ ID NO: 5042 - DNA, 16 bp, Artificial Sequence
  synthetic [barcode part1]
gaattcactgcacggt

SEQ ID NO: 5043 - DNA, 16 bp, Artificial Sequence
  synthetic [barcode part1]
tggatctcgtcgtctg

SEQ ID NO: 5044 - DNA, 16 bp, Artificial Sequence
  synthetic [barcode part1]
gaagaccgcactagtg

SEQ ID NO: 5045 - DNA, 16 bp, Artificial Sequence
  synthetic [barcode part1]
gacgtcagttgtggtt

SEQ ID NO: 5046 - DNA, 16 bp, Artificial Sequence
  synthetic [barcode part1]
agtcggttcggttagt

SEQ ID NO: 5047 - DNA, 16 bp, Artificial Sequence
  synthetic [barcode part1]
tcggtaataagaacgc

SEQ ID NO: 5048 - DNA, 16 bp, Artificial Sequence
  synthetic [barcode part1]
cgtactaactacgcag

SEQ ID NO: 5049 - DNA, 16 bp, Artificial Sequence
  synthetic [barcode part1]
gtagaccaaggcaatt

SEQ ID NO: 5050 - DNA, 16 bp, Artificial Sequence
  synthetic [barcode part1]
ttgcgtcctattgaac

SEQ ID NO: 5051 - DNA, 16 bp, Artificial Sequence
  synthetic [barcode part1]
actgaaccgtcttcgc

SEQ ID NO: 5052 - DNA, 16 bp, Artificial Sequence
  synthetic [barcode part1]
gacggagttggtgtgt

SEQ ID NO: 5053 - DNA, 16 bp, Artificial Sequence
  synthetic [barcode part1]
ttcgaccactacacgc

SEQ ID NO: 5054 - DNA, 16 bp, Artificial Sequence
  synthetic [barcode part1]
attagaggtcggcgtg

SEQ ID NO: 5055 - DNA, 16 bp, Artificial Sequence
  synthetic [barcode part1]
cctcagttaatcctcc

SEQ ID NO: 5056 - DNA, 16 bp, Artificial Sequence
  synthetic [barcode part1]
gtctggcgttagattg

SEQ ID NO: 5057 - DNA, 16 bp, Artificial Sequence
  synthetic [barcode part1]
tgaacactggtgaggc

SEQ ID NO: 5058 - DNA, 16 bp, Artificial Sequence
  synthetic [barcode part1]
tgagaggtgtggtcac

SEQ ID NO: 5059 - DNA, 16 bp, Artificial Sequence
  synthetic [barcode part1]
gtagatcgaggactgc

SEQ ID NO: 5060 - DNA, 16 bp, Artificial Sequence
  synthetic [barcode part1]
accttatcgttagtgc

SEQ ID NO: 5061 - DNA, 16 bp, Artificial Sequence
  synthetic [barcode part1]
tgagttctaccgcctg

SEQ ID NO: 5062 - DNA, 16 bp, Artificial Sequence
  synthetic [barcode part1]
cctctcaaccttctag

SEQ ID NO: 5063 - DNA, 16 bp, Artificial Sequence
  synthetic [barcode part1]
gcgttctggttatcgc

SEQ ID NO: 5064 - DNA, 16 bp, Artificial Sequence
  synthetic [barcode part1]
aattgcacgcgactgt

SEQ ID NO: 5065 - DNA, 16 bp, Artificial Sequence
  synthetic [barcode part1]
gtcgaatctgtattcc

SEQ ID NO: 5066 - DNA, 16 bp, Artificial Sequence
  synthetic [barcode part1]
ttgcacagttgtgcag

SEQ ID NO: 5067 - DNA, 16 bp, Artificial Sequence
  synthetic [barcode part1]
tgaccgcacaaggtag

SEQ ID NO: 5068 - DNA, 16 bp, Artificial Sequence
  synthetic [barcode part1]
tgcgtcttagactatc

SEQ ID NO: 5069 - DNA, 16 bp, Artificial Sequence
  synthetic [barcode part1]
aaggtagttcagacgt

SEQ ID NO: 5070 - DNA, 16 bp, Artificial Sequence
  synthetic [barcode part1]
tccacactacgtcttc

SEQ ID NO: 5071 - DNA, 16 bp, Artificial Sequence
  synthetic [barcode part1]
taatactgcctgtctg

SEQ ID NO: 5072 - DNA, 16 bp, Artificial Sequence
  synthetic [barcode part1]
gacctcggtagtattg

SEQ ID NO: 5073 - DNA, 16 bp, Artificial Sequence
  synthetic [barcode part1]
gtagttcgacgcagag

SEQ ID NO: 5074 - DNA, 16 bp, Artificial Sequence
  synthetic [barcode part1]
tctcaatccttaccgc

SEQ ID NO: 5075 - DNA, 16 bp, Artificial Sequence
  synthetic [barcode part1]
gacgtgttacgcgatt

SEQ ID NO: 5076 - DNA, 16 bp, Artificial Sequence
  synthetic [barcode part1]
aagtccaggtggcaac

SEQ ID NO: 5077 - DNA, 16 bp, Artificial Sequence
  synthetic [barcode part1]
tctagagaggatcctc

SEQ ID NO: 5078 - DNA, 16 bp, Artificial Sequence
  synthetic [barcode part1]
gcctggagagtgatac

SEQ ID NO: 5079 - DNA, 16 bp, Artificial Sequence
  synthetic [barcode part1]
aagataggacgagacc

SEQ ID NO: 5080 - DNA, 16 bp, Artificial Sequence
  synthetic [barcode part1]
tagtcgttctggcctg

SEQ ID NO: 5081 - DNA, 16 bp, Artificial Sequence
  synthetic [barcode part1]
gcgaactgccacttct

SEQ ID NO: 5082 - DNA, 16 bp, Artificial Sequence
  synthetic [barcode part1]
gtatcttggccgtcac

SEQ ID NO: 5083 - DNA, 16 bp, Artificial Sequence
  synthetic [barcode part1]
tgacgagtcgttctag

SEQ ID NO: 5084 - DNA, 16 bp, Artificial Sequence
  synthetic [barcode part1]
cactgcggttatagtg

SEQ ID NO: 5085 - DNA, 16 bp, Artificial Sequence
  synthetic [barcode part1]
ttggacttgactcgag

SEQ ID NO: 5086 - DNA, 16 bp, Artificial Sequence
  synthetic [barcode part1]
gcaattgccgatcctc

SEQ ID NO: 5087 - DNA, 16 bp, Artificial Sequence
  synthetic [barcode part1]
tacgaacgcggtagac

SEQ ID NO: 5088 - DNA, 16 bp, Artificial Sequence
  synthetic [barcode part1]
tcggatagtcttgttc

SEQ ID NO: 5089 - DNA, 16 bp, Artificial Sequence
  synthetic [barcode part1]
acagatagtggtactg

SEQ ID NO: 5090 - DNA, 16 bp, Artificial Sequence
  synthetic [barcode part1]
gattcagtggtctgac

SEQ ID NO: 5091 - DNA, 16 bp, Artificial Sequence
  synthetic [barcode part1]
ttgtgcaacacgtcag

SEQ ID NO: 5092 - DNA, 16 bp, Artificial Sequence
  synthetic [barcode part1]
tagatcgtatacctcc

SEQ ID NO: 5093 - DNA, 16 bp, Artificial Sequence
  synthetic [barcode part1]
cggaacctaatcgatc

SEQ ID NO: 5094 - DNA, 16 bp, Artificial Sequence
  synthetic [barcode part1]
actaggttgttggacc

SEQ ID NO: 5095 - DNA, 16 bp, Artificial Sequence
  synthetic [barcode part1]
cgcacgaacttcttgc

SEQ ID NO: 5096 - DNA, 16 bp, Artificial Sequence
  synthetic [barcode part1]
tcgtctcactattccg

SEQ ID NO: 5097 - DNA, 16 bp, Artificial Sequence
  synthetic [barcode part1]
tggttgtctatcactg

SEQ ID NO: 5098 - DNA, 16 bp, Artificial Sequence
  synthetic [barcode part1]
gttcgatcgcgagaag

SEQ ID NO: 5099 - DNA, 16 bp, Artificial Sequence
  synthetic [barcode part1]
cgttgattcaaggaag

SEQ ID NO: 5100 - DNA, 16 bp, Artificial Sequence
  synthetic [barcode part1]
acgttacacgacgttg

SEQ ID NO: 5101 - DNA, 16 bp, Artificial Sequence
  synthetic [barcode part1]
atagaacaggtccgcg

SEQ ID NO: 5102 - DNA, 16 bp, Artificial Sequence
  synthetic [barcode part1]
tattagaactcctgcc

SEQ ID NO: 5103 - DNA, 16 bp, Artificial Sequence
  synthetic [barcode part1]
atcaacgaggtgttcc

SEQ ID NO: 5104 - DNA, 16 bp, Artificial Sequence
  synthetic [barcode part1]
cagtactgcaacgttg

SEQ ID NO: 5105 - DNA, 16 bp, Artificial Sequence
  synthetic [barcode part1]
acgaaggccagtgatc

SEQ ID NO: 5106 - DNA, 16 bp, Artificial Sequence
  synthetic [barcode part1]
ttgcagaccgtcactc

SEQ ID NO: 5107 - DNA, 16 bp, Artificial Sequence
  synthetic [barcode part1]
agttcaccaggtgttg

SEQ ID NO: 5108 - DNA, 16 bp, Artificial Sequence
  synthetic [barcode part1]
acaccgaattgaaggt

SEQ ID NO: 5109 - DNA, 16 bp, Artificial Sequence
  synthetic [barcode part1]
tgagtcttctggacag

SEQ ID NO: 5110 - DNA, 16 bp, Artificial Sequence
  synthetic [barcode part1]
tctaggttcgcgtaag

SEQ ID NO: 5111 - DNA, 16 bp, Artificial Sequence
  synthetic [barcode part1]
cggacgtgttgaagac

SEQ ID NO: 5112 - DNA, 16 bp, Artificial Sequence
  synthetic [barcode part1]
gacttgacgtgaaggc

SEQ ID NO: 5113 - DNA, 16 bp, Artificial Sequence
  synthetic [barcode part1]
tcacgaggacgacagt

SEQ ID NO: 5114 - DNA, 16 bp, Artificial Sequence
  synthetic [barcode part1]
cggcagtacacaagac

SEQ ID NO: 5115 - DNA, 16 bp, Artificial Sequence
  synthetic [barcode part1]
agataagtcacggcgc

SEQ ID NO: 5116 - DNA, 16 bp, Artificial Sequence
  synthetic [barcode part1]
acacactcactggtag

SEQ ID NO: 5117 - DNA, 16 bp, Artificial Sequence
  synthetic [barcode part1]
aagaggtgagtgtctt

SEQ ID NO: 5118 - DNA, 16 bp, Artificial Sequence
  synthetic [barcode part1]
ttctgtatcaacggtc

SEQ ID NO: 5119 - DNA, 16 bp, Artificial Sequence
  synthetic [barcode part1]
cgtgtctgttcaacgc

SEQ ID NO: 5120 - DNA, 16 bp, Artificial Sequence
  synthetic [barcode part1]
gcgattagtcagtgtc

SEQ ID NO: 5121 - DNA, 16 bp, Artificial Sequence
  synthetic [barcode part1]
tgaatcgtcttcacac

SEQ ID NO: 5122 - DNA, 16 bp, Artificial Sequence
  synthetic [barcode part1]
ttcgttgacgtggcct

SEQ ID NO: 5123 - DNA, 16 bp, Artificial Sequence
  synthetic [barcode part1]
ttggtccgaactgaac

SEQ ID NO: 5124 - DNA, 16 bp, Artificial Sequence
  synthetic [barcode part1]
ttgtgcaacgtaccag

SEQ ID NO: 5125 - DNA, 16 bp, Artificial Sequence
  synthetic [barcode part1]
cagttcaaggtacaag

SEQ ID NO: 5126 - DNA, 16 bp, Artificial Sequence
  synthetic [barcode part1]
gtggaaccgaacgttg

SEQ ID NO: 5127 - DNA, 16 bp, Artificial Sequence
  synthetic [barcode part1]
tcaatctgtgactacc

SEQ ID NO: 5128 - DNA, 16 bp, Artificial Sequence
  synthetic [barcode part1]
tattctggttcgcggc

SEQ ID NO: 5129 - DNA, 16 bp, Artificial Sequence
  synthetic [barcode part1]
tcgtagtatacgtgcg

SEQ ID NO: 5130 - DNA, 16 bp, Artificial Sequence
  synthetic [barcode part1]
tgtagtagacgccact

SEQ ID NO: 5131 - DNA, 16 bp, Artificial Sequence
  synthetic [barcode part1]
ttgaggtgagttctgc

SEQ ID NO: 5132 - DNA, 16 bp, Artificial Sequence
  synthetic [barcode part1]
atagaggccggtgact

SEQ ID NO: 5133 - DNA, 16 bp, Artificial Sequence
  synthetic [barcode part1]
gatcacttgaaccacg

SEQ ID NO: 5134 - DNA, 16 bp, Artificial Sequence
  synthetic [barcode part1]
gccagtgcaaggaatc

SEQ ID NO: 5135 - DNA, 16 bp, Artificial Sequence
  synthetic [barcode part1]
aacggacgcgaataag

SEQ ID NO: 5136 - DNA, 16 bp, Artificial Sequence
  synthetic [barcode part1]
tgcaggaaggatacag

SEQ ID NO: 5137 - DNA, 16 bp, Artificial Sequence
  synthetic [barcode part1]
cgtgtatctaaggtcg

SEQ ID NO: 5138 - DNA, 16 bp, Artificial Sequence
  synthetic [barcode part1]
tcgcacggattctctg

SEQ ID NO: 5139 - DNA, 16 bp, Artificial Sequence
  synthetic [barcode part1]
tcagtgagtgaaggcc

SEQ ID NO: 5140 - DNA, 16 bp, Artificial Sequence
  synthetic [barcode part1]
tcaggatacaggcgac

SEQ ID NO: 5141 - DNA, 16 bp, Artificial Sequence
  synthetic [barcode part1]
aagtgcctggatacct

SEQ ID NO: 5142 - DNA, 16 bp, Artificial Sequence
  synthetic [barcode part1]
ttactggttccgtgcg

SEQ ID NO: 5143 - DNA, 16 bp, Artificial Sequence
  synthetic [barcode part1]
aacacaacggagacag

SEQ ID NO: 5144 - DNA, 16 bp, Artificial Sequence
  synthetic [barcode part1]
agaatcaagttgtgcg

SEQ ID NO: 5145 - DNA, 16 bp, Artificial Sequence
  synthetic [barcode part1]
acacggttcaagaagt

SEQ ID NO: 5146 - DNA, 16 bp, Artificial Sequence
  synthetic [barcode part1]
tagtcaccaggagacg

SEQ ID NO: 5147 - DNA, 16 bp, Artificial Sequence
  synthetic [barcode part1]
attctcgcagatcgtt

SEQ ID NO: 5148 - DNA, 16 bp, Artificial Sequence
  synthetic [barcode part1]
caacaggtgaacgtcg

SEQ ID NO: 5149 - DNA, 16 bp, Artificial Sequence
  synthetic [barcode part1]
atagtgcactaaccgc

SEQ ID NO: 5150 - DNA, 16 bp, Artificial Sequence
  synthetic [barcode part1]
ttacaaggagtcgagt

SEQ ID NO: 5151 - DNA, 16 bp, Artificial Sequence
  synthetic [barcode part1]
tctcaacgcgcagtct

SEQ ID NO: 5152 - DNA, 16 bp, Artificial Sequence
  synthetic [barcode part1]
ccacaaggcaactact

SEQ ID NO: 5153 - DNA, 16 bp, Artificial Sequence
  synthetic [barcode part1]
tatacagtccggttct

SEQ ID NO: 5154 - DNA, 16 bp, Artificial Sequence
  synthetic [barcode part1]
tgcacctacctagtgc

SEQ ID NO: 5155 - DNA, 16 bp, Artificial Sequence
  synthetic [barcode part1]
cctattggattcgtgt

SEQ ID NO: 5156 - DNA, 16 bp, Artificial Sequence
  synthetic [barcode part1]
caagtacaacctgcac

SEQ ID NO: 5157 - DNA, 16 bp, Artificial Sequence
  synthetic [barcode part1]
cgatcttaagaggcct

SEQ ID NO: 5158 - DNA, 16 bp, Artificial Sequence
  synthetic [barcode part1]
gtcttcggaattgttc

SEQ ID NO: 5159 - DNA, 16 bp, Artificial Sequence
  synthetic [barcode part1]
gtgttgaccaggtatc

SEQ ID NO: 5160 - DNA, 16 bp, Artificial Sequence
  synthetic [barcode part1]
ttatacacggtgtgcg

SEQ ID NO: 5161 - DNA, 16 bp, Artificial Sequence
  synthetic [barcode part1]
cctacacagtctaatc

SEQ ID NO: 5162 - DNA, 16 bp, Artificial Sequence
  synthetic [barcode part1]
tgttggtctccgatcg

SEQ ID NO: 5163 - DNA, 16 bp, Artificial Sequence
  synthetic [barcode part1]
cagttcctcaatcctc

SEQ ID NO: 5164 - DNA, 16 bp, Artificial Sequence
  synthetic [barcode part1]
aatagaccaagatccg

SEQ ID NO: 5165 - DNA, 16 bp, Artificial Sequence
  synthetic [barcode part1]
cgaactaaggatacac

SEQ ID NO: 5166 - DNA, 16 bp, Artificial Sequence
  synthetic [barcode part1]
gttggcgaatagtaac

SEQ ID NO: 5167 - DNA, 16 bp, Artificial Sequence
  synthetic [barcode part1]
aattcaactctcgcac

SEQ ID NO: 5168 - DNA, 16 bp, Artificial Sequence
  synthetic [barcode part1]
gcagactgtgtctagt

SEQ ID NO: 5169 - DNA, 16 bp, Artificial Sequence
  synthetic [barcode part1]
tcggatactacagacc

SEQ ID NO: 5170 - DNA, 16 bp, Artificial Sequence
  synthetic [barcode part1]
cacgtgcaatcaatcg

SEQ ID NO: 5171 - DNA, 16 bp, Artificial Sequence
  synthetic [barcode part1]
tgtgcgactgttactt

SEQ ID NO: 5172 - DNA, 16 bp, Artificial Sequence
  synthetic [barcode part1]
atctcttaccaacacg

SEQ ID NO: 5173 - DNA, 16 bp, Artificial Sequence
  synthetic [barcode part1]
acacttccacgtctct

SEQ ID NO: 5174 - DNA, 16 bp, Artificial Sequence
  synthetic [barcode part1]
cctccaacgtagttgc

SEQ ID NO: 5175 - DNA, 16 bp, Artificial Sequence
  synthetic [barcode part1]
tgtctattcgcggcac

SEQ ID NO: 5176 - DNA, 16 bp, Artificial Sequence
  synthetic [barcode part1]
acctagatccactatc

SEQ ID NO: 5177 - DNA, 16 bp, Artificial Sequence
  synthetic [barcode part1]
tctgccttggatagag

SEQ ID NO: 5178 - DNA, 16 bp, Artificial Sequence
  synthetic [barcode part1]
gtaaccaatcgacgtc

SEQ ID NO: 5179 - DNA, 16 bp, Artificial Sequence
  synthetic [barcode part1]
tctcgtctaggacaag

SEQ ID NO: 5180 - DNA, 16 bp, Artificial Sequence
  synthetic [barcode part1]
tcgcagataggagatt

SEQ ID NO: 5181 - DNA, 16 bp, Artificial Sequence
  synthetic [barcode part1]
tgtactgactgacgtg

SEQ ID NO: 5182 - DNA, 16 bp, Artificial Sequence
  synthetic [barcode part1]
tacgcctctatcaggc

SEQ ID NO: 5183 - DNA, 16 bp, Artificial Sequence
  synthetic [barcode part1]
gatacgtgttgcgtac

SEQ ID NO: 5184 - DNA, 16 bp, Artificial Sequence
  synthetic [barcode part1]
gaggtgaatctgtaac

SEQ ID NO: 5185 - DNA, 16 bp, Artificial Sequence
  synthetic [barcode part1]
gtgttctcagttcagt

SEQ ID NO: 5186 - DNA, 16 bp, Artificial Sequence
  synthetic [barcode part1]
taggtcgattggacct

SEQ ID NO: 5187 - DNA, 16 bp, Artificial Sequence
  synthetic [barcode part1]
agtactcggaccagag

SEQ ID NO: 5188 - DNA, 16 bp, Artificial Sequence
  synthetic [barcode part1]
tattctcgttagaccg

SEQ ID NO: 5189 - DNA, 16 bp, Artificial Sequence
  synthetic [barcode part1]
atctcgagatctcgag

SEQ ID NO: 5190 - DNA, 16 bp, Artificial Sequence
  synthetic [barcode part1]
atctgaccagtaaccg

SEQ ID NO: 5191 - DNA, 16 bp, Artificial Sequence
  synthetic [barcode part1]
actggacgtaatccgt

SEQ ID NO: 5192 - DNA, 16 bp, Artificial Sequence
  synthetic [barcode part1]
atcacagttgtggcac

SEQ ID NO: 5193 - DNA, 16 bp, Artificial Sequence
  synthetic [barcode part1]
gcaatcgcacacgatt

SEQ ID NO: 5194 - DNA, 16 bp, Artificial Sequence
  synthetic [barcode part1]
cctattaacacagtcc

SEQ ID NO: 5195 - DNA, 16 bp, Artificial Sequence
  synthetic [barcode part1]
aggtcacagtataggt

SEQ ID NO: 5196 - DNA, 16 bp, Artificial Sequence
  synthetic [barcode part1]
gcgttctggcctaatc

SEQ ID NO: 5197 - DNA, 16 bp, Artificial Sequence
  synthetic [barcode part1]
cgcaattaagacagtg

SEQ ID NO: 5198 - DNA, 16 bp, Artificial Sequence
  synthetic [barcode part1]
cgacgaattcaggcag

SEQ ID NO: 5199 - DNA, 16 bp, Artificial Sequence
  synthetic [barcode part1]
cacacttgacaactct

SEQ ID NO: 5200 - DNA, 16 bp, Artificial Sequence
  synthetic [barcode part1]
atacagtctccaacct

SEQ ID NO: 5201 - DNA, 16 bp, Artificial Sequence
  synthetic [barcode part1]
gacactgtgcaacgtt

SEQ ID NO: 5202 - DNA, 16 bp, Artificial Sequence
  synthetic [barcode part1]
cgaattaggcctggtt

SEQ ID NO: 5203 - DNA, 16 bp, Artificial Sequence
  synthetic [barcode part1]
cgaagttcacgatacc

SEQ ID NO: 5204 - DNA, 16 bp, Artificial Sequence
  synthetic [barcode part1]
gaggttggtacgactg

SEQ ID NO: 5205 - DNA, 16 bp, Artificial Sequence
  synthetic [barcode part1]
agtccggacactcttc

SEQ ID NO: 5206 - DNA, 16 bp, Artificial Sequence
  synthetic [barcode part1]
gaagagtctcgcaggt

SEQ ID NO: 5207 - DNA, 16 bp, Artificial Sequence
  synthetic [barcode part1]
gcagtcactaggaggt

SEQ ID NO: 5208 - DNA, 16 bp, Artificial Sequence
  synthetic [barcode part1]
acgcaagaataacctg

SEQ ID NO: 5209 - DNA, 16 bp, Artificial Sequence
  synthetic [barcode part1]
aatcgcactggtctcc

SEQ ID NO: 5210 - DNA, 16 bp, Artificial Sequence
  synthetic [barcode part1]
cacacgaattccttgt

SEQ ID NO: 5211 - DNA, 16 bp, Artificial Sequence
  synthetic [barcode part1]
gcacctgaataaggcg

SEQ ID NO: 5212 - DNA, 16 bp, Artificial Sequence
  synthetic [barcode part1]
cacggtcgtattcaag

SEQ ID NO: 5213 - DNA, 16 bp, Artificial Sequence
  synthetic [barcode part1]
cagttctgtaccagtt

SEQ ID NO: 5214 - DNA, 16 bp, Artificial Sequence
  synthetic [barcode part1]
tctcacgccgacaatc

SEQ ID NO: 5215 - DNA, 16 bp, Artificial Sequence
  synthetic [barcode part1]
tatctcaggtgtccgc

SEQ ID NO: 5216 - DNA, 16 bp, Artificial Sequence
  synthetic [barcode part1]
gcgagtcagaagtcac

SEQ ID NO: 5217 - DNA, 16 bp, Artificial Sequence
  synthetic [barcode part1]
taccgaataggttgcc

SEQ ID NO: 5218 - DNA, 16 bp, Artificial Sequence
  synthetic [barcode part1]
aacaggccgagacttg

SEQ ID NO: 5219 - DNA, 16 bp, Artificial Sequence
  synthetic [barcode part1]
acgaacgcaagactcg

SEQ ID NO: 5220 - DNA, 16 bp, Artificial Sequence
  synthetic [barcode part1]
gtcaacaacctggatc

SEQ ID NO: 5221 - DNA, 16 bp, Artificial Sequence
  synthetic [barcode part1]
gtgtcaataacaggac

SEQ ID NO: 5222 - DNA, 16 bp, Artificial Sequence
  synthetic [barcode part1]
tattctaggcgttcgt

SEQ ID NO: 5223 - DNA, 16 bp, Artificial Sequence
  synthetic [barcode part1]
tgactgtgtaaccgtg

SEQ ID NO: 5224 - DNA, 16 bp, Artificial Sequence
  synthetic [barcode part1]
tgcgtctcactagacc

SEQ ID NO: 5225 - DNA, 16 bp, Artificial Sequence
  synthetic [barcode part1]
acggtatccagaatcc

SEQ ID NO: 5226 - DNA, 16 bp, Artificial Sequence
  synthetic [barcode part1]
aggatctcttacttgc

SEQ ID NO: 5227 - DNA, 16 bp, Artificial Sequence
  synthetic [barcode part1]
taactaaggtcggtcc

SEQ ID NO: 5228 - DNA, 16 bp, Artificial Sequence
  synthetic [barcode part1]
gcgattatcagttctc

SEQ ID NO: 5229 - DNA, 16 bp, Artificial Sequence
  synthetic [barcode part1]
cgacaacgaggtgtgt

SEQ ID NO: 5230 - DNA, 16 bp, Artificial Sequence
  synthetic [barcode part1]
agactggttagtctcg

SEQ ID NO: 5231 - DNA, 16 bp, Artificial Sequence
  synthetic [barcode part1]
cacgtcttctgtgttc

SEQ ID NO: 5232 - DNA, 16 bp, Artificial Sequence
  synthetic [barcode part1]
agaagaggccagttag

SEQ ID NO: 5233 - DNA, 16 bp, Artificial Sequence
  synthetic [barcode part1]
ttcgccactaagtgcc

SEQ ID NO: 5234 - DNA, 16 bp, Artificial Sequence
  synthetic [barcode part1]
cctggtcaactctctt

SEQ ID NO: 5235 - DNA, 16 bp, Artificial Sequence
  synthetic [barcode part1]
gtagtctctgtatctg

SEQ ID NO: 5236 - DNA, 16 bp, Artificial Sequence
  synthetic [barcode part1]
tagttgcagatcgaag

SEQ ID NO: 5237 - DNA, 16 bp, Artificial Sequence
  synthetic [barcode part1]
tgacaacttggcagtc

SEQ ID NO: 5238 - DNA, 16 bp, Artificial Sequence
  synthetic [barcode part1]
ttcgtccgtgaacaag

SEQ ID NO: 5239 - DNA, 16 bp, Artificial Sequence
  synthetic [barcode part1]
gacttcttgacggagt

SEQ ID NO: 5240 - DNA, 16 bp, Artificial Sequence
  synthetic [barcode part1]
cctgtcttgtctactg

SEQ ID NO: 5241 - DNA, 16 bp, Artificial Sequence
  synthetic [barcode part1]
gttggaccttgtactt

SEQ ID NO: 5242 - DNA, 16 bp, Artificial Sequence
  synthetic [barcode part1]
gtgagagtagtaatcc

SEQ ID NO: 5243 - DNA, 16 bp, Artificial Sequence
  synthetic [barcode part1]
gcctataattacctcg

SEQ ID NO: 5244 - DNA, 16 bp, Artificial Sequence
  synthetic [barcode part1]
tcctgataacttgcgt

SEQ ID NO: 5245 - DNA, 16 bp, Artificial Sequence
  synthetic [barcode part1]
tcaacagacaggaatc

SEQ ID NO: 5246 - DNA, 16 bp, Artificial Sequence
  synthetic [barcode part1]
gaaggcaacaatccgc

SEQ ID NO: 5247 - DNA, 16 bp, Artificial Sequence
  synthetic [barcode part1]
aacgtgccaatcgtgt

SEQ ID NO: 5248 - DNA, 16 bp, Artificial Sequence
  synthetic [barcode part1]
aatacgcgtcgtgtac

SEQ ID NO: 5249 - DNA, 16 bp, Artificial Sequence
  synthetic [barcode part1]
cctaaggagaggaagt

SEQ ID NO: 5250 - DNA, 16 bp, Artificial Sequence
  synthetic [barcode part1]
caactaggtgtcacac

SEQ ID NO: 5251 - DNA, 16 bp, Artificial Sequence
  synthetic [barcode part1]
gttgaggaagaccaag

SEQ ID NO: 5252 - DNA, 16 bp, Artificial Sequence
  synthetic [barcode part1]
ttccaacctgaacgtt

SEQ ID NO: 5253 - DNA, 16 bp, Artificial Sequence
  synthetic [barcode part1]
acgttaggttatctcc

SEQ ID NO: 5254 - DNA, 16 bp, Artificial Sequence
  synthetic [barcode part1]
aagtattggtgtccgc

SEQ ID NO: 5255 - DNA, 16 bp, Artificial Sequence
  synthetic [barcode part1]
gtcgaatagtacagac

SEQ ID NO: 5256 - DNA, 16 bp, Artificial Sequence
  synthetic [barcode part1]
ccgtatccgaactgtc

SEQ ID NO: 5257 - DNA, 16 bp, Artificial Sequence
  synthetic [barcode part1]
aacgattgcgttcctt

SEQ ID NO: 5258 - DNA, 16 bp, Artificial Sequence
  synthetic [barcode part1]
atcgtactgactcttg

SEQ ID NO: 5259 - DNA, 16 bp, Artificial Sequence
  synthetic [barcode part1]
ttaggacgtctgcctc

SEQ ID NO: 5260 - DNA, 16 bp, Artificial Sequence
  synthetic [barcode part1]
gtgcaagaacgtagag

SEQ ID NO: 5261 - DNA, 16 bp, Artificial Sequence
  synthetic [barcode part1]
gtatcactgtctatcg

SEQ ID NO: 5262 - DNA, 16 bp, Artificial Sequence
  synthetic [barcode part1]
cgactatcagatccag

SEQ ID NO: 5263 - DNA, 16 bp, Artificial Sequence
  synthetic [barcode part1]
tacacgaattcggacc

SEQ ID NO: 5264 - DNA, 16 bp, Artificial Sequence
  synthetic [barcode part1]
cagtggactgcaagtg

SEQ ID NO: 5265 - DNA, 16 bp, Artificial Sequence
  synthetic [barcode part1]
ttccacgtgatagttc

SEQ ID NO: 5266 - DNA, 16 bp, Artificial Sequence
  synthetic [barcode part1]
ttcacgcgattaccgc

SEQ ID NO: 5267 - DNA, 16 bp, Artificial Sequence
  synthetic [barcode part1]
tctctcggcaactacg

SEQ ID NO: 5268 - DNA, 16 bp, Artificial Sequence
  synthetic [barcode part1]
cgcgcagtaagaggtt

SEQ ID NO: 5269 - DNA, 16 bp, Artificial Sequence
  synthetic [barcode part1]
cgaatactcggtacac

SEQ ID NO: 5270 - DNA, 16 bp, Artificial Sequence
  synthetic [barcode part1]
agttgcagacttcttc

SEQ ID NO: 5271 - DNA, 16 bp, Artificial Sequence
  synthetic [barcode part1]
ttgtgtgcgatcgtag

SEQ ID NO: 5272 - DNA, 16 bp, Artificial Sequence
  synthetic [barcode part1]
tgatagacctaccgtg

SEQ ID NO: 5273 - DNA, 16 bp, Artificial Sequence
  synthetic [barcode part1]
tgacacgcgacttcct

SEQ ID NO: 5274 - DNA, 16 bp, Artificial Sequence
  synthetic [barcode part1]
gaggaacaacgcgttc

SEQ ID NO: 5275 - DNA, 16 bp, Artificial Sequence
  synthetic [barcode part1]
gttcttaggtaactcc

SEQ ID NO: 5276 - DNA, 16 bp, Artificial Sequence
  synthetic [barcode part1]
agtccgatcggtaact

SEQ ID NO: 5277 - DNA, 16 bp, Artificial Sequence
  synthetic [barcode part1]
cactaccacctgaacc

SEQ ID NO: 5278 - DNA, 16 bp, Artificial Sequence
  synthetic [barcode part1]
gcgcgattcttagtcc

SEQ ID NO: 5279 - DNA, 16 bp, Artificial Sequence
  synthetic [barcode part1]
tacgttggtgtaccag

SEQ ID NO: 5280 - DNA, 16 bp, Artificial Sequence
  synthetic [barcode part1]
tccacgtaccaagtcc

SEQ ID NO: 5281 - DNA, 16 bp, Artificial Sequence
  synthetic [barcode part1]
acggagacaatctaac

SEQ ID NO: 5282 - DNA, 16 bp, Artificial Sequence
  synthetic [barcode part1]
aagtcgccttagtggt

SEQ ID NO: 5283 - DNA, 16 bp, Artificial Sequence
  synthetic [barcode part1]
acctcgtggtgtactc

SEQ ID NO: 5284 - DNA, 16 bp, Artificial Sequence
  synthetic [barcode part1]
tcttctcaatcggtcc

SEQ ID NO: 5285 - DNA, 16 bp, Artificial Sequence
  synthetic [barcode part1]
aaggtcgattgttccg

SEQ ID NO: 5286 - DNA, 16 bp, Artificial Sequence
  synthetic [barcode part1]
cctactgttaatacgc

SEQ ID NO: 5287 - DNA, 16 bp, Artificial Sequence
  synthetic [barcode part1]
cgcacgatactagtac

SEQ ID NO: 5288 - DNA, 16 bp, Artificial Sequence
  synthetic [barcode part1]
acacacgatcaaccgt

SEQ ID NO: 5289 - DNA, 16 bp, Artificial Sequence
  synthetic [barcode part1]
acacacaacgtacgtc

SEQ ID NO: 5290 - DNA, 16 bp, Artificial Sequence
  synthetic [barcode part1]
tccgtgcgacctagtt

SEQ ID NO: 5291 - DNA, 16 bp, Artificial Sequence
  synthetic [barcode part1]
taatcctcggttgcgc

SEQ ID NO: 5292 - DNA, 16 bp, Artificial Sequence
  synthetic [barcode part1]
agtatcacgtggcact

SEQ ID NO: 5293 - DNA, 16 bp, Artificial Sequence
  synthetic [barcode part1]
tatcttgaacactcgc

SEQ ID NO: 5294 - DNA, 16 bp, Artificial Sequence
  synthetic [barcode part1]
tgttgacaaccagaag

SEQ ID NO: 5295 - DNA, 16 bp, Artificial Sequence
  synthetic [barcode part1]
tgcgaagtaacgaccg

SEQ ID NO: 5296 - DNA, 16 bp, Artificial Sequence
  synthetic [barcode part1]
tggcagagtgaacctg

SEQ ID NO: 5297 - DNA, 16 bp, Artificial Sequence
  synthetic [barcode part1]
tgagtacgtcaagaac

SEQ ID NO: 5298 - DNA, 16 bp, Artificial Sequence
  synthetic [barcode part1]
ccactctagagtaacg

SEQ ID NO: 5299 - DNA, 16 bp, Artificial Sequence
  synthetic [barcode part1]
tgtctattactgtggc

SEQ ID NO: 5300 - DNA, 16 bp, Artificial Sequence
  synthetic [barcode part1]
ccgtgagaatagtggc

SEQ ID NO: 5301 - DNA, 16 bp, Artificial Sequence
  synthetic [barcode part1]
attcggattgcgagtc

SEQ ID NO: 5302 - DNA, 16 bp, Artificial Sequence
  synthetic [barcode part1]
tactgtccggagagtt

SEQ ID NO: 5303 - DNA, 16 bp, Artificial Sequence
  synthetic [barcode part1]
acggactctcctaatt

SEQ ID NO: 5304 - DNA, 16 bp, Artificial Sequence
  synthetic [barcode part1]
cgagattgttacggtc

SEQ ID NO: 5305 - DNA, 16 bp, Artificial Sequence
  synthetic [barcode part1]
actgcctggataacac

SEQ ID NO: 5306 - DNA, 16 bp, Artificial Sequence
  synthetic [barcode part1]
gccggacactcttact

SEQ ID NO: 5307 - DNA, 16 bp, Artificial Sequence
  synthetic [barcode part1]
gaaggattgccgacgt

SEQ ID NO: 5308 - DNA, 16 bp, Artificial Sequence
  synthetic [barcode part1]
ccaattcggatactct

SEQ ID NO: 5309 - DNA, 16 bp, Artificial Sequence
  synthetic [barcode part1]
aggaacgcagagatac

SEQ ID NO: 5310 - DNA, 16 bp, Artificial Sequence
  synthetic [barcode part1]
tgtgaacgtagacctc

SEQ ID NO: 5311 - DNA, 16 bp, Artificial Sequence
  synthetic [barcode part1]
agtctagagtccaacc

SEQ ID NO: 5312 - DNA, 16 bp, Artificial Sequence
  synthetic [barcode part1]
tgtagtgtgccgtaac

SEQ ID NO: 5313 - DNA, 16 bp, Artificial Sequence
  synthetic [barcode part1]
gccagtgataaggcac

SEQ ID NO: 5314 - DNA, 16 bp, Artificial Sequence
  synthetic [barcode part1]
accgaacgtccttatt

SEQ ID NO: 5315 - DNA, 16 bp, Artificial Sequence
  synthetic [barcode part1]
atcagacacgaggacc

SEQ ID NO: 5316 - DNA, 16 bp, Artificial Sequence
  synthetic [barcode part1]
acaacctatccttacg

SEQ ID NO: 5317 - DNA, 16 bp, Artificial Sequence
  synthetic [barcode part1]
tcgcgtcgtgaagatt

SEQ ID NO: 5318 - DNA, 16 bp, Artificial Sequence
  synthetic [barcode part1]
tcgttaggtattcctg

SEQ ID NO: 5319 - DNA, 16 bp, Artificial Sequence
  synthetic [barcode part1]
cgccaacttaattctg

SEQ ID NO: 5320 - DNA, 16 bp, Artificial Sequence
  synthetic [barcode part1]
gccaataacgactacc

SEQ ID NO: 5321 - DNA, 16 bp, Artificial Sequence
  synthetic [barcode part1]
gtaaccagtaccgatc

SEQ ID NO: 5322 - DNA, 16 bp, Artificial Sequence
  synthetic [barcode part1]
tcgtgccaacggtctt

SEQ ID NO: 5323 - DNA, 16 bp, Artificial Sequence
  synthetic [barcode part1]
cagtgatagagatacc

SEQ ID NO: 5324 - DNA, 16 bp, Artificial Sequence
  synthetic [barcode part1]
atagtgtcggccagtt

SEQ ID NO: 5325 - DNA, 16 bp, Artificial Sequence
  synthetic [barcode part1]
atcgtcaatcgagtcg

SEQ ID NO: 5326 - DNA, 16 bp, Artificial Sequence
  synthetic [barcode part1]
tacgtgtgtgtcacag

SEQ ID NO: 5327 - DNA, 16 bp, Artificial Sequence
  synthetic [barcode part1]
tctcaacggccacact

SEQ ID NO: 5328 - DNA, 16 bp, Artificial Sequence
  synthetic [barcode part1]
tatcggatcactggac

SEQ ID NO: 5329 - DNA, 16 bp, Artificial Sequence
  synthetic [barcode part1]
cgttagaatagtccgc

SEQ ID NO: 5330 - DNA, 16 bp, Artificial Sequence
  synthetic [barcode part1]
caacctccacaatcgc

SEQ ID NO: 5331 - DNA, 16 bp, Artificial Sequence
  synthetic [barcode part1]
actctcgaggtcactc

SEQ ID NO: 5332 - DNA, 16 bp, Artificial Sequence
  synthetic [barcode part1]
accgtgacgaacaggt

SEQ ID NO: 5333 - DNA, 16 bp, Artificial Sequence
  synthetic [barcode part1]
cgtggcggaacgaatt

SEQ ID NO: 5334 - DNA, 16 bp, Artificial Sequence
  synthetic [barcode part1]
ccagaactggaacctt

SEQ ID NO: 5335 - DNA, 16 bp, Artificial Sequence
  synthetic [barcode part1]
gtcgaagatcaatacg

SEQ ID NO: 5336 - DNA, 16 bp, Artificial Sequence
  synthetic [barcode part1]
cggtagaactcgtgag

SEQ ID NO: 5337 - DNA, 16 bp, Artificial Sequence
  synthetic [barcode part1]
agatcactgaagacac

SEQ ID NO: 5338 - DNA, 16 bp, Artificial Sequence
  synthetic [barcode part1]
gacgattaccgttgac

SEQ ID NO: 5339 - DNA, 16 bp, Artificial Sequence
  synthetic [barcode part1]
gagttcaaggtgttcc

SEQ ID NO: 5340 - DNA, 16 bp, Artificial Sequence
  synthetic [barcode part1]
gaacgtgtaacagttg

SEQ ID NO: 5341 - DNA, 16 bp, Artificial Sequence
  synthetic [barcode part1]
cactaccaagtcgaac

SEQ ID NO: 5342 - DNA, 16 bp, Artificial Sequence
  synthetic [barcode part1]
caactctggtcaaggt

SEQ ID NO: 5343 - DNA, 16 bp, Artificial Sequence
  synthetic [barcode part1]
ccgttcgtaagatctt

SEQ ID NO: 5344 - DNA, 16 bp, Artificial Sequence
  synthetic [barcode part1]
taccttagagtgacgc

SEQ ID NO: 5345 - DNA, 16 bp, Artificial Sequence
  synthetic [barcode part1]
tatctggtggcaggag

SEQ ID NO: 5346 - DNA, 16 bp, Artificial Sequence
  synthetic [barcode part1]
gttctgcaatacactc

SEQ ID NO: 5347 - DNA, 16 bp, Artificial Sequence
  synthetic [barcode part1]
actctgagatcggttg

SEQ ID NO: 5348 - DNA, 16 bp, Artificial Sequence
  synthetic [barcode part1]
ttcgattcacgcaatc

SEQ ID NO: 5349 - DNA, 16 bp, Artificial Sequence
  synthetic [barcode part1]
tagttatcgagaggtg

SEQ ID NO: 5350 - DNA, 16 bp, Artificial Sequence
  synthetic [barcode part1]
tagacaccagtagaac

SEQ ID NO: 5351 - DNA, 16 bp, Artificial Sequence
  synthetic [barcode part1]
ttcggattggacctag

SEQ ID NO: 5352 - DNA, 16 bp, Artificial Sequence
  synthetic [barcode part1]
gagtgcagacttgacg

SEQ ID NO: 5353 - DNA, 16 bp, Artificial Sequence
  synthetic [barcode part1]
gatagtagaattcgcg

SEQ ID NO: 5354 - DNA, 16 bp, Artificial Sequence
  synthetic [barcode part1]
gacggaatcctgttac

SEQ ID NO: 5355 - DNA, 16 bp, Artificial Sequence
  synthetic [barcode part1]
ccagttcgtaactgcc

SEQ ID NO: 5356 - DNA, 16 bp, Artificial Sequence
  synthetic [barcode part1]
ttgttgcgaatccgtt

SEQ ID NO: 5357 - DNA, 16 bp, Artificial Sequence
  synthetic [barcode part1]
gtcgtaactactcgcc

SEQ ID NO: 5358 - DNA, 16 bp, Artificial Sequence
  synthetic [barcode part1]
gagtgacactgagaag

SEQ ID NO: 5359 - DNA, 16 bp, Artificial Sequence
  synthetic [barcode part1]
tggagttataccgcac

SEQ ID NO: 5360 - DNA, 16 bp, Artificial Sequence
  synthetic [barcode part1]
taccagtgtactggtg

SEQ ID NO: 5361 - DNA, 16 bp, Artificial Sequence
  synthetic [barcode part1]
taacttccgacacgcc

SEQ ID NO: 5362 - DNA, 16 bp, Artificial Sequence
  synthetic [barcode part1]
gtaatcgacgttggtc

SEQ ID NO: 5363 - DNA, 16 bp, Artificial Sequence
  synthetic [barcode part1]
ccttgatcgtgtcggt

SEQ ID NO: 5364 - DNA, 16 bp, Artificial Sequence
  synthetic [barcode part1]
atccttataggtcacc

SEQ ID NO: 5365 - DNA, 16 bp, Artificial Sequence
  synthetic [barcode part1]
acgtcgaattagaggt

SEQ ID NO: 5366 - DNA, 16 bp, Artificial Sequence
  synthetic [barcode part1]
tcaacgaggcgtagac

SEQ ID NO: 5367 - DNA, 16 bp, Artificial Sequence
  synthetic [barcode part1]
tgatcgtctacgcaag

SEQ ID NO: 5368 - DNA, 16 bp, Artificial Sequence
  synthetic [barcode part1]
gtgtgcgtaaccaatc

SEQ ID NO: 5369 - DNA, 16 bp, Artificial Sequence
  synthetic [barcode part1]
cgtaactctctgttag

SEQ ID NO: 5370 - DNA, 16 bp, Artificial Sequence
  synthetic [barcode part1]
gaggcagtaagacagt

SEQ ID NO: 5371 - DNA, 16 bp, Artificial Sequence
  synthetic [barcode part1]
ttaggtggatagaacc

SEQ ID NO: 5372 - DNA, 16 bp, Artificial Sequence
  synthetic [barcode part1]
acaattgccgatctct

SEQ ID NO: 5373 - DNA, 16 bp, Artificial Sequence
  synthetic [barcode part1]
tcggtccttacgcagt

SEQ ID NO: 5374 - DNA, 16 bp, Artificial Sequence
  synthetic [barcode part1]
aatcggcaattccggt

SEQ ID NO: 5375 - DNA, 16 bp, Artificial Sequence
  synthetic [barcode part1]
gataaccaagaacacc

SEQ ID NO: 5376 - DNA, 16 bp, Artificial Sequence
  synthetic [barcode part1]
tagttcctggcgcgtt

SEQ ID NO: 5377 - DNA, 16 bp, Artificial Sequence
  synthetic [barcode part1]
cgtgtgacgaatctgt

SEQ ID NO: 5378 - DNA, 16 bp, Artificial Sequence
  synthetic [barcode part1]
tgattcctctctcggt

SEQ ID NO: 5379 - DNA, 16 bp, Artificial Sequence
  synthetic [barcode part1]
gtggacctgataggac

SEQ ID NO: 5380 - DNA, 16 bp, Artificial Sequence
  synthetic [barcode part1]
tctacgttaatccggt

SEQ ID NO: 5381 - DNA, 16 bp, Artificial Sequence
  synthetic [barcode part1]
agatatccaaggtggt

SEQ ID NO: 5382 - DNA, 16 bp, Artificial Sequence
  synthetic [barcode part1]
cggatcagattcgact

SEQ ID NO: 5383 - DNA, 16 bp, Artificial Sequence
  synthetic [barcode part1]
agtctgagactactgc

SEQ ID NO: 5384 - DNA, 16 bp, Artificial Sequence
  synthetic [barcode part1]
gcgtagactacacttg

SEQ ID NO: 5385 - DNA, 16 bp, Artificial Sequence
  synthetic [barcode part1]
cacgagaatacctctg

SEQ ID NO: 5386 - DNA, 16 bp, Artificial Sequence
  synthetic [barcode part1]
acctccgaacgactct

SEQ ID NO: 5387 - DNA, 16 bp, Artificial Sequence
  synthetic [barcode part1]
tgcactaggtcttccg

SEQ ID NO: 5388 - DNA, 16 bp, Artificial Sequence
  synthetic [barcode part1]
tgcaactcacgttgag

SEQ ID NO: 5389 - DNA, 16 bp, Artificial Sequence
  synthetic [barcode part1]
acaactgttggtcttc

SEQ ID NO: 5390 - DNA, 16 bp, Artificial Sequence
  synthetic [barcode part1]
ataccgaagagtagtc

SEQ ID NO: 5391 - DNA, 16 bp, Artificial Sequence
  synthetic [barcode part1]
gtgatcaaccgtgtac

SEQ ID NO: 5392 - DNA, 16 bp, Artificial Sequence
  synthetic [barcode part1]
tactgaccagtgtgtg

SEQ ID NO: 5393 - DNA, 16 bp, Artificial Sequence
  synthetic [barcode part1]
aggtcgtcgagttgtt

SEQ ID NO: 5394 - DNA, 16 bp, Artificial Sequence
  synthetic [barcode part1]
gcctgtgactgagaag

SEQ ID NO: 5395 - DNA, 16 bp, Artificial Sequence
  synthetic [barcode part1]
cacaagtctacttcac

SEQ ID NO: 5396 - DNA, 16 bp, Artificial Sequence
  synthetic [barcode part1]
tcggttacggtatcag

SEQ ID NO: 5397 - DNA, 16 bp, Artificial Sequence
  synthetic [barcode part1]
tgagactgactctgac

SEQ ID NO: 5398 - DNA, 16 bp, Artificial Sequence
  synthetic [barcode part1]
atagaccaccgtcctc

SEQ ID NO: 5399 - DNA, 16 bp, Artificial Sequence
  synthetic [barcode part1]
ccagtatccttagttg

SEQ ID NO: 5400 - DNA, 16 bp, Artificial Sequence
  synthetic [barcode part1]
caacgttcgcctactg

SEQ ID NO: 5401 - DNA, 16 bp, Artificial Sequence
  synthetic [barcode part1]
aggtagaggtgccact

SEQ ID NO: 5402 - DNA, 16 bp, Artificial Sequence
  synthetic [barcode part1]
gtatcttaccaggttc

SEQ ID NO: 5403 - DNA, 16 bp, Artificial Sequence
  synthetic [barcode part1]
atagtcgaaggagttc

SEQ ID NO: 5404 - DNA, 16 bp, Artificial Sequence
  synthetic [barcode part1]
tctagagagttctggc

SEQ ID NO: 5405 - DNA, 16 bp, Artificial Sequence
  synthetic [barcode part1]
gacagaatcaggtact

SEQ ID NO: 5406 - DNA, 16 bp, Artificial Sequence
  synthetic [barcode part1]
agttgaacgccttacg

SEQ ID NO: 5407 - DNA, 16 bp, Artificial Sequence
  synthetic [barcode part1]
ttcgccttatctgtcg

SEQ ID NO: 5408 - DNA, 16 bp, Artificial Sequence
  synthetic [barcode part1]
tccactgactgttctc

SEQ ID NO: 5409 - DNA, 16 bp, Artificial Sequence
  synthetic [barcode part1]
ttggatacactgcctt

SEQ ID NO: 5410 - DNA, 16 bp, Artificial Sequence
  synthetic [barcode part1]
gttattctcgcagatc

SEQ ID NO: 5411 - DNA, 16 bp, Artificial Sequence
  synthetic [barcode part1]
aggcaggcaggatctt

SEQ ID NO: 5412 - DNA, 16 bp, Artificial Sequence
  synthetic [barcode part1]
tctaccgtaacctctc

SEQ ID NO: 5413 - DNA, 16 bp, Artificial Sequence
  synthetic [barcode part1]
aagtctgaggccagac

SEQ ID NO: 5414 - DNA, 16 bp, Artificial Sequence
  synthetic [barcode part1]
tcttgtgcaacaacct

SEQ ID NO: 5415 - DNA, 16 bp, Artificial Sequence
  synthetic [barcode part1]
ttcgtcgtcctatcac

SEQ ID NO: 5416 - DNA, 16 bp, Artificial Sequence
  synthetic [barcode part1]
ttaccagtggcctaag

SEQ ID NO: 5417 - DNA, 16 bp, Artificial Sequence
  synthetic [barcode part1]
cgttactaacgacggt

SEQ ID NO: 5418 - DNA, 16 bp, Artificial Sequence
  synthetic [barcode part1]
gactcttggcctacgt

SEQ ID NO: 5419 - DNA, 16 bp, Artificial Sequence
  synthetic [barcode part1]
cacacaagaatcgaac

SEQ ID NO: 5420 - DNA, 16 bp, Artificial Sequence
  synthetic [barcode part1]
gagacacgatcaccag

SEQ ID NO: 5421 - DNA, 16 bp, Artificial Sequence
  synthetic [barcode part1]
tcgttcgaagtcctgc

SEQ ID NO: 5422 - DNA, 16 bp, Artificial Sequence
  synthetic [barcode part1]
ttccagtaacctgtgt

SEQ ID NO: 5423 - DNA, 16 bp, Artificial Sequence
  synthetic [barcode part1]
gtcgataatcctctac

SEQ ID NO: 5424 - DNA, 16 bp, Artificial Sequence
  synthetic [barcode part1]
aacgttgcaactggtc

SEQ ID NO: 5425 - DNA, 16 bp, Artificial Sequence
  synthetic [barcode part1]
gtgacttatcttcacg

SEQ ID NO: 5426 - DNA, 16 bp, Artificial Sequence
  synthetic [barcode part1]
cgagttatacagagac

SEQ ID NO: 5427 - DNA, 16 bp, Artificial Sequence
  synthetic [barcode part1]
tgaactctgtcgtccg

SEQ ID NO: 5428 - DNA, 16 bp, Artificial Sequence
  synthetic [barcode part1]
tcttcggaactcttcc

SEQ ID NO: 5429 - DNA, 16 bp, Artificial Sequence
  synthetic [barcode part1]
agttcagacgtcctcc

SEQ ID NO: 5430 - DNA, 16 bp, Artificial Sequence
  synthetic [barcode part1]
tcggagtcaagtaagt

SEQ ID NO: 5431 - DNA, 16 bp, Artificial Sequence
  synthetic [barcode part1]
gttaacggcaattgcc

SEQ ID NO: 5432 - DNA, 16 bp, Artificial Sequence
  synthetic [barcode part1]
tcggcctcttacgagt

SEQ ID NO: 5433 - DNA, 16 bp, Artificial Sequence
  synthetic [barcode part1]
agtctaccggaataag

SEQ ID NO: 5434 - DNA, 16 bp, Artificial Sequence
  synthetic [barcode part1]
tattcaagaagtggcg

SEQ ID NO: 5435 - DNA, 16 bp, Artificial Sequence
  synthetic [barcode part1]
tctccgattccaatcc

SEQ ID NO: 5436 - DNA, 16 bp, Artificial Sequence
  synthetic [barcode part1]
gtaatcctcaccagag

SEQ ID NO: 5437 - DNA, 16 bp, Artificial Sequence
  synthetic [barcode part1]
aacgtgcaatcaaggt

SEQ ID NO: 5438 - DNA, 16 bp, Artificial Sequence
  synthetic [barcode part1]
aacgttggaggaagac

SEQ ID NO: 5439 - DNA, 16 bp, Artificial Sequence
  synthetic [barcode part1]
aggtatattggaccag

SEQ ID NO: 5440 - DNA, 16 bp, Artificial Sequence
  synthetic [barcode part1]
tgtaggtgtaggttcc

SEQ ID NO: 5441 - DNA, 16 bp, Artificial Sequence
  synthetic [barcode part1]
cactcgccttacttgt

SEQ ID NO: 5442 - DNA, 16 bp, Artificial Sequence
  synthetic [barcode part1]
acgaatcttccactac

SEQ ID NO: 5443 - DNA, 16 bp, Artificial Sequence
  synthetic [barcode part1]
acctggacaaggcagt

SEQ ID NO: 5444 - DNA, 16 bp, Artificial Sequence
  synthetic [barcode part1]
tctaggtggcgacaag

SEQ ID NO: 5445 - DNA, 16 bp, Artificial Sequence
  synthetic [barcode part1]
actctgactaggatcg

SEQ ID NO: 5446 - DNA, 16 bp, Artificial Sequence
  synthetic [barcode part1]
agtgttccactggtag

SEQ ID NO: 5447 - DNA, 16 bp, Artificial Sequence
  synthetic [barcode part1]
aggcctagatacacct

SEQ ID NO: 5448 - DNA, 16 bp, Artificial Sequence
  synthetic [barcode part1]
gcaactgcgtacgatt

SEQ ID NO: 5449 - DNA, 16 bp, Artificial Sequence
  synthetic [barcode part1]
agagtcttctgttcac

SEQ ID NO: 5450 - DNA, 16 bp, Artificial Sequence
  synthetic [barcode part1]
attcggaactctatcc

SEQ ID NO: 5451 - DNA, 16 bp, Artificial Sequence
  synthetic [barcode part1]
caccttagtgacgagt

SEQ ID NO: 5452 - DNA, 16 bp, Artificial Sequence
  synthetic [barcode part1]
taccgtacacacgtag

SEQ ID NO: 5453 - DNA, 16 bp, Artificial Sequence
  synthetic [barcode part1]
gtgttccgtataggac

SEQ ID NO: 5454 - DNA, 16 bp, Artificial Sequence
  synthetic [barcode part1]
cagacgcagagtagtc

SEQ ID NO: 5455 - DNA, 16 bp, Artificial Sequence
  synthetic [barcode part1]
gatcggagacgataag

SEQ ID NO: 5456 - DNA, 16 bp, Artificial Sequence
  synthetic [barcode part1]
tgccggtgttaatacg

SEQ ID NO: 5457 - DNA, 16 bp, Artificial Sequence
  synthetic [barcode part1]
gaggtacggagtatag

SEQ ID NO: 5458 - DNA, 16 bp, Artificial Sequence
  synthetic [barcode part1]
agtgaccgcgttcctt

SEQ ID NO: 5459 - DNA, 16 bp, Artificial Sequence
  synthetic [barcode part1]
tcgaagttaagtggac

SEQ ID NO: 5460 - DNA, 16 bp, Artificial Sequence
  synthetic [barcode part1]
gtaggtcgcacaatct

SEQ ID NO: 5461 - DNA, 16 bp, Artificial Sequence
  synthetic [barcode part1]
tagtggtacgtagaac

SEQ ID NO: 5462 - DNA, 16 bp, Artificial Sequence
  synthetic [barcode part1]
gaatctggtctggatc

SEQ ID NO: 5463 - DNA, 16 bp, Artificial Sequence
  synthetic [barcode part1]
cggtggtaattcaacc

SEQ ID NO: 5464 - DNA, 16 bp, Artificial Sequence
  synthetic [barcode part1]
tgcctgcggtattatt

SEQ ID NO: 5465 - DNA, 16 bp, Artificial Sequence
  synthetic [barcode part1]
atctccgtggattatc

SEQ ID NO: 5466 - DNA, 16 bp, Artificial Sequence
  synthetic [barcode part1]
tgtctcagttctgcct

SEQ ID NO: 5467 - DNA, 16 bp, Artificial Sequence
  synthetic [barcode part1]
gcgattggaagttagt

SEQ ID NO: 5468 - DNA, 16 bp, Artificial Sequence
  synthetic [barcode part1]
gtctaaggatatccgc

SEQ ID NO: 5469 - DNA, 16 bp, Artificial Sequence
  synthetic [barcode part1]
agaggaaggtcttgag

SEQ ID NO: 5470 - DNA, 16 bp, Artificial Sequence
  synthetic [barcode part1]
gactgactgactgact

SEQ ID NO: 5471 - DNA, 16 bp, Artificial Sequence
  synthetic [barcode part1]
ttgataactcgcactc

SEQ ID NO: 5472 - DNA, 16 bp, Artificial Sequence
  synthetic [barcode part1]
cgtggaaggtcgttag

SEQ ID NO: 5473 - DNA, 16 bp, Artificial Sequence
  synthetic [barcode part1]
tcacgaactcgactcc

SEQ ID NO: 5474 - DNA, 16 bp, Artificial Sequence
  synthetic [barcode part1]
ccttggtgtacctgac

SEQ ID NO: 5475 - DNA, 16 bp, Artificial Sequence
  synthetic [barcode part1]
tataccttcgtcgaac

SEQ ID NO: 5476 - DNA, 16 bp, Artificial Sequence
  synthetic [barcode part1]
gaccagtgtgttgtgt

SEQ ID NO: 5477 - DNA, 16 bp, Artificial Sequence
  synthetic [barcode part1]
agtgcaggttcttgtg

SEQ ID NO: 5478 - DNA, 16 bp, Artificial Sequence
  synthetic [barcode part1]
cctcgttatcctactg

SEQ ID NO: 5479 - DNA, 16 bp, Artificial Sequence
  synthetic [barcode part1]
attcgacaccgttgag

SEQ ID NO: 5480 - DNA, 16 bp, Artificial Sequence
  synthetic [barcode part1]
gcacgtagatcagtct

SEQ ID NO: 5481 - DNA, 16 bp, Artificial Sequence
  synthetic [barcode part1]
gtaatcaggtctcctt

SEQ ID NO: 5482 - DNA, 16 bp, Artificial Sequence
  synthetic [barcode part1]
tgtcaccacgattgcc

SEQ ID NO: 5483 - DNA, 16 bp, Artificial Sequence
  synthetic [barcode part1]
cgtaggcctcactatc

SEQ ID NO: 5484 - DNA, 16 bp, Artificial Sequence
  synthetic [barcode part1]
tcagaacacttgttcc

SEQ ID NO: 5485 - DNA, 16 bp, Artificial Sequence
  synthetic [barcode part1]
taccgtaatcgtggtg

SEQ ID NO: 5486 - DNA, 16 bp, Artificial Sequence
  synthetic [barcode part1]
ttgaacgtaggcactc

SEQ ID NO: 5487 - DNA, 16 bp, Artificial Sequence
  synthetic [barcode part1]
cacagtacctaagacc

SEQ ID NO: 5488 - DNA, 16 bp, Artificial Sequence
  synthetic [barcode part1]
caggccttgttacctg

SEQ ID NO: 5489 - DNA, 16 bp, Artificial Sequence
  synthetic [barcode part1]
tgacacggtatctggt

SEQ ID NO: 5490 - DNA, 16 bp, Artificial Sequence
  synthetic [barcode part1]
gtgtgagatctctgtg

SEQ ID NO: 5491 - DNA, 16 bp, Artificial Sequence
  synthetic [barcode part1]
ttagaaggagacgacg

SEQ ID NO: 5492 - DNA, 16 bp, Artificial Sequence
  synthetic [barcode part1]
gagtattgtctcgtct

SEQ ID NO: 5493 - DNA, 16 bp, Artificial Sequence
  synthetic [barcode part1]
aacactgtgtggtacc

SEQ ID NO: 5494 - DNA, 16 bp, Artificial Sequence
  synthetic [barcode part1]
tcaactgtggtaccag

SEQ ID NO: 5495 - DNA, 16 bp, Artificial Sequence
  synthetic [barcode part1]
tctcggtagagattgc

SEQ ID NO: 5496 - DNA, 16 bp, Artificial Sequence
  synthetic [barcode part1]
gcgttagtcaacacgt

SEQ ID NO: 5497 - DNA, 16 bp, Artificial Sequence
  synthetic [barcode part1]
aggaagtaggcgcctt

SEQ ID NO: 5498 - DNA, 16 bp, Artificial Sequence
  synthetic [barcode part1]
caactcacttgtgccg

SEQ ID NO: 5499 - DNA, 16 bp, Artificial Sequence
  synthetic [barcode part1]
taggtcttgtctggag

SEQ ID NO: 5500 - DNA, 16 bp, Artificial Sequence
  synthetic [barcode part1]
tataagtacctcgtcc

SEQ ID NO: 5501 - DNA, 16 bp, Artificial Sequence
  synthetic [barcode part1]
gttaacaggtggcggt

SEQ ID NO: 5502 - DNA, 16 bp, Artificial Sequence
  synthetic [barcode part1]
caatcagagtcggttc

SEQ ID NO: 5503 - DNA, 16 bp, Artificial Sequence
  synthetic [barcode part1]
cagtactccacaacag

SEQ ID NO: 5504 - DNA, 16 bp, Artificial Sequence
  synthetic [barcode part1]
gtgtaggatctgatag

SEQ ID NO: 5505 - DNA, 16 bp, Artificial Sequence
  synthetic [barcode part1]
gccaagtggtgtaggt

SEQ ID NO: 5506 - DNA, 16 bp, Artificial Sequence
  synthetic [barcode part1]
cgaagaggttatacac

SEQ ID NO: 5507 - DNA, 16 bp, Artificial Sequence
  synthetic [barcode part1]
ttgattctgcctcgtc

SEQ ID NO: 5508 - DNA, 16 bp, Artificial Sequence
  synthetic [barcode part1]
gattcggaggagtatt

SEQ ID NO: 5509 - DNA, 16 bp, Artificial Sequence
  synthetic [barcode part1]
tgtagacgaacctgtc

SEQ ID NO: 5510 - DNA, 16 bp, Artificial Sequence
  synthetic [barcode part1]
cgttgtcttcgattcc

SEQ ID NO: 5511 - DNA, 16 bp, Artificial Sequence
  synthetic [barcode part1]
cctctgaacgtaccac

SEQ ID NO: 5512 - DNA, 16 bp, Artificial Sequence
  synthetic [barcode part1]
gtagaagacgcctctt

SEQ ID NO: 5513 - DNA, 16 bp, Artificial Sequence
  synthetic [barcode part1]
tgcggtacaaggttct

SEQ ID NO: 5514 - DNA, 16 bp, Artificial Sequence
  synthetic [barcode part1]
caatcagtcagttggc

SEQ ID NO: 5515 - DNA, 16 bp, Artificial Sequence
  synthetic [barcode part1]
ttcgcaataggacaag

SEQ ID NO: 5516 - DNA, 16 bp, Artificial Sequence
  synthetic [barcode part1]
cggaacaataggacag

SEQ ID NO: 5517 - DNA, 16 bp, Artificial Sequence
  synthetic [barcode part1]
acctcaatctcgagag

SEQ ID NO: 5518 - DNA, 16 bp, Artificial Sequence
  synthetic [barcode part1]
gactggtgtacacgtt

SEQ ID NO: 5519 - DNA, 16 bp, Artificial Sequence
  synthetic [barcode part1]
cggacactgacaagac

SEQ ID NO: 5520 - DNA, 16 bp, Artificial Sequence
  synthetic [barcode part1]
acggttgatcgtgtgt

SEQ ID NO: 5521 - DNA, 16 bp, Artificial Sequence
  synthetic [barcode part1]
ttatcaattccgtgcg

SEQ ID NO: 5522 - DNA, 16 bp, Artificial Sequence
  synthetic [barcode part1]
tcgccgtattccactt

SEQ ID NO: 5523 - DNA, 16 bp, Artificial Sequence
  synthetic [barcode part1]
gacaggtcagagttcg

SEQ ID NO: 5524 - DNA, 16 bp, Artificial Sequence
  synthetic [barcode part1]
cggactgtcttacacc

SEQ ID NO: 5525 - DNA, 16 bp, Artificial Sequence
  synthetic [barcode part1]
ataccgacttctggcc

SEQ ID NO: 5526 - DNA, 16 bp, Artificial Sequence
  synthetic [barcode part1]
gtccgttctcaaggtc

SEQ ID NO: 5527 - DNA, 16 bp, Artificial Sequence
  synthetic [barcode part1]
gccttctgttggtgtg

SEQ ID NO: 5528 - DNA, 16 bp, Artificial Sequence
  synthetic [barcode part1]
ttggaactatcgcgac

SEQ ID NO: 5529 - DNA, 16 bp, Artificial Sequence
  synthetic [barcode part1]
caattcggtctccgtg

SEQ ID NO: 5530 - DNA, 16 bp, Artificial Sequence
  synthetic [barcode part1]
cctaattctccgatcc

SEQ ID NO: 5531 - DNA, 16 bp, Artificial Sequence
  synthetic [barcode part1]
aagaacactcacgtcc

SEQ ID NO: 5532 - DNA, 16 bp, Artificial Sequence
  synthetic [barcode part1]
gacaccgtaacactac

SEQ ID NO: 5533 - DNA, 16 bp, Artificial Sequence
  synthetic [barcode part1]
gataccggttagtcgt

SEQ ID NO: 5534 - DNA, 16 bp, Artificial Sequence
  synthetic [barcode part1]
agaccgttaggtcact

SEQ ID NO: 5535 - DNA, 16 bp, Artificial Sequence
  synthetic [barcode part1]
ttcggttgtactgact

SEQ ID NO: 5536 - DNA, 16 bp, Artificial Sequence
  synthetic [barcode part1]
ttgacacctgattctg

SEQ ID NO: 5537 - DNA, 16 bp, Artificial Sequence
  synthetic [barcode part1]
atcttcacagactacc

SEQ ID NO: 5538 - DNA, 16 bp, Artificial Sequence
  synthetic [barcode part1]
tacacaattgcgcggt

SEQ ID NO: 5539 - DNA, 16 bp, Artificial Sequence
  synthetic [barcode part1]
caccactgaatattcc

SEQ ID NO: 5540 - DNA, 16 bp, Artificial Sequence
  synthetic [barcode part1]
atcgccggttgttaag

SEQ ID NO: 5541 - DNA, 16 bp, Artificial Sequence
  synthetic [barcode part1]
gtattccgcacttcct

SEQ ID NO: 5542 - DNA, 16 bp, Artificial Sequence
  synthetic [barcode part1]
gtcgagacggtatacg

SEQ ID NO: 5543 - DNA, 16 bp, Artificial Sequence
  synthetic [barcode part1]
gaatattccgcggatc

SEQ ID NO: 5544 - DNA, 16 bp, Artificial Sequence
  synthetic [barcode part1]
tgtctgacacaagtcg

SEQ ID NO: 5545 - DNA, 16 bp, Artificial Sequence
  synthetic [barcode part1]
cggatataccaagaac

SEQ ID NO: 5546 - DNA, 16 bp, Artificial Sequence
  synthetic [barcode part1]
gattcctctaacgtgt

SEQ ID NO: 5547 - DNA, 16 bp, Artificial Sequence
  synthetic [barcode part1]
gtatattgtggtcgcg

SEQ ID NO: 5548 - DNA, 16 bp, Artificial Sequence
  synthetic [barcode part1]
accttgaccgattgag

SEQ ID NO: 5549 - DNA, 16 bp, Artificial Sequence
  synthetic [barcode part1]
agtggactctgagacg

SEQ ID NO: 5550 - DNA, 16 bp, Artificial Sequence
  synthetic [barcode part1]
ttccaagttactcacg

SEQ ID NO: 5551 - DNA, 16 bp, Artificial Sequence
  synthetic [barcode part1]
gcctggaacagtagac

SEQ ID NO: 5552 - DNA, 16 bp, Artificial Sequence
  synthetic [barcode part1]
atccaggttcgccgtt

SEQ ID NO: 5553 - DNA, 16 bp, Artificial Sequence
  synthetic [barcode part1]
cgtaccggtatatcag

SEQ ID NO: 5554 - DNA, 16 bp, Artificial Sequence
  synthetic [barcode part1]
tagtgaccgcgtcttc

SEQ ID NO: 5555 - DNA, 16 bp, Artificial Sequence
  synthetic [barcode part1]
gatagatcggaattcg

SEQ ID NO: 5556 - DNA, 16 bp, Artificial Sequence
  synthetic [barcode part1]
agtgcgtcggtatact

SEQ ID NO: 5557 - DNA, 16 bp, Artificial Sequence
  synthetic [barcode part1]
ccaatccggtgtactc

SEQ ID NO: 5558 - DNA, 16 bp, Artificial Sequence
  synthetic [barcode part1]
tcagtgtcgatcgtag

SEQ ID NO: 5559 - DNA, 16 bp, Artificial Sequence
  synthetic [barcode part1]
gtaatccgaatcgtcg

SEQ ID NO: 5560 - DNA, 16 bp, Artificial Sequence
  synthetic [barcode part1]
atcaaccgttgtggtg

SEQ ID NO: 5561 - DNA, 16 bp, Artificial Sequence
  synthetic [barcode part1]
tacttactggaactcc

SEQ ID NO: 5562 - DNA, 16 bp, Artificial Sequence
  synthetic [barcode part1]
attaggaccaggagag

SEQ ID NO: 5563 - DNA, 16 bp, Artificial Sequence
  synthetic [barcode part1]
cgtgattctggatacg

SEQ ID NO: 5564 - DNA, 16 bp, Artificial Sequence
  synthetic [barcode part1]
attcctaatccagtgc

SEQ ID NO: 5565 - DNA, 16 bp, Artificial Sequence
  synthetic [barcode part1]
attaggcgcagttcac

SEQ ID NO: 5566 - DNA, 16 bp, Artificial Sequence
  synthetic [barcode part1]
gactagtactagtcgc

SEQ ID NO: 5567 - DNA, 16 bp, Artificial Sequence
  synthetic [barcode part1]
tccgcagtgaatactg

SEQ ID NO: 5568 - DNA, 16 bp, Artificial Sequence
  synthetic [barcode part1]
cacgtcgagttgagag

SEQ ID NO: 5569 - DNA, 16 bp, Artificial Sequence
  synthetic [barcode part1]
tataagtacctgcggc

SEQ ID NO: 5570 - DNA, 16 bp, Artificial Sequence
  synthetic [barcode part1]
gagtgagtatcacggc

SEQ ID NO: 5571 - DNA, 16 bp, Artificial Sequence
  synthetic [barcode part1]
gcggtgtactgattac

SEQ ID NO: 5572 - DNA, 16 bp, Artificial Sequence
  synthetic [barcode part1]
cgcgttgtcttggttg

SEQ ID NO: 5573 - DNA, 16 bp, Artificial Sequence
  synthetic [barcode part1]
atctcgtaccttccgt

SEQ ID NO: 5574 - DNA, 16 bp, Artificial Sequence
  synthetic [barcode part1]
acggtgtctgactagt

SEQ ID NO: 5575 - DNA, 16 bp, Artificial Sequence
  synthetic [barcode part1]
cacgtcgaacttctcg

SEQ ID NO: 5576 - DNA, 16 bp, Artificial Sequence
  synthetic [barcode part1]
ataggtccttccggtc

SEQ ID NO: 5577 - DNA, 16 bp, Artificial Sequence
  synthetic [barcode part1]
tcacagaagactgaac

SEQ ID NO: 5578 - DNA, 16 bp, Artificial Sequence
  synthetic [barcode part1]
cgacaacagaagtact

SEQ ID NO: 5579 - DNA, 16 bp, Artificial Sequence
  synthetic [barcode part1]
ttccgtgagagatacc

SEQ ID NO: 5580 - DNA, 16 bp, Artificial Sequence
  synthetic [barcode part1]
aactgtaaggaccagt

SEQ ID NO: 5581 - DNA, 16 bp, Artificial Sequence
  synthetic [barcode part1]
tccgattgtgccggtt

SEQ ID NO: 5582 - DNA, 16 bp, Artificial Sequence
  synthetic [barcode part1]
gatagtatcgtgaacg

SEQ ID NO: 5583 - DNA, 16 bp, Artificial Sequence
  synthetic [barcode part1]
ttgcgtaatcgcacag

SEQ ID NO: 5584 - DNA, 16 bp, Artificial Sequence
  synthetic [barcode part1]
agtgactcgcgagaac

SEQ ID NO: 5585 - DNA, 16 bp, Artificial Sequence
  synthetic [barcode part1]
acttggagtaggtctc

SEQ ID NO: 5586 - DNA, 16 bp, Artificial Sequence
  synthetic [barcode part1]
acaatccttgcgtccg

SEQ ID NO: 5587 - DNA, 16 bp, Artificial Sequence
  synthetic [barcode part1]
tgagacggatacgtcg

SEQ ID NO: 5588 - DNA, 16 bp, Artificial Sequence
  synthetic [barcode part1]
tacgcgatcactatct

SEQ ID NO: 5589 - DNA, 16 bp, Artificial Sequence
  synthetic [barcode part1]
aggcgagtagaatctt

SEQ ID NO: 5590 - DNA, 16 bp, Artificial Sequence
  synthetic [barcode part1]
gatagattaaggcctg

SEQ ID NO: 5591 - DNA, 16 bp, Artificial Sequence
  synthetic [barcode part1]
cacttagtgcgagttg

SEQ ID NO: 5592 - DNA, 16 bp, Artificial Sequence
  synthetic [barcode part1]
agagagataactggcg

SEQ ID NO: 5593 - DNA, 16 bp, Artificial Sequence
  synthetic [barcode part1]
aaccgccacaagagtg

SEQ ID NO: 5594 - DNA, 16 bp, Artificial Sequence
  synthetic [barcode part1]
tacgtgagacaacaac

SEQ ID NO: 5595 - DNA, 16 bp, Artificial Sequence
  synthetic [barcode part1]
aatacgcaactgagac

SEQ ID NO: 5596 - DNA, 16 bp, Artificial Sequence
  synthetic [barcode part1]
ttacctgtcgcctact

SEQ ID NO: 5597 - DNA, 16 bp, Artificial Sequence
  synthetic [barcode part1]
aagtcacgaatacgac

SEQ ID NO: 5598 - DNA, 16 bp, Artificial Sequence
  synthetic [barcode part1]
agtgagacttccggtt

SEQ ID NO: 5599 - DNA, 16 bp, Artificial Sequence
  synthetic [barcode part1]
tcagagtattccggac

SEQ ID NO: 5600 - DNA, 16 bp, Artificial Sequence
  synthetic [barcode part1]
tgagtctactcacgag

SEQ ID NO: 5601 - DNA, 16 bp, Artificial Sequence
  synthetic [barcode part1]
tgttaggatctgacgc

SEQ ID NO: 5602 - DNA, 16 bp, Artificial Sequence
  synthetic [barcode part1]
gatacacttctgactc

SEQ ID NO: 5603 - DNA, 16 bp, Artificial Sequence
  synthetic [barcode part1]
gacgtatctggtctcc

SEQ ID NO: 5604 - DNA, 16 bp, Artificial Sequence
  synthetic [barcode part1]
tggtcttaccagtgtt

SEQ ID NO: 5605 - DNA, 16 bp, Artificial Sequence
  synthetic [barcode part1]
gtggttgtaatcgcgt

SEQ ID NO: 5606 - DNA, 16 bp, Artificial Sequence
  synthetic [barcode part1]
tgtgttgccaatcttg

SEQ ID NO: 5607 - DNA, 16 bp, Artificial Sequence
  synthetic [barcode part1]
tcaggtgtgtccaagt

SEQ ID NO: 5608 - DNA, 16 bp, Artificial Sequence
  synthetic [barcode part1]
ttacggatctgacttc

SEQ ID NO: 5609 - DNA, 16 bp, Artificial Sequence
  synthetic [barcode part1]
atctcacagtacgtct

SEQ ID NO: 5610 - DNA, 16 bp, Artificial Sequence
  synthetic [barcode part1]
cgcaggtagacttatc

SEQ ID NO: 5611 - DNA, 16 bp, Artificial Sequence
  synthetic [barcode part1]
cgtactacggttgtag

SEQ ID NO: 5612 - DNA, 16 bp, Artificial Sequence
  synthetic [barcode part1]
tagtgtgacacgatcc

SEQ ID NO: 5613 - DNA, 16 bp, Artificial Sequence
  synthetic [barcode part1]
actagtggtcctccac

SEQ ID NO: 5614 - DNA, 16 bp, Artificial Sequence
  synthetic [barcode part1]
aacttggacacaagac

SEQ ID NO: 5615 - DNA, 16 bp, Artificial Sequence
  synthetic [barcode part1]
tagttcctcctggtct

SEQ ID NO: 5616 - DNA, 16 bp, Artificial Sequence
  synthetic [barcode part1]
gcaattgttgatctcc

SEQ ID NO: 5617 - DNA, 16 bp, Artificial Sequence
  synthetic [barcode part1]
cacgttcgttcggtac

SEQ ID NO: 5618 - DNA, 16 bp, Artificial Sequence
  synthetic [barcode part1]
caagtcggtcgttagt

SEQ ID NO: 5619 - DNA, 16 bp, Artificial Sequence
  synthetic [barcode part1]
cgcgttgttaacctcg

SEQ ID NO: 5620 - DNA, 16 bp, Artificial Sequence
  synthetic [barcode part1]
agagtaactgtagacc

SEQ ID NO: 5621 - DNA, 16 bp, Artificial Sequence
  synthetic [barcode part1]
gcgtcaataacctctt

SEQ ID NO: 5622 - DNA, 16 bp, Artificial Sequence
  synthetic [barcode part1]
gactctcaactgtgcc

SEQ ID NO: 5623 - DNA, 16 bp, Artificial Sequence
  synthetic [barcode part1]
cgccttggaatccact

SEQ ID NO: 5624 - DNA, 16 bp, Artificial Sequence
  synthetic [barcode part1]
aacgaattcacggtag

SEQ ID NO: 5625 - DNA, 16 bp, Artificial Sequence
  synthetic [barcode part1]
taattctgccgtgtgt

SEQ ID NO: 5626 - DNA, 16 bp, Artificial Sequence
  synthetic [barcode part1]
aagaacgcgtcagatt

SEQ ID NO: 5627 - DNA, 16 bp, Artificial Sequence
  synthetic [barcode part1]
cgtatcagacctcctg

SEQ ID NO: 5628 - DNA, 16 bp, Artificial Sequence
  synthetic [barcode part1]
atctgtgtcaggtacg

SEQ ID NO: 5629 - DNA, 16 bp, Artificial Sequence
  synthetic [barcode part1]
gttgagtagacgtggc

SEQ ID NO: 5630 - DNA, 16 bp, Artificial Sequence
  synthetic [barcode part1]
tagaattgcgcgtgtc

SEQ ID NO: 5631 - DNA, 16 bp, Artificial Sequence
  synthetic [barcode part1]
ttgtacgaaccaagag

SEQ ID NO: 5632 - DNA, 16 bp, Artificial Sequence
  synthetic [barcode part1]
tcaatccgtctgagtt

SEQ ID NO: 5633 - DNA, 16 bp, Artificial Sequence
  synthetic [barcode part1]
tccaagttcactactg

SEQ ID NO: 5634 - DNA, 16 bp, Artificial Sequence
  synthetic [barcode part1]
atatcggaggacaatc

SEQ ID NO: 5635 - DNA, 16 bp, Artificial Sequence
  synthetic [barcode part1]
tcggtaactgtcgaac

SEQ ID NO: 5636 - DNA, 16 bp, Artificial Sequence
  synthetic [barcode part1]
agataggacagtgtct

SEQ ID NO: 5637 - DNA, 16 bp, Artificial Sequence
  synthetic [barcode part1]
acaggtgtctggaacg

SEQ ID NO: 5638 - DNA, 16 bp, Artificial Sequence
  synthetic [barcode part1]
tgtgtaggagtgtctc

SEQ ID NO: 5639 - DNA, 16 bp, Artificial Sequence
  synthetic [barcode part1]
gataatccggtctggt

SEQ ID NO: 5640 - DNA, 16 bp, Artificial Sequence
  synthetic [barcode part1]
tactcacggtgttgtt

SEQ ID NO: 5641 - DNA, 16 bp, Artificial Sequence
  synthetic [barcode part1]
gacgcgtaactaggac

SEQ ID NO: 5642 - DNA, 16 bp, Artificial Sequence
  synthetic [barcode part1]
aacacgcctggtcctt

SEQ ID NO: 5643 - DNA, 16 bp, Artificial Sequence
  synthetic [barcode part1]
acggttgcctcgactt

SEQ ID NO: 5644 - DNA, 16 bp, Artificial Sequence
  synthetic [barcode part1]
atcacactggttcttg

SEQ ID NO: 5645 - DNA, 16 bp, Artificial Sequence
  synthetic [barcode part1]
cgatcaaggtcttgac

SEQ ID NO: 5646 - DNA, 16 bp, Artificial Sequence
  synthetic [barcode part1]
acggttgttaagaggt

SEQ ID NO: 5647 - DNA, 16 bp, Artificial Sequence
  synthetic [barcode part1]
aagttcaacgagacgt

SEQ ID NO: 5648 - DNA, 16 bp, Artificial Sequence
  synthetic [barcode part1]
cacttgaatacggtcg

SEQ ID NO: 5649 - DNA, 16 bp, Artificial Sequence
  synthetic [barcode part1]
gtctgaactgttctac

SEQ ID NO: 5650 - DNA, 16 bp, Artificial Sequence
  synthetic [barcode part1]
tcaatagaggccacct

SEQ ID NO: 5651 - DNA, 16 bp, Artificial Sequence
  synthetic [barcode part1]
gatacggttgcacttg

SEQ ID NO: 5652 - DNA, 16 bp, Artificial Sequence
  synthetic [barcode part1]
acttcacgcgattgtt

SEQ ID NO: 5653 - DNA, 16 bp, Artificial Sequence
  synthetic [barcode part1]
ttcgaacacttctcag

SEQ ID NO: 5654 - DNA, 16 bp, Artificial Sequence
  synthetic [barcode part1]
gccagtatcacgtagt

SEQ ID NO: 5655 - DNA, 16 bp, Artificial Sequence
  synthetic [barcode part1]
acgttagaccgaaggc

SEQ ID NO: 5656 - DNA, 16 bp, Artificial Sequence
  synthetic [barcode part1]
cgattcctacacaatc

SEQ ID NO: 5657 - DNA, 16 bp, Artificial Sequence
  synthetic [barcode part1]
ttgcactggaccacct

SEQ ID NO: 5658 - DNA, 16 bp, Artificial Sequence
  synthetic [barcode part1]
aggtcgaaccacacag

SEQ ID NO: 5659 - DNA, 16 bp, Artificial Sequence
  synthetic [barcode part1]
aacacgttggtgtgtc

SEQ ID NO: 5660 - DNA, 16 bp, Artificial Sequence
  synthetic [barcode part1]
gtacctcactgttggc

SEQ ID NO: 5661 - DNA, 16 bp, Artificial Sequence
  synthetic [barcode part1]
gtcaggcagatacgac

SEQ ID NO: 5662 - DNA, 16 bp, Artificial Sequence
  synthetic [barcode part1]
taggcaccgacctctt

SEQ ID NO: 5663 - DNA, 16 bp, Artificial Sequence
  synthetic [barcode part1]
cagtgaggagtagtag

SEQ ID NO: 5664 - DNA, 16 bp, Artificial Sequence
  synthetic [barcode part1]
aggatctccgtgatac

SEQ ID NO: 5665 - DNA, 16 bp, Artificial Sequence
  synthetic [barcode part1]
tgccaatcgtgtaacg

SEQ ID NO: 5666 - DNA, 16 bp, Artificial Sequence
  synthetic [barcode part1]
tcttagtcgcaagttc

SEQ ID NO: 5667 - DNA, 16 bp, Artificial Sequence
  synthetic [barcode part1]
gattacgaattcctcc

SEQ ID NO: 5668 - DNA, 16 bp, Artificial Sequence
  synthetic [barcode part1]
gatctgtataggtccg

SEQ ID NO: 5669 - DNA, 16 bp, Artificial Sequence
  synthetic [barcode part1]
atcgatatcgtgcggt

SEQ ID NO: 5670 - DNA, 16 bp, Artificial Sequence
  synthetic [barcode part1]
ttgttcaccacctgtc

SEQ ID NO: 5671 - DNA, 16 bp, Artificial Sequence
  synthetic [barcode part1]
tgtgtcacagtcacag

SEQ ID NO: 5672 - DNA, 16 bp, Artificial Sequence
  synthetic [barcode part1]
ttgtggtgtacgtgtg

SEQ ID NO: 5673 - DNA, 16 bp, Artificial Sequence
  synthetic [barcode part1]
atagagaactaggtcc

SEQ ID NO: 5674 - DNA, 16 bp, Artificial Sequence
  synthetic [barcode part1]
cctgtgtagtctaatc

SEQ ID NO: 5675 - DNA, 16 bp, Artificial Sequence
  synthetic [barcode part1]
cggtcactaaggaacg

SEQ ID NO: 5676 - DNA, 16 bp, Artificial Sequence
  synthetic [barcode part1]
gcaccttaacttagtc

SEQ ID NO: 5677 - DNA, 16 bp, Artificial Sequence
  synthetic [barcode part1]
ttagtgactgcgtctt

SEQ ID NO: 5678 - DNA, 16 bp, Artificial Sequence
  synthetic [barcode part1]
tccttgcctaccagag

SEQ ID NO: 5679 - DNA, 16 bp, Artificial Sequence
  synthetic [barcode part1]
cgccgcgtaatattag

SEQ ID NO: 5680 - DNA, 16 bp, Artificial Sequence
  synthetic [barcode part1]
tcggaaccagataagt

SEQ ID NO: 5681 - DNA, 16 bp, Artificial Sequence
  synthetic [barcode part1]
cactctagtagatcct

SEQ ID NO: 5682 - DNA, 16 bp, Artificial Sequence
  synthetic [barcode part1]
cgagaagtgattacac

SEQ ID NO: 5683 - DNA, 16 bp, Artificial Sequence
  synthetic [barcode part1]
gaagatacaggttacc

SEQ ID NO: 5684 - DNA, 16 bp, Artificial Sequence
  synthetic [barcode part1]
aatacacctccggcct

SEQ ID NO: 5685 - DNA, 16 bp, Artificial Sequence
  synthetic [barcode part1]
tatactatcggaggag

SEQ ID NO: 5686 - DNA, 16 bp, Artificial Sequence
  synthetic [barcode part1]
tctcgtattggtgact

SEQ ID NO: 5687 - DNA, 16 bp, Artificial Sequence
  synthetic [barcode part1]
ttgcgttacggcctgt

SEQ ID NO: 5688 - DNA, 16 bp, Artificial Sequence
  synthetic [barcode part1]
cgttagtcttcagttg

SEQ ID NO: 5689 - DNA, 16 bp, Artificial Sequence
  synthetic [barcode part1]
gtctaccagtaggtac

SEQ ID NO: 5690 - DNA, 16 bp, Artificial Sequence
  synthetic [barcode part1]
caatcgagtcaactgc

SEQ ID NO: 5691 - DNA, 16 bp, Artificial Sequence
  synthetic [barcode part1]
aggtggttgtgtcgag

SEQ ID NO: 5692 - DNA, 16 bp, Artificial Sequence
  synthetic [barcode part1]
gcgtggcgattaaggt

SEQ ID NO: 5693 - DNA, 16 bp, Artificial Sequence
  synthetic [barcode part1]
tattagtgaccaggag

SEQ ID NO: 5694 - DNA, 16 bp, Artificial Sequence
  synthetic [barcode part1]
ttcctcgaggttgaag

SEQ ID NO: 5695 - DNA, 16 bp, Artificial Sequence
  synthetic [barcode part1]
ccgagaacacaagtcg

SEQ ID NO: 5696 - DNA, 16 bp, Artificial Sequence
  synthetic [barcode part1]
tgtggattatcgttcc

SEQ ID NO: 5697 - DNA, 16 bp, Artificial Sequence
  synthetic [barcode part1]
gacttgtcagacactg

SEQ ID NO: 5698 - DNA, 16 bp, Artificial Sequence
  synthetic [barcode part1]
cacacaagtcttccgc

SEQ ID NO: 5699 - DNA, 16 bp, Artificial Sequence
  synthetic [barcode part1]
ttggtacagtctcttg

SEQ ID NO: 5700 - DNA, 16 bp, Artificial Sequence
  synthetic [barcode part1]
cgaccggattaatcgt

SEQ ID NO: 5701 - DNA, 16 bp, Artificial Sequence
  synthetic [barcode part1]
ccacttgatagtatcc

SEQ ID NO: 5702 - DNA, 16 bp, Artificial Sequence
  synthetic [barcode part1]
agtactctagagagtg

SEQ ID NO: 5703 - DNA, 16 bp, Artificial Sequence
  synthetic [barcode part1]
cctgtctaacaggtag

SEQ ID NO: 5704 - DNA, 16 bp, Artificial Sequence
  synthetic [barcode part1]
tggccacaataacaag

SEQ ID NO: 5705 - DNA, 16 bp, Artificial Sequence
  synthetic [barcode part1]
agactgcggattgtct

SEQ ID NO: 5706 - DNA, 16 bp, Artificial Sequence
  synthetic [barcode part1]
gcgagtctacgaattc

SEQ ID NO: 5707 - DNA, 16 bp, Artificial Sequence
  synthetic [barcode part1]
gttgtccaatatctgc

SEQ ID NO: 5708 - DNA, 16 bp, Artificial Sequence
  synthetic [barcode part1]
ccgacgtgttgtatag

SEQ ID NO: 5709 - DNA, 16 bp, Artificial Sequence
  synthetic [barcode part1]
aacacgcaatctcctt

SEQ ID NO: 5710 - DNA, 16 bp, Artificial Sequence
  synthetic [barcode part1]
accggtgtcgttactc

SEQ ID NO: 5711 - DNA, 16 bp, Artificial Sequence
  synthetic [barcode part1]
ccttaacacgcaatct

SEQ ID NO: 5712 - DNA, 16 bp, Artificial Sequence
  synthetic [barcode part1]
ttggacagtccgtaac

SEQ ID NO: 5713 - DNA, 16 bp, Artificial Sequence
  synthetic [barcode part1]
gaggttctaagtaggt

SEQ ID NO: 5714 - DNA, 16 bp, Artificial Sequence
  synthetic [barcode part1]
agtcttcctggtgcgt

SEQ ID NO: 5715 - DNA, 16 bp, Artificial Sequence
  synthetic [barcode part1]
tcacagttgtggtgtg

SEQ ID NO: 5716 - DNA, 16 bp, Artificial Sequence
  synthetic [barcode part1]
caacacaactgaagac

SEQ ID NO: 5717 - DNA, 16 bp, Artificial Sequence
  synthetic [barcode part1]
tggtctaagtgactcg

SEQ ID NO: 5718 - DNA, 16 bp, Artificial Sequence
  synthetic [barcode part1]
tagacctgcgaatctg

SEQ ID NO: 5719 - DNA, 16 bp, Artificial Sequence
  synthetic [barcode part1]
atcgcaatctacttgc

SEQ ID NO: 5720 - DNA, 16 bp, Artificial Sequence
  synthetic [barcode part1]
actcaaggtgagttcc

SEQ ID NO: 5721 - DNA, 16 bp, Artificial Sequence
  synthetic [barcode part1]
taacgtggccagagac

SEQ ID NO: 5722 - DNA, 16 bp, Artificial Sequence
  synthetic [barcode part1]
gtctcaactggaactg

SEQ ID NO: 5723 - DNA, 16 bp, Artificial Sequence
  synthetic [barcode part1]
attaggaaccggcgtg

SEQ ID NO: 5724 - DNA, 16 bp, Artificial Sequence
  synthetic [barcode part1]
ataccttcaatctggc

SEQ ID NO: 5725 - DNA, 16 bp, Artificial Sequence
  synthetic [barcode part1]
gccaagtatccaacgt

SEQ ID NO: 5726 - DNA, 16 bp, Artificial Sequence
  synthetic [barcode part1]
tgacgcagttattcct

SEQ ID NO: 5727 - DNA, 16 bp, Artificial Sequence
  synthetic [barcode part1]
taattacctcgacctg

SEQ ID NO: 5728 - DNA, 16 bp, Artificial Sequence
  synthetic [barcode part1]
tctgtaccggcgactt

SEQ ID NO: 5729 - DNA, 16 bp, Artificial Sequence
  synthetic [barcode part1]
aagattggcacaactg

SEQ ID NO: 5730 - DNA, 16 bp, Artificial Sequence
  synthetic [barcode part1]
gccagaagtcacacag

SEQ ID NO: 5731 - DNA, 16 bp, Artificial Sequence
  synthetic [barcode part1]
cgcaagtacaataggt

SEQ ID NO: 5732 - DNA, 16 bp, Artificial Sequence
  synthetic [barcode part1]
acgttacgacaagtag

SEQ ID NO: 5733 - DNA, 16 bp, Artificial Sequence
  synthetic [barcode part1]
aggtgttaggttcgtc

SEQ ID NO: 5734 - DNA, 16 bp, Artificial Sequence
  synthetic [barcode part1]
tcacgagtcactactt

SEQ ID NO: 5735 - DNA, 16 bp, Artificial Sequence
  synthetic [barcode part1]
tcgtctgcctattcac

SEQ ID NO: 5736 - DNA, 16 bp, Artificial Sequence
  synthetic [barcode part1]
tacgtctaggccgtct

SEQ ID NO: 5737 - DNA, 16 bp, Artificial Sequence
  synthetic [barcode part1]
ttacgtcgacacaggt

SEQ ID NO: 5738 - DNA, 16 bp, Artificial Sequence
  synthetic [barcode part1]
gagttggacgtcagtg

SEQ ID NO: 5739 - DNA, 16 bp, Artificial Sequence
  synthetic [barcode part1]
ttaatacgtcggcgtg

SEQ ID NO: 5740 - DNA, 16 bp, Artificial Sequence
  synthetic [barcode part1]
cctgtcgatacaactt

SEQ ID NO: 5741 - DNA, 16 bp, Artificial Sequence
  synthetic [barcode part1]
gtcgccaatacttccg

SEQ ID NO: 5742 - DNA, 16 bp, Artificial Sequence
  synthetic [barcode part1]
caggattgtatcgtgc

SEQ ID NO: 5743 - DNA, 16 bp, Artificial Sequence
  synthetic [barcode part1]
caatcactgtcggtag

SEQ ID NO: 5744 - DNA, 16 bp, Artificial Sequence
  synthetic [barcode part1]
acgaaggtagttcaac

SEQ ID NO: 5745 - DNA, 16 bp, Artificial Sequence
  synthetic [barcode part1]
gacactaattgaccgc

SEQ ID NO: 5746 - DNA, 16 bp, Artificial Sequence
  synthetic [barcode part1]
cagacagtatcacaag

SEQ ID NO: 5747 - DNA, 16 bp, Artificial Sequence
  synthetic [barcode part1]
tgagacgtctgacttg

SEQ ID NO: 5748 - DNA, 16 bp, Artificial Sequence
  synthetic [barcode part1]
tcctataaccactgac

SEQ ID NO: 5749 - DNA, 16 bp, Artificial Sequence
  synthetic [barcode part1]
tctagaaggttggcct

SEQ ID NO: 5750 - DNA, 16 bp, Artificial Sequence
  synthetic [barcode part1]
agactaatagtcgcag

SEQ ID NO: 5751 - DNA, 16 bp, Artificial Sequence
  synthetic [barcode part1]
tggtcctatacaccgc

SEQ ID NO: 5752 - DNA, 16 bp, Artificial Sequence
  synthetic [barcode part1]
ccagaacttcaggact

SEQ ID NO: 5753 - DNA, 16 bp, Artificial Sequence
  synthetic [barcode part1]
tgttgccaggttgaac

SEQ ID NO: 5754 - DNA, 16 bp, Artificial Sequence
  synthetic [barcode part1]
gacgaactgccacaag

SEQ ID NO: 5755 - DNA, 16 bp, Artificial Sequence
  synthetic [barcode part1]
acacggcactgatatc

SEQ ID NO: 5756 - DNA, 16 bp, Artificial Sequence
  synthetic [barcode part1]
tcacacctatcggacc

SEQ ID NO: 5757 - DNA, 16 bp, Artificial Sequence
  synthetic [barcode part1]
atacagagaaccgccg

SEQ ID NO: 5758 - DNA, 16 bp, Artificial Sequence
  synthetic [barcode part1]
cacggactaaggcaac

SEQ ID NO: 5759 - DNA, 16 bp, Artificial Sequence
  synthetic [barcode part1]
cgttagaactcttgtc

SEQ ID NO: 5760 - DNA, 16 bp, Artificial Sequence
  synthetic [barcode part1]
aacagtccgatagtcc

SEQ ID NO: 5761 - DNA, 16 bp, Artificial Sequence
  synthetic [barcode part1]
acctcgcgtgactgtt

SEQ ID NO: 5762 - DNA, 16 bp, Artificial Sequence
  synthetic [barcode part1]
acagttctcgtgtccg

SEQ ID NO: 5763 - DNA, 16 bp, Artificial Sequence
  synthetic [barcode part1]
cggacactcttactgc

SEQ ID NO: 5764 - DNA, 16 bp, Artificial Sequence
  synthetic [barcode part1]
taactatcgtctcgtg

SEQ ID NO: 5765 - DNA, 16 bp, Artificial Sequence
  synthetic [barcode part1]
aggttcgtctgatctt

SEQ ID NO: 5766 - DNA, 16 bp, Artificial Sequence
  synthetic [barcode part1]
gcagtgtgtcacaact

SEQ ID NO: 5767 - DNA, 16 bp, Artificial Sequence
  synthetic [barcode part1]
ataggaaggtctagtc

SEQ ID NO: 5768 - DNA, 16 bp, Artificial Sequence
  synthetic [barcode part1]
cacttaggaagtggcg

SEQ ID NO: 5769 - DNA, 16 bp, Artificial Sequence
  synthetic [barcode part1]
cgaatcacggtaactc

SEQ ID NO: 5770 - DNA, 16 bp, Artificial Sequence
  synthetic [barcode part1]
ttatcgccaaggtggt

SEQ ID NO: 5771 - DNA, 16 bp, Artificial Sequence
  synthetic [barcode part1]
agtagatacctgcctg

SEQ ID NO: 5772 - DNA, 16 bp, Artificial Sequence
  synthetic [barcode part1]
cgattcctagttgcgc

SEQ ID NO: 5773 - DNA, 16 bp, Artificial Sequence
  synthetic [barcode part1]
tggtcaacacgtacac

SEQ ID NO: 5774 - DNA, 16 bp, Artificial Sequence
  synthetic [barcode part1]
agactcttggcgttag

SEQ ID NO: 5775 - DNA, 16 bp, Artificial Sequence
  synthetic [barcode part1]
tcacaacagtcaaccg

SEQ ID NO: 5776 - DNA, 16 bp, Artificial Sequence
  synthetic [barcode part1]
atagtcaggttctcct

SEQ ID NO: 5777 - DNA, 16 bp, Artificial Sequence
  synthetic [barcode part1]
gagtcacggcaattct

SEQ ID NO: 5778 - DNA, 16 bp, Artificial Sequence
  synthetic [barcode part1]
tactgtctcgtgtagt

SEQ ID NO: 5779 - DNA, 16 bp, Artificial Sequence
  synthetic [barcode part1]
ttctactgtccgcgag

SEQ ID NO: 5780 - DNA, 16 bp, Artificial Sequence
  synthetic [barcode part1]
tgagtactgacagaac

SEQ ID NO: 5781 - DNA, 16 bp, Artificial Sequence
  synthetic [barcode part1]
gtagaataagtccgtg

SEQ ID NO: 5782 - DNA, 16 bp, Artificial Sequence
  synthetic [barcode part1]
atactctgtcgagttc

SEQ ID NO: 5783 - DNA, 16 bp, Artificial Sequence
  synthetic [barcode part1]
aaccacgaatctcctt

SEQ ID NO: 5784 - DNA, 16 bp, Artificial Sequence
  synthetic [barcode part1]
gagaacacaggttgtt

SEQ ID NO: 5785 - DNA, 16 bp, Artificial Sequence
  synthetic [barcode part1]
tgtggataggtgatac

SEQ ID NO: 5786 - DNA, 16 bp, Artificial Sequence
  synthetic [barcode part1]
atatagtcttcctggc

SEQ ID NO: 5787 - DNA, 16 bp, Artificial Sequence
  synthetic [barcode part1]
tatcctgacttcgcct

SEQ ID NO: 5788 - DNA, 16 bp, Artificial Sequence
  synthetic [barcode part1]
aacttgcacctcgtcg

SEQ ID NO: 5789 - DNA, 16 bp, Artificial Sequence
  synthetic [barcode part1]
gattggcgttagtcgt

SEQ ID NO: 5790 - DNA, 16 bp, Artificial Sequence
  synthetic [barcode part1]
aatcaccacgaggacg

SEQ ID NO: 5791 - DNA, 16 bp, Artificial Sequence
  synthetic [barcode part1]
ttctagtcttcgtcgc

SEQ ID NO: 5792 - DNA, 16 bp, Artificial Sequence
  synthetic [barcode part1]
gttgatcgtcacagtg

SEQ ID NO: 5793 - DNA, 16 bp, Artificial Sequence
  synthetic [barcode part1]
agttccactcaaggtg

SEQ ID NO: 5794 - DNA, 16 bp, Artificial Sequence
  synthetic [barcode part1]
cgaattcctcgagtag

SEQ ID NO: 5795 - DNA, 16 bp, Artificial Sequence
  synthetic [barcode part1]
gatatagtagaccacg

SEQ ID NO: 5796 - DNA, 16 bp, Artificial Sequence
  synthetic [barcode part1]
tccacgtatcgaattc

SEQ ID NO: 5797 - DNA, 16 bp, Artificial Sequence
  synthetic [barcode part1]
tgaggccagtcttaac

SEQ ID NO: 5798 - DNA, 16 bp, Artificial Sequence
  synthetic [barcode part1]
gatacggatccaatag

SEQ ID NO: 5799 - DNA, 16 bp, Artificial Sequence
  synthetic [barcode part1]
tctcgcgtggtgatct

SEQ ID NO: 5800 - DNA, 16 bp, Artificial Sequence
  synthetic [barcode part1]
tcttgccttacggacg

SEQ ID NO: 5801 - DNA, 16 bp, Artificial Sequence
  synthetic [barcode part1]
tcacgcgtcgatcttg

SEQ ID NO: 5802 - DNA, 16 bp, Artificial Sequence
  synthetic [barcode part1]
actggttgttgtgacg

SEQ ID NO: 5803 - DNA, 16 bp, Artificial Sequence
  synthetic [barcode part1]
agagttccggataggc

SEQ ID NO: 5804 - DNA, 16 bp, Artificial Sequence
  synthetic [barcode part1]
tatagacgccttgtct

SEQ ID NO: 5805 - DNA, 16 bp, Artificial Sequence
  synthetic [barcode part1]
caagtgtgaggtaatc

SEQ ID NO: 5806 - DNA, 16 bp, Artificial Sequence
  synthetic [barcode part1]
agtgtgtcagtgtacc

SEQ ID NO: 5807 - DNA, 16 bp, Artificial Sequence
  synthetic [barcode part1]
gcagattaccggagac

SEQ ID NO: 5808 - DNA, 16 bp, Artificial Sequence
  synthetic [barcode part1]
tgagtcggagacgtgt

SEQ ID NO: 5809 - DNA, 16 bp, Artificial Sequence
  synthetic [barcode part1]
actctcgatcttcacc

SEQ ID NO: 5810 - DNA, 16 bp, Artificial Sequence
  synthetic [barcode part1]
cgtaggaagagtgtag

SEQ ID NO: 5811 - DNA, 16 bp, Artificial Sequence
  synthetic [barcode part1]
acgaactgattgtgcc

SEQ ID NO: 5812 - DNA, 16 bp, Artificial Sequence
  synthetic [barcode part1]
tgccgtctgagttcgt

SEQ ID NO: 5813 - DNA, 16 bp, Artificial Sequence
  synthetic [barcode part1]
tctcctgcagactcag

SEQ ID NO: 5814 - DNA, 16 bp, Artificial Sequence
  synthetic [barcode part1]
acgtgcagatcgactt

SEQ ID NO: 5815 - DNA, 16 bp, Artificial Sequence
  synthetic [barcode part1]
tgaataccgcaggtct

SEQ ID NO: 5816 - DNA, 16 bp, Artificial Sequence
  synthetic [barcode part1]
caagtaacaggatctg

SEQ ID NO: 5817 - DNA, 16 bp, Artificial Sequence
  synthetic [barcode part1]
cgatagtggtctaacc

SEQ ID NO: 5818 - DNA, 16 bp, Artificial Sequence
  synthetic [barcode part1]
gtagtctctacgcctg

SEQ ID NO: 5819 - DNA, 16 bp, Artificial Sequence
  synthetic [barcode part1]
gtataatcctcggttc

SEQ ID NO: 5820 - DNA, 16 bp, Artificial Sequence
  synthetic [barcode part1]
aagactcggtggacac

SEQ ID NO: 5821 - DNA, 16 bp, Artificial Sequence
  synthetic [barcode part1]
tgtcgaacaccaagtc

SEQ ID NO: 5822 - DNA, 16 bp, Artificial Sequence
  synthetic [barcode part1]
aacggtgtgaacaccg

SEQ ID NO: 5823 - DNA, 16 bp, Artificial Sequence
  synthetic [barcode part1]
ttgaagtcgcctatct

SEQ ID NO: 5824 - DNA, 16 bp, Artificial Sequence
  synthetic [barcode part1]
ttccttctctctctcc

SEQ ID NO: 5825 - DNA, 16 bp, Artificial Sequence
  synthetic [barcode part1]
ccactcgacgaatagt

SEQ ID NO: 5826 - DNA, 16 bp, Artificial Sequence
  synthetic [barcode part1]
tattaagtgtcctcgc

SEQ ID NO: 5827 - DNA, 16 bp, Artificial Sequence
  synthetic [barcode part1]
tcaacaagttcggcgt

SEQ ID NO: 5828 - DNA, 16 bp, Artificial Sequence
  synthetic [barcode part1]
atacgacagttgagac

SEQ ID NO: 5829 - DNA, 16 bp, Artificial Sequence
  synthetic [barcode part1]
gcgtcgtagatagacg

SEQ ID NO: 5830 - DNA, 16 bp, Artificial Sequence
  synthetic [barcode part1]
gtcgttcgacgttcac

SEQ ID NO: 5831 - DNA, 16 bp, Artificial Sequence
  synthetic [barcode part1]
tacagactccgagtac

SEQ ID NO: 5832 - DNA, 16 bp, Artificial Sequence
  synthetic [barcode part1]
atcctcgataaggacc

SEQ ID NO: 5833 - DNA, 16 bp, Artificial Sequence
  synthetic [barcode part1]
tacgcaaccaccgttc

SEQ ID NO: 5834 - DNA, 16 bp, Artificial Sequence
  synthetic [barcode part1]
acgaactagaggttac

SEQ ID NO: 5835 - DNA, 16 bp, Artificial Sequence
  synthetic [barcode part1]
acacttgtctgttacg

SEQ ID NO: 5836 - DNA, 16 bp, Artificial Sequence
  synthetic [barcode part1]
cgtcgcctagatctac

SEQ ID NO: 5837 - DNA, 16 bp, Artificial Sequence
  synthetic [barcode part1]
tgcaactaaggcgacg

SEQ ID NO: 5838 - DNA, 16 bp, Artificial Sequence
  synthetic [barcode part1]
aggtaggttacgatac

SEQ ID NO: 5839 - DNA, 16 bp, Artificial Sequence
  synthetic [barcode part1]
taacctgtggactacg

SEQ ID NO: 5840 - DNA, 16 bp, Artificial Sequence
  synthetic [barcode part1]
tgaggcactgtgcaag

SEQ ID NO: 5841 - DNA, 16 bp, Artificial Sequence
  synthetic [barcode part1]
tctctctgttacggtc

SEQ ID NO: 5842 - DNA, 16 bp, Artificial Sequence
  synthetic [barcode part1]
aaggtcctggaatcct

SEQ ID NO: 5843 - DNA, 16 bp, Artificial Sequence
  synthetic [barcode part1]
tagttcgataggaacg

SEQ ID NO: 5844 - DNA, 16 bp, Artificial Sequence
  synthetic [barcode part1]
ccaattgccttctctg

SEQ ID NO: 5845 - DNA, 16 bp, Artificial Sequence
  synthetic [barcode part1]
gtcttcgacaagagtc

SEQ ID NO: 5846 - DNA, 16 bp, Artificial Sequence
  synthetic [barcode part1]
tattgccagtgcgcct

SEQ ID NO: 5847 - DNA, 16 bp, Artificial Sequence
  synthetic [barcode part1]
gaatctcgtcgtagtg

SEQ ID NO: 5848 - DNA, 16 bp, Artificial Sequence
  synthetic [barcode part1]
atcagtgcgaattcgc

SEQ ID NO: 5849 - DNA, 16 bp, Artificial Sequence
  synthetic [barcode part1]
tcctgtggttggactc

SEQ ID NO: 5850 - DNA, 16 bp, Artificial Sequence
  synthetic [barcode part1]
gaactgtcactctcgc

SEQ ID NO: 5851 - DNA, 16 bp, Artificial Sequence
  synthetic [barcode part1]
tgcggtcaggagttag

SEQ ID NO: 5852 - DNA, 16 bp, Artificial Sequence
  synthetic [barcode part1]
tactataacacgcgcg

SEQ ID NO: 5853 - DNA, 16 bp, Artificial Sequence
  synthetic [barcode part1]
cgcggtgttatagtgt

SEQ ID NO: 5854 - DNA, 16 bp, Artificial Sequence
  synthetic [barcode part1]
atctgttcagacaggc

SEQ ID NO: 5855 - DNA, 16 bp, Artificial Sequence
  synthetic [barcode part1]
agacgtcgcctatagt

SEQ ID NO: 5856 - DNA, 16 bp, Artificial Sequence
  synthetic [barcode part1]
tactaccacggagtgt

SEQ ID NO: 5857 - DNA, 16 bp, Artificial Sequence
  synthetic [barcode part1]
aatctgaggaggtgtt

SEQ ID NO: 5858 - DNA, 16 bp, Artificial Sequence
  synthetic [barcode part1]
caggatcaccacagtt

SEQ ID NO: 5859 - DNA, 16 bp, Artificial Sequence
  synthetic [barcode part1]
agttaatcgcgtgcac

SEQ ID NO: 5860 - DNA, 16 bp, Artificial Sequence
  synthetic [barcode part1]
accttgcctacgtgac

SEQ ID NO: 5861 - DNA, 16 bp, Artificial Sequence
  synthetic [barcode part1]
tatcacgtagtgccag

SEQ ID NO: 5862 - DNA, 16 bp, Artificial Sequence
  synthetic [barcode part1]
tgaggtgtagatctag

SEQ ID NO: 5863 - DNA, 16 bp, Artificial Sequence
  synthetic [barcode part1]
tagatatcctcgccgc

SEQ ID NO: 5864 - DNA, 16 bp, Artificial Sequence
  synthetic [barcode part1]
tgtgtgtggttgactg

SEQ ID NO: 5865 - DNA, 16 bp, Artificial Sequence
  synthetic [barcode part1]
acaccagtagttctct

SEQ ID NO: 5866 - DNA, 16 bp, Artificial Sequence
  synthetic [barcode part1]
gttcacagatctgcag

SEQ ID NO: 5867 - DNA, 16 bp, Artificial Sequence
  synthetic [barcode part1]
tcactccgatcgtacg

SEQ ID NO: 5868 - DNA, 16 bp, Artificial Sequence
  synthetic [barcode part1]
taccgtctggactcac

SEQ ID NO: 5869 - DNA, 16 bp, Artificial Sequence
  synthetic [barcode part1]
acagtcttaccgaacg

SEQ ID NO: 5870 - DNA, 16 bp, Artificial Sequence
  synthetic [barcode part1]
ttccgaatccgaagtg

SEQ ID NO: 5871 - DNA, 16 bp, Artificial Sequence
  synthetic [barcode part1]
actgtgacaccacaac

SEQ ID NO: 5872 - DNA, 16 bp, Artificial Sequence
  synthetic [barcode part1]
agactgccagatcgtt

SEQ ID NO: 5873 - DNA, 16 bp, Artificial Sequence
  synthetic [barcode part1]
cactgccttcagttct

SEQ ID NO: 5874 - DNA, 16 bp, Artificial Sequence
  synthetic [barcode part1]
gaacaggtgtcgcaac

SEQ ID NO: 5875 - DNA, 16 bp, Artificial Sequence
  synthetic [barcode part1]
ccttcagaattgaggc

SEQ ID NO: 5876 - DNA, 16 bp, Artificial Sequence
  synthetic [barcode part1]
agtgtcaccaaggttc

SEQ ID NO: 5877 - DNA, 16 bp, Artificial Sequence
  synthetic [barcode part1]
gtacttgcaggataag

SEQ ID NO: 5878 - DNA, 16 bp, Artificial Sequence
  synthetic [barcode part1]
gcaatctatctccgcg

SEQ ID NO: 5879 - DNA, 16 bp, Artificial Sequence
  synthetic [barcode part1]
aggcggactacttact

SEQ ID NO: 5880 - DNA, 16 bp, Artificial Sequence
  synthetic [barcode part1]
ttcgagtctatcactg

SEQ ID NO: 5881 - DNA, 16 bp, Artificial Sequence
  synthetic [barcode part1]
gtacagtcgtagttgc

SEQ ID NO: 5882 - DNA, 16 bp, Artificial Sequence
  synthetic [barcode part1]
tctccgtaggtcgttg

SEQ ID NO: 5883 - DNA, 16 bp, Artificial Sequence
  synthetic [barcode part1]
tagaactccgaggtct

SEQ ID NO: 5884 - DNA, 16 bp, Artificial Sequence
  synthetic [barcode part1]
caacctattcgtgttg

SEQ ID NO: 5885 - DNA, 16 bp, Artificial Sequence
  synthetic [barcode part1]
tccactcgcgatatcg

SEQ ID NO: 5886 - DNA, 16 bp, Artificial Sequence
  synthetic [barcode part1]
tgcaaggactaagttg

SEQ ID NO: 5887 - DNA, 16 bp, Artificial Sequence
  synthetic [barcode part1]
tcctcgatatacagtc

SEQ ID NO: 5888 - DNA, 16 bp, Artificial Sequence
  synthetic [barcode part1]
gaggactactggtgtg

SEQ ID NO: 5889 - DNA, 16 bp, Artificial Sequence
  synthetic [barcode part1]
tactgagtactcttgc

SEQ ID NO: 5890 - DNA, 16 bp, Artificial Sequence
  synthetic [barcode part1]
caacgataccagatcc

SEQ ID NO: 5891 - DNA, 16 bp, Artificial Sequence
  synthetic [barcode part1]
aacgtcaacgtacgtc

SEQ ID NO: 5892 - DNA, 16 bp, Artificial Sequence
  synthetic [barcode part1]
cctacgttcgagtcac

SEQ ID NO: 5893 - DNA, 16 bp, Artificial Sequence
  synthetic [barcode part1]
tgacctaatagagacg

SEQ ID NO: 5894 - DNA, 16 bp, Artificial Sequence
  synthetic [barcode part1]
ttcgaaccgtcttgcg

SEQ ID NO: 5895 - DNA, 16 bp, Artificial Sequence
  synthetic [barcode part1]
caggaccgttaattgc

SEQ ID NO: 5896 - DNA, 16 bp, Artificial Sequence
  synthetic [barcode part1]
tacttcttggtggttg

SEQ ID NO: 5897 - DNA, 16 bp, Artificial Sequence
  synthetic [barcode part1]
cgttagtcggttacag

SEQ ID NO: 5898 - DNA, 16 bp, Artificial Sequence
  synthetic [barcode part1]
tgagaggaccagtgtc

SEQ ID NO: 5899 - DNA, 16 bp, Artificial Sequence
  synthetic [barcode part1]
acagagacacggaagt

SEQ ID NO: 5900 - DNA, 16 bp, Artificial Sequence
  synthetic [barcode part1]
ccaatctaacgacggt

SEQ ID NO: 5901 - DNA, 16 bp, Artificial Sequence
  synthetic [barcode part1]
cagtggatatcactcg

SEQ ID NO: 5902 - DNA, 16 bp, Artificial Sequence
  synthetic [barcode part1]
gcgatatactgcagtc

SEQ ID NO: 5903 - DNA, 16 bp, Artificial Sequence
  synthetic [barcode part1]
gatatcggtgtgtacc

SEQ ID NO: 5904 - DNA, 16 bp, Artificial Sequence
  synthetic [barcode part1]
ccgactcgataacagt

SEQ ID NO: 5905 - DNA, 16 bp, Artificial Sequence
  synthetic [barcode part1]
ttaacagtccgcactt

SEQ ID NO: 5906 - DNA, 16 bp, Artificial Sequence
  synthetic [barcode part1]
tcacaactacgcgtag

SEQ ID NO: 5907 - DNA, 16 bp, Artificial Sequence
  synthetic [barcode part1]
tacggaccactcaagt

SEQ ID NO: 5908 - DNA, 16 bp, Artificial Sequence
  synthetic [barcode part1]
gtgtgtaggtcaactc

SEQ ID NO: 5909 - DNA, 16 bp, Artificial Sequence
  synthetic [barcode part1]
tgcgttagagatcaag

SEQ ID NO: 5910 - DNA, 16 bp, Artificial Sequence
  synthetic [barcode part1]
tatcaccttgtcgcct

SEQ ID NO: 5911 - DNA, 16 bp, Artificial Sequence
  synthetic [barcode part1]
accttgtcctggtctt

SEQ ID NO: 5912 - DNA, 16 bp, Artificial Sequence
  synthetic [barcode part1]
gtgcgtcgcaagatag

SEQ ID NO: 5913 - DNA, 16 bp, Artificial Sequence
  synthetic [barcode part1]
tccgtgtaccagatcc

SEQ ID NO: 5914 - DNA, 16 bp, Artificial Sequence
  synthetic [barcode part1]
acctgcgtgattctcg

SEQ ID NO: 5915 - DNA, 16 bp, Artificial Sequence
  synthetic [barcode part1]
gcgagaactgataatc

SEQ ID NO: 5916 - DNA, 16 bp, Artificial Sequence
  synthetic [barcode part1]
tactctacttaggtgc

SEQ ID NO: 5917 - DNA, 16 bp, Artificial Sequence
  synthetic [barcode part1]
cagttctcaacacact

SEQ ID NO: 5918 - DNA, 16 bp, Artificial Sequence
  synthetic [barcode part1]
tcggtgacctgatagt

SEQ ID NO: 5919 - DNA, 16 bp, Artificial Sequence
  synthetic [barcode part1]
cgtagagtaacggtcg

SEQ ID NO: 5920 - DNA, 16 bp, Artificial Sequence
  synthetic [barcode part1]
tctgttgaacctgtgt

SEQ ID NO: 5921 - DNA, 16 bp, Artificial Sequence
  synthetic [barcode part1]
cgaacgactataacag

SEQ ID NO: 5922 - DNA, 16 bp, Artificial Sequence
  synthetic [barcode part1]
agacaatcacgaactg

SEQ ID NO: 5923 - DNA, 16 bp, Artificial Sequence
  synthetic [barcode part1]
gaagagtaacggtggt

SEQ ID NO: 5924 - DNA, 16 bp, Artificial Sequence
  synthetic [barcode part1]
cagtcggattgtaacc

SEQ ID NO: 5925 - DNA, 16 bp, Artificial Sequence
  synthetic [barcode part1]
cgtaggattagactag

SEQ ID NO: 5926 - DNA, 16 bp, Artificial Sequence
  synthetic [barcode part1]
tatctcgtggacactt

SEQ ID NO: 5927 - DNA, 16 bp, Artificial Sequence
  synthetic [barcode part1]
tacgtgattgttgtcc

SEQ ID NO: 5928 - DNA, 16 bp, Artificial Sequence
  synthetic [barcode part1]
tgtgttcctgtgtcct

SEQ ID NO: 5929 - DNA, 16 bp, Artificial Sequence
  synthetic [barcode part1]
cgcaataacttcaggc

SEQ ID NO: 5930 - DNA, 16 bp, Artificial Sequence
  synthetic [barcode part1]
acacggcgactagaac

SEQ ID NO: 5931 - DNA, 16 bp, Artificial Sequence
  synthetic [barcode part1]
tctcagtgtacggcct

SEQ ID NO: 5932 - DNA, 16 bp, Artificial Sequence
  synthetic [barcode part1]
tctatcgccggacact

SEQ ID NO: 5933 - DNA, 16 bp, Artificial Sequence
  synthetic [barcode part1]
gagactcgtctgtcct

SEQ ID NO: 5934 - DNA, 16 bp, Artificial Sequence
  synthetic [barcode part1]
gtgacagaggtgttcg

SEQ ID NO: 5935 - DNA, 16 bp, Artificial Sequence
  synthetic [barcode part1]
actccgtgcggttatc

SEQ ID NO: 5936 - DNA, 16 bp, Artificial Sequence
  synthetic [barcode part1]
cacggtataggactct

SEQ ID NO: 5937 - DNA, 16 bp, Artificial Sequence
  synthetic [barcode part1]
acgttcagtcctattg

SEQ ID NO: 5938 - DNA, 16 bp, Artificial Sequence
  synthetic [barcode part1]
gtagacgactctggag

SEQ ID NO: 5939 - DNA, 16 bp, Artificial Sequence
  synthetic [barcode part1]
agataaccggttctcg

SEQ ID NO: 5940 - DNA, 16 bp, Artificial Sequence
  synthetic [barcode part1]
gcagtcgtgatatacc

SEQ ID NO: 5941 - DNA, 16 bp, Artificial Sequence
  synthetic [barcode part1]
agttggcgcgtgtatt

SEQ ID NO: 5942 - DNA, 16 bp, Artificial Sequence
  synthetic [barcode part1]
gatctggccttcacgt

SEQ ID NO: 5943 - DNA, 16 bp, Artificial Sequence
  synthetic [barcode part1]
tgtcgatagtcagaag

SEQ ID NO: 5944 - DNA, 16 bp, Artificial Sequence
  synthetic [barcode part1]
taccacagacttcgag

SEQ ID NO: 5945 - DNA, 16 bp, Artificial Sequence
  synthetic [barcode part1]
gattgacggagaagac

SEQ ID NO: 5946 - DNA, 16 bp, Artificial Sequence
  synthetic [barcode part1]
gttgaggacaccagtg

SEQ ID NO: 5947 - DNA, 16 bp, Artificial Sequence
  synthetic [barcode part1]
actccaattggagtcg

SEQ ID NO: 5948 - DNA, 16 bp, Artificial Sequence
  synthetic [barcode part1]
tgacagtaagacgtac

SEQ ID NO: 5949 - DNA, 16 bp, Artificial Sequence
  synthetic [barcode part1]
gtagatcgtgtagtcc

SEQ ID NO: 5950 - DNA, 16 bp, Artificial Sequence
  synthetic [barcode part1]
gcgcgactgtatagtt

SEQ ID NO: 5951 - DNA, 16 bp, Artificial Sequence
  synthetic [barcode part1]
gccgttcctacgaact

SEQ ID NO: 5952 - DNA, 16 bp, Artificial Sequence
  synthetic [barcode part1]
tctcagttataccggt

SEQ ID NO: 5953 - DNA, 16 bp, Artificial Sequence
  synthetic [barcode part1]
gaactacacctggtac

SEQ ID NO: 5954 - DNA, 16 bp, Artificial Sequence
  synthetic [barcode part1]
gatactggaggttctc

SEQ ID NO: 5955 - DNA, 16 bp, Artificial Sequence
  synthetic [barcode part1]
tccgcaggtctataag

SEQ ID NO: 5956 - DNA, 16 bp, Artificial Sequence
  synthetic [barcode part1]
aggttaactgactccg

SEQ ID NO: 5957 - DNA, 16 bp, Artificial Sequence
  synthetic [barcode part1]
ttaaggacggtaggag

SEQ ID NO: 5958 - DNA, 16 bp, Artificial Sequence
  synthetic [barcode part1]
tccgttgtacgtcgac

SEQ ID NO: 5959 - DNA, 16 bp, Artificial Sequence
  synthetic [barcode part1]
aacgtctgcgagacag

SEQ ID NO: 5960 - DNA, 16 bp, Artificial Sequence
  synthetic [barcode part1]
cagttacagactgaag

SEQ ID NO: 5961 - DNA, 16 bp, Artificial Sequence
  synthetic [barcode part1]
tggtgttggtattgcg

SEQ ID NO: 5962 - DNA, 16 bp, Artificial Sequence
  synthetic [barcode part1]
gtgtggaatctctacg

SEQ ID NO: 5963 - DNA, 16 bp, Artificial Sequence
  synthetic [barcode part1]
cgatacagaaggtcgc

SEQ ID NO: 5964 - DNA, 16 bp, Artificial Sequence
  synthetic [barcode part1]
tatcgacgtatcggtg

SEQ ID NO: 5965 - DNA, 16 bp, Artificial Sequence
  synthetic [barcode part1]
agtaccgtgatcggtt

SEQ ID NO: 5966 - DNA, 16 bp, Artificial Sequence
  synthetic [barcode part1]
gaatccgaggtactct

SEQ ID NO: 5967 - DNA, 16 bp, Artificial Sequence
  synthetic [barcode part1]
taccgaacacctccac

SEQ ID NO: 5968 - DNA, 16 bp, Artificial Sequence
  synthetic [barcode part1]
tcgtagtctctggaag

SEQ ID NO: 5969 - DNA, 16 bp, Artificial Sequence
  synthetic [barcode part1]
cgacttcgtatactac

SEQ ID NO: 5970 - DNA, 16 bp, Artificial Sequence
  synthetic [barcode part1]
caggagaatacactac

SEQ ID NO: 5971 - DNA, 16 bp, Artificial Sequence
  synthetic [barcode part1]
ttattcggacgtcgcc

SEQ ID NO: 5972 - DNA, 16 bp, Artificial Sequence
  synthetic [barcode part1]
gtctgttacaggtggt

SEQ ID NO: 5973 - DNA, 16 bp, Artificial Sequence
  synthetic [barcode part1]
gtacggttcctctggt

SEQ ID NO: 5974 - DNA, 16 bp, Artificial Sequence
  synthetic [barcode part1]
tcggagtataagtggt

SEQ ID NO: 5975 - DNA, 16 bp, Artificial Sequence
  synthetic [barcode part1]
gtgatcgtgcacgatt

SEQ ID NO: 5976 - DNA, 16 bp, Artificial Sequence
  synthetic [barcode part1]
caagaatctgtcgaag

SEQ ID NO: 5977 - DNA, 16 bp, Artificial Sequence
  synthetic [barcode part1]
tggtatcaacgaacag

SEQ ID NO: 5978 - DNA, 16 bp, Artificial Sequence
  synthetic [barcode part1]
tccgactgatcaagac

SEQ ID NO: 5979 - DNA, 16 bp, Artificial Sequence
  synthetic [barcode part1]
ccggttgaaccaattg

SEQ ID NO: 5980 - DNA, 16 bp, Artificial Sequence
  synthetic [barcode part1]
agtgcacagttctctt

SEQ ID NO: 5981 - DNA, 16 bp, Artificial Sequence
  synthetic [barcode part1]
aactgacaccagtcac

SEQ ID NO: 5982 - DNA, 16 bp, Artificial Sequence
  synthetic [barcode part1]
tcaacgagtaggaatc

SEQ ID NO: 5983 - DNA, 16 bp, Artificial Sequence
  synthetic [barcode part1]
tactactatctaggcc

SEQ ID NO: 5984 - DNA, 16 bp, Artificial Sequence
  synthetic [barcode part1]
ttgttgccgttcaagt

SEQ ID NO: 5985 - DNA, 16 bp, Artificial Sequence
  synthetic [barcode part1]
tctagttattggcgtc

SEQ ID NO: 5986 - DNA, 16 bp, Artificial Sequence
  synthetic [barcode part1]
gtattggcgataagac

SEQ ID NO: 5987 - DNA, 16 bp, Artificial Sequence
  synthetic [barcode part1]
agatccaacggagtgc

SEQ ID NO: 5988 - DNA, 16 bp, Artificial Sequence
  synthetic [barcode part1]
atcgtcacgtaagaag

SEQ ID NO: 5989 - DNA, 16 bp, Artificial Sequence
  synthetic [barcode part1]
gagtacgtcgacaacg

SEQ ID NO: 5990 - DNA, 16 bp, Artificial Sequence
  synthetic [barcode part1]
gtccgtcgtagatagt

SEQ ID NO: 5991 - DNA, 16 bp, Artificial Sequence
  synthetic [barcode part1]
aagtagtctggcgcag

SEQ ID NO: 5992 - DNA, 16 bp, Artificial Sequence
  synthetic [barcode part1]
ccttaagactccagag

SEQ ID NO: 5993 - DNA, 16 bp, Artificial Sequence
  synthetic [barcode part1]
tcgaatccgacaactg

SEQ ID NO: 5994 - DNA, 16 bp, Artificial Sequence
  synthetic [barcode part1]
gcgtattctactgttg

SEQ ID NO: 5995 - DNA, 16 bp, Artificial Sequence
  synthetic [barcode part1]
ttctgcgcaatagttc

SEQ ID NO: 5996 - DNA, 16 bp, Artificial Sequence
  synthetic [barcode part1]
tctagtcgaggttggt

SEQ ID NO: 5997 - DNA, 16 bp, Artificial Sequence
  synthetic [barcode part1]
gatactgtgaccgatc

SEQ ID NO: 5998 - DNA, 16 bp, Artificial Sequence
  synthetic [barcode part1]
tgtctcaacctacagt

SEQ ID NO: 5999 - DNA, 16 bp, Artificial Sequence
  synthetic [barcode part1]
cctgtactcttacgtc

SEQ ID NO: 6000 - DNA, 16 bp, Artificial Sequence
  synthetic [barcode part1]
tagacggactctggag

SEQ ID NO: 6001 - DNA, 16 bp, Artificial Sequence
  synthetic [barcode part1]
gcacagatctataccg

SEQ ID NO: 6002 - DNA, 16 bp, Artificial Sequence
  synthetic [barcode part1]
acgaacggaacctcag

SEQ ID NO: 6003 - DNA, 16 bp, Artificial Sequence
  synthetic [barcode part1]
tacctccttggtgacg

SEQ ID NO: 6004 - DNA, 16 bp, Artificial Sequence
  synthetic [barcode part1]
acgtagtcttcctaac

SEQ ID NO: 6005 - DNA, 16 bp, Artificial Sequence
  synthetic [barcode part1]
gtattcgtccagacag

SEQ ID NO: 6006 - DNA, 16 bp, Artificial Sequence
  synthetic [barcode part1]
caacgtgccttcgact

SEQ ID NO: 6007 - DNA, 16 bp, Artificial Sequence
  synthetic [barcode part1]
cggagaacagttatac

SEQ ID NO: 6008 - DNA, 16 bp, Artificial Sequence
  synthetic [barcode part1]
ttccggtctctactac

SEQ ID NO: 6009 - DNA, 16 bp, Artificial Sequence
  synthetic [barcode part1]
gtacacacgattggtc

SEQ ID NO: 6010 - DNA, 16 bp, Artificial Sequence
  synthetic [barcode part1]
cgagaggtacgtaatt

SEQ ID NO: 6011 - DNA, 16 bp, Artificial Sequence
  synthetic [barcode part1]
cactctataggtgtct

SEQ ID NO: 6012 - DNA, 16 bp, Artificial Sequence
  synthetic [barcode part1]
gattggttggtcgatc

SEQ ID NO: 6013 - DNA, 16 bp, Artificial Sequence
  synthetic [barcode part1]
actacgttcgaacgtg

SEQ ID NO: 6014 - DNA, 16 bp, Artificial Sequence
  synthetic [barcode part1]
agagtggaagtccgtc

SEQ ID NO: 6015 - DNA, 16 bp, Artificial Sequence
  synthetic [barcode part1]
aacctgacctctgcac

SEQ ID NO: 6016 - DNA, 16 bp, Artificial Sequence
  synthetic [barcode part1]
taagttacgcacttcc

SEQ ID NO: 6017 - DNA, 16 bp, Artificial Sequence
  synthetic [barcode part1]
cgtcacggtattacag

SEQ ID NO: 6018 - DNA, 16 bp, Artificial Sequence
  synthetic [barcode part1]
cacagttcttctaacg

SEQ ID NO: 6019 - DNA, 16 bp, Artificial Sequence
  synthetic [barcode part1]
cctagaagttgcgatc

SEQ ID NO: 6020 - DNA, 16 bp, Artificial Sequence
  synthetic [barcode part1]
gtcacgacagagttct

SEQ ID NO: 6021 - DNA, 16 bp, Artificial Sequence
  synthetic [barcode part1]
tatcggaacggtctac

SEQ ID NO: 6022 - DNA, 16 bp, Artificial Sequence
  synthetic [barcode part1]
acttcgtcttgtgagt

SEQ ID NO: 6023 - DNA, 16 bp, Artificial Sequence
  synthetic [barcode part1]
gtacaacacgtcgatc

SEQ ID NO: 6024 - DNA, 16 bp, Artificial Sequence
  synthetic [barcode part1]
acgacaggtccaagtg

SEQ ID NO: 6025 - DNA, 16 bp, Artificial Sequence
  synthetic [barcode part1]
ttgcagataggtccac

SEQ ID NO: 6026 - DNA, 16 bp, Artificial Sequence
  synthetic [barcode part1]
cgtggaaccagatcag

SEQ ID NO: 6027 - DNA, 16 bp, Artificial Sequence
  synthetic [barcode part1]
aagtattgtggtaggc

SEQ ID NO: 6028 - DNA, 16 bp, Artificial Sequence
  synthetic [barcode part1]
gcctgaaggcagaact

SEQ ID NO: 6029 - DNA, 16 bp, Artificial Sequence
  synthetic [barcode part1]
cctcttgagatcgaag

SEQ ID NO: 6030 - DNA, 16 bp, Artificial Sequence
  synthetic [barcode part1]
attctcaatcctcgcc

SEQ ID NO: 6031 - DNA, 16 bp, Artificial Sequence
  synthetic [barcode part1]
aataccggaccaatcc

SEQ ID NO: 6032 - DNA, 16 bp, Artificial Sequence
  synthetic [barcode part1]
caatcactattccacg

SEQ ID NO: 6033 - DNA, 16 bp, Artificial Sequence
  synthetic [barcode part1]
ttaagtgagacgacgt

SEQ ID NO: 6034 - DNA, 16 bp, Artificial Sequence
  synthetic [barcode part1]
tcctgcgttgaattgt

SEQ ID NO: 6035 - DNA, 16 bp, Artificial Sequence
  synthetic [barcode part1]
ttgtgcacagttgcag

SEQ ID NO: 6036 - DNA, 16 bp, Artificial Sequence
  synthetic [barcode part1]
acacactaacaacgag

SEQ ID NO: 6037 - DNA, 16 bp, Artificial Sequence
  synthetic [barcode part1]
ttcggttcagtgtact

SEQ ID NO: 6038 - DNA, 16 bp, Artificial Sequence
  synthetic [barcode part1]
gccactcctgtaggtt

SEQ ID NO: 6039 - DNA, 16 bp, Artificial Sequence
  synthetic [barcode part1]
gttcctcgtacaccag

SEQ ID NO: 6040 - DNA, 16 bp, Artificial Sequence
  synthetic [barcode part1]
gtctattctcaagacc

SEQ ID NO: 6041 - DNA, 16 bp, Artificial Sequence
  synthetic [barcode part1]
aaggttccttggaacc

SEQ ID NO: 6042 - DNA, 16 bp, Artificial Sequence
  synthetic [barcode part1]
ataacagagtggcgag

SEQ ID NO: 6043 - DNA, 16 bp, Artificial Sequence
  synthetic [barcode part1]
aacgtactaatcgcgc

SEQ ID NO: 6044 - DNA, 16 bp, Artificial Sequence
  synthetic [barcode part1]
cagataagacactgtg

SEQ ID NO: 6045 - DNA, 16 bp, Artificial Sequence
  synthetic [barcode part1]
cgagaggcgtataatt

SEQ ID NO: 6046 - DNA, 16 bp, Artificial Sequence
  synthetic [barcode part1]
gaggtggtgtctgagt

SEQ ID NO: 6047 - DNA, 16 bp, Artificial Sequence
  synthetic [barcode part1]
caggaggttaactcct

SEQ ID NO: 6048 - DNA, 16 bp, Artificial Sequence
  synthetic [barcode part1]
agtactggtcacagtc

SEQ ID NO: 6049 - DNA, 16 bp, Artificial Sequence
  synthetic [barcode part1]
gtggagattgaactac

SEQ ID NO: 6050 - DNA, 16 bp, Artificial Sequence
  synthetic [barcode part1]
cgacaatcgacagttc

SEQ ID NO: 6051 - DNA, 16 bp, Artificial Sequence
  synthetic [barcode part1]
gaagtcctccggaatt

SEQ ID NO: 6052 - DNA, 16 bp, Artificial Sequence
  synthetic [barcode part1]
tcagacacaccgttcc

SEQ ID NO: 6053 - DNA, 16 bp, Artificial Sequence
  synthetic [barcode part1]
accgtattcggtgtag

SEQ ID NO: 6054 - DNA, 16 bp, Artificial Sequence
  synthetic [barcode part1]
tagtgtcacaagtgag

SEQ ID NO: 6055 - DNA, 16 bp, Artificial Sequence
  synthetic [barcode part1]
tgtacaggtccgaatc

SEQ ID NO: 6056 - DNA, 16 bp, Artificial Sequence
  synthetic [barcode part1]
gcacaatagagttgac

SEQ ID NO: 6057 - DNA, 16 bp, Artificial Sequence
  synthetic [barcode part1]
taatctccgtgaccgc

SEQ ID NO: 6058 - DNA, 16 bp, Artificial Sequence
  synthetic [barcode part1]
cagacactgtgagtct

SEQ ID NO: 6059 - DNA, 16 bp, Artificial Sequence
  synthetic [barcode part1]
gtgcgtgaatcttgac

SEQ ID NO: 6060 - DNA, 16 bp, Artificial Sequence
  synthetic [barcode part1]
tgcacctctgtcgaac

SEQ ID NO: 6061 - DNA, 16 bp, Artificial Sequence
  synthetic [barcode part1]
caatctgtaccagacg

SEQ ID NO: 6062 - DNA, 16 bp, Artificial Sequence
  synthetic [barcode part1]
acgcgtactaggactt

SEQ ID NO: 6063 - DNA, 16 bp, Artificial Sequence
  synthetic [barcode part1]
caggagacacgtagtc

SEQ ID NO: 6064 - DNA, 16 bp, Artificial Sequence
  synthetic [barcode part1]
ttgactctcacacagt

SEQ ID NO: 6065 - DNA, 16 bp, Artificial Sequence
  synthetic [barcode part1]
gtcagatacaacctgc

SEQ ID NO: 6066 - DNA, 16 bp, Artificial Sequence
  synthetic [barcode part1]
gacgaacttacctacg

SEQ ID NO: 6067 - DNA, 16 bp, Artificial Sequence
  synthetic [barcode part1]
agatattggacggtac

SEQ ID NO: 6068 - DNA, 16 bp, Artificial Sequence
  synthetic [barcode part1]
tccagtctataatcgc

SEQ ID NO: 6069 - DNA, 16 bp, Artificial Sequence
  synthetic [barcode part1]
attaacggtcctctgt

SEQ ID NO: 6070 - DNA, 16 bp, Artificial Sequence
  synthetic [barcode part1]
gttcaggtctgttgtt

SEQ ID NO: 6071 - DNA, 16 bp, Artificial Sequence
  synthetic [barcode part1]
agtagagaccggaagt

SEQ ID NO: 6072 - DNA, 16 bp, Artificial Sequence
  synthetic [barcode part1]
gattcgaatcgccaac

SEQ ID NO: 6073 - DNA, 16 bp, Artificial Sequence
  synthetic [barcode part1]
cacacaagtggaatac

SEQ ID NO: 6074 - DNA, 16 bp, Artificial Sequence
  synthetic [barcode part1]
taccacctacttcgtc

SEQ ID NO: 6075 - DNA, 16 bp, Artificial Sequence
  synthetic [barcode part1]
cggacacagtctatac

SEQ ID NO: 6076 - DNA, 16 bp, Artificial Sequence
  synthetic [barcode part1]
ccgtatcttgtactcc

SEQ ID NO: 6077 - DNA, 16 bp, Artificial Sequence
  synthetic [barcode part1]
acgtcaatccttaacc

SEQ ID NO: 6078 - DNA, 16 bp, Artificial Sequence
  synthetic [barcode part1]
attcttgacctgacac

SEQ ID NO: 6079 - DNA, 16 bp, Artificial Sequence
  synthetic [barcode part1]
aacaccgaccgtaact

SEQ ID NO: 6080 - DNA, 16 bp, Artificial Sequence
  synthetic [barcode part1]
tcgccgattgaatcag

SEQ ID NO: 6081 - DNA, 16 bp, Artificial Sequence
  synthetic [barcode part1]
gcggaattcgtgaacg

SEQ ID NO: 6082 - DNA, 16 bp, Artificial Sequence
  synthetic [barcode part1]
gtatcggtgtagacct

SEQ ID NO: 6083 - DNA, 16 bp, Artificial Sequence
  synthetic [barcode part1]
tctaacgcgtctccag

SEQ ID NO: 6084 - DNA, 16 bp, Artificial Sequence
  synthetic [barcode part1]
tctcaatacgcagttc

SEQ ID NO: 6085 - DNA, 16 bp, Artificial Sequence
  synthetic [barcode part1]
attattcggcgttcgt

SEQ ID NO: 6086 - DNA, 16 bp, Artificial Sequence
  synthetic [barcode part1]
cctcaatctggatact

SEQ ID NO: 6087 - DNA, 16 bp, Artificial Sequence
  synthetic [barcode part1]
acacaacacactggtc

SEQ ID NO: 6088 - DNA, 16 bp, Artificial Sequence
  synthetic [barcode part1]
gcactctcggtgattc

SEQ ID NO: 6089 - DNA, 16 bp, Artificial Sequence
  synthetic [barcode part1]
cagagaggcaccaatc

SEQ ID NO: 6090 - DNA, 16 bp, Artificial Sequence
  synthetic [barcode part1]
tcgagtacttggacac

SEQ ID NO: 6091 - DNA, 16 bp, Artificial Sequence
  synthetic [barcode part1]
cggcctcgtactaatc

SEQ ID NO: 6092 - DNA, 16 bp, Artificial Sequence
  synthetic [barcode part1]
attctaacacggtgcg

SEQ ID NO: 6093 - DNA, 16 bp, Artificial Sequence
  synthetic [barcode part1]
ccttgtatctcgcgtt

SEQ ID NO: 6094 - DNA, 16 bp, Artificial Sequence
  synthetic [barcode part1]
gtgcacgcaattagtc

SEQ ID NO: 6095 - DNA, 16 bp, Artificial Sequence
  synthetic [barcode part1]
gttcttagtgacttgc

SEQ ID NO: 6096 - DNA, 16 bp, Artificial Sequence
  synthetic [barcode part1]
tgcacttggattgtct

SEQ ID NO: 6097 - DNA, 16 bp, Artificial Sequence
  synthetic [barcode part1]
tcggaagtgatcttcg

SEQ ID NO: 6098 - DNA, 16 bp, Artificial Sequence
  synthetic [barcode part1]
gaggacgtaagttact

SEQ ID NO: 6099 - DNA, 16 bp, Artificial Sequence
  synthetic [barcode part1]
tgatagttcggcgact

SEQ ID NO: 6100 - DNA, 16 bp, Artificial Sequence
  synthetic [barcode part1]
ttagtcgatacgcgtg

SEQ ID NO: 6101 - DNA, 16 bp, Artificial Sequence
  synthetic [barcode part1]
agtggactaagattcg

SEQ ID NO: 6102 - DNA, 16 bp, Artificial Sequence
  synthetic [barcode part1]
tcggtgacagactact

SEQ ID NO: 6103 - DNA, 16 bp, Artificial Sequence
  synthetic [barcode part1]
agaatacaaggcgcag

SEQ ID NO: 6104 - DNA, 16 bp, Artificial Sequence
  synthetic [barcode part1]
acgcgatctgagaggt

SEQ ID NO: 6105 - DNA, 16 bp, Artificial Sequence
  synthetic [barcode part1]
tgtctgagtacgactg

SEQ ID NO: 6106 - DNA, 16 bp, Artificial Sequence
  synthetic [barcode part1]
gaactctgtatcgcag

SEQ ID NO: 6107 - DNA, 16 bp, Artificial Sequence
  synthetic [barcode part1]
gttgtggacggacagt

SEQ ID NO: 6108 - DNA, 16 bp, Artificial Sequence
  synthetic [barcode part1]
gcaagtgtaggtagag

SEQ ID NO: 6109 - DNA, 16 bp, Artificial Sequence
  synthetic [barcode part1]
gttctcggcaattcgc

SEQ ID NO: 6110 - DNA, 16 bp, Artificial Sequence
  synthetic [barcode part1]
agacggttgtaccgag

SEQ ID NO: 6111 - DNA, 16 bp, Artificial Sequence
  synthetic [barcode part1]
ttggtgaaggttgtcc

SEQ ID NO: 6112 - DNA, 16 bp, Artificial Sequence
  synthetic [barcode part1]
aattggcagagaaggc

SEQ ID NO: 6113 - DNA, 16 bp, Artificial Sequence
  synthetic [barcode part1]
tcgaacaacaataggc

SEQ ID NO: 6114 - DNA, 16 bp, Artificial Sequence
  synthetic [barcode part1]
ttccgatagtcacgtt

SEQ ID NO: 6115 - DNA, 16 bp, Artificial Sequence
  synthetic [barcode part1]
cgtgaagatacggaag

SEQ ID NO: 6116 - DNA, 16 bp, Artificial Sequence
  synthetic [barcode part1]
aattactctgccggag

SEQ ID NO: 6117 - DNA, 16 bp, Artificial Sequence
  synthetic [barcode part1]
ttgttcgccgcagtgt

SEQ ID NO: 6118 - DNA, 16 bp, Artificial Sequence
  synthetic [barcode part1]
tctgttatcggcgtgc

SEQ ID NO: 6119 - DNA, 16 bp, Artificial Sequence
  synthetic [barcode part1]
cggtctctctcaatct

SEQ ID NO: 6120 - DNA, 16 bp, Artificial Sequence
  synthetic [barcode part1]
gaccaaggcaactgtg

SEQ ID NO: 6121 - DNA, 16 bp, Artificial Sequence
  synthetic [barcode part1]
atccgttggtgccact

SEQ ID NO: 6122 - DNA, 16 bp, Artificial Sequence
  synthetic [barcode part1]
gtctgtaatacggtcg

SEQ ID NO: 6123 - DNA, 16 bp, Artificial Sequence
  synthetic [barcode part1]
tccgtggtattattcg

SEQ ID NO: 6124 - DNA, 16 bp, Artificial Sequence
  synthetic [barcode part1]
atctcgaccaatcgag

SEQ ID NO: 6125 - DNA, 16 bp, Artificial Sequence
  synthetic [barcode part1]
aacaccgagagagagt

SEQ ID NO: 6126 - DNA, 16 bp, Artificial Sequence
  synthetic [barcode part1]
cagtctccgtgtagtc

SEQ ID NO: 6127 - DNA, 16 bp, Artificial Sequence
  synthetic [barcode part1]
ccggtggtcgtattct

SEQ ID NO: 6128 - DNA, 16 bp, Artificial Sequence
  synthetic [barcode part1]
ttgttgcagatccact

SEQ ID NO: 6129 - DNA, 16 bp, Artificial Sequence
  synthetic [barcode part1]
agtcaacgtaccacac

SEQ ID NO: 6130 - DNA, 16 bp, Artificial Sequence
  synthetic [barcode part1]
gttgtcaagtcaccag

SEQ ID NO: 6131 - DNA, 16 bp, Artificial Sequence
  synthetic [barcode part1]
aagaactattgcgcag

SEQ ID NO: 6132 - DNA, 16 bp, Artificial Sequence
  synthetic [barcode part1]
agttctggatatcgcg

SEQ ID NO: 6133 - DNA, 16 bp, Artificial Sequence
  synthetic [barcode part1]
aattgtggccgacact

SEQ ID NO: 6134 - DNA, 16 bp, Artificial Sequence
  synthetic [barcode part1]
acgtcctctggattgc

SEQ ID NO: 6135 - DNA, 16 bp, Artificial Sequence
  synthetic [barcode part1]
cctatacaatcaccgt

SEQ ID NO: 6136 - DNA, 16 bp, Artificial Sequence
  synthetic [barcode part1]
agtccggtataagaac

SEQ ID NO: 6137 - DNA, 16 bp, Artificial Sequence
  synthetic [barcode part1]
taccagttgacgtgtg

SEQ ID NO: 6138 - DNA, 16 bp, Artificial Sequence
  synthetic [barcode part1]
ccggtacctagtcttg

SEQ ID NO: 6139 - DNA, 16 bp, Artificial Sequence
  synthetic [barcode part1]
tactggaagacgtaac

SEQ ID NO: 6140 - DNA, 16 bp, Artificial Sequence
  synthetic [barcode part1]
tcagttcggcaacagt

SEQ ID NO: 6141 - DNA, 16 bp, Artificial Sequence
  synthetic [barcode part1]
gatctcaagtaccacg

SEQ ID NO: 6142 - DNA, 16 bp, Artificial Sequence
  synthetic [barcode part1]
ccacctatattgtgac

SEQ ID NO: 6143 - DNA, 16 bp, Artificial Sequence
  synthetic [barcode part1]
tgcgttaggaagattg

SEQ ID NO: 6144 - DNA, 16 bp, Artificial Sequence
  synthetic [barcode part1]
tcgtaactctctcctg

SEQ ID NO: 6145 - DNA, 16 bp, Artificial Sequence
  synthetic [barcode part1]
atcgtctataggtcct

SEQ ID NO: 6146 - DNA, 16 bp, Artificial Sequence
  synthetic [barcode part1]
gtcagtgtccgactct

SEQ ID NO: 6147 - DNA, 16 bp, Artificial Sequence
  synthetic [barcode part1]
tacaatacctgcctac

SEQ ID NO: 6148 - DNA, 16 bp, Artificial Sequence
  synthetic [barcode part1]
gcgaacacctattcag

SEQ ID NO: 6149 - DNA, 16 bp, Artificial Sequence
  synthetic [barcode part1]
atacttcaaggcgcac

SEQ ID NO: 6150 - DNA, 16 bp, Artificial Sequence
  synthetic [barcode part1]
acttgaaggcaggatt

SEQ ID NO: 6151 - DNA, 16 bp, Artificial Sequence
  synthetic [barcode part1]
cgaagtgccacacaag

SEQ ID NO: 6152 - DNA, 16 bp, Artificial Sequence
  synthetic [barcode part1]
cacagtattcgttcac

SEQ ID NO: 6153 - DNA, 16 bp, Artificial Sequence
  synthetic [barcode part1]
ttcctcgtctacggag

SEQ ID NO: 6154 - DNA, 16 bp, Artificial Sequence
  synthetic [barcode part1]
gttcagaatctgtggc

SEQ ID NO: 6155 - DNA, 16 bp, Artificial Sequence
  synthetic [barcode part1]
tgcggatccaccttgt

SEQ ID NO: 6156 - DNA, 16 bp, Artificial Sequence
  synthetic [barcode part1]
gtatcttgccgagtcc

SEQ ID NO: 6157 - DNA, 16 bp, Artificial Sequence
  synthetic [barcode part1]
tgtcgaggttcttgtt

SEQ ID NO: 6158 - DNA, 16 bp, Artificial Sequence
  synthetic [barcode part1]
gagttgttatccttgc

SEQ ID NO: 6159 - DNA, 16 bp, Artificial Sequence
  synthetic [barcode part1]
caattcctctcgacct

SEQ ID NO: 6160 - DNA, 16 bp, Artificial Sequence
  synthetic [barcode part1]
tgagttcctacaggtg

SEQ ID NO: 6161 - DNA, 16 bp, Artificial Sequence
  synthetic [barcode part1]
acgttgacgcaagttc

SEQ ID NO: 6162 - DNA, 16 bp, Artificial Sequence
  synthetic [barcode part1]
agaacaggtcctacct

SEQ ID NO: 6163 - DNA, 16 bp, Artificial Sequence
  synthetic [barcode part1]
tcggtagtgagtcact

SEQ ID NO: 6164 - DNA, 16 bp, Artificial Sequence
  synthetic [barcode part1]
agaggtccaatacgcg

SEQ ID NO: 6165 - DNA, 16 bp, Artificial Sequence
  synthetic [barcode part1]
tcggagtgaacgaatt

SEQ ID NO: 6166 - DNA, 16 bp, Artificial Sequence
  synthetic [barcode part1]
cgacttataggagtag

SEQ ID NO: 6167 - DNA, 16 bp, Artificial Sequence
  synthetic [barcode part1]
gcgcgtgaatcaactt

SEQ ID NO: 6168 - DNA, 16 bp, Artificial Sequence
  synthetic [barcode part1]
tattcgttcgttcgcc

SEQ ID NO: 6169 - DNA, 16 bp, Artificial Sequence
  synthetic [barcode part1]
actcggacttgttgtt

SEQ ID NO: 6170 - DNA, 16 bp, Artificial Sequence
  synthetic [barcode part1]
actggtatctacggac

SEQ ID NO: 6171 - DNA, 16 bp, Artificial Sequence
  synthetic [barcode part1]
ttaggacagtaccgtc

SEQ ID NO: 6172 - DNA, 16 bp, Artificial Sequence
  synthetic [barcode part1]
gtctaggtggaatagt

SEQ ID NO: 6173 - DNA, 16 bp, Artificial Sequence
  synthetic [barcode part1]
accgtatactatcctg

SEQ ID NO: 6174 - DNA, 16 bp, Artificial Sequence
  synthetic [barcode part1]
cgacacggttaggaac

SEQ ID NO: 6175 - DNA, 16 bp, Artificial Sequence
  synthetic [barcode part1]
tactatcctgcgtaac

SEQ ID NO: 6176 - DNA, 16 bp, Artificial Sequence
  synthetic [barcode part1]
gtcacaacgcctgttc

SEQ ID NO: 6177 - DNA, 16 bp, Artificial Sequence
  synthetic [barcode part1]
gttggtaatctaggcc

SEQ ID NO: 6178 - DNA, 16 bp, Artificial Sequence
  synthetic [barcode part1]
cctatcgtacgtcgac

SEQ ID NO: 6179 - DNA, 16 bp, Artificial Sequence
  synthetic [barcode part1]
tccgtaatcacttcag

SEQ ID NO: 6180 - DNA, 16 bp, Artificial Sequence
  synthetic [barcode part1]
tctgtccttactcacg

SEQ ID NO: 6181 - DNA, 16 bp, Artificial Sequence
  synthetic [barcode part1]
gacttgaggaacgtgc

SEQ ID NO: 6182 - DNA, 16 bp, Artificial Sequence
  synthetic [barcode part1]
cgttccactacgagtc

SEQ ID NO: 6183 - DNA, 16 bp, Artificial Sequence
  synthetic [barcode part1]
gagaacaaggcgtagt

SEQ ID NO: 6184 - DNA, 16 bp, Artificial Sequence
  synthetic [barcode part1]
tcaccaactagtgacg

SEQ ID NO: 6185 - DNA, 16 bp, Artificial Sequence
  synthetic [barcode part1]
atcaggtacagaagtc

SEQ ID NO: 6186 - DNA, 16 bp, Artificial Sequence
  synthetic [barcode part1]
tccacgtgtcagatcc

SEQ ID NO: 6187 - DNA, 16 bp, Artificial Sequence
  synthetic [barcode part1]
ttgccacgtccacaac

SEQ ID NO: 6188 - DNA, 16 bp, Artificial Sequence
  synthetic [barcode part1]
gaactcagtggaacgc

SEQ ID NO: 6189 - DNA, 16 bp, Artificial Sequence
  synthetic [barcode part1]
cgtgcgactcaattcc

SEQ ID NO: 6190 - DNA, 16 bp, Artificial Sequence
  synthetic [barcode part1]
gaatattggtggagtc

SEQ ID NO: 6191 - DNA, 16 bp, Artificial Sequence
  synthetic [barcode part1]
agtatcaccgactggt

SEQ ID NO: 6192 - DNA, 16 bp, Artificial Sequence
  synthetic [barcode part1]
gagtatccaccactcc

SEQ ID NO: 6193 - DNA, 16 bp, Artificial Sequence
  synthetic [barcode part1]
taccgccgatacacct

SEQ ID NO: 6194 - DNA, 16 bp, Artificial Sequence
  synthetic [barcode part1]
attatcctccaggcgc

SEQ ID NO: 6195 - DNA, 16 bp, Artificial Sequence
  synthetic [barcode part1]
aggtaatcgcgaattg

SEQ ID NO: 6196 - DNA, 16 bp, Artificial Sequence
  synthetic [barcode part1]
gtcaacacctaattcc

SEQ ID NO: 6197 - DNA, 16 bp, Artificial Sequence
  synthetic [barcode part1]
caacgcgtaataagac

SEQ ID NO: 6198 - DNA, 16 bp, Artificial Sequence
  synthetic [barcode part1]
gaggagtccacgtaac

SEQ ID NO: 6199 - DNA, 16 bp, Artificial Sequence
  synthetic [barcode part1]
atctcgagttgtggtg

SEQ ID NO: 6200 - DNA, 16 bp, Artificial Sequence
  synthetic [barcode part1]
tattctcaggaacgcg

SEQ ID NO: 6201 - DNA, 16 bp, Artificial Sequence
  synthetic [barcode part1]
gccagacgaacacaac

SEQ ID NO: 6202 - DNA, 16 bp, Artificial Sequence
  synthetic [barcode part1]
gaatcggaaggtcaag

SEQ ID NO: 6203 - DNA, 16 bp, Artificial Sequence
  synthetic [barcode part1]
tgaactccgagataag

SEQ ID NO: 6204 - DNA, 16 bp, Artificial Sequence
  synthetic [barcode part1]
ttggccttatcgacgc

SEQ ID NO: 6205 - DNA, 16 bp, Artificial Sequence
  synthetic [barcode part1]
aaggaatccgcgcaac

SEQ ID NO: 6206 - DNA, 16 bp, Artificial Sequence
  synthetic [barcode part1]
tgtaatacgtcacggc

SEQ ID NO: 6207 - DNA, 16 bp, Artificial Sequence
  synthetic [barcode part1]
ccgatctataatcgtc

SEQ ID NO: 6208 - DNA, 16 bp, Artificial Sequence
  synthetic [barcode part1]
ccgattaggccttaag

SEQ ID NO: 6209 - DNA, 16 bp, Artificial Sequence
  synthetic [barcode part1]
ttccggcgactgtgtt

SEQ ID NO: 6210 - DNA, 16 bp, Artificial Sequence
  synthetic [barcode part1]
agttggtctaggactc

SEQ ID NO: 6211 - DNA, 16 bp, Artificial Sequence
  synthetic [barcode part1]
agtgtggatagttcag

SEQ ID NO: 6212 - DNA, 16 bp, Artificial Sequence
  synthetic [barcode part1]
gagacgagtgatagac

SEQ ID NO: 6213 - DNA, 16 bp, Artificial Sequence
  synthetic [barcode part1]
tcgattgccttaggag

SEQ ID NO: 6214 - DNA, 16 bp, Artificial Sequence
  synthetic [barcode part1]
cgtcaagtctatacct

SEQ ID NO: 6215 - DNA, 16 bp, Artificial Sequence
  synthetic [barcode part1]
tactggacgaatcgtc

SEQ ID NO: 6216 - DNA, 16 bp, Artificial Sequence
  synthetic [barcode part1]
tctaaccgatcctcct

SEQ ID NO: 6217 - DNA, 16 bp, Artificial Sequence
  synthetic [barcode part1]
gttgtactacgtcgag

SEQ ID NO: 6218 - DNA, 16 bp, Artificial Sequence
  synthetic [barcode part1]
ttctcgacaacacact

SEQ ID NO: 6219 - DNA, 16 bp, Artificial Sequence
  synthetic [barcode part1]
ccagtagatctctact

SEQ ID NO: 6220 - DNA, 16 bp, Artificial Sequence
  synthetic [barcode part1]
cgtgcctaataacctt

SEQ ID NO: 6221 - DNA, 16 bp, Artificial Sequence
  synthetic [barcode part1]
tctccggatcggtgtt

SEQ ID NO: 6222 - DNA, 16 bp, Artificial Sequence
  synthetic [barcode part1]
attcttcgacctcctg

SEQ ID NO: 6223 - DNA, 16 bp, Artificial Sequence
  synthetic [barcode part1]
tcctacgtaatagtcc

SEQ ID NO: 6224 - DNA, 16 bp, Artificial Sequence
  synthetic [barcode part1]
aggaatattaccaggc

SEQ ID NO: 6225 - DNA, 16 bp, Artificial Sequence
  synthetic [barcode part1]
tactcaccgagatctt

SEQ ID NO: 6226 - DNA, 16 bp, Artificial Sequence
  synthetic [barcode part1]
aggactgtgacaagag

SEQ ID NO: 6227 - DNA, 16 bp, Artificial Sequence
  synthetic [barcode part1]
agagtcctaggactct

SEQ ID NO: 6228 - DNA, 16 bp, Artificial Sequence
  synthetic [barcode part1]
ccacgttatagtctac

SEQ ID NO: 6229 - DNA, 16 bp, Artificial Sequence
  synthetic [barcode part1]
gagtaggaacggatac

SEQ ID NO: 6230 - DNA, 16 bp, Artificial Sequence
  synthetic [barcode part1]
gttgtacttggtgcag

SEQ ID NO: 6231 - DNA, 16 bp, Artificial Sequence
  synthetic [barcode part1]
ttgacgtaagaagtcg

SEQ ID NO: 6232 - DNA, 16 bp, Artificial Sequence
  synthetic [barcode part1]
tgcgaaccttactact

SEQ ID NO: 6233 - DNA, 16 bp, Artificial Sequence
  synthetic [barcode part1]
agaatactggcagttg

SEQ ID NO: 6234 - DNA, 16 bp, Artificial Sequence
  synthetic [barcode part1]
cacctaagtgcaactg

SEQ ID NO: 6235 - DNA, 16 bp, Artificial Sequence
  synthetic [barcode part1]
tgattggcgtatacgc

SEQ ID NO: 6236 - DNA, 16 bp, Artificial Sequence
  synthetic [barcode part1]
ttgtggttgaccagtg

SEQ ID NO: 6237 - DNA, 16 bp, Artificial Sequence
  synthetic [barcode part1]
gcaggatatctgtaag

SEQ ID NO: 6238 - DNA, 16 bp, Artificial Sequence
  synthetic [barcode part1]
cgagtatccgaatacc

SEQ ID NO: 6239 - DNA, 16 bp, Artificial Sequence
  synthetic [barcode part1]
gttctgtcactccact

SEQ ID NO: 6240 - DNA, 16 bp, Artificial Sequence
  synthetic [barcode part1]
ccttacgccaacaacc

SEQ ID NO: 6241 - DNA, 16 bp, Artificial Sequence
  synthetic [barcode part1]
ataggccaagacaact

SEQ ID NO: 6242 - DNA, 16 bp, Artificial Sequence
  synthetic [barcode part1]
tgtctagtgtgccaag

SEQ ID NO: 6243 - DNA, 16 bp, Artificial Sequence
  synthetic [barcode part1]
tcgtatctaggtcgtt

SEQ ID NO: 6244 - DNA, 16 bp, Artificial Sequence
  synthetic [barcode part1]
caaggaggtacactgc

SEQ ID NO: 6245 - DNA, 16 bp, Artificial Sequence
  synthetic [barcode part1]
tctattggagacggtc

SEQ ID NO: 6246 - DNA, 16 bp, Artificial Sequence
  synthetic [barcode part1]
ttgcaacaccaaccag

SEQ ID NO: 6247 - DNA, 16 bp, Artificial Sequence
  synthetic [barcode part1]
gcgtggttcttctgac

SEQ ID NO: 6248 - DNA, 16 bp, Artificial Sequence
  synthetic [barcode part1]
acgttagtgatcttcc

SEQ ID NO: 6249 - DNA, 16 bp, Artificial Sequence
  synthetic [barcode part1]
tcactgtactccacct

SEQ ID NO: 6250 - DNA, 16 bp, Artificial Sequence
  synthetic [barcode part1]
agttggtcagtgttgc

SEQ ID NO: 6251 - DNA, 16 bp, Artificial Sequence
  synthetic [barcode part1]
gagagaactccagaag

SEQ ID NO: 6252 - DNA, 16 bp, Artificial Sequence
  synthetic [barcode part1]
ccacgtgagttctctg

SEQ ID NO: 6253 - DNA, 16 bp, Artificial Sequence
  synthetic [barcode part1]
cctaaccacacaccac

SEQ ID NO: 6254 - DNA, 16 bp, Artificial Sequence
  synthetic [barcode part1]
taatcggccgaagttc

SEQ ID NO: 6255 - DNA, 16 bp, Artificial Sequence
  synthetic [barcode part1]
ttggtgtacaccagtg

SEQ ID NO: 6256 - DNA, 16 bp, Artificial Sequence
  synthetic [barcode part1]
accactccttggacac

SEQ ID NO: 6257 - DNA, 16 bp, Artificial Sequence
  synthetic [barcode part1]
gacttacagtgtccag

SEQ ID NO: 6258 - DNA, 16 bp, Artificial Sequence
  synthetic [barcode part1]
ccgcactgaattgcct

SEQ ID NO: 6259 - DNA, 16 bp, Artificial Sequence
  synthetic [barcode part1]
cgtgcgattattgttc

SEQ ID NO: 6260 - DNA, 16 bp, Artificial Sequence
  synthetic [barcode part1]
gaaggtccgtggttag

SEQ ID NO: 6261 - DNA, 16 bp, Artificial Sequence
  synthetic [barcode part1]
tatccgttcgcggtgt

SEQ ID NO: 6262 - DNA, 16 bp, Artificial Sequence
  synthetic [barcode part1]
atcacgtggaggtcag

SEQ ID NO: 6263 - DNA, 16 bp, Artificial Sequence
  synthetic [barcode part1]
gacacttccaccactg

SEQ ID NO: 6264 - DNA, 16 bp, Artificial Sequence
  synthetic [barcode part1]
ttgcaggactctccgt

SEQ ID NO: 6265 - DNA, 16 bp, Artificial Sequence
  synthetic [barcode part1]
ttacctactacagtgc

SEQ ID NO: 6266 - DNA, 16 bp, Artificial Sequence
  synthetic [barcode part1]
cagtaggacgaactcg

SEQ ID NO: 6267 - DNA, 16 bp, Artificial Sequence
  synthetic [barcode part1]
gacactggttgtggtt

SEQ ID NO: 6268 - DNA, 16 bp, Artificial Sequence
  synthetic [barcode part1]
aattaggagacgttcg

SEQ ID NO: 6269 - DNA, 16 bp, Artificial Sequence
  synthetic [barcode part1]
cacaatcttcctaacg

SEQ ID NO: 6270 - DNA, 16 bp, Artificial Sequence
  synthetic [barcode part1]
atagaggcaacgatct

SEQ ID NO: 6271 - DNA, 16 bp, Artificial Sequence
  synthetic [barcode part1]
aaggtccgcctactct

SEQ ID NO: 6272 - DNA, 16 bp, Artificial Sequence
  synthetic [barcode part1]
cctctgtatagaggtg

SEQ ID NO: 6273 - DNA, 16 bp, Artificial Sequence
  synthetic [barcode part1]
gcaacacacgtgtact

SEQ ID NO: 6274 - DNA, 16 bp, Artificial Sequence
  synthetic [barcode part1]
accactaccagtagtg

SEQ ID NO: 6275 - DNA, 16 bp, Artificial Sequence
  synthetic [barcode part1]
gcggattatacgacct

SEQ ID NO: 6276 - DNA, 16 bp, Artificial Sequence
  synthetic [barcode part1]
tcttatcctcgtcgtg

SEQ ID NO: 6277 - DNA, 16 bp, Artificial Sequence
  synthetic [barcode part1]
ttgacgaacgaagatc

SEQ ID NO: 6278 - DNA, 16 bp, Artificial Sequence
  synthetic [barcode part1]
tgtggagagaacacag

SEQ ID NO: 6279 - DNA, 16 bp, Artificial Sequence
  synthetic [barcode part1]
gtcaccttcgttctac

SEQ ID NO: 6280 - DNA, 16 bp, Artificial Sequence
  synthetic [barcode part1]
ttccttacgtcctgtg

SEQ ID NO: 6281 - DNA, 16 bp, Artificial Sequence
  synthetic [barcode part1]
tcgcgcagagaagttg

SEQ ID NO: 6282 - DNA, 16 bp, Artificial Sequence
  synthetic [barcode part1]
ccaagacgcggatagt

SEQ ID NO: 6283 - DNA, 16 bp, Artificial Sequence
  synthetic [barcode part1]
taggactctagagtcc

SEQ ID NO: 6284 - DNA, 16 bp, Artificial Sequence
  synthetic [barcode part1]
ttatcaccggaacgac

SEQ ID NO: 6285 - DNA, 16 bp, Artificial Sequence
  synthetic [barcode part1]
ccttcttcgtacgtac

SEQ ID NO: 6286 - DNA, 16 bp, Artificial Sequence
  synthetic [barcode part1]
aacagtctgacggttc

SEQ ID NO: 6287 - DNA, 16 bp, Artificial Sequence
  synthetic [barcode part1]
tcggcaactatcgagt

SEQ ID NO: 6288 - DNA, 16 bp, Artificial Sequence
  synthetic [barcode part1]
aaggttcactcacttc

SEQ ID NO: 6289 - DNA, 16 bp, Artificial Sequence
  synthetic [barcode part1]
tagaatcgccacggtt

SEQ ID NO: 6290 - DNA, 16 bp, Artificial Sequence
  synthetic [barcode part1]
ccagtctgacgtactc

SEQ ID NO: 6291 - DNA, 16 bp, Artificial Sequence
  synthetic [barcode part1]
acgttggcagtcctct

SEQ ID NO: 6292 - DNA, 16 bp, Artificial Sequence
  synthetic [barcode part1]
gtaagatcttgccgtg

SEQ ID NO: 6293 - DNA, 16 bp, Artificial Sequence
  synthetic [barcode part1]
tacggactctgccact

SEQ ID NO: 6294 - DNA, 16 bp, Artificial Sequence
  synthetic [barcode part1]
acgttcttggtccggt

SEQ ID NO: 6295 - DNA, 16 bp, Artificial Sequence
  synthetic [barcode part1]
cgtatacgccaatcag

SEQ ID NO: 6296 - DNA, 16 bp, Artificial Sequence
  synthetic [barcode part1]
ttgacttccgtgtaac

SEQ ID NO: 6297 - DNA, 16 bp, Artificial Sequence
  synthetic [barcode part1]
ttacttctggcaggag

SEQ ID NO: 6298 - DNA, 16 bp, Artificial Sequence
  synthetic [barcode part1]
agaggcactactaggc

SEQ ID NO: 6299 - DNA, 16 bp, Artificial Sequence
  synthetic [barcode part1]
attccagagttgaccg

SEQ ID NO: 6300 - DNA, 16 bp, Artificial Sequence
  synthetic [barcode part1]
acaattaagaaccggc

SEQ ID NO: 6301 - DNA, 16 bp, Artificial Sequence
  synthetic [barcode part1]
gtgccggaagagttgt

SEQ ID NO: 6302 - DNA, 16 bp, Artificial Sequence
  synthetic [barcode part1]
tcgttcggtctacttc

SEQ ID NO: 6303 - DNA, 16 bp, Artificial Sequence
  synthetic [barcode part1]
caacgcggttgttctc

SEQ ID NO: 6304 - DNA, 16 bp, Artificial Sequence
  synthetic [barcode part1]
atataacgccaacgcc

SEQ ID NO: 6305 - DNA, 16 bp, Artificial Sequence
  synthetic [barcode part1]
gtgagtcctccgttgt

SEQ ID NO: 6306 - DNA, 16 bp, Artificial Sequence
  synthetic [barcode part1]
tcgtggaccgtatagt

SEQ ID NO: 6307 - DNA, 16 bp, Artificial Sequence
  synthetic [barcode part1]
atccgaatatcgttcc

SEQ ID NO: 6308 - DNA, 16 bp, Artificial Sequence
  synthetic [barcode part1]
atctagaggacagtgt

SEQ ID NO: 6309 - DNA, 16 bp, Artificial Sequence
  synthetic [barcode part1]
tgcaactgtcgttccg

SEQ ID NO: 6310 - DNA, 16 bp, Artificial Sequence
  synthetic [barcode part1]
cgcagtgattcactcc

SEQ ID NO: 6311 - DNA, 16 bp, Artificial Sequence
  synthetic [barcode part1]
cgtggacttattccgc

SEQ ID NO: 6312 - DNA, 16 bp, Artificial Sequence
  synthetic [barcode part1]
gttacttgcctacggc

SEQ ID NO: 6313 - DNA, 16 bp, Artificial Sequence
  synthetic [barcode part1]
gaagtgaagtgtctgt

SEQ ID NO: 6314 - DNA, 16 bp, Artificial Sequence
  synthetic [barcode part1]
gtcctcacactcttac

SEQ ID NO: 6315 - DNA, 16 bp, Artificial Sequence
  synthetic [barcode part1]
gcgttcttcgacgatc

SEQ ID NO: 6316 - DNA, 16 bp, Artificial Sequence
  synthetic [barcode part1]
tacgtctctcaacagt

SEQ ID NO: 6317 - DNA, 16 bp, Artificial Sequence
  synthetic [barcode part1]
cgtggtacgaagttct

SEQ ID NO: 6318 - DNA, 16 bp, Artificial Sequence
  synthetic [barcode part1]
caaggagacacaccac

SEQ ID NO: 6319 - DNA, 16 bp, Artificial Sequence
  synthetic [barcode part1]
tcagtcctatcaacac

SEQ ID NO: 6320 - DNA, 16 bp, Artificial Sequence
  synthetic [barcode part1]
gaatctcgagagagag

SEQ ID NO: 6321 - DNA, 16 bp, Artificial Sequence
  synthetic [barcode part1]
taagaccgaccaactc

SEQ ID NO: 6322 - DNA, 16 bp, Artificial Sequence
  synthetic [barcode part1]
aatagagaaggaccgc

SEQ ID NO: 6323 - DNA, 16 bp, Artificial Sequence
  synthetic [barcode part1]
tgcgtagtgagaagtt

SEQ ID NO: 6324 - DNA, 16 bp, Artificial Sequence
  synthetic [barcode part1]
gcacttccaattcggc

SEQ ID NO: 6325 - DNA, 16 bp, Artificial Sequence
  synthetic [barcode part1]
ttggcaactcgacaac

SEQ ID NO: 6326 - DNA, 16 bp, Artificial Sequence
  synthetic [barcode part1]
aggaggcagtagtagt

SEQ ID NO: 6327 - DNA, 16 bp, Artificial Sequence
  synthetic [barcode part1]
ttgaagttcgtccgtt

SEQ ID NO: 6328 - DNA, 16 bp, Artificial Sequence
  synthetic [barcode part1]
tctaccaggttacgtt

SEQ ID NO: 6329 - DNA, 16 bp, Artificial Sequence
  synthetic [barcode part1]
gaggttccaggcaagt

SEQ ID NO: 6330 - DNA, 16 bp, Artificial Sequence
  synthetic [barcode part1]
tcgcaaggtgactgtt

SEQ ID NO: 6331 - DNA, 16 bp, Artificial Sequence
  synthetic [barcode part1]
actcctccacaattag

SEQ ID NO: 6332 - DNA, 16 bp, Artificial Sequence
  synthetic [barcode part1]
ttccggtgcacagttc

SEQ ID NO: 6333 - DNA, 16 bp, Artificial Sequence
  synthetic [barcode part1]
ttgagacgtaggtaac

SEQ ID NO: 6334 - DNA, 16 bp, Artificial Sequence
  synthetic [barcode part1]
attgtctcgttcgaac

SEQ ID NO: 6335 - DNA, 16 bp, Artificial Sequence
  synthetic [barcode part1]
tacgcggtactagtac

SEQ ID NO: 6336 - DNA, 16 bp, Artificial Sequence
  synthetic [barcode part1]
tacggtagtaggcgac

SEQ ID NO: 6337 - DNA, 16 bp, Artificial Sequence
  synthetic [barcode part1]
ttcgcaagaacagtag

SEQ ID NO: 6338 - DNA, 16 bp, Artificial Sequence
  synthetic [barcode part1]
taccaccgagtgttcc

SEQ ID NO: 6339 - DNA, 16 bp, Artificial Sequence
  synthetic [barcode part1]
tctcggtaggatagtc

SEQ ID NO: 6340 - DNA, 16 bp, Artificial Sequence
  synthetic [barcode part1]
ccttacgcggcaattc

SEQ ID NO: 6341 - DNA, 16 bp, Artificial Sequence
  synthetic [barcode part1]
gtcgtctggacaatac

SEQ ID NO: 6342 - DNA, 16 bp, Artificial Sequence
  synthetic [barcode part1]
gagtaatagtcgcgcg

SEQ ID NO: 6343 - DNA, 16 bp, Artificial Sequence
  synthetic [barcode part1]
taggacgtaagttcag

SEQ ID NO: 6344 - DNA, 16 bp, Artificial Sequence
  synthetic [barcode part1]
acactaacgacgaagt

SEQ ID NO: 6345 - DNA, 16 bp, Artificial Sequence
  synthetic [barcode part1]
cggaactgagagaagt

SEQ ID NO: 6346 - DNA, 16 bp, Artificial Sequence
  synthetic [barcode part1]
gtcaaggttccttgag

SEQ ID NO: 6347 - DNA, 16 bp, Artificial Sequence
  synthetic [barcode part1]
tgactggagttggtct

SEQ ID NO: 6348 - DNA, 16 bp, Artificial Sequence
  synthetic [barcode part1]
agtctggaccgaatct

SEQ ID NO: 6349 - DNA, 16 bp, Artificial Sequence
  synthetic [barcode part1]
cagaccggattatcac

SEQ ID NO: 6350 - DNA, 16 bp, Artificial Sequence
  synthetic [barcode part1]
aataacgccgtaagtg

SEQ ID NO: 6351 - DNA, 16 bp, Artificial Sequence
  synthetic [barcode part1]
ttcagttccgactctc

SEQ ID NO: 6352 - DNA, 16 bp, Artificial Sequence
  synthetic [barcode part1]
tcgtgaactgttactc

SEQ ID NO: 6353 - DNA, 16 bp, Artificial Sequence
  synthetic [barcode part1]
tattctgaagtctgcc

SEQ ID NO: 6354 - DNA, 16 bp, Artificial Sequence
  synthetic [barcode part1]
atctaatcggcggttg

SEQ ID NO: 6355 - DNA, 16 bp, Artificial Sequence
  synthetic [barcode part1]
actacaattcgcctgt

SEQ ID NO: 6356 - DNA, 16 bp, Artificial Sequence
  synthetic [barcode part1]
caacacaatcgcctcc

SEQ ID NO: 6357 - DNA, 16 bp, Artificial Sequence
  synthetic [barcode part1]
taggagacgcagtcgt

SEQ ID NO: 6358 - DNA, 16 bp, Artificial Sequence
  synthetic [barcode part1]
ttcgttagaagaccgc

SEQ ID NO: 6359 - DNA, 16 bp, Artificial Sequence
  synthetic [barcode part1]
attgttcctacgaacc

SEQ ID NO: 6360 - DNA, 16 bp, Artificial Sequence
  synthetic [barcode part1]
gcctgacagaagtacg

SEQ ID NO: 6361 - DNA, 16 bp, Artificial Sequence
  synthetic [barcode part1]
gcgtctcttgacaatt

SEQ ID NO: 6362 - DNA, 16 bp, Artificial Sequence
  synthetic [barcode part1]
tccacaatctgttacg

SEQ ID NO: 6363 - DNA, 16 bp, Artificial Sequence
  synthetic [barcode part1]
ttctgacggagtggtt

SEQ ID NO: 6364 - DNA, 16 bp, Artificial Sequence
  synthetic [barcode part1]
gcgattactccttggc

SEQ ID NO: 6365 - DNA, 16 bp, Artificial Sequence
  synthetic [barcode part1]
tcggaaggttactctg

SEQ ID NO: 6366 - DNA, 16 bp, Artificial Sequence
  synthetic [barcode part1]
gtagtgtagaagaggc

SEQ ID NO: 6367 - DNA, 16 bp, Artificial Sequence
  synthetic [barcode part1]
caatacggtgtagtcc

SEQ ID NO: 6368 - DNA, 16 bp, Artificial Sequence
  synthetic [barcode part1]
ccaacttgtaggacgt

SEQ ID NO: 6369 - DNA, 16 bp, Artificial Sequence
  synthetic [barcode part1]
gcgtgtcaagtcgaag

SEQ ID NO: 6370 - DNA, 16 bp, Artificial Sequence
  synthetic [barcode part1]
ttaagtatcgtcctgc

SEQ ID NO: 6371 - DNA, 16 bp, Artificial Sequence
  synthetic [barcode part1]
gcacttcttagtaacc

SEQ ID NO: 6372 - DNA, 16 bp, Artificial Sequence
  synthetic [barcode part1]
tccgtacaccaagtcc

SEQ ID NO: 6373 - DNA, 16 bp, Artificial Sequence
  synthetic [barcode part1]
agacgcaatactctcg

SEQ ID NO: 6374 - DNA, 16 bp, Artificial Sequence
  synthetic [barcode part1]
gaccttcttcctaacc

SEQ ID NO: 6375 - DNA, 16 bp, Artificial Sequence
  synthetic [barcode part1]
tacaggcggacaacgt

SEQ ID NO: 6376 - DNA, 16 bp, Artificial Sequence
  synthetic [barcode part1]
tcgataccacgtaacg

SEQ ID NO: 6377 - DNA, 16 bp, Artificial Sequence
  synthetic [barcode part1]
cctgattcacgaccgt

SEQ ID NO: 6378 - DNA, 16 bp, Artificial Sequence
  synthetic [barcode part1]
acgactaccagaaggc

SEQ ID NO: 6379 - DNA, 16 bp, Artificial Sequence
  synthetic [barcode part1]
gtatccacactatctg

SEQ ID NO: 6380 - DNA, 16 bp, Artificial Sequence
  synthetic [barcode part1]
actaccaacgtctccg

SEQ ID NO: 6381 - DNA, 16 bp, Artificial Sequence
  synthetic [barcode part1]
gccgtggatagtactt

SEQ ID NO: 6382 - DNA, 16 bp, Artificial Sequence
  synthetic [barcode part1]
tcagtgaagacacggc

SEQ ID NO: 6383 - DNA, 16 bp, Artificial Sequence
  synthetic [barcode part1]
agtccgacgcactctt

SEQ ID NO: 6384 - DNA, 16 bp, Artificial Sequence
  synthetic [barcode part1]
taactgcggatatccg

SEQ ID NO: 6385 - DNA, 16 bp, Artificial Sequence
  synthetic [barcode part1]
gaactgccgaatcgtt

SEQ ID NO: 6386 - DNA, 16 bp, Artificial Sequence
  synthetic [barcode part1]
tgacaatccgacggtt

SEQ ID NO: 6387 - DNA, 16 bp, Artificial Sequence
  synthetic [barcode part1]
tgtaggtataacggac

SEQ ID NO: 6388 - DNA, 16 bp, Artificial Sequence
  synthetic [barcode part1]
actaggttggaggcac

SEQ ID NO: 6389 - DNA, 16 bp, Artificial Sequence
  synthetic [barcode part1]
cagaatctaaccgacc

SEQ ID NO: 6390 - DNA, 16 bp, Artificial Sequence
  synthetic [barcode part1]
taggacctcctaaggt

SEQ ID NO: 6391 - DNA, 16 bp, Artificial Sequence
  synthetic [barcode part1]
gattcgtaccttactg

SEQ ID NO: 6392 - DNA, 16 bp, Artificial Sequence
  synthetic [barcode part1]
tctagtgacttggcag

SEQ ID NO: 6393 - DNA, 16 bp, Artificial Sequence
  synthetic [barcode part1]
gcgttcttcgaatcgc

SEQ ID NO: 6394 - DNA, 16 bp, Artificial Sequence
  synthetic [barcode part1]
acggaccgagaattgc

SEQ ID NO: 6395 - DNA, 16 bp, Artificial Sequence
  synthetic [barcode part1]
gtatctctcggcggtt

SEQ ID NO: 6396 - DNA, 16 bp, Artificial Sequence
  synthetic [barcode part1]
cactcaacgcagattg

SEQ ID NO: 6397 - DNA, 16 bp, Artificial Sequence
  synthetic [barcode part1]
tgcacagagactaagt

SEQ ID NO: 6398 - DNA, 16 bp, Artificial Sequence
  synthetic [barcode part1]
acgcaagtgttaagtg

SEQ ID NO: 6399 - DNA, 16 bp, Artificial Sequence
  synthetic [barcode part1]
attgccactctgcacg

SEQ ID NO: 6400 - DNA, 16 bp, Artificial Sequence
  synthetic [barcode part1]
cagattggttaccgac

SEQ ID NO: 6401 - DNA, 16 bp, Artificial Sequence
  synthetic [barcode part1]
gtccggtgttatcaag

SEQ ID NO: 6402 - DNA, 16 bp, Artificial Sequence
  synthetic [barcode part1]
caattccgtgccaatt

SEQ ID NO: 6403 - DNA, 16 bp, Artificial Sequence
  synthetic [barcode part1]
tgatcggcaataccgt

SEQ ID NO: 6404 - DNA, 16 bp, Artificial Sequence
  synthetic [barcode part1]
tccgatcgtcaacgtc

SEQ ID NO: 6405 - DNA, 16 bp, Artificial Sequence
  synthetic [barcode part1]
ccgtaatctccttctg

SEQ ID NO: 6406 - DNA, 16 bp, Artificial Sequence
  synthetic [barcode part1]
caataactggcggtct

SEQ ID NO: 6407 - DNA, 16 bp, Artificial Sequence
  synthetic [barcode part1]
gaactcagtctggatc

SEQ ID NO: 6408 - DNA, 16 bp, Artificial Sequence
  synthetic [barcode part1]
gtacggatctgtgttg

SEQ ID NO: 6409 - DNA, 16 bp, Artificial Sequence
  synthetic [barcode part1]
tgtgtgacctggttcc

SEQ ID NO: 6410 - DNA, 16 bp, Artificial Sequence
  synthetic [barcode part1]
atcttggccaaccaag

SEQ ID NO: 6411 - DNA, 16 bp, Artificial Sequence
  synthetic [barcode part1]
gaccaaccagtgttgt

SEQ ID NO: 6412 - DNA, 16 bp, Artificial Sequence
  synthetic [barcode part1]
acagtctataggaacg

SEQ ID NO: 6413 - DNA, 16 bp, Artificial Sequence
  synthetic [barcode part1]
gagttctgaggaagag

SEQ ID NO: 6414 - DNA, 16 bp, Artificial Sequence
  synthetic [barcode part1]
gatcacgtgtaaccgt

SEQ ID NO: 6415 - DNA, 16 bp, Artificial Sequence
  synthetic [barcode part1]
cacgattaaggtaacg

SEQ ID NO: 6416 - DNA, 16 bp, Artificial Sequence
  synthetic [barcode part1]
aggacaagacgcctgt

SEQ ID NO: 6417 - DNA, 16 bp, Artificial Sequence
  synthetic [barcode part1]
tcgccagtgtatctcg

SEQ ID NO: 6418 - DNA, 16 bp, Artificial Sequence
  synthetic [barcode part1]
actaacactaccacct

SEQ ID NO: 6419 - DNA, 16 bp, Artificial Sequence
  synthetic [barcode part1]
tgtcttaggattcacc

SEQ ID NO: 6420 - DNA, 16 bp, Artificial Sequence
  synthetic [barcode part1]
gcgaggacttcgtatt

SEQ ID NO: 6421 - DNA, 16 bp, Artificial Sequence
  synthetic [barcode part1]
caatagaggtggagtg

SEQ ID NO: 6422 - DNA, 16 bp, Artificial Sequence
  synthetic [barcode part1]
ttctgcctactcggag

SEQ ID NO: 6423 - DNA, 16 bp, Artificial Sequence
  synthetic [barcode part1]
agtcacagatctcttc

SEQ ID NO: 6424 - DNA, 16 bp, Artificial Sequence
  synthetic [barcode part1]
ttgagtgacagacctc

SEQ ID NO: 6425 - DNA, 16 bp, Artificial Sequence
  synthetic [barcode part1]
attacggaagtgagtc

SEQ ID NO: 6426 - DNA, 16 bp, Artificial Sequence
  synthetic [barcode part1]
atattgaggtcacgcc

SEQ ID NO: 6427 - DNA, 16 bp, Artificial Sequence
  synthetic [barcode part1]
aggaccacaacaagag

SEQ ID NO: 6428 - DNA, 16 bp, Artificial Sequence
  synthetic [barcode part1]
aagaactgttagtgcg

SEQ ID NO: 6429 - DNA, 16 bp, Artificial Sequence
  synthetic [barcode part1]
gaacttggtggaatac

SEQ ID NO: 6430 - DNA, 16 bp, Artificial Sequence
  synthetic [barcode part1]
tgtggaggatctggtg

SEQ ID NO: 6431 - DNA, 16 bp, Artificial Sequence
  synthetic [barcode part1]
gtgttagtaactctcc

SEQ ID NO: 6432 - DNA, 16 bp, Artificial Sequence
  synthetic [barcode part1]
atacagatcgcactcg

SEQ ID NO: 6433 - DNA, 16 bp, Artificial Sequence
  synthetic [barcode part1]
cggtagtctggtgatt

SEQ ID NO: 6434 - DNA, 16 bp, Artificial Sequence
  synthetic [barcode part1]
agttcgttccagacag

SEQ ID NO: 6435 - DNA, 16 bp, Artificial Sequence
  synthetic [barcode part1]
gagataagaactcgtc

SEQ ID NO: 6436 - DNA, 16 bp, Artificial Sequence
  synthetic [barcode part1]
ttaggtgtcgtctcgc

SEQ ID NO: 6437 - DNA, 16 bp, Artificial Sequence
  synthetic [barcode part1]
taactctccaggagac

SEQ ID NO: 6438 - DNA, 16 bp, Artificial Sequence
  synthetic [barcode part1]
gcgtaactcaatctct

SEQ ID NO: 6439 - DNA, 16 bp, Artificial Sequence
  synthetic [barcode part1]
cgttggaccacgttct

SEQ ID NO: 6440 - DNA, 16 bp, Artificial Sequence
  synthetic [barcode part1]
cctagagttgactggt

SEQ ID NO: 6441 - DNA, 16 bp, Artificial Sequence
  synthetic [barcode part1]
taatccggcctctgtg

SEQ ID NO: 6442 - DNA, 16 bp, Artificial Sequence
  synthetic [barcode part1]
ttgtcgttacctaggt

SEQ ID NO: 6443 - DNA, 16 bp, Artificial Sequence
  synthetic [barcode part1]
tatcgagatccttgtc

SEQ ID NO: 6444 - DNA, 16 bp, Artificial Sequence
  synthetic [barcode part1]
tgatcttgcgcgtcac

SEQ ID NO: 6445 - DNA, 16 bp, Artificial Sequence
  synthetic [barcode part1]
caacgccaagtgaacg

SEQ ID NO: 6446 - DNA, 16 bp, Artificial Sequence
  synthetic [barcode part1]
tgtctcaggacttact

SEQ ID NO: 6447 - DNA, 16 bp, Artificial Sequence
  synthetic [barcode part1]
ccgtctatactgcgac

SEQ ID NO: 6448 - DNA, 16 bp, Artificial Sequence
  synthetic [barcode part1]
agtgtataccgcgtgt

SEQ ID NO: 6449 - DNA, 16 bp, Artificial Sequence
  synthetic [barcode part1]
cgtattgtctcgaccg

SEQ ID NO: 6450 - DNA, 16 bp, Artificial Sequence
  synthetic [barcode part1]
cgaccaaggagttctt

SEQ ID NO: 6451 - DNA, 16 bp, Artificial Sequence
  synthetic [barcode part1]
ttacaggaacacgtcc

SEQ ID NO: 6452 - DNA, 16 bp, Artificial Sequence
  synthetic [barcode part1]
cacagacgacaggact

SEQ ID NO: 6453 - DNA, 16 bp, Artificial Sequence
  synthetic [barcode part1]
acggaagaccgaatcc

SEQ ID NO: 6454 - DNA, 16 bp, Artificial Sequence
  synthetic [barcode part1]
agaaggacacgtacag

SEQ ID NO: 6455 - DNA, 16 bp, Artificial Sequence
  synthetic [barcode part1]
ttgaacgtactgtctc

SEQ ID NO: 6456 - DNA, 16 bp, Artificial Sequence
  synthetic [barcode part1]
tcaccgtagacctgtc

SEQ ID NO: 6457 - DNA, 16 bp, Artificial Sequence
  synthetic [barcode part1]
gagtgaggcaacactc

SEQ ID NO: 6458 - DNA, 16 bp, Artificial Sequence
  synthetic [barcode part1]
tatagttacgcggtcg

SEQ ID NO: 6459 - DNA, 16 bp, Artificial Sequence
  synthetic [barcode part1]
ttgtaggagtgcgttc

SEQ ID NO: 6460 - DNA, 16 bp, Artificial Sequence
  synthetic [barcode part1]
gaagtggttcgagtgc

SEQ ID NO: 6461 - DNA, 16 bp, Artificial Sequence
  synthetic [barcode part1]
gcgagttccttcgact

SEQ ID NO: 6462 - DNA, 16 bp, Artificial Sequence
  synthetic [barcode part1]
tcgttacgccttgtct

SEQ ID NO: 6463 - DNA, 16 bp, Artificial Sequence
  synthetic [barcode part1]
ccggtacgactagaag

SEQ ID NO: 6464 - DNA, 16 bp, Artificial Sequence
  synthetic [barcode part1]
gcaactgatcgtacgt

SEQ ID NO: 6465 - DNA, 16 bp, Artificial Sequence
  synthetic [barcode part1]
cactgaagacgcgaac

SEQ ID NO: 6466 - DNA, 16 bp, Artificial Sequence
  synthetic [barcode part1]
cgcgtcttgtcaggtt

SEQ ID NO: 6467 - DNA, 16 bp, Artificial Sequence
  synthetic [barcode part1]
tcgcctattcgtctac

SEQ ID NO: 6468 - DNA, 16 bp, Artificial Sequence
  synthetic [barcode part1]
tagtaagacctgcaag

SEQ ID NO: 6469 - DNA, 16 bp, Artificial Sequence
  synthetic [barcode part1]
tcgccgttactgttct

SEQ ID NO: 6470 - DNA, 16 bp, Artificial Sequence
  synthetic [barcode part1]
gtctccaggtgacttc

SEQ ID NO: 6471 - DNA, 16 bp, Artificial Sequence
  synthetic [barcode part1]
ccagttattgaccgag

SEQ ID NO: 6472 - DNA, 16 bp, Artificial Sequence
  synthetic [barcode part1]
aacgaatctgtggtag

SEQ ID NO: 6473 - DNA, 16 bp, Artificial Sequence
  synthetic [barcode part1]
tccacaagtaagtccg

SEQ ID NO: 6474 - DNA, 16 bp, Artificial Sequence
  synthetic [barcode part1]
tacttctggttcaacg

SEQ ID NO: 6475 - DNA, 16 bp, Artificial Sequence
  synthetic [barcode part1]
tagacactgcagactc

SEQ ID NO: 6476 - DNA, 16 bp, Artificial Sequence
  synthetic [barcode part1]
caccaagtgccttcgt

SEQ ID NO: 6477 - DNA, 16 bp, Artificial Sequence
  synthetic [barcode part1]
cgtgaacttacggact

SEQ ID NO: 6478 - DNA, 16 bp, Artificial Sequence
  synthetic [barcode part1]
atacaatcggtcgtgc

SEQ ID NO: 6479 - DNA, 16 bp, Artificial Sequence
  synthetic [barcode part1]
tctccagttgacttcc

SEQ ID NO: 6480 - DNA, 16 bp, Artificial Sequence
  synthetic [barcode part1]
gtccgagtaagtactc

SEQ ID NO: 6481 - DNA, 16 bp, Artificial Sequence
  synthetic [barcode part1]
tctccaagactcctct

SEQ ID NO: 6482 - DNA, 16 bp, Artificial Sequence
  synthetic [barcode part1]
gtaagtcgatctgcac

SEQ ID NO: 6483 - DNA, 16 bp, Artificial Sequence
  synthetic [barcode part1]
tgtgtaaggcacacct

SEQ ID NO: 6484 - DNA, 16 bp, Artificial Sequence
  synthetic [barcode part1]
aatcacgatcacgtgc

SEQ ID NO: 6485 - DNA, 16 bp, Artificial Sequence
  synthetic [barcode part1]
tgtcttgactctgcct

SEQ ID NO: 6486 - DNA, 16 bp, Artificial Sequence
  synthetic [barcode part1]
tctcacggaccgttac

SEQ ID NO: 6487 - DNA, 16 bp, Artificial Sequence
  synthetic [barcode part1]
cacgacacctgaagtt

SEQ ID NO: 6488 - DNA, 16 bp, Artificial Sequence
  synthetic [barcode part1]
tctcgatcctctgact

SEQ ID NO: 6489 - DNA, 16 bp, Artificial Sequence
  synthetic [barcode part1]
attctgttagatccgc

SEQ ID NO: 6490 - DNA, 16 bp, Artificial Sequence
  synthetic [barcode part1]
tcttacaccttgcacc

SEQ ID NO: 6491 - DNA, 16 bp, Artificial Sequence
  synthetic [barcode part1]
tcctaatctgagtgtc

SEQ ID NO: 6492 - DNA, 16 bp, Artificial Sequence
  synthetic [barcode part1]
caggtgccaatctctc

SEQ ID NO: 6493 - DNA, 16 bp, Artificial Sequence
  synthetic [barcode part1]
attggcaatagtcgcc

SEQ ID NO: 6494 - DNA, 16 bp, Artificial Sequence
  synthetic [barcode part1]
gataattggccaccac

SEQ ID NO: 6495 - DNA, 16 bp, Artificial Sequence
  synthetic [barcode part1]
atagaggcgataacct

SEQ ID NO: 6496 - DNA, 16 bp, Artificial Sequence
  synthetic [barcode part1]
gagtaggtctaagatc

SEQ ID NO: 6497 - DNA, 16 bp, Artificial Sequence
  synthetic [barcode part1]
acacttctctccacgt

SEQ ID NO: 6498 - DNA, 16 bp, Artificial Sequence
  synthetic [barcode part1]
ttcgacagtcctcgtg

SEQ ID NO: 6499 - DNA, 16 bp, Artificial Sequence
  synthetic [barcode part1]
tgcgttatacacggtg

SEQ ID NO: 6500 - DNA, 16 bp, Artificial Sequence
  synthetic [barcode part1]
tgaagaactaggaggc

SEQ ID NO: 6501 - DNA, 16 bp, Artificial Sequence
  synthetic [barcode part1]
ttgttcaaggtggacc

SEQ ID NO: 6502 - DNA, 16 bp, Artificial Sequence
  synthetic [barcode part1]
gcactaggtcacctct

SEQ ID NO: 6503 - DNA, 16 bp, Artificial Sequence
  synthetic [barcode part1]
gaccaatcaatcgacc

SEQ ID NO: 6504 - DNA, 16 bp, Artificial Sequence
  synthetic [barcode part1]
tctccaagaggagtct

SEQ ID NO: 6505 - DNA, 16 bp, Artificial Sequence
  synthetic [barcode part1]
cagaactgagaggaac

SEQ ID NO: 6506 - DNA, 16 bp, Artificial Sequence
  synthetic [barcode part1]
tgtacagtgttccgcc

SEQ ID NO: 6507 - DNA, 16 bp, Artificial Sequence
  synthetic [barcode part1]
gtgagaaggttgttgt

SEQ ID NO: 6508 - DNA, 16 bp, Artificial Sequence
  synthetic [barcode part1]
ccgataagagtacggc

SEQ ID NO: 6509 - DNA, 16 bp, Artificial Sequence
  synthetic [barcode part1]
attcggatcactctac

SEQ ID NO: 6510 - DNA, 16 bp, Artificial Sequence
  synthetic [barcode part1]
ccttggtcgatagaac

SEQ ID NO: 6511 - DNA, 16 bp, Artificial Sequence
  synthetic [barcode part1]
tgcaactgagaactag

SEQ ID NO: 6512 - DNA, 16 bp, Artificial Sequence
  synthetic [barcode part1]
gttacagttgtccgcc

SEQ ID NO: 6513 - DNA, 16 bp, Artificial Sequence
  synthetic [barcode part1]
taaggtccgtgtgtac

SEQ ID NO: 6514 - DNA, 16 bp, Artificial Sequence
  synthetic [barcode part1]
gaactacgttcaacgc

SEQ ID NO: 6515 - DNA, 16 bp, Artificial Sequence
  synthetic [barcode part1]
cactaccgttcgaacc

SEQ ID NO: 6516 - DNA, 16 bp, Artificial Sequence
  synthetic [barcode part1]
gattggcaggatctct

SEQ ID NO: 6517 - DNA, 16 bp, Artificial Sequence
  synthetic [barcode part1]
tgccttgactcgcaac

SEQ ID NO: 6518 - DNA, 16 bp, Artificial Sequence
  synthetic [barcode part1]
caactgactagagtcc

SEQ ID NO: 6519 - DNA, 16 bp, Artificial Sequence
  synthetic [barcode part1]
gaagtgcaccggattg

SEQ ID NO: 6520 - DNA, 16 bp, Artificial Sequence
  synthetic [barcode part1]
gcaattgtcctagttc

SEQ ID NO: 6521 - DNA, 16 bp, Artificial Sequence
  synthetic [barcode part1]
tcgtattgcaggaacc

SEQ ID NO: 6522 - DNA, 16 bp, Artificial Sequence
  synthetic [barcode part1]
acagttgagaaggttc

SEQ ID NO: 6523 - DNA, 16 bp, Artificial Sequence
  synthetic [barcode part1]
tcctgtgccaacagtc

SEQ ID NO: 6524 - DNA, 16 bp, Artificial Sequence
  synthetic [barcode part1]
ttggatacgagacagt

SEQ ID NO: 6525 - DNA, 16 bp, Artificial Sequence
  synthetic [barcode part1]
tccaccttgtctgttg

SEQ ID NO: 6526 - DNA, 16 bp, Artificial Sequence
  synthetic [barcode part1]
cgtacaggaacgttct

SEQ ID NO: 6527 - DNA, 16 bp, Artificial Sequence
  synthetic [barcode part1]
gtcttgcactcgagtc

SEQ ID NO: 6528 - DNA, 16 bp, Artificial Sequence
  synthetic [barcode part1]
cagtacgatcgttctt

SEQ ID NO: 6529 - DNA, 16 bp, Artificial Sequence
  synthetic [barcode part1]
tcgaacgtatccgagt

SEQ ID NO: 6530 - DNA, 16 bp, Artificial Sequence
  synthetic [barcode part1]
tagagaggcactgatt

SEQ ID NO: 6531 - DNA, 16 bp, Artificial Sequence
  synthetic [barcode part1]
tcacagatatcctacc

SEQ ID NO: 6532 - DNA, 16 bp, Artificial Sequence
  synthetic [barcode part1]
atcgcaggaatctcgt

SEQ ID NO: 6533 - DNA, 16 bp, Artificial Sequence
  synthetic [barcode part1]
cgttccgatcttgtct

SEQ ID NO: 6534 - DNA, 16 bp, Artificial Sequence
  synthetic [barcode part1]
cgagtgaatctactcg

SEQ ID NO: 6535 - DNA, 16 bp, Artificial Sequence
  synthetic [barcode part1]
ccttctctaacgtcgt

SEQ ID NO: 6536 - DNA, 16 bp, Artificial Sequence
  synthetic [barcode part1]
cagacgagtcctagag

SEQ ID NO: 6537 - DNA, 16 bp, Artificial Sequence
  synthetic [barcode part1]
ttgactgtacgcgtag

SEQ ID NO: 6538 - DNA, 16 bp, Artificial Sequence
  synthetic [barcode part1]
cgttcgtgtcttggac

SEQ ID NO: 6539 - DNA, 16 bp, Artificial Sequence
  synthetic [barcode part1]
agttgtgcacacaacc

SEQ ID NO: 6540 - DNA, 16 bp, Artificial Sequence
  synthetic [barcode part1]
gatatagttcggcaag

SEQ ID NO: 6541 - DNA, 16 bp, Artificial Sequence
  synthetic [barcode part1]
tcgacgcagagtcaag

SEQ ID NO: 6542 - DNA, 16 bp, Artificial Sequence
  synthetic [barcode part1]
acacacttcactgccg

SEQ ID NO: 6543 - DNA, 16 bp, Artificial Sequence
  synthetic [barcode part1]
aactcgacaacttggc

SEQ ID NO: 6544 - DNA, 16 bp, Artificial Sequence
  synthetic [barcode part1]
tattcgcaggttctgt

SEQ ID NO: 6545 - DNA, 16 bp, Artificial Sequence
  synthetic [barcode part1]
tcttcagagtcggagt

SEQ ID NO: 6546 - DNA, 16 bp, Artificial Sequence
  synthetic [barcode part1]
gacaatacttaggcag

SEQ ID NO: 6547 - DNA, 16 bp, Artificial Sequence
  synthetic [barcode part1]
tctgacaacttggcag

SEQ ID NO: 6548 - DNA, 16 bp, Artificial Sequence
  synthetic [barcode part1]
gagtcgttattctcgt

SEQ ID NO: 6549 - DNA, 16 bp, Artificial Sequence
  synthetic [barcode part1]
aagatccgataccacc

SEQ ID NO: 6550 - DNA, 16 bp, Artificial Sequence
  synthetic [barcode part1]
gcgccttgtcgaactt

SEQ ID NO: 6551 - DNA, 16 bp, Artificial Sequence
  synthetic [barcode part1]
cgagtgcgaagtaacc

SEQ ID NO: 6552 - DNA, 16 bp, Artificial Sequence
  synthetic [barcode part1]
aatctcgtacttaccg

SEQ ID NO: 6553 - DNA, 16 bp, Artificial Sequence
  synthetic [barcode part1]
tgcagatcctaggtac

SEQ ID NO: 6554 - DNA, 16 bp, Artificial Sequence
  synthetic [barcode part1]
atctaggtccgtcacc

SEQ ID NO: 6555 - DNA, 16 bp, Artificial Sequence
  synthetic [barcode part1]
gtaatcggttgtgtgc

SEQ ID NO: 6556 - DNA, 16 bp, Artificial Sequence
  synthetic [barcode part1]
gcgtgatccagtcctt

SEQ ID NO: 6557 - DNA, 16 bp, Artificial Sequence
  synthetic [barcode part1]
ccgagaatcagtatag

SEQ ID NO: 6558 - DNA, 16 bp, Artificial Sequence
  synthetic [barcode part1]
agagttcggtgagtgc

SEQ ID NO: 6559 - DNA, 16 bp, Artificial Sequence
  synthetic [barcode part1]
tgttatcgtgatcacc

SEQ ID NO: 6560 - DNA, 16 bp, Artificial Sequence
  synthetic [barcode part1]
aacttggtcaggtcac

SEQ ID NO: 6561 - DNA, 16 bp, Artificial Sequence
  synthetic [barcode part1]
ttgtatctctagtggc

SEQ ID NO: 6562 - DNA, 16 bp, Artificial Sequence
  synthetic [barcode part1]
ccagaatctgtctatc

SEQ ID NO: 6563 - DNA, 16 bp, Artificial Sequence
  synthetic [barcode part1]
agtacaaggtgcagag

SEQ ID NO: 6564 - DNA, 16 bp, Artificial Sequence
  synthetic [barcode part1]
gttcgtaagaacggcg

SEQ ID NO: 6565 - DNA, 16 bp, Artificial Sequence
  synthetic [barcode part1]
tcggattgattcggtg

SEQ ID NO: 6566 - DNA, 16 bp, Artificial Sequence
  synthetic [barcode part1]
actccactcgcacaac

SEQ ID NO: 6567 - DNA, 16 bp, Artificial Sequence
  synthetic [barcode part1]
cgtctctaggatacag

SEQ ID NO: 6568 - DNA, 16 bp, Artificial Sequence
  synthetic [barcode part1]
tgccaataggactaag

SEQ ID NO: 6569 - DNA, 16 bp, Artificial Sequence
  synthetic [barcode part1]
tgtcgtcctatacaac

SEQ ID NO: 6570 - DNA, 16 bp, Artificial Sequence
  synthetic [barcode part1]
gataagatcgaacacc

SEQ ID NO: 6571 - DNA, 16 bp, Artificial Sequence
  synthetic [barcode part1]
gtaggcaagatagacg

SEQ ID NO: 6572 - DNA, 16 bp, Artificial Sequence
  synthetic [barcode part1]
agttcttctgatacgc

SEQ ID NO: 6573 - DNA, 16 bp, Artificial Sequence
  synthetic [barcode part1]
ttggcgacctacacct

SEQ ID NO: 6574 - DNA, 16 bp, Artificial Sequence
  synthetic [barcode part1]
gtcgtcggattactag

SEQ ID NO: 6575 - DNA, 16 bp, Artificial Sequence
  synthetic [barcode part1]
attggcaacctagacc

SEQ ID NO: 6576 - DNA, 16 bp, Artificial Sequence
  synthetic [barcode part1]
tacgcgatctggcctt

SEQ ID NO: 6577 - DNA, 16 bp, Artificial Sequence
  synthetic [barcode part1]
tgtaacacaggtgagt

SEQ ID NO: 6578 - DNA, 16 bp, Artificial Sequence
  synthetic [barcode part1]
gagtgagagacttcgc

SEQ ID NO: 6579 - DNA, 16 bp, Artificial Sequence
  synthetic [barcode part1]
tccacaacttgttgtg

SEQ ID NO: 6580 - DNA, 16 bp, Artificial Sequence
  synthetic [barcode part1]
attatccaacactcgc

SEQ ID NO: 6581 - DNA, 16 bp, Artificial Sequence
  synthetic [barcode part1]
ttggtccggtacgttc

SEQ ID NO: 6582 - DNA, 16 bp, Artificial Sequence
  synthetic [barcode part1]
ccgacgtagtcagaag

SEQ ID NO: 6583 - DNA, 16 bp, Artificial Sequence
  synthetic [barcode part1]
gataattgatccggcc

SEQ ID NO: 6584 - DNA, 16 bp, Artificial Sequence
  synthetic [barcode part1]
tctgattgcaccggtc

SEQ ID NO: 6585 - DNA, 16 bp, Artificial Sequence
  synthetic [barcode part1]
tagtgcggtgcaactt

SEQ ID NO: 6586 - DNA, 16 bp, Artificial Sequence
  synthetic [barcode part1]
cgattggtcgagatct

SEQ ID NO: 6587 - DNA, 16 bp, Artificial Sequence
  synthetic [barcode part1]
tcagtccggattagac

SEQ ID NO: 6588 - DNA, 16 bp, Artificial Sequence
  synthetic [barcode part1]
taattgtccacgcgag

SEQ ID NO: 6589 - DNA, 16 bp, Artificial Sequence
  synthetic [barcode part1]
aactggtgttggttgc

SEQ ID NO: 6590 - DNA, 16 bp, Artificial Sequence
  synthetic [barcode part1]
gagaccttctggaact

SEQ ID NO: 6591 - DNA, 16 bp, Artificial Sequence
  synthetic [barcode part1]
ttccaagtactcgccg

SEQ ID NO: 6592 - DNA, 16 bp, Artificial Sequence
  synthetic [barcode part1]
gtaccttgcacagagt

SEQ ID NO: 6593 - DNA, 16 bp, Artificial Sequence
  synthetic [barcode part1]
atcgtgattactcgtc

SEQ ID NO: 6594 - DNA, 16 bp, Artificial Sequence
  synthetic [barcode part1]
cgtaacaagattccgc

SEQ ID NO: 6595 - DNA, 16 bp, Artificial Sequence
  synthetic [barcode part1]
taagtcgttcctgcgc

SEQ ID NO: 6596 - DNA, 16 bp, Artificial Sequence
  synthetic [barcode part1]
tcctccacttgatctg

SEQ ID NO: 6597 - DNA, 16 bp, Artificial Sequence
  synthetic [barcode part1]
accgttaggtcactag

SEQ ID NO: 6598 - DNA, 16 bp, Artificial Sequence
  synthetic [barcode part1]
cacaagtcgagtactc

SEQ ID NO: 6599 - DNA, 16 bp, Artificial Sequence
  synthetic [barcode part1]
cactaagtgtcgaacc

SEQ ID NO: 6600 - DNA, 16 bp, Artificial Sequence
  synthetic [barcode part1]
tctatcgtacgtcagt

SEQ ID NO: 6601 - DNA, 16 bp, Artificial Sequence
  synthetic [barcode part1]
caggtaccgatctcct

SEQ ID NO: 6602 - DNA, 16 bp, Artificial Sequence
  synthetic [barcode part1]
taccgccgtaattgtt

SEQ ID NO: 6603 - DNA, 16 bp, Artificial Sequence
  synthetic [barcode part1]
atagttgtcttggcct

SEQ ID NO: 6604 - DNA, 16 bp, Artificial Sequence
  synthetic [barcode part1]
aggaccagttgaagag

SEQ ID NO: 6605 - DNA, 16 bp, Artificial Sequence
  synthetic [barcode part1]
tctcgatcgtatcagt

SEQ ID NO: 6606 - DNA, 16 bp, Artificial Sequence
  synthetic [barcode part1]
gcacagaattcggcag

SEQ ID NO: 6607 - DNA, 16 bp, Artificial Sequence
  synthetic [barcode part1]
gtagttcctgtgcctg

SEQ ID NO: 6608 - DNA, 16 bp, Artificial Sequence
  synthetic [barcode part1]
tactctatccgtcgtc

SEQ ID NO: 6609 - DNA, 16 bp, Artificial Sequence
  synthetic [barcode part1]
aacctcacgcctatcg

SEQ ID NO: 6610 - DNA, 16 bp, Artificial Sequence
  synthetic [barcode part1]
actacggtaagtgagt

SEQ ID NO: 6611 - DNA, 16 bp, Artificial Sequence
  synthetic [barcode part1]
gtgacttcgtctccag

SEQ ID NO: 6612 - DNA, 16 bp, Artificial Sequence
  synthetic [barcode part1]
agaagtggagtgtggt

SEQ ID NO: 6613 - DNA, 16 bp, Artificial Sequence
  synthetic [barcode part1]
tggcgacgttatcaac

SEQ ID NO: 6614 - DNA, 16 bp, Artificial Sequence
  synthetic [barcode part1]
tcaacacacactggtg

SEQ ID NO: 6615 - DNA, 16 bp, Artificial Sequence
  synthetic [barcode part1]
aattgacggcctcagt

SEQ ID NO: 6616 - DNA, 16 bp, Artificial Sequence
  synthetic [barcode part1]
acggttatcctgattc

SEQ ID NO: 6617 - DNA, 16 bp, Artificial Sequence
  synthetic [barcode part1]
gactatcagtgtagag

SEQ ID NO: 6618 - DNA, 16 bp, Artificial Sequence
  synthetic [barcode part1]
agttaccacctccgtg

SEQ ID NO: 6619 - DNA, 16 bp, Artificial Sequence
  synthetic [barcode part1]
tgattgcggactggag

SEQ ID NO: 6620 - DNA, 16 bp, Artificial Sequence
  synthetic [barcode part1]
acaatcaaggatcggt

SEQ ID NO: 6621 - DNA, 16 bp, Artificial Sequence
  synthetic [barcode part1]
cacctcgtactgtctt

SEQ ID NO: 6622 - DNA, 16 bp, Artificial Sequence
  synthetic [barcode part1]
acgtgcctactgatag

SEQ ID NO: 6623 - DNA, 16 bp, Artificial Sequence
  synthetic [barcode part1]
cagttgtaatacgccg

SEQ ID NO: 6624 - DNA, 16 bp, Artificial Sequence
  synthetic [barcode part1]
acgtatcctcgtagag

SEQ ID NO: 6625 - DNA, 16 bp, Artificial Sequence
  synthetic [barcode part1]
actacgactatccgcc

SEQ ID NO: 6626 - DNA, 16 bp, Artificial Sequence
  synthetic [barcode part1]
cgaaggacgcacaatc

SEQ ID NO: 6627 - DNA, 16 bp, Artificial Sequence
  synthetic [barcode part1]
gaggacgtaccaggtt

SEQ ID NO: 6628 - DNA, 16 bp, Artificial Sequence
  synthetic [barcode part1]
cacgtaggaacacctt

SEQ ID NO: 6629 - DNA, 16 bp, Artificial Sequence
  synthetic [barcode part1]
tctgcgcgactcaact

SEQ ID NO: 6630 - DNA, 16 bp, Artificial Sequence
  synthetic [barcode part1]
ccaagagtgcgttgag

SEQ ID NO: 6631 - DNA, 16 bp, Artificial Sequence
  synthetic [barcode part1]
tacacacacgtgtgtg

SEQ ID NO: 6632 - DNA, 16 bp, Artificial Sequence
  synthetic [barcode part1]
actacggtcgtctatt

SEQ ID NO: 6633 - DNA, 16 bp, Artificial Sequence
  synthetic [barcode part1]
atcgtgagtgagtggc

SEQ ID NO: 6634 - DNA, 16 bp, Artificial Sequence
  synthetic [barcode part1]
aggcgtagactaccag

SEQ ID NO: 6635 - DNA, 16 bp, Artificial Sequence
  synthetic [barcode part1]
gtgaaggttgatagtc

SEQ ID NO: 6636 - DNA, 16 bp, Artificial Sequence
  synthetic [barcode part1]
tgacttgtcgtgcctg

SEQ ID NO: 6637 - DNA, 16 bp, Artificial Sequence
  synthetic [barcode part1]
caggactgtcaactgt

SEQ ID NO: 6638 - DNA, 16 bp, Artificial Sequence
  synthetic [barcode part1]
ccttgtgaccactgac

SEQ ID NO: 6639 - DNA, 16 bp, Artificial Sequence
  synthetic [barcode part1]
accttccttgagagag

SEQ ID NO: 6640 - DNA, 16 bp, Artificial Sequence
  synthetic [barcode part1]
cgaggagtggttacgt

SEQ ID NO: 6641 - DNA, 16 bp, Artificial Sequence
  synthetic [barcode part1]
tctcggttacaccgac

SEQ ID NO: 6642 - DNA, 16 bp, Artificial Sequence
  synthetic [barcode part1]
tgaggaaccagtcctt

SEQ ID NO: 6643 - DNA, 16 bp, Artificial Sequence
  synthetic [barcode part1]
caggactaaccttggt

SEQ ID NO: 6644 - DNA, 16 bp, Artificial Sequence
  synthetic [barcode part1]
acctgcgaaggactag

SEQ ID NO: 6645 - DNA, 16 bp, Artificial Sequence
  synthetic [barcode part1]
actcaagtgttactcc

SEQ ID NO: 6646 - DNA, 16 bp, Artificial Sequence
  synthetic [barcode part1]
tgcgtcgtagtatacg

SEQ ID NO: 6647 - DNA, 16 bp, Artificial Sequence
  synthetic [barcode part1]
tcttctaaggtgttcg

SEQ ID NO: 6648 - DNA, 16 bp, Artificial Sequence
  synthetic [barcode part1]
gcaaggactggtagtc

SEQ ID NO: 6649 - DNA, 16 bp, Artificial Sequence
  synthetic [barcode part1]
acagtcaaccagtacc

SEQ ID NO: 6650 - DNA, 16 bp, Artificial Sequence
  synthetic [barcode part1]
tagtggtccaagttgc

SEQ ID NO: 6651 - DNA, 16 bp, Artificial Sequence
  synthetic [barcode part1]
gataagaccaatacgc

SEQ ID NO: 6652 - DNA, 16 bp, Artificial Sequence
  synthetic [barcode part1]
tgacacgttaggcact

SEQ ID NO: 6653 - DNA, 16 bp, Artificial Sequence
  synthetic [barcode part1]
gtaactaggtcgaagt

SEQ ID NO: 6654 - DNA, 16 bp, Artificial Sequence
  synthetic [barcode part1]
cctacctcctagagtg

SEQ ID NO: 6655 - DNA, 16 bp, Artificial Sequence
  synthetic [barcode part1]
gagataaggcgcctac

SEQ ID NO: 6656 - DNA, 16 bp, Artificial Sequence
  synthetic [barcode part1]
tgagatatcacgtgag

SEQ ID NO: 6657 - DNA, 16 bp, Artificial Sequence
  synthetic [barcode part1]
tggcgtcttgtagtag

SEQ ID NO: 6658 - DNA, 16 bp, Artificial Sequence
  synthetic [barcode part1]
agtcaataccgcgact

SEQ ID NO: 6659 - DNA, 16 bp, Artificial Sequence
  synthetic [barcode part1]
tcgagaccagaatcct

SEQ ID NO: 6660 - DNA, 16 bp, Artificial Sequence
  synthetic [barcode part1]
cgtactactcttcaag

SEQ ID NO: 6661 - DNA, 16 bp, Artificial Sequence
  synthetic [barcode part1]
cgttgattcaatctcg

SEQ ID NO: 6662 - DNA, 16 bp, Artificial Sequence
  synthetic [barcode part1]
tcggtgacagaggtgt

SEQ ID NO: 6663 - DNA, 16 bp, Artificial Sequence
  synthetic [barcode part1]
caacctcaagaggttc

SEQ ID NO: 6664 - DNA, 16 bp, Artificial Sequence
  synthetic [barcode part1]
gcacaagtgaggatag

SEQ ID NO: 6665 - DNA, 16 bp, Artificial Sequence
  synthetic [barcode part1]
cgtggatctgcaagtt

SEQ ID NO: 6666 - DNA, 16 bp, Artificial Sequence
  synthetic [barcode part1]
tggagtgacttaagtg

SEQ ID NO: 6667 - DNA, 16 bp, Artificial Sequence
  synthetic [barcode part1]
cgatcgatacgacgtt

SEQ ID NO: 6668 - DNA, 16 bp, Artificial Sequence
  synthetic [barcode part1]
tcgaacacctaccacc

SEQ ID NO: 6669 - DNA, 16 bp, Artificial Sequence
  synthetic [barcode part1]
ccaatccaagtgcctc

SEQ ID NO: 6670 - DNA, 16 bp, Artificial Sequence
  synthetic [barcode part1]
aggacgtggttcaacg

SEQ ID NO: 6671 - DNA, 16 bp, Artificial Sequence
  synthetic [barcode part1]
atcaaccgtgtacgtg

SEQ ID NO: 6672 - DNA, 16 bp, Artificial Sequence
  synthetic [barcode part1]
aggcaacgtacaaccg

SEQ ID NO: 6673 - DNA, 16 bp, Artificial Sequence
  synthetic [barcode part1]
acgagttgttatctcc

SEQ ID NO: 6674 - DNA, 16 bp, Artificial Sequence
  synthetic [barcode part1]
aacactgtgcagtgtc

SEQ ID NO: 6675 - DNA, 16 bp, Artificial Sequence
  synthetic [barcode part1]
aacaccgaactctggt

SEQ ID NO: 6676 - DNA, 16 bp, Artificial Sequence
  synthetic [barcode part1]
cagatacctcttagtc

SEQ ID NO: 6677 - DNA, 16 bp, Artificial Sequence
  synthetic [barcode part1]
tcaagacacttcaggc

SEQ ID NO: 6678 - DNA, 16 bp, Artificial Sequence
  synthetic [barcode part1]
gttgtctggcaagact

SEQ ID NO: 6679 - DNA, 16 bp, Artificial Sequence
  synthetic [barcode part1]
ccagagtgtagtgtct

SEQ ID NO: 6680 - DNA, 16 bp, Artificial Sequence
  synthetic [barcode part1]
tatctggcacgttgag

SEQ ID NO: 6681 - DNA, 16 bp, Artificial Sequence
  synthetic [barcode part1]
aagtccggtagtcact

SEQ ID NO: 6682 - DNA, 16 bp, Artificial Sequence
  synthetic [barcode part1]
tcggtctgttcaggtc

SEQ ID NO: 6683 - DNA, 16 bp, Artificial Sequence
  synthetic [barcode part1]
cactaagtaagtcgcc

SEQ ID NO: 6684 - DNA, 16 bp, Artificial Sequence
  synthetic [barcode part1]
tctagaggaccaatcc

SEQ ID NO: 6685 - DNA, 16 bp, Artificial Sequence
  synthetic [barcode part1]
cctgagataaccgact

SEQ ID NO: 6686 - DNA, 16 bp, Artificial Sequence
  synthetic [barcode part1]
aacgcaccaatcacgt

SEQ ID NO: 6687 - DNA, 16 bp, Artificial Sequence
  synthetic [barcode part1]
gacaggtcttacctag

SEQ ID NO: 6688 - DNA, 16 bp, Artificial Sequence
  synthetic [barcode part1]
cctcgcgtatatcttc

SEQ ID NO: 6689 - DNA, 16 bp, Artificial Sequence
  synthetic [barcode part1]
cgtgtgattgtacggt

SEQ ID NO: 6690 - DNA, 16 bp, Artificial Sequence
  synthetic [barcode part1]
tgaccagaactggtct

SEQ ID NO: 6691 - DNA, 16 bp, Artificial Sequence
  synthetic [barcode part1]
ccggaaccacctattc

SEQ ID NO: 6692 - DNA, 16 bp, Artificial Sequence
  synthetic [barcode part1]
aataactcgtgtctcc

SEQ ID NO: 6693 - DNA, 16 bp, Artificial Sequence
  synthetic [barcode part1]
cacgtcgactatacag

SEQ ID NO: 6694 - DNA, 16 bp, Artificial Sequence
  synthetic [barcode part1]
tctgtacgccgagtct

SEQ ID NO: 6695 - DNA, 16 bp, Artificial Sequence
  synthetic [barcode part1]
gagttgtcgtcaagtc

SEQ ID NO: 6696 - DNA, 16 bp, Artificial Sequence
  synthetic [barcode part1]
acaaggacgcacttct

SEQ ID NO: 6697 - DNA, 16 bp, Artificial Sequence
  synthetic [barcode part1]
gcacgacagttaaggc

SEQ ID NO: 6698 - DNA, 16 bp, Artificial Sequence
  synthetic [barcode part1]
cgttcacagtactgcc

SEQ ID NO: 6699 - DNA, 16 bp, Artificial Sequence
  synthetic [barcode part1]
gaacgactcctgttag

SEQ ID NO: 6700 - DNA, 16 bp, Artificial Sequence
  synthetic [barcode part1]
tccgaatataggacag

SEQ ID NO: 6701 - DNA, 16 bp, Artificial Sequence
  synthetic [barcode part1]
cctatagactccaccg

SEQ ID NO: 6702 - DNA, 16 bp, Artificial Sequence
  synthetic [barcode part1]
tacacgtgacttcgag

SEQ ID NO: 6703 - DNA, 16 bp, Artificial Sequence
  synthetic [barcode part1]
atcagaccagactacc

SEQ ID NO: 6704 - DNA, 16 bp, Artificial Sequence
  synthetic [barcode part1]
tgttgttgcggtcacc

SEQ ID NO: 6705 - DNA, 16 bp, Artificial Sequence
  synthetic [barcode part1]
aagatagttcgagtgc

SEQ ID NO: 6706 - DNA, 16 bp, Artificial Sequence
  synthetic [barcode part1]
acgaattcgatcctct

SEQ ID NO: 6707 - DNA, 16 bp, Artificial Sequence
  synthetic [barcode part1]
gccgtctagtaggatt

SEQ ID NO: 6708 - DNA, 16 bp, Artificial Sequence
  synthetic [barcode part1]
tctaggtcacctcgtg

SEQ ID NO: 6709 - DNA, 16 bp, Artificial Sequence
  synthetic [barcode part1]
ccaccagtccttacag

SEQ ID NO: 6710 - DNA, 16 bp, Artificial Sequence
  synthetic [barcode part1]
cactatcacgactact

SEQ ID NO: 6711 - DNA, 16 bp, Artificial Sequence
  synthetic [barcode part1]
ttctactcgtcactcg

SEQ ID NO: 6712 - DNA, 16 bp, Artificial Sequence
  synthetic [barcode part1]
ttcttcaacagtcacg

SEQ ID NO: 6713 - DNA, 16 bp, Artificial Sequence
  synthetic [barcode part1]
ttctgatagttcacgc

SEQ ID NO: 6714 - DNA, 16 bp, Artificial Sequence
  synthetic [barcode part1]
gaattcactcggtctt

SEQ ID NO: 6715 - DNA, 16 bp, Artificial Sequence
  synthetic [barcode part1]
tcaactgcaacaccag

SEQ ID NO: 6716 - DNA, 16 bp, Artificial Sequence
  synthetic [barcode part1]
tcactatattcacggc

SEQ ID NO: 6717 - DNA, 16 bp, Artificial Sequence
  synthetic [barcode part1]
ccggtctgtctaggtt

SEQ ID NO: 6718 - DNA, 16 bp, Artificial Sequence
  synthetic [barcode part1]
agatccagtggttgtc

SEQ ID NO: 6719 - DNA, 16 bp, Artificial Sequence
  synthetic [barcode part1]
ttagtgccgtgtaacg

SEQ ID NO: 6720 - DNA, 16 bp, Artificial Sequence
  synthetic [barcode part1]
gataactccaggtcgt

SEQ ID NO: 6721 - DNA, 16 bp, Artificial Sequence
  synthetic [barcode part1]
aaccacgttagttcct

SEQ ID NO: 6722 - DNA, 16 bp, Artificial Sequence
  synthetic [barcode part1]
tctctgcagtgactcg

SEQ ID NO: 6723 - DNA, 16 bp, Artificial Sequence
  synthetic [barcode part1]
agaggcagtctagtgc

SEQ ID NO: 6724 - DNA, 16 bp, Artificial Sequence
  synthetic [barcode part1]
acactggcacgaatct

SEQ ID NO: 6725 - DNA, 16 bp, Artificial Sequence
  synthetic [barcode part1]
cgtgtgattacgtggt

SEQ ID NO: 6726 - DNA, 16 bp, Artificial Sequence
  synthetic [barcode part1]
cggcaatcttcgcact

SEQ ID NO: 6727 - DNA, 16 bp, Artificial Sequence
  synthetic [barcode part1]
atccaggttgcgaact

SEQ ID NO: 6728 - DNA, 16 bp, Artificial Sequence
  synthetic [barcode part1]
gacggagttggacgtt

SEQ ID NO: 6729 - DNA, 16 bp, Artificial Sequence
  synthetic [barcode part1]
aagacgcgtatctctg

SEQ ID NO: 6730 - DNA, 16 bp, Artificial Sequence
  synthetic [barcode part1]
cggccaattctagaac

SEQ ID NO: 6731 - DNA, 16 bp, Artificial Sequence
  synthetic [barcode part1]
tctataacagacgccg

SEQ ID NO: 6732 - DNA, 16 bp, Artificial Sequence
  synthetic [barcode part1]
tcgcctattatctgcc

SEQ ID NO: 6733 - DNA, 16 bp, Artificial Sequence
  synthetic [barcode part1]
cctcaactataccggc

SEQ ID NO: 6734 - DNA, 16 bp, Artificial Sequence
  synthetic [barcode part1]
agagaaccgtcctact

SEQ ID NO: 6735 - DNA, 16 bp, Artificial Sequence
  synthetic [barcode part1]
gtgagagtagttcaac

SEQ ID NO: 6736 - DNA, 16 bp, Artificial Sequence
  synthetic [barcode part1]
tgtatccagtagtcct

SEQ ID NO: 6737 - DNA, 16 bp, Artificial Sequence
  synthetic [barcode part1]
tcaccgtcagaacaac

SEQ ID NO: 6738 - DNA, 16 bp, Artificial Sequence
  synthetic [barcode part1]
tacgtacgtgtgtgtg

SEQ ID NO: 6739 - DNA, 16 bp, Artificial Sequence
  synthetic [barcode part1]
ttcctaagaccgagac

SEQ ID NO: 6740 - DNA, 16 bp, Artificial Sequence
  synthetic [barcode part1]
agagtaaggtggaacc

SEQ ID NO: 6741 - DNA, 16 bp, Artificial Sequence
  synthetic [barcode part1]
acgaggtatcttgtcg

SEQ ID NO: 6742 - DNA, 16 bp, Artificial Sequence
  synthetic [barcode part1]
acaacaaggaccagag

SEQ ID NO: 6743 - DNA, 16 bp, Artificial Sequence
  synthetic [barcode part1]
tccgtaataccgcctg

SEQ ID NO: 6744 - DNA, 16 bp, Artificial Sequence
  synthetic [barcode part1]
cacctctgacctagtg

SEQ ID NO: 6745 - DNA, 16 bp, Artificial Sequence
  synthetic [barcode part1]
tccagtactgtgtccg

SEQ ID NO: 6746 - DNA, 16 bp, Artificial Sequence
  synthetic [barcode part1]
tcgtctcaggagttag

SEQ ID NO: 6747 - DNA, 16 bp, Artificial Sequence
  synthetic [barcode part1]
tctccgtcgaagatag

SEQ ID NO: 6748 - DNA, 16 bp, Artificial Sequence
  synthetic [barcode part1]
cagtcagtcgactagt

SEQ ID NO: 6749 - DNA, 16 bp, Artificial Sequence
  synthetic [barcode part1]
tctgtacggttgttgt

SEQ ID NO: 6750 - DNA, 16 bp, Artificial Sequence
  synthetic [barcode part1]
caccggagatacagac

SEQ ID NO: 6751 - DNA, 16 bp, Artificial Sequence
  synthetic [barcode part1]
tccacgcctggtgatt

SEQ ID NO: 6752 - DNA, 16 bp, Artificial Sequence
  synthetic [barcode part1]
attcgaacaccactct

SEQ ID NO: 6753 - DNA, 16 bp, Artificial Sequence
  synthetic [barcode part1]
aggcgtctatctgaac

SEQ ID NO: 6754 - DNA, 16 bp, Artificial Sequence
  synthetic [barcode part1]
ttactcgtatccgcct

SEQ ID NO: 6755 - DNA, 16 bp, Artificial Sequence
  synthetic [barcode part1]
acggaggactggatct

SEQ ID NO: 6756 - DNA, 16 bp, Artificial Sequence
  synthetic [barcode part1]
gtggaaccaagacaag

SEQ ID NO: 6757 - DNA, 16 bp, Artificial Sequence
  synthetic [barcode part1]
tccaccagatcacacc

SEQ ID NO: 6758 - DNA, 16 bp, Artificial Sequence
  synthetic [barcode part1]
gaactactctggtgac

SEQ ID NO: 6759 - DNA, 16 bp, Artificial Sequence
  synthetic [barcode part1]
acacaacggaggactc

SEQ ID NO: 6760 - DNA, 16 bp, Artificial Sequence
  synthetic [barcode part1]
gataatcaaggcgtgt

SEQ ID NO: 6761 - DNA, 16 bp, Artificial Sequence
  synthetic [barcode part1]
agtgtgttcttccggc

SEQ ID NO: 6762 - DNA, 16 bp, Artificial Sequence
  synthetic [barcode part1]
tcggtgacgtcagatt

SEQ ID NO: 6763 - DNA, 16 bp, Artificial Sequence
  synthetic [barcode part1]
cagacgaacagtaccg

SEQ ID NO: 6764 - DNA, 16 bp, Artificial Sequence
  synthetic [barcode part1]
ccacttctgcgaactg

SEQ ID NO: 6765 - DNA, 16 bp, Artificial Sequence
  synthetic [barcode part1]
atctcagtgcaacacg

SEQ ID NO: 6766 - DNA, 16 bp, Artificial Sequence
  synthetic [barcode part1]
caacgactccttgcgt

SEQ ID NO: 6767 - DNA, 16 bp, Artificial Sequence
  synthetic [barcode part1]
gttgatcgaggtcttg

SEQ ID NO: 6768 - DNA, 16 bp, Artificial Sequence
  synthetic [barcode part1]
ccgtgcaactgtatag

SEQ ID NO: 6769 - DNA, 16 bp, Artificial Sequence
  synthetic [barcode part1]
cgagaactaggaacag

SEQ ID NO: 6770 - DNA, 16 bp, Artificial Sequence
  synthetic [barcode part1]
caggttacgcaccttc

SEQ ID NO: 6771 - DNA, 16 bp, Artificial Sequence
  synthetic [barcode part1]
actggtagaactgaac

SEQ ID NO: 6772 - DNA, 16 bp, Artificial Sequence
  synthetic [barcode part1]
aacggaaggtcgtatt

SEQ ID NO: 6773 - DNA, 16 bp, Artificial Sequence
  synthetic [barcode part1]
tatacggtagatccgc

SEQ ID NO: 6774 - DNA, 16 bp, Artificial Sequence
  synthetic [barcode part1]
tgtcagtacgtgtcag

SEQ ID NO: 6775 - DNA, 16 bp, Artificial Sequence
  synthetic [barcode part1]
agtgtacgtgtgtcac

SEQ ID NO: 6776 - DNA, 16 bp, Artificial Sequence
  synthetic [barcode part1]
acacgcgacgttatac

SEQ ID NO: 6777 - DNA, 16 bp, Artificial Sequence
  synthetic [barcode part1]
accgaacttgtgttct

SEQ ID NO: 6778 - DNA, 16 bp, Artificial Sequence
  synthetic [barcode part1]
aacgactcctctacgc

SEQ ID NO: 6779 - DNA, 16 bp, Artificial Sequence
  synthetic [barcode part1]
taactggaggaaggac

SEQ ID NO: 6780 - DNA, 16 bp, Artificial Sequence
  synthetic [barcode part1]
gattcgagatccgatc

SEQ ID NO: 6781 - DNA, 16 bp, Artificial Sequence
  synthetic [barcode part1]
taagtgcaggagttac

SEQ ID NO: 6782 - DNA, 16 bp, Artificial Sequence
  synthetic [barcode part1]
gatatagactcctgcg

SEQ ID NO: 6783 - DNA, 16 bp, Artificial Sequence
  synthetic [barcode part1]
gaccaactacgtacgt

SEQ ID NO: 6784 - DNA, 16 bp, Artificial Sequence
  synthetic [barcode part1]
gtagtgcaaggagagt

SEQ ID NO: 6785 - DNA, 16 bp, Artificial Sequence
  synthetic [barcode part1]
atcgaattagaggcgt

SEQ ID NO: 6786 - DNA, 16 bp, Artificial Sequence
  synthetic [barcode part1]
acttccggtccttatc

SEQ ID NO: 6787 - DNA, 16 bp, Artificial Sequence
  synthetic [barcode part1]
tcaatcctaagtccgt

SEQ ID NO: 6788 - DNA, 16 bp, Artificial Sequence
  synthetic [barcode part1]
caagacctcaagacct

SEQ ID NO: 6789 - DNA, 16 bp, Artificial Sequence
  synthetic [barcode part1]
gtgcctgacagtgaag

SEQ ID NO: 6790 - DNA, 16 bp, Artificial Sequence
  synthetic [barcode part1]
cacgttaccgaaggag

SEQ ID NO: 6791 - DNA, 16 bp, Artificial Sequence
  synthetic [barcode part1]
ttgcaacacacacgtg

SEQ ID NO: 6792 - DNA, 16 bp, Artificial Sequence
  synthetic [barcode part1]
cctagattcgttactg

SEQ ID NO: 6793 - DNA, 16 bp, Artificial Sequence
  synthetic [barcode part1]
tcacgccgttcttgtt

SEQ ID NO: 6794 - DNA, 16 bp, Artificial Sequence
  synthetic [barcode part1]
gatcgatcctctcttc

SEQ ID NO: 6795 - DNA, 16 bp, Artificial Sequence
  synthetic [barcode part1]
tgttggtactggtgtg

SEQ ID NO: 6796 - DNA, 16 bp, Artificial Sequence
  synthetic [barcode part1]
ttcaccaatcgcctct

SEQ ID NO: 6797 - DNA, 16 bp, Artificial Sequence
  synthetic [barcode part1]
atcagacaacgcaggc

SEQ ID NO: 6798 - DNA, 16 bp, Artificial Sequence
  synthetic [barcode part1]
gaattgatagtgcgtg

SEQ ID NO: 6799 - DNA, 16 bp, Artificial Sequence
  synthetic [barcode part1]
caccacctaggaagtt

SEQ ID NO: 6800 - DNA, 16 bp, Artificial Sequence
  synthetic [barcode part1]
acgacttgcctagtag

SEQ ID NO: 6801 - DNA, 16 bp, Artificial Sequence
  synthetic [barcode part1]
ttcgcgtgattattgc

SEQ ID NO: 6802 - DNA, 16 bp, Artificial Sequence
  synthetic [barcode part1]
aagtagtgtcgaggag

SEQ ID NO: 6803 - DNA, 16 bp, Artificial Sequence
  synthetic [barcode part1]
ttcgagatcggagttc

SEQ ID NO: 6804 - DNA, 16 bp, Artificial Sequence
  synthetic [barcode part1]
tgtgttctaccaggtt

SEQ ID NO: 6805 - DNA, 16 bp, Artificial Sequence
  synthetic [barcode part1]
gacttgagtgcaggac

SEQ ID NO: 6806 - DNA, 16 bp, Artificial Sequence
  synthetic [barcode part1]
gaacgtgaggatacag

SEQ ID NO: 6807 - DNA, 16 bp, Artificial Sequence
  synthetic [barcode part1]
tacgacacttacctac

SEQ ID NO: 6808 - DNA, 16 bp, Artificial Sequence
  synthetic [barcode part1]
tgagtaataccgcaag

SEQ ID NO: 6809 - DNA, 16 bp, Artificial Sequence
  synthetic [barcode part1]
agaagacgagtcaggt

SEQ ID NO: 6810 - DNA, 16 bp, Artificial Sequence
  synthetic [barcode part1]
agtgttctcgtacgag

SEQ ID NO: 6811 - DNA, 16 bp, Artificial Sequence
  synthetic [barcode part1]
gtaactgccaacctcc

SEQ ID NO: 6812 - DNA, 16 bp, Artificial Sequence
  synthetic [barcode part1]
tccagatctcacagag

SEQ ID NO: 6813 - DNA, 16 bp, Artificial Sequence
  synthetic [barcode part1]
gcgagatagattcgcg

SEQ ID NO: 6814 - DNA, 16 bp, Artificial Sequence
  synthetic [barcode part1]
tctaggttaggaggcg

SEQ ID NO: 6815 - DNA, 16 bp, Artificial Sequence
  synthetic [barcode part1]
ccggaaccttacttgc

SEQ ID NO: 6816 - DNA, 16 bp, Artificial Sequence
  synthetic [barcode part1]
acgtgattcctagttc

SEQ ID NO: 6817 - DNA, 16 bp, Artificial Sequence
  synthetic [barcode part1]
gtactccaattactgc

SEQ ID NO: 6818 - DNA, 16 bp, Artificial Sequence
  synthetic [barcode part1]
gagattagactcgtag

SEQ ID NO: 6819 - DNA, 16 bp, Artificial Sequence
  synthetic [barcode part1]
gttcctggaacgtaac

SEQ ID NO: 6820 - DNA, 16 bp, Artificial Sequence
  synthetic [barcode part1]
tatctgcgtaggtggt

SEQ ID NO: 6821 - DNA, 16 bp, Artificial Sequence
  synthetic [barcode part1]
cgcaataggcgagtac

SEQ ID NO: 6822 - DNA, 16 bp, Artificial Sequence
  synthetic [barcode part1]
aaggtggtcacagacc

SEQ ID NO: 6823 - DNA, 16 bp, Artificial Sequence
  synthetic [barcode part1]
aaccactatccgacag

SEQ ID NO: 6824 - DNA, 16 bp, Artificial Sequence
  synthetic [barcode part1]
ccacactactcctatc

SEQ ID NO: 6825 - DNA, 16 bp, Artificial Sequence
  synthetic [barcode part1]
gttatcttgcctgaac

SEQ ID NO: 6826 - DNA, 16 bp, Artificial Sequence
  synthetic [barcode part1]
aggcagattacctgtc

SEQ ID NO: 6827 - DNA, 16 bp, Artificial Sequence
  synthetic [barcode part1]
tccgttatctcaccgt

SEQ ID NO: 6828 - DNA, 16 bp, Artificial Sequence
  synthetic [barcode part1]
gaccgcaagttaaggc

SEQ ID NO: 6829 - DNA, 16 bp, Artificial Sequence
  synthetic [barcode part1]
attgtcctgttcgagt

SEQ ID NO: 6830 - DNA, 16 bp, Artificial Sequence
  synthetic [barcode part1]
gccgaattctgtgcct

SEQ ID NO: 6831 - DNA, 16 bp, Artificial Sequence
  synthetic [barcode part1]
gatctggaaggcgtgt

SEQ ID NO: 6832 - DNA, 16 bp, Artificial Sequence
  synthetic [barcode part1]
gttacacgactgtgtg

SEQ ID NO: 6833 - DNA, 16 bp, Artificial Sequence
  synthetic [barcode part1]
atcaagtctacgtcct

SEQ ID NO: 6834 - DNA, 16 bp, Artificial Sequence
  synthetic [barcode part1]
actctgttgtcggcgt

SEQ ID NO: 6835 - DNA, 16 bp, Artificial Sequence
  synthetic [barcode part1]
aacgttctaccttgtg

SEQ ID NO: 6836 - DNA, 16 bp, Artificial Sequence
  synthetic [barcode part1]
accttcggtaacttac

SEQ ID NO: 6837 - DNA, 16 bp, Artificial Sequence
  synthetic [barcode part1]
tgtcctcaattaccag

SEQ ID NO: 6838 - DNA, 16 bp, Artificial Sequence
  synthetic [barcode part1]
atacttctcaacgacc

SEQ ID NO: 6839 - DNA, 16 bp, Artificial Sequence
  synthetic [barcode part1]
ttctctacgtcctacg

SEQ ID NO: 6840 - DNA, 16 bp, Artificial Sequence
  synthetic [barcode part1]
tactctgaagtccact

SEQ ID NO: 6841 - DNA, 16 bp, Artificial Sequence
  synthetic [barcode part1]
tccggtcgattctctt

SEQ ID NO: 6842 - DNA, 16 bp, Artificial Sequence
  synthetic [barcode part1]
attccacaatacgcct

SEQ ID NO: 6843 - DNA, 16 bp, Artificial Sequence
  synthetic [barcode part1]
caactgatacgcgtac

SEQ ID NO: 6844 - DNA, 16 bp, Artificial Sequence
  synthetic [barcode part1]
tctcgtggtatcttcc

SEQ ID NO: 6845 - DNA, 16 bp, Artificial Sequence
  synthetic [barcode part1]
gtgactggttgacgtt

SEQ ID NO: 6846 - DNA, 16 bp, Artificial Sequence
  synthetic [barcode part1]
ttgcgtcacagtccac

SEQ ID NO: 6847 - DNA, 16 bp, Artificial Sequence
  synthetic [barcode part1]
cagtgttgcctgttcg

SEQ ID NO: 6848 - DNA, 16 bp, Artificial Sequence
  synthetic [barcode part1]
cagtgtgtgacgaggt

SEQ ID NO: 6849 - DNA, 16 bp, Artificial Sequence
  synthetic [barcode part1]
tgtcggatacctccgt

SEQ ID NO: 6850 - DNA, 16 bp, Artificial Sequence
  synthetic [barcode part1]
tacacggttcggcctt

SEQ ID NO: 6851 - DNA, 16 bp, Artificial Sequence
  synthetic [barcode part1]
cagtaactcctgcgtc

SEQ ID NO: 6852 - DNA, 16 bp, Artificial Sequence
  synthetic [barcode part1]
gcaggaactggcaatc

SEQ ID NO: 6853 - DNA, 16 bp, Artificial Sequence
  synthetic [barcode part1]
gtgattggcgttagtc

SEQ ID NO: 6854 - DNA, 16 bp, Artificial Sequence
  synthetic [barcode part1]
gatcctctgtgttggc

SEQ ID NO: 6855 - DNA, 16 bp, Artificial Sequence
  synthetic [barcode part1]
actcagtctagtggtg

SEQ ID NO: 6856 - DNA, 16 bp, Artificial Sequence
  synthetic [barcode part1]
ccaggcgtactacctt

SEQ ID NO: 6857 - DNA, 16 bp, Artificial Sequence
  synthetic [barcode part1]
tgagacttggttggtc

SEQ ID NO: 6858 - DNA, 16 bp, Artificial Sequence
  synthetic [barcode part1]
accttgccttgtggac

SEQ ID NO: 6859 - DNA, 16 bp, Artificial Sequence
  synthetic [barcode part1]
cgtgaacgaactcact

SEQ ID NO: 6860 - DNA, 16 bp, Artificial Sequence
  synthetic [barcode part1]
gaatctgcctaatctc

SEQ ID NO: 6861 - DNA, 16 bp, Artificial Sequence
  synthetic [barcode part1]
tgcgttcgtggttcac

SEQ ID NO: 6862 - DNA, 16 bp, Artificial Sequence
  synthetic [barcode part1]
gcggacgatagtatcg

SEQ ID NO: 6863 - DNA, 16 bp, Artificial Sequence
  synthetic [barcode part1]
gtgtaggagactattg

SEQ ID NO: 6864 - DNA, 16 bp, Artificial Sequence
  synthetic [barcode part1]
tgtctcgaacgaagtc

SEQ ID NO: 6865 - DNA, 16 bp, Artificial Sequence
  synthetic [barcode part1]
ccgtctaccgtaacac

SEQ ID NO: 6866 - DNA, 16 bp, Artificial Sequence
  synthetic [barcode part1]
tagtggcggtctgatt

SEQ ID NO: 6867 - DNA, 16 bp, Artificial Sequence
  synthetic [barcode part1]
tgaaccggcgtgaagt

SEQ ID NO: 6868 - DNA, 16 bp, Artificial Sequence
  synthetic [barcode part1]
cggacacaagagtcac

SEQ ID NO: 6869 - DNA, 16 bp, Artificial Sequence
  synthetic [barcode part1]
cacaggtgaacctact

SEQ ID NO: 6870 - DNA, 16 bp, Artificial Sequence
  synthetic [barcode part1]
ccacgagtaagtctac

SEQ ID NO: 6871 - DNA, 16 bp, Artificial Sequence
  synthetic [barcode part1]
atagaactgttcggag

SEQ ID NO: 6872 - DNA, 16 bp, Artificial Sequence
  synthetic [barcode part1]
gcgttggtaataagac

SEQ ID NO: 6873 - DNA, 16 bp, Artificial Sequence
  synthetic [barcode part1]
tgtcgaggtctccgtt

SEQ ID NO: 6874 - DNA, 16 bp, Artificial Sequence
  synthetic [barcode part1]
aatagtctgtgcctct

SEQ ID NO: 6875 - DNA, 16 bp, Artificial Sequence
  synthetic [barcode part1]
gatcttccacggacct

SEQ ID NO: 6876 - DNA, 16 bp, Artificial Sequence
  synthetic [barcode part1]
gagacacgtcaagtcg

SEQ ID NO: 6877 - DNA, 16 bp, Artificial Sequence
  synthetic [barcode part1]
aacactgacgtcacac

SEQ ID NO: 6878 - DNA, 16 bp, Artificial Sequence
  synthetic [barcode part1]
cagtactcctgaagtg

SEQ ID NO: 6879 - DNA, 16 bp, Artificial Sequence
  synthetic [barcode part1]
tatcgacgcgtgttag

SEQ ID NO: 6880 - DNA, 16 bp, Artificial Sequence
  synthetic [barcode part1]
gtaaggaagttcgact

SEQ ID NO: 6881 - DNA, 16 bp, Artificial Sequence
  synthetic [barcode part1]
cactcgtcggaattcc

SEQ ID NO: 6882 - DNA, 16 bp, Artificial Sequence
  synthetic [barcode part1]
cggacctgatagaacg

SEQ ID NO: 6883 - DNA, 16 bp, Artificial Sequence
  synthetic [barcode part1]
actgtgtcgtagatcg

SEQ ID NO: 6884 - DNA, 16 bp, Artificial Sequence
  synthetic [barcode part1]
tctattgaactacgcc

SEQ ID NO: 6885 - DNA, 16 bp, Artificial Sequence
  synthetic [barcode part1]
ttgcctaactcgcctt

SEQ ID NO: 6886 - DNA, 16 bp, Artificial Sequence
  synthetic [barcode part1]
tgtctatctgcggtgc

SEQ ID NO: 6887 - DNA, 16 bp, Artificial Sequence
  synthetic [barcode part1]
accagagattgtgtag

SEQ ID NO: 6888 - DNA, 16 bp, Artificial Sequence
  synthetic [barcode part1]
gcggatacgttataag

SEQ ID NO: 6889 - DNA, 16 bp, Artificial Sequence
  synthetic [barcode part1]
ttaggaccaggattcc

SEQ ID NO: 6890 - DNA, 16 bp, Artificial Sequence
  synthetic [barcode part1]
gaacactacggattcc

SEQ ID NO: 6891 - DNA, 16 bp, Artificial Sequence
  synthetic [barcode part1]
cctccaataatcacac

SEQ ID NO: 6892 - DNA, 16 bp, Artificial Sequence
  synthetic [barcode part1]
gaggagttgccagtac

SEQ ID NO: 6893 - DNA, 16 bp, Artificial Sequence
  synthetic [barcode part1]
cacaacactcagagtc

SEQ ID NO: 6894 - DNA, 16 bp, Artificial Sequence
  synthetic [barcode part1]
gtcctgtgcgattgtc

SEQ ID NO: 6895 - DNA, 16 bp, Artificial Sequence
  synthetic [barcode part1]
gcagactaaccgtgtt

SEQ ID NO: 6896 - DNA, 16 bp, Artificial Sequence
  synthetic [barcode part1]
tatacctcaggccgtc

SEQ ID NO: 6897 - DNA, 16 bp, Artificial Sequence
  synthetic [barcode part1]
cctactcgtaatactg

SEQ ID NO: 6898 - DNA, 16 bp, Artificial Sequence
  synthetic [barcode part1]
attgacgtattccgtc

SEQ ID NO: 6899 - DNA, 16 bp, Artificial Sequence
  synthetic [barcode part1]
acagattgcgtctggt

SEQ ID NO: 6900 - DNA, 16 bp, Artificial Sequence
  synthetic [barcode part1]
agagagtcgtctcact

SEQ ID NO: 6901 - DNA, 16 bp, Artificial Sequence
  synthetic [barcode part1]
tacttgtaataccgcc

SEQ ID NO: 6902 - DNA, 16 bp, Artificial Sequence
  synthetic [barcode part1]
ttagtaagacgcagac

SEQ ID NO: 6903 - DNA, 16 bp, Artificial Sequence
  synthetic [barcode part1]
ttaacctgacggtgac

SEQ ID NO: 6904 - DNA, 16 bp, Artificial Sequence
  synthetic [barcode part1]
cgcaaccgttgaagag

SEQ ID NO: 6905 - DNA, 16 bp, Artificial Sequence
  synthetic [barcode part1]
gagagtcttggtcttg

SEQ ID NO: 6906 - DNA, 16 bp, Artificial Sequence
  synthetic [barcode part1]
aactgtctgaaggtag

SEQ ID NO: 6907 - DNA, 16 bp, Artificial Sequence
  synthetic [barcode part1]
gttcgtccaaggtctc

SEQ ID NO: 6908 - DNA, 16 bp, Artificial Sequence
  synthetic [barcode part1]
tcaacctcgccttgtt

SEQ ID NO: 6909 - DNA, 16 bp, Artificial Sequence
  synthetic [barcode part1]
gaggttggtgtgatcg

SEQ ID NO: 6910 - DNA, 16 bp, Artificial Sequence
  synthetic [barcode part1]
cacctgcggtactact

SEQ ID NO: 6911 - DNA, 16 bp, Artificial Sequence
  synthetic [barcode part1]
tcgttgtccacgaatt

SEQ ID NO: 6912 - DNA, 16 bp, Artificial Sequence
  synthetic [barcode part1]
agaagactatcggtgt

SEQ ID NO: 6913 - DNA, 16 bp, Artificial Sequence
  synthetic [barcode part1]
gcaagtcaaccacact

SEQ ID NO: 6914 - DNA, 16 bp, Artificial Sequence
  synthetic [barcode part1]
agtccagatacaaggt

SEQ ID NO: 6915 - DNA, 16 bp, Artificial Sequence
  synthetic [barcode part1]
tacctcaggtgaggtt

SEQ ID NO: 6916 - DNA, 16 bp, Artificial Sequence
  synthetic [barcode part1]
caacctccagtatatc

SEQ ID NO: 6917 - DNA, 16 bp, Artificial Sequence
  synthetic [barcode part1]
acacgtggttagtcgt

SEQ ID NO: 6918 - DNA, 16 bp, Artificial Sequence
  synthetic [barcode part1]
agtgacgtgaatatcg

SEQ ID NO: 6919 - DNA, 16 bp, Artificial Sequence
  synthetic [barcode part1]
caccactgcagttacc

SEQ ID NO: 6920 - DNA, 16 bp, Artificial Sequence
  synthetic [barcode part1]
gacaacttgtatcctc

SEQ ID NO: 6921 - DNA, 16 bp, Artificial Sequence
  synthetic [barcode part1]
cagtgattggcaatcc

SEQ ID NO: 6922 - DNA, 16 bp, Artificial Sequence
  synthetic [barcode part1]
ttaagttcgacgaccg

SEQ ID NO: 6923 - DNA, 16 bp, Artificial Sequence
  synthetic [barcode part1]
ccttctcttgaccagt

SEQ ID NO: 6924 - DNA, 16 bp, Artificial Sequence
  synthetic [barcode part1]
gaatacaccgataacg

SEQ ID NO: 6925 - DNA, 16 bp, Artificial Sequence
  synthetic [barcode part1]
tacgacgcaggattct

SEQ ID NO: 6926 - DNA, 16 bp, Artificial Sequence
  synthetic [barcode part1]
ttactcttgtaccgag

SEQ ID NO: 6927 - DNA, 16 bp, Artificial Sequence
  synthetic [barcode part1]
cggatagtagaattcg

SEQ ID NO: 6928 - DNA, 16 bp, Artificial Sequence
  synthetic [barcode part1]
ttcaacgccgtgtctg

SEQ ID NO: 6929 - DNA, 16 bp, Artificial Sequence
  synthetic [barcode part1]
ttgagtgagtgaagtc

SEQ ID NO: 6930 - DNA, 16 bp, Artificial Sequence
  synthetic [barcode part1]
tctcacctactcggag

SEQ ID NO: 6931 - DNA, 16 bp, Artificial Sequence
  synthetic [barcode part1]
gtgatctcagaggcag

SEQ ID NO: 6932 - DNA, 16 bp, Artificial Sequence
  synthetic [barcode part1]
atccaaggcctcgttc

SEQ ID NO: 6933 - DNA, 16 bp, Artificial Sequence
  synthetic [barcode part1]
tagtgtagtcgtcctt

SEQ ID NO: 6934 - DNA, 16 bp, Artificial Sequence
  synthetic [barcode part1]
cacacgattcaactct

SEQ ID NO: 6935 - DNA, 16 bp, Artificial Sequence
  synthetic [barcode part1]
attgcggagacaagtt

SEQ ID NO: 6936 - DNA, 16 bp, Artificial Sequence
  synthetic [barcode part1]
gtgacaggaacgttcg

SEQ ID NO: 6937 - DNA, 16 bp, Artificial Sequence
  synthetic [barcode part1]
tgcgcaacctgacctt

SEQ ID NO: 6938 - DNA, 16 bp, Artificial Sequence
  synthetic [barcode part1]
attggaataacgcacg

SEQ ID NO: 6939 - DNA, 16 bp, Artificial Sequence
  synthetic [barcode part1]
tccgccgaattgtgtc

SEQ ID NO: 6940 - DNA, 16 bp, Artificial Sequence
  synthetic [barcode part1]
gacgtccttgtgtaag

SEQ ID NO: 6941 - DNA, 16 bp, Artificial Sequence
  synthetic [barcode part1]
gcagtaggcaatcgtg

SEQ ID NO: 6942 - DNA, 16 bp, Artificial Sequence
  synthetic [barcode part1]
gacgcgcagaattggt

SEQ ID NO: 6943 - DNA, 16 bp, Artificial Sequence
  synthetic [barcode part1]
tgtacgacctggtctc

SEQ ID NO: 6944 - DNA, 16 bp, Artificial Sequence
  synthetic [barcode part1]
ttcctggtgcgatcac

SEQ ID NO: 6945 - DNA, 16 bp, Artificial Sequence
  synthetic [barcode part1]
acctctgatagtccgc

SEQ ID NO: 6946 - DNA, 16 bp, Artificial Sequence
  synthetic [barcode part1]
ttcaccgagagtgatc

SEQ ID NO: 6947 - DNA, 16 bp, Artificial Sequence
  synthetic [barcode part1]
gactgtatcaatctcc

SEQ ID NO: 6948 - DNA, 16 bp, Artificial Sequence
  synthetic [barcode part1]
gttgtactataggccg

SEQ ID NO: 6949 - DNA, 16 bp, Artificial Sequence
  synthetic [barcode part1]
tgtcaagtgccagatc

SEQ ID NO: 6950 - DNA, 16 bp, Artificial Sequence
  synthetic [barcode part1]
gtgttggcgtagatct

SEQ ID NO: 6951 - DNA, 16 bp, Artificial Sequence
  synthetic [barcode part1]
tattagtccgaaggag

SEQ ID NO: 6952 - DNA, 16 bp, Artificial Sequence
  synthetic [barcode part1]
aacacctggcaacgag

SEQ ID NO: 6953 - DNA, 16 bp, Artificial Sequence
  synthetic [barcode part1]
atcaacacgttccact

SEQ ID NO: 6954 - DNA, 16 bp, Artificial Sequence
  synthetic [barcode part1]
tctggtcgcactgatc

SEQ ID NO: 6955 - DNA, 16 bp, Artificial Sequence
  synthetic [barcode part1]
gtgtgattcctggtcc

SEQ ID NO: 6956 - DNA, 16 bp, Artificial Sequence
  synthetic [barcode part1]
tgactaaccgactggt

SEQ ID NO: 6957 - DNA, 16 bp, Artificial Sequence
  synthetic [barcode part1]
ttgtatactccggccg

SEQ ID NO: 6958 - DNA, 16 bp, Artificial Sequence
  synthetic [barcode part1]
gttgaggactggtgtg

SEQ ID NO: 6959 - DNA, 16 bp, Artificial Sequence
  synthetic [barcode part1]
taacacgtggcgagac

SEQ ID NO: 6960 - DNA, 16 bp, Artificial Sequence
  synthetic [barcode part1]
actaacgcagaaggcc

SEQ ID NO: 6961 - DNA, 16 bp, Artificial Sequence
  synthetic [barcode part1]
aacagaggaaggtcgt

SEQ ID NO: 6962 - DNA, 16 bp, Artificial Sequence
  synthetic [barcode part1]
tgtggttcacaccaag

SEQ ID NO: 6963 - DNA, 16 bp, Artificial Sequence
  synthetic [barcode part1]
gtcggcagataataac

SEQ ID NO: 6964 - DNA, 16 bp, Artificial Sequence
  synthetic [barcode part1]
gtgcagtctgacctct

SEQ ID NO: 6965 - DNA, 16 bp, Artificial Sequence
  synthetic [barcode part1]
taacctgttgtatccg

SEQ ID NO: 6966 - DNA, 16 bp, Artificial Sequence
  synthetic [barcode part1]
tgacaggttgccttag

SEQ ID NO: 6967 - DNA, 16 bp, Artificial Sequence
  synthetic [barcode part1]
tcacttggtggtgcct

SEQ ID NO: 6968 - DNA, 16 bp, Artificial Sequence
  synthetic [barcode part1]
atcttggaaccaaccg

SEQ ID NO: 6969 - DNA, 16 bp, Artificial Sequence
  synthetic [barcode part1]
atctgtcgataccgtt

SEQ ID NO: 6970 - DNA, 16 bp, Artificial Sequence
  synthetic [barcode part1]
cgcgatacaggtgagt

SEQ ID NO: 6971 - DNA, 16 bp, Artificial Sequence
  synthetic [barcode part1]
actcttggtctaacgt

SEQ ID NO: 6972 - DNA, 16 bp, Artificial Sequence
  synthetic [barcode part1]
gtcgataagatcagac

SEQ ID NO: 6973 - DNA, 16 bp, Artificial Sequence
  synthetic [barcode part1]
acacgtacgattggtc

SEQ ID NO: 6974 - DNA, 16 bp, Artificial Sequence
  synthetic [barcode part1]
ttggtctgcgattact

SEQ ID NO: 6975 - DNA, 16 bp, Artificial Sequence
  synthetic [barcode part1]
gttagtgtatcctgtc

SEQ ID NO: 6976 - DNA, 16 bp, Artificial Sequence
  synthetic [barcode part1]
caataccttatctgcg

SEQ ID NO: 6977 - DNA, 16 bp, Artificial Sequence
  synthetic [barcode part1]
tgcaatatatccgcct

SEQ ID NO: 6978 - DNA, 16 bp, Artificial Sequence
  synthetic [barcode part1]
caacgtagtcagaggc

SEQ ID NO: 6979 - DNA, 16 bp, Artificial Sequence
  synthetic [barcode part1]
cgtggtgtaagatctc

SEQ ID NO: 6980 - DNA, 16 bp, Artificial Sequence
  synthetic [barcode part1]
tagttaacggccgatc

SEQ ID NO: 6981 - DNA, 16 bp, Artificial Sequence
  synthetic [barcode part1]
gtcagagtctcttgag

SEQ ID NO: 6982 - DNA, 16 bp, Artificial Sequence
  synthetic [barcode part1]
agatcactcgtatctc

SEQ ID NO: 6983 - DNA, 16 bp, Artificial Sequence
  synthetic [barcode part1]
gtaccaagtcagaggc

SEQ ID NO: 6984 - DNA, 16 bp, Artificial Sequence
  synthetic [barcode part1]
tatcgagtcacacttc

SEQ ID NO: 6985 - DNA, 16 bp, Artificial Sequence
  synthetic [barcode part1]
cagaacgacagaacag

SEQ ID NO: 6986 - DNA, 16 bp, Artificial Sequence
  synthetic [barcode part1]
actcgaattgtcctac

SEQ ID NO: 6987 - DNA, 16 bp, Artificial Sequence
  synthetic [barcode part1]
taggtaccacagactc

SEQ ID NO: 6988 - DNA, 16 bp, Artificial Sequence
  synthetic [barcode part1]
agtctaaccttgcact

SEQ ID NO: 6989 - DNA, 16 bp, Artificial Sequence
  synthetic [barcode part1]
cgcctagtcttcaacg

SEQ ID NO: 6990 - DNA, 16 bp, Artificial Sequence
  synthetic [barcode part1]
tcgaaggagagactag

SEQ ID NO: 6991 - DNA, 16 bp, Artificial Sequence
  synthetic [barcode part1]
ccaagtgtgccgttct

SEQ ID NO: 6992 - DNA, 16 bp, Artificial Sequence
  synthetic [barcode part1]
ttgtgaactaccacct

SEQ ID NO: 6993 - DNA, 16 bp, Artificial Sequence
  synthetic [barcode part1]
aatcgtgtagtacgcc

SEQ ID NO: 6994 - DNA, 16 bp, Artificial Sequence
  synthetic [barcode part1]
agtcttgcggaatctg

SEQ ID NO: 6995 - DNA, 16 bp, Artificial Sequence
  synthetic [barcode part1]
cgaactaccgataacc

SEQ ID NO: 6996 - DNA, 16 bp, Artificial Sequence
  synthetic [barcode part1]
tgttctgaacacctgt

SEQ ID NO: 6997 - DNA, 16 bp, Artificial Sequence
  synthetic [barcode part1]
aagtcaacaatacgcg

SEQ ID NO: 6998 - DNA, 16 bp, Artificial Sequence
  synthetic [barcode part1]
ttcaactcaatcgcac

SEQ ID NO: 6999 - DNA, 16 bp, Artificial Sequence
  synthetic [barcode part1]
cagtctcgtattgatc

SEQ ID NO: 7000 - DNA, 16 bp, Artificial Sequence
  synthetic [barcode part1]
aattcgcgaacggcag

SEQ ID NO: 7001 - DNA, 16 bp, Artificial Sequence
  synthetic [barcode part1]
caatcggtgcgatact

SEQ ID NO: 7002 - DNA, 16 bp, Artificial Sequence
  synthetic [barcode part1]
gagactgcgattcttg

SEQ ID NO: 7003 - DNA, 16 bp, Artificial Sequence
  synthetic [barcode part1]
gcgaaccactgaagac

SEQ ID NO: 7004 - DNA, 16 bp, Artificial Sequence
  synthetic [barcode part1]
agaccaggcacgttag

SEQ ID NO: 7005 - DNA, 16 bp, Artificial Sequence
  synthetic [barcode part1]
agatacagagagtgcg

SEQ ID NO: 7006 - DNA, 16 bp, Artificial Sequence
  synthetic [barcode part1]
gtctagagatactcgc

SEQ ID NO: 7007 - DNA, 16 bp, Artificial Sequence
  synthetic [barcode part1]
acctattgacgttgtc

SEQ ID NO: 7008 - DNA, 16 bp, Artificial Sequence
  synthetic [barcode part1]
cgtataggcgaggtac

SEQ ID NO: 7009 - DNA, 16 bp, Artificial Sequence
  synthetic [barcode part1]
ttctctaccgtcactg

SEQ ID NO: 7010 - DNA, 16 bp, Artificial Sequence
  synthetic [barcode part1]
gtagtaccaaccgatc

SEQ ID NO: 7011 - DNA, 16 bp, Artificial Sequence
  synthetic [barcode part1]
tctggttacgtcaact

SEQ ID NO: 7012 - DNA, 16 bp, Artificial Sequence
  synthetic [barcode part1]
ttatctgcactgcggc

SEQ ID NO: 7013 - DNA, 16 bp, Artificial Sequence
  synthetic [barcode part1]
tgtgaacgagtctgtc

SEQ ID NO: 7014 - DNA, 16 bp, Artificial Sequence
  synthetic [barcode part1]
agtagaagtacctgac

SEQ ID NO: 7015 - DNA, 16 bp, Artificial Sequence
  synthetic [barcode part1]
tcgtgccgcaagaatt

SEQ ID NO: 7016 - DNA, 16 bp, Artificial Sequence
  synthetic [barcode part1]
ttcgccttaggactcg

SEQ ID NO: 7017 - DNA, 16 bp, Artificial Sequence
  synthetic [barcode part1]
tgtacacgtgtacacg

SEQ ID NO: 7018 - DNA, 16 bp, Artificial Sequence
  synthetic [barcode part1]
tatatccgcaggagtc

SEQ ID NO: 7019 - DNA, 16 bp, Artificial Sequence
  synthetic [barcode part1]
gtaactcctgtcgaag

SEQ ID NO: 7020 - DNA, 16 bp, Artificial Sequence
  synthetic [barcode part1]
gtgcggtgtatactac

SEQ ID NO: 7021 - DNA, 16 bp, Artificial Sequence
  synthetic [barcode part1]
gttctccacgtattag

SEQ ID NO: 7022 - DNA, 16 bp, Artificial Sequence
  synthetic [barcode part1]
gattgcacgtacagtc

SEQ ID NO: 7023 - DNA, 16 bp, Artificial Sequence
  synthetic [barcode part1]
gcgagaacggcaattc

SEQ ID NO: 7024 - DNA, 16 bp, Artificial Sequence
  synthetic [barcode part1]
gtcgtaacggaacttc

SEQ ID NO: 7025 - DNA, 16 bp, Artificial Sequence
  synthetic [barcode part1]
taaggattatcggacg

SEQ ID NO: 7026 - DNA, 16 bp, Artificial Sequence
  synthetic [barcode part1]
cctcctagttcttcag

SEQ ID NO: 7027 - DNA, 16 bp, Artificial Sequence
  synthetic [barcode part1]
gttaggtgtagagatc

SEQ ID NO: 7028 - DNA, 16 bp, Artificial Sequence
  synthetic [barcode part1]
cgtgtggtcactgttc

SEQ ID NO: 7029 - DNA, 16 bp, Artificial Sequence
  synthetic [barcode part1]
tacgtaccgcgtatag

SEQ ID NO: 7030 - DNA, 16 bp, Artificial Sequence
  synthetic [barcode part1]
cacgtctgacgatctc

SEQ ID NO: 7031 - DNA, 16 bp, Artificial Sequence
  synthetic [barcode part1]
tatctcgacttgtggt

SEQ ID NO: 7032 - DNA, 16 bp, Artificial Sequence
  synthetic [barcode part1]
gcaagaccagagtaag

SEQ ID NO: 7033 - DNA, 16 bp, Artificial Sequence
  synthetic [barcode part1]
atactaatctccgacc

SEQ ID NO: 7034 - DNA, 16 bp, Artificial Sequence
  synthetic [barcode part1]
gatctaattcctgcgt

SEQ ID NO: 7035 - DNA, 16 bp, Artificial Sequence
  synthetic [barcode part1]
cgatagtccagtgatc

SEQ ID NO: 7036 - DNA, 16 bp, Artificial Sequence
  synthetic [barcode part1]
attcctagttcctgcc

SEQ ID NO: 7037 - DNA, 16 bp, Artificial Sequence
  synthetic [barcode part1]
acaccggcgtattaac

SEQ ID NO: 7038 - DNA, 16 bp, Artificial Sequence
  synthetic [barcode part1]
tgttgcagttgtgacg

SEQ ID NO: 7039 - DNA, 16 bp, Artificial Sequence
  synthetic [barcode part1]
atcggttccaatcgag

SEQ ID NO: 7040 - DNA, 16 bp, Artificial Sequence
  synthetic [barcode part1]
gtaggaatcctgcgtt

SEQ ID NO: 7041 - DNA, 16 bp, Artificial Sequence
  synthetic [barcode part1]
gtgtagtagttcttcc

SEQ ID NO: 7042 - DNA, 16 bp, Artificial Sequence
  synthetic [barcode part1]
gtcttatacctcctgc

SEQ ID NO: 7043 - DNA, 16 bp, Artificial Sequence
  synthetic [barcode part1]
agaagtaggcacagac

SEQ ID NO: 7044 - DNA, 16 bp, Artificial Sequence
  synthetic [barcode part1]
cgtccaggttaaggag

SEQ ID NO: 7045 - DNA, 16 bp, Artificial Sequence
  synthetic [barcode part1]
taatctccgacgtgcc

SEQ ID NO: 7046 - DNA, 16 bp, Artificial Sequence
  synthetic [barcode part1]
gaccttaggtatcgtg

SEQ ID NO: 7047 - DNA, 16 bp, Artificial Sequence
  synthetic [barcode part1]
attgtgatcgcctact

SEQ ID NO: 7048 - DNA, 16 bp, Artificial Sequence
  synthetic [barcode part1]
aggactcgcgaacagt

SEQ ID NO: 7049 - DNA, 16 bp, Artificial Sequence
  synthetic [barcode part1]
caagtcgtgtaagagt

SEQ ID NO: 7050 - DNA, 16 bp, Artificial Sequence
  synthetic [barcode part1]
ttgtgttgagttgtcc

SEQ ID NO: 7051 - DNA, 16 bp, Artificial Sequence
  synthetic [barcode part1]
acaacgtacgtgtacc

SEQ ID NO: 7052 - DNA, 16 bp, Artificial Sequence
  synthetic [barcode part1]
cctaccagatctacgc

SEQ ID NO: 7053 - DNA, 16 bp, Artificial Sequence
  synthetic [barcode part1]
gaatctgcgttccacc

SEQ ID NO: 7054 - DNA, 16 bp, Artificial Sequence
  synthetic [barcode part1]
taaggtcgttacgacc

SEQ ID NO: 7055 - DNA, 16 bp, Artificial Sequence
  synthetic [barcode part1]
gacctcttgataaggc

SEQ ID NO: 7056 - DNA, 16 bp, Artificial Sequence
  synthetic [barcode part1]
tgacagtgttggatcc

SEQ ID NO: 7057 - DNA, 16 bp, Artificial Sequence
  synthetic [barcode part1]
tgagttggaggtgcac

SEQ ID NO: 7058 - DNA, 16 bp, Artificial Sequence
  synthetic [barcode part1]
acgcggtgagaagttc

SEQ ID NO: 7059 - DNA, 16 bp, Artificial Sequence
  synthetic [barcode part1]
gaatacacgacgattg

SEQ ID NO: 7060 - DNA, 16 bp, Artificial Sequence
  synthetic [barcode part1]
taatcaacgacgtcgc

SEQ ID NO: 7061 - DNA, 16 bp, Artificial Sequence
  synthetic [barcode part1]
gcaagtgagtgtcacg

SEQ ID NO: 7062 - DNA, 16 bp, Artificial Sequence
  synthetic [barcode part1]
gaataccgataggatc

SEQ ID NO: 7063 - DNA, 16 bp, Artificial Sequence
  synthetic [barcode part1]
gtccgtgcaattctcg

SEQ ID NO: 7064 - DNA, 16 bp, Artificial Sequence
  synthetic [barcode part1]
ttacttctcggcgcag

SEQ ID NO: 7065 - DNA, 16 bp, Artificial Sequence
  synthetic [barcode part1]
gtgcaatctaactctc

SEQ ID NO: 7066 - DNA, 16 bp, Artificial Sequence
  synthetic [barcode part1]
agtcctaacaacgtcg

SEQ ID NO: 7067 - DNA, 16 bp, Artificial Sequence
  synthetic [barcode part1]
attgacaccacacggt

SEQ ID NO: 7068 - DNA, 16 bp, Artificial Sequence
  synthetic [barcode part1]
attggacaagtgcggc

SEQ ID NO: 7069 - DNA, 16 bp, Artificial Sequence
  synthetic [barcode part1]
tagttcgatccttgtg

SEQ ID NO: 7070 - DNA, 16 bp, Artificial Sequence
  synthetic [barcode part1]
gagtcgtagattgcct

SEQ ID NO: 7071 - DNA, 16 bp, Artificial Sequence
  synthetic [barcode part1]
taactctgtcgcgcac

SEQ ID NO: 7072 - DNA, 16 bp, Artificial Sequence
  synthetic [barcode part1]
tgtcgtaccaagactg

SEQ ID NO: 7073 - DNA, 16 bp, Artificial Sequence
  synthetic [barcode part1]
gtactgaatcgttctc

SEQ ID NO: 7074 - DNA, 16 bp, Artificial Sequence
  synthetic [barcode part1]
atacgtgatcagtcgc

SEQ ID NO: 7075 - DNA, 16 bp, Artificial Sequence
  synthetic [barcode part1]
acaggtcgtgcaatct

SEQ ID NO: 7076 - DNA, 16 bp, Artificial Sequence
  synthetic [barcode part1]
ttaggatccgttcgtt

SEQ ID NO: 7077 - DNA, 16 bp, Artificial Sequence
  synthetic [barcode part1]
cacgtctctgttggac

SEQ ID NO: 7078 - DNA, 16 bp, Artificial Sequence
  synthetic [barcode part1]
tgcagacagtgttcgt

SEQ ID NO: 7079 - DNA, 16 bp, Artificial Sequence
  synthetic [barcode part1]
tcaaggcgacgagtgt

SEQ ID NO: 7080 - DNA, 16 bp, Artificial Sequence
  synthetic [barcode part1]
acactggccagatact

SEQ ID NO: 7081 - DNA, 16 bp, Artificial Sequence
  synthetic [barcode part1]
gtcacctcacttaggc

SEQ ID NO: 7082 - DNA, 16 bp, Artificial Sequence
  synthetic [barcode part1]
ttccgcaattgagttc

SEQ ID NO: 7083 - DNA, 16 bp, Artificial Sequence
  synthetic [barcode part1]
caataccggacgagtg

SEQ ID NO: 7084 - DNA, 16 bp, Artificial Sequence
  synthetic [barcode part1]
tgcggattaggatagt

SEQ ID NO: 7085 - DNA, 16 bp, Artificial Sequence
  synthetic [barcode part1]
gttgacgaacacacct

SEQ ID NO: 7086 - DNA, 16 bp, Artificial Sequence
  synthetic [barcode part1]
actcgttgaatctcgt

SEQ ID NO: 7087 - DNA, 16 bp, Artificial Sequence
  synthetic [barcode part1]
cgcaataagactctgc

SEQ ID NO: 7088 - DNA, 16 bp, Artificial Sequence
  synthetic [barcode part1]
tacttggaacctgcag

SEQ ID NO: 7089 - DNA, 16 bp, Artificial Sequence
  synthetic [barcode part1]
atccagagacaggacc

SEQ ID NO: 7090 - DNA, 16 bp, Artificial Sequence
  synthetic [barcode part1]
cgatatccagaactcg

SEQ ID NO: 7091 - DNA, 16 bp, Artificial Sequence
  synthetic [barcode part1]
aagtaacagttgtgcg

SEQ ID NO: 7092 - DNA, 16 bp, Artificial Sequence
  synthetic [barcode part1]
acagaattctgtcgcg

SEQ ID NO: 7093 - DNA, 16 bp, Artificial Sequence
  synthetic [barcode part1]
acgtgttagtgtaccg

SEQ ID NO: 7094 - DNA, 16 bp, Artificial Sequence
  synthetic [barcode part1]
gacttctcgcgagtct

SEQ ID NO: 7095 - DNA, 16 bp, Artificial Sequence
  synthetic [barcode part1]
cgtgttcaagtacgac

SEQ ID NO: 7096 - DNA, 16 bp, Artificial Sequence
  synthetic [barcode part1]
agtgatcagtccgatc

SEQ ID NO: 7097 - DNA, 16 bp, Artificial Sequence
  synthetic [barcode part1]
cgattgtacgattgcg

SEQ ID NO: 7098 - DNA, 16 bp, Artificial Sequence
  synthetic [barcode part1]
tcgatacctggtctcg

SEQ ID NO: 7099 - DNA, 16 bp, Artificial Sequence
  synthetic [barcode part1]
agagaacgtaggacgt

SEQ ID NO: 7100 - DNA, 16 bp, Artificial Sequence
  synthetic [barcode part1]
tgtaggtgtgacaggc

SEQ ID NO: 7101 - DNA, 16 bp, Artificial Sequence
  synthetic [barcode part1]
aacctcactacgacag

SEQ ID NO: 7102 - DNA, 16 bp, Artificial Sequence
  synthetic [barcode part1]
tccgtaccgatctgac

SEQ ID NO: 7103 - DNA, 16 bp, Artificial Sequence
  synthetic [barcode part1]
atccaacaagaacacg

SEQ ID NO: 7104 - DNA, 16 bp, Artificial Sequence
  synthetic [barcode part1]
ccgcgaattactgtcc

SEQ ID NO: 7105 - DNA, 16 bp, Artificial Sequence
  synthetic [barcode part1]
cagtcgactagtcagt

SEQ ID NO: 7106 - DNA, 16 bp, Artificial Sequence
  synthetic [barcode part1]
aaggaattcacacgac

SEQ ID NO: 7107 - DNA, 16 bp, Artificial Sequence
  synthetic [barcode part1]
actcttattcaacggc

SEQ ID NO: 7108 - DNA, 16 bp, Artificial Sequence
  synthetic [barcode part1]
aggtcgaactgtgcag

SEQ ID NO: 7109 - DNA, 16 bp, Artificial Sequence
  synthetic [barcode part1]
gatctgtgttcgcaag

SEQ ID NO: 7110 - DNA, 16 bp, Artificial Sequence
  synthetic [barcode part1]
tgcgatatctgaggtc

SEQ ID NO: 7111 - DNA, 16 bp, Artificial Sequence
  synthetic [barcode part1]
acagttgacacaccac

SEQ ID NO: 7112 - DNA, 16 bp, Artificial Sequence
  synthetic [barcode part1]
gtatacctaaggagtg

SEQ ID NO: 7113 - DNA, 16 bp, Artificial Sequence
  synthetic [barcode part1]
ccttcggtcctaatct

SEQ ID NO: 7114 - DNA, 16 bp, Artificial Sequence
  synthetic [barcode part1]
attcactggacagacc

SEQ ID NO: 7115 - DNA, 16 bp, Artificial Sequence
  synthetic [barcode part1]
agaagttacgccggtg

SEQ ID NO: 7116 - DNA, 16 bp, Artificial Sequence
  synthetic [barcode part1]
tgttgttcaccttgcc

SEQ ID NO: 7117 - DNA, 16 bp, Artificial Sequence
  synthetic [barcode part1]
caaggagtgacacgtc

SEQ ID NO: 7118 - DNA, 16 bp, Artificial Sequence
  synthetic [barcode part1]
ccgttattcacaggtt

SEQ ID NO: 7119 - DNA, 16 bp, Artificial Sequence
  synthetic [barcode part1]
cggactagtgcagagt

SEQ ID NO: 7120 - DNA, 16 bp, Artificial Sequence
  synthetic [barcode part1]
cactcctagttgccag

SEQ ID NO: 7121 - DNA, 16 bp, Artificial Sequence
  synthetic [barcode part1]
acttcgtgttcctcgt

SEQ ID NO: 7122 - DNA, 16 bp, Artificial Sequence
  synthetic [barcode part1]
taaggaactggaaggc

SEQ ID NO: 7123 - DNA, 16 bp, Artificial Sequence
  synthetic [barcode part1]
cgcaatactcgttcgc

SEQ ID NO: 7124 - DNA, 16 bp, Artificial Sequence
  synthetic [barcode part1]
tgaactgtgacgactc

SEQ ID NO: 7125 - DNA, 16 bp, Artificial Sequence
  synthetic [barcode part1]
acggtgaacttctcag

SEQ ID NO: 7126 - DNA, 16 bp, Artificial Sequence
  synthetic [barcode part1]
aggcaggtcacctatt

SEQ ID NO: 7127 - DNA, 16 bp, Artificial Sequence
  synthetic [barcode part1]
gactaaccgactaacc

SEQ ID NO: 7128 - DNA, 16 bp, Artificial Sequence
  synthetic [barcode part1]
gtcacgcaaggtaacg

SEQ ID NO: 7129 - DNA, 16 bp, Artificial Sequence
  synthetic [barcode part1]
agagtcctactgtggt

SEQ ID NO: 7130 - DNA, 16 bp, Artificial Sequence
  synthetic [barcode part1]
tcgaggccacttgttc

SEQ ID NO: 7131 - DNA, 16 bp, Artificial Sequence
  synthetic [barcode part1]
aaggttcgatatcgcc

SEQ ID NO: 7132 - DNA, 16 bp, Artificial Sequence
  synthetic [barcode part1]
gtggttgttaaggagt

SEQ ID NO: 7133 - DNA, 16 bp, Artificial Sequence
  synthetic [barcode part1]
gcgtagattatcgaag

SEQ ID NO: 7134 - DNA, 16 bp, Artificial Sequence
  synthetic [barcode part1]
agaccgtattctcgtt

SEQ ID NO: 7135 - DNA, 16 bp, Artificial Sequence
  synthetic [barcode part1]
attggacgtggaggtc

SEQ ID NO: 7136 - DNA, 16 bp, Artificial Sequence
  synthetic [barcode part1]
acctggagtagatcct

SEQ ID NO: 7137 - DNA, 16 bp, Artificial Sequence
  synthetic [barcode part1]
atatacacgtgtgcgc

SEQ ID NO: 7138 - DNA, 16 bp, Artificial Sequence
  synthetic [barcode part1]
tgttctgtagacgtct

SEQ ID NO: 7139 - DNA, 16 bp, Artificial Sequence
  synthetic [barcode part1]
gtagaatcaggcaccg

SEQ ID NO: 7140 - DNA, 16 bp, Artificial Sequence
  synthetic [barcode part1]
gttagtgagtggtaac

SEQ ID NO: 7141 - DNA, 16 bp, Artificial Sequence
  synthetic [barcode part1]
tcgatccggacacttc

SEQ ID NO: 7142 - DNA, 16 bp, Artificial Sequence
  synthetic [barcode part1]
gactacaaccggtatc

SEQ ID NO: 7143 - DNA, 16 bp, Artificial Sequence
  synthetic [barcode part1]
agagaccgcacactag

SEQ ID NO: 7144 - DNA, 16 bp, Artificial Sequence
  synthetic [barcode part1]
accttgttctacgagt

SEQ ID NO: 7145 - DNA, 16 bp, Artificial Sequence
  synthetic [barcode part1]
gaatcaagttacgcag

SEQ ID NO: 7146 - DNA, 16 bp, Artificial Sequence
  synthetic [barcode part1]
cacctgcaacgtcgtt

SEQ ID NO: 7147 - DNA, 16 bp, Artificial Sequence
  synthetic [barcode part1]
actgtcagtgtctccg

SEQ ID NO: 7148 - DNA, 16 bp, Artificial Sequence
  synthetic [barcode part1]
gccgtggttatctatt

SEQ ID NO: 7149 - DNA, 16 bp, Artificial Sequence
  synthetic [barcode part1]
gtgtctatatcgtctg

SEQ ID NO: 7150 - DNA, 16 bp, Artificial Sequence
  synthetic [barcode part1]
gagttggtggttgcag

SEQ ID NO: 7151 - DNA, 16 bp, Artificial Sequence
  synthetic [barcode part1]
tagtacgacacctgac

SEQ ID NO: 7152 - DNA, 16 bp, Artificial Sequence
  synthetic [barcode part1]
gaagaccttccaatcg

SEQ ID NO: 7153 - DNA, 16 bp, Artificial Sequence
  synthetic [barcode part1]
ccagagataactctcg

SEQ ID NO: 7154 - DNA, 16 bp, Artificial Sequence
  synthetic [barcode part1]
tggaggttgccaagtg

SEQ ID NO: 7155 - DNA, 16 bp, Artificial Sequence
  synthetic [barcode part1]
tggaacgaacgtattg

SEQ ID NO: 7156 - DNA, 16 bp, Artificial Sequence
  synthetic [barcode part1]
accagagagttaggag

SEQ ID NO: 7157 - DNA, 16 bp, Artificial Sequence
  synthetic [barcode part1]
atcggagtggttgcag

SEQ ID NO: 7158 - DNA, 16 bp, Artificial Sequence
  synthetic [barcode part1]
acaactggtgttgacc

SEQ ID NO: 7159 - DNA, 16 bp, Artificial Sequence
  synthetic [barcode part1]
gccagaatcgaagaag

SEQ ID NO: 7160 - DNA, 16 bp, Artificial Sequence
  synthetic [barcode part1]
gtcggacgtctaatac

SEQ ID NO: 7161 - DNA, 16 bp, Artificial Sequence
  synthetic [barcode part1]
atctatcgcctactcc

SEQ ID NO: 7162 - DNA, 16 bp, Artificial Sequence
  synthetic [barcode part1]
cacgttaaccgtacag

SEQ ID NO: 7163 - DNA, 16 bp, Artificial Sequence
  synthetic [barcode part1]
agaatcctccacttac

SEQ ID NO: 7164 - DNA, 16 bp, Artificial Sequence
  synthetic [barcode part1]
agaggaattccggaag

SEQ ID NO: 7165 - DNA, 16 bp, Artificial Sequence
  synthetic [barcode part1]
agacactgcagatctc

SEQ ID NO: 7166 - DNA, 16 bp, Artificial Sequence
  synthetic [barcode part1]
ttcttctctgaggcct

SEQ ID NO: 7167 - DNA, 16 bp, Artificial Sequence
  synthetic [barcode part1]
cgttagtataccggtg

SEQ ID NO: 7168 - DNA, 16 bp, Artificial Sequence
  synthetic [barcode part1]
cgcactgatataccag

SEQ ID NO: 7169 - DNA, 16 bp, Artificial Sequence
  synthetic [barcode part1]
aacctgagaggacacc

SEQ ID NO: 7170 - DNA, 16 bp, Artificial Sequence
  synthetic [barcode part1]
cacgaagtagttcaag

SEQ ID NO: 7171 - DNA, 16 bp, Artificial Sequence
  synthetic [barcode part1]
gttcctgtatcggacc

SEQ ID NO: 7172 - DNA, 16 bp, Artificial Sequence
  synthetic [barcode part1]
gacgaagatcacttcc

SEQ ID NO: 7173 - DNA, 16 bp, Artificial Sequence
  synthetic [barcode part1]
gacagttcgcactctc

SEQ ID NO: 7174 - DNA, 16 bp, Artificial Sequence
  synthetic [barcode part1]
actgtggaacaggcgt

SEQ ID NO: 7175 - DNA, 16 bp, Artificial Sequence
  synthetic [barcode part1]
gatcttgtcgtggtag

SEQ ID NO: 7176 - DNA, 16 bp, Artificial Sequence
  synthetic [barcode part1]
ttgttatccgcagact

SEQ ID NO: 7177 - DNA, 16 bp, Artificial Sequence
  synthetic [barcode part1]
cgattactatcggcag

SEQ ID NO: 7178 - DNA, 16 bp, Artificial Sequence
  synthetic [barcode part1]
gttattacctcgcgcg

SEQ ID NO: 7179 - DNA, 16 bp, Artificial Sequence
  synthetic [barcode part1]
gagacggcactcaagt

SEQ ID NO: 7180 - DNA, 16 bp, Artificial Sequence
  synthetic [barcode part1]
tgcagatacggacttc

SEQ ID NO: 7181 - DNA, 16 bp, Artificial Sequence
  synthetic [barcode part1]
aataaggaaggcggtc

SEQ ID NO: 7182 - DNA, 16 bp, Artificial Sequence
  synthetic [barcode part1]
tctactacttcgccac

SEQ ID NO: 7183 - DNA, 16 bp, Artificial Sequence
  synthetic [barcode part1]
gcactgacctctggtt

SEQ ID NO: 7184 - DNA, 16 bp, Artificial Sequence
  synthetic [barcode part1]
cgagaggaccaacgtt

SEQ ID NO: 7185 - DNA, 16 bp, Artificial Sequence
  synthetic [barcode part1]
ttccaccaggttcacg

SEQ ID NO: 7186 - DNA, 16 bp, Artificial Sequence
  synthetic [barcode part1]
gttgcaggtctatctt

SEQ ID NO: 7187 - DNA, 16 bp, Artificial Sequence
  synthetic [barcode part1]
aaggattaccggcgtg

SEQ ID NO: 7188 - DNA, 16 bp, Artificial Sequence
  synthetic [barcode part1]
cctcgacggtcgtatt

SEQ ID NO: 7189 - DNA, 16 bp, Artificial Sequence
  synthetic [barcode part1]
aattcctaggaaccgc

SEQ ID NO: 7190 - DNA, 16 bp, Artificial Sequence
  synthetic [barcode part1]
gtgtcaagtgcctaac

SEQ ID NO: 7191 - DNA, 16 bp, Artificial Sequence
  synthetic [barcode part1]
attcgttacctgcctc

SEQ ID NO: 7192 - DNA, 16 bp, Artificial Sequence
  synthetic [barcode part1]
ttctatctgttcggag

SEQ ID NO: 7193 - DNA, 16 bp, Artificial Sequence
  synthetic [barcode part1]
tactctgacggcaagt

SEQ ID NO: 7194 - DNA, 16 bp, Artificial Sequence
  synthetic [barcode part1]
tatcttctcggcgacg

SEQ ID NO: 7195 - DNA, 16 bp, Artificial Sequence
  synthetic [barcode part1]
acggttattgacttcc

SEQ ID NO: 7196 - DNA, 16 bp, Artificial Sequence
  synthetic [barcode part1]
tggaatcctctcttcc

SEQ ID NO: 7197 - DNA, 16 bp, Artificial Sequence
  synthetic [barcode part1]
aactaccgtctgacag

SEQ ID NO: 7198 - DNA, 16 bp, Artificial Sequence
  synthetic [barcode part1]
taccgttgttcagact

SEQ ID NO: 7199 - DNA, 16 bp, Artificial Sequence
  synthetic [barcode part1]
gttcggattcgagtgt

SEQ ID NO: 7200 - DNA, 16 bp, Artificial Sequence
  synthetic [barcode part1]
gccgacacaaggaatc

SEQ ID NO: 7201 - DNA, 16 bp, Artificial Sequence
  synthetic [barcode part1]
gtgtgattcaatctcc

SEQ ID NO: 7202 - DNA, 16 bp, Artificial Sequence
  synthetic [barcode part1]
acgagtcagtcacgtt

SEQ ID NO: 7203 - DNA, 16 bp, Artificial Sequence
  synthetic [barcode part1]
cggaatcaaggtctct

SEQ ID NO: 7204 - DNA, 16 bp, Artificial Sequence
  synthetic [barcode part1]
cgacaattgattcggc

SEQ ID NO: 7205 - DNA, 16 bp, Artificial Sequence
  synthetic [barcode part1]
gtacgattgtgaccac

SEQ ID NO: 7206 - DNA, 16 bp, Artificial Sequence
  synthetic [barcode part1]
ttacttcaaggcgacg

SEQ ID NO: 7207 - DNA, 16 bp, Artificial Sequence
  synthetic [barcode part1]
actaggttccgacaac

SEQ ID NO: 7208 - DNA, 16 bp, Artificial Sequence
  synthetic [barcode part1]
gacactagaagaggac

SEQ ID NO: 7209 - DNA, 16 bp, Artificial Sequence
  synthetic [barcode part1]
gagtatcaggtctgtc

SEQ ID NO: 7210 - DNA, 16 bp, Artificial Sequence
  synthetic [barcode part1]
aactacgcagttacgc

SEQ ID NO: 7211 - DNA, 16 bp, Artificial Sequence
  synthetic [barcode part1]
atcacgaagacaagtc

SEQ ID NO: 7212 - DNA, 16 bp, Artificial Sequence
  synthetic [barcode part1]
cacaggaactagattg

SEQ ID NO: 7213 - DNA, 16 bp, Artificial Sequence
  synthetic [barcode part1]
accgtcttcgtaggtc

SEQ ID NO: 7214 - DNA, 16 bp, Artificial Sequence
  synthetic [barcode part1]
caggtatccagtacac

SEQ ID NO: 7215 - DNA, 16 bp, Artificial Sequence
  synthetic [barcode part1]
aacaattgttgccggc

SEQ ID NO: 7216 - DNA, 16 bp, Artificial Sequence
  synthetic [barcode part1]
cagtactccacctacg

SEQ ID NO: 7217 - DNA, 16 bp, Artificial Sequence
  synthetic [barcode part1]
acttccaagatcgtct

SEQ ID NO: 7218 - DNA, 16 bp, Artificial Sequence
  synthetic [barcode part1]
caagaatagattgccg

SEQ ID NO: 7219 - DNA, 16 bp, Artificial Sequence
  synthetic [barcode part1]
gaccacggagagattc

SEQ ID NO: 7220 - DNA, 16 bp, Artificial Sequence
  synthetic [barcode part1]
accgcgtggaataacg

SEQ ID NO: 7221 - DNA, 16 bp, Artificial Sequence
  synthetic [barcode part1]
atcagtgccaccgttc

SEQ ID NO: 7222 - DNA, 16 bp, Artificial Sequence
  synthetic [barcode part1]
tctcaatcggtctctc

SEQ ID NO: 7223 - DNA, 16 bp, Artificial Sequence
  synthetic [barcode part1]
acgttgtggcgaacag

SEQ ID NO: 7224 - DNA, 16 bp, Artificial Sequence
  synthetic [barcode part1]
gtctctgagattatcc

SEQ ID NO: 7225 - DNA, 16 bp, Artificial Sequence
  synthetic [barcode part1]
ccacgtcggattgtct

SEQ ID NO: 7226 - DNA, 16 bp, Artificial Sequence
  synthetic [barcode part1]
gcaccagttagtgtac

SEQ ID NO: 7227 - DNA, 16 bp, Artificial Sequence
  synthetic [barcode part1]
atcttcggcagtccgt

SEQ ID NO: 7228 - DNA, 16 bp, Artificial Sequence
  synthetic [barcode part1]
ccttcgattcttcgac

SEQ ID NO: 7229 - DNA, 16 bp, Artificial Sequence
  synthetic [barcode part1]
aaggttagaaggccag

SEQ ID NO: 7230 - DNA, 16 bp, Artificial Sequence
  synthetic [barcode part1]
gcgactattccaactt

SEQ ID NO: 7231 - DNA, 16 bp, Artificial Sequence
  synthetic [barcode part1]
tcttagttctcgtcgc

SEQ ID NO: 7232 - DNA, 16 bp, Artificial Sequence
  synthetic [barcode part1]
gttacttgcctcactc

SEQ ID NO: 7233 - DNA, 16 bp, Artificial Sequence
  synthetic [barcode part1]
agacctgtctaatcct

SEQ ID NO: 7234 - DNA, 16 bp, Artificial Sequence
  synthetic [barcode part1]
aatcaagacgatcacg

SEQ ID NO: 7235 - DNA, 16 bp, Artificial Sequence
  synthetic [barcode part1]
agataacgtatccgag

SEQ ID NO: 7236 - DNA, 16 bp, Artificial Sequence
  synthetic [barcode part1]
tctgatccggcgtgtt

SEQ ID NO: 7237 - DNA, 16 bp, Artificial Sequence
  synthetic [barcode part1]
tcggcacagagagttg

SEQ ID NO: 7238 - DNA, 16 bp, Artificial Sequence
  synthetic [barcode part1]
gtacaacagtcgaggc

SEQ ID NO: 7239 - DNA, 16 bp, Artificial Sequence
  synthetic [barcode part1]
gtccggttacagagag

SEQ ID NO: 7240 - DNA, 16 bp, Artificial Sequence
  synthetic [barcode part1]
atcacaggaactctgc

SEQ ID NO: 7241 - DNA, 16 bp, Artificial Sequence
  synthetic [barcode part1]
ttagttccgttggcgc

SEQ ID NO: 7242 - DNA, 16 bp, Artificial Sequence
  synthetic [barcode part1]
acaatcagagactggt

SEQ ID NO: 7243 - DNA, 16 bp, Artificial Sequence
  synthetic [barcode part1]
gaggactacacgtcag

SEQ ID NO: 7244 - DNA, 16 bp, Artificial Sequence
  synthetic [barcode part1]
gtaggcactgtggtag

SEQ ID NO: 7245 - DNA, 16 bp, Artificial Sequence
  synthetic [barcode part1]
tctgtgttgacctagt

SEQ ID NO: 7246 - DNA, 16 bp, Artificial Sequence
  synthetic [barcode part1]
acggactgttgcctct

SEQ ID NO: 7247 - DNA, 16 bp, Artificial Sequence
  synthetic [barcode part1]
tctaccgaaggtaacc

SEQ ID NO: 7248 - DNA, 16 bp, Artificial Sequence
  synthetic [barcode part1]
tcgtctctctctagtg

SEQ ID NO: 7249 - DNA, 16 bp, Artificial Sequence
  synthetic [barcode part1]
ccagtccggtaatagt

SEQ ID NO: 7250 - DNA, 16 bp, Artificial Sequence
  synthetic [barcode part1]
ttctgcacaacctagt

SEQ ID NO: 7251 - DNA, 16 bp, Artificial Sequence
  synthetic [barcode part1]
cgtacaattcgatctc

SEQ ID NO: 7252 - DNA, 16 bp, Artificial Sequence
  synthetic [barcode part1]
actctcggtccgatac

SEQ ID NO: 7253 - DNA, 16 bp, Artificial Sequence
  synthetic [barcode part1]
gtataagtcactggag

SEQ ID NO: 7254 - DNA, 16 bp, Artificial Sequence
  synthetic [barcode part1]
ttgccacaggttcgtc

SEQ ID NO: 7255 - DNA, 16 bp, Artificial Sequence
  synthetic [barcode part1]
aatactgcgcggtgtt

SEQ ID NO: 7256 - DNA, 16 bp, Artificial Sequence
  synthetic [barcode part1]
cgagttaacgcggaac

SEQ ID NO: 7257 - DNA, 16 bp, Artificial Sequence
  synthetic [barcode part1]
ttatccgccgtctgtt

SEQ ID NO: 7258 - DNA, 16 bp, Artificial Sequence
  synthetic [barcode part1]
tcgtaccacaaggatc

SEQ ID NO: 7259 - DNA, 16 bp, Artificial Sequence
  synthetic [barcode part1]
aagtggagtgatacct

SEQ ID NO: 7260 - DNA, 16 bp, Artificial Sequence
  synthetic [barcode part1]
aatccggacgtgaggt

SEQ ID NO: 7261 - DNA, 16 bp, Artificial Sequence
  synthetic [barcode part1]
aacacgtactgtgtgc

SEQ ID NO: 7262 - DNA, 16 bp, Artificial Sequence
  synthetic [barcode part1]
tgagtacgacttgcac

SEQ ID NO: 7263 - DNA, 16 bp, Artificial Sequence
  synthetic [barcode part1]
ataagtgccacagtag

SEQ ID NO: 7264 - DNA, 16 bp, Artificial Sequence
  synthetic [barcode part1]
aacgactctagtgacc

SEQ ID NO: 7265 - DNA, 16 bp, Artificial Sequence
  synthetic [barcode part1]
caggaggcagttgtgt

SEQ ID NO: 7266 - DNA, 16 bp, Artificial Sequence
  synthetic [barcode part1]
tctccagtcctgattc

SEQ ID NO: 7267 - DNA, 16 bp, Artificial Sequence
  synthetic [barcode part1]
ccaacagattctcgtt

SEQ ID NO: 7268 - DNA, 16 bp, Artificial Sequence
  synthetic [barcode part1]
tggtcctcaatatacc

SEQ ID NO: 7269 - DNA, 16 bp, Artificial Sequence
  synthetic [barcode part1]
tgtgaacctcgttgcc

SEQ ID NO: 7270 - DNA, 16 bp, Artificial Sequence
  synthetic [barcode part1]
cgttagaacctgacac

SEQ ID NO: 7271 - DNA, 16 bp, Artificial Sequence
  synthetic [barcode part1]
aggacgtgtgtaagag

SEQ ID NO: 7272 - DNA, 16 bp, Artificial Sequence
  synthetic [barcode part1]
tggtcttgtcagtact

SEQ ID NO: 7273 - DNA, 16 bp, Artificial Sequence
  synthetic [barcode part1]
cgtgtctatccttgtc

SEQ ID NO: 7274 - DNA, 16 bp, Artificial Sequence
  synthetic [barcode part1]
gaatccacgttgacac

SEQ ID NO: 7275 - DNA, 16 bp, Artificial Sequence
  synthetic [barcode part1]
tcgagagttgatacag

SEQ ID NO: 7276 - DNA, 16 bp, Artificial Sequence
  synthetic [barcode part1]
cggttgattgatcggt

SEQ ID NO: 7277 - DNA, 16 bp, Artificial Sequence
  synthetic [barcode part1]
aacgttgtcgattggc

SEQ ID NO: 7278 - DNA, 16 bp, Artificial Sequence
  synthetic [barcode part1]
acctacaatcacttcg

SEQ ID NO: 7279 - DNA, 16 bp, Artificial Sequence
  synthetic [barcode part1]
tgttactgtagtcacc

SEQ ID NO: 7280 - DNA, 16 bp, Artificial Sequence
  synthetic [barcode part1]
acaactctccacaccg

SEQ ID NO: 7281 - DNA, 16 bp, Artificial Sequence
  synthetic [barcode part1]
gatatcaccgaccagt

SEQ ID NO: 7282 - DNA, 16 bp, Artificial Sequence
  synthetic [barcode part1]
acgttaggttactctc

SEQ ID NO: 7283 - DNA, 16 bp, Artificial Sequence
  synthetic [barcode part1]
aacgaaggcactcggt

SEQ ID NO: 7284 - DNA, 16 bp, Artificial Sequence
  synthetic [barcode part1]
aacctaggactcagtc

SEQ ID NO: 7285 - DNA, 16 bp, Artificial Sequence
  synthetic [barcode part1]
gagaatagtccaacac

SEQ ID NO: 7286 - DNA, 16 bp, Artificial Sequence
  synthetic [barcode part1]
agatagagtctcgaac

SEQ ID NO: 7287 - DNA, 16 bp, Artificial Sequence
  synthetic [barcode part1]
tgagaggcagttgtgc

SEQ ID NO: 7288 - DNA, 16 bp, Artificial Sequence
  synthetic [barcode part1]
tcgtgattaaccggtg

SEQ ID NO: 7289 - DNA, 16 bp, Artificial Sequence
  synthetic [barcode part1]
atcggtagagtactcc

SEQ ID NO: 7290 - DNA, 16 bp, Artificial Sequence
  synthetic [barcode part1]
ttgttctcgtagactg

SEQ ID NO: 7291 - DNA, 16 bp, Artificial Sequence
  synthetic [barcode part1]
ttcttacctcggtaag

SEQ ID NO: 7292 - DNA, 16 bp, Artificial Sequence
  synthetic [barcode part1]
gtctaactgtaggaag

SEQ ID NO: 7293 - DNA, 16 bp, Artificial Sequence
  synthetic [barcode part1]
gtgttggaaccgtgtt

SEQ ID NO: 7294 - DNA, 16 bp, Artificial Sequence
  synthetic [barcode part1]
caccgaagacacgagt

SEQ ID NO: 7295 - DNA, 16 bp, Artificial Sequence
  synthetic [barcode part1]
tacagatctactccgt

SEQ ID NO: 7296 - DNA, 16 bp, Artificial Sequence
  synthetic [barcode part1]
aaggtccagtggacgt

SEQ ID NO: 7297 - DNA, 16 bp, Artificial Sequence
  synthetic [barcode part1]
tggtcttgaggaacct

SEQ ID NO: 7298 - DNA, 16 bp, Artificial Sequence
  synthetic [barcode part1]
cctaattacgtcaacc

SEQ ID NO: 7299 - DNA, 16 bp, Artificial Sequence
  synthetic [barcode part1]
atctataccggcacag

SEQ ID NO: 7300 - DNA, 16 bp, Artificial Sequence
  synthetic [barcode part1]
aggttggtgcaattag

SEQ ID NO: 7301 - DNA, 16 bp, Artificial Sequence
  synthetic [barcode part1]
tggttgttggactcag

SEQ ID NO: 7302 - DNA, 16 bp, Artificial Sequence
  synthetic [barcode part1]
acgacttaggttaccg

SEQ ID NO: 7303 - DNA, 16 bp, Artificial Sequence
  synthetic [barcode part1]
aataagacgcggatct

SEQ ID NO: 7304 - DNA, 16 bp, Artificial Sequence
  synthetic [barcode part1]
gaacggtaacttgtag

SEQ ID NO: 7305 - DNA, 16 bp, Artificial Sequence
  synthetic [barcode part1]
ttcaaggtcaactggc

SEQ ID NO: 7306 - DNA, 16 bp, Artificial Sequence
  synthetic [barcode part1]
aggcctgataattgcc

SEQ ID NO: 7307 - DNA, 16 bp, Artificial Sequence
  synthetic [barcode part1]
ttggaacgtcctgaac

SEQ ID NO: 7308 - DNA, 16 bp, Artificial Sequence
  synthetic [barcode part1]
aacgtgcaatctctct

SEQ ID NO: 7309 - DNA, 16 bp, Artificial Sequence
  synthetic [barcode part1]
cctgaatcgttctgcg

SEQ ID NO: 7310 - DNA, 16 bp, Artificial Sequence
  synthetic [barcode part1]
cagaaggcaattgcgc

SEQ ID NO: 7311 - DNA, 16 bp, Artificial Sequence
  synthetic [barcode part1]
gtactacttcggaacg

SEQ ID NO: 7312 - DNA, 16 bp, Artificial Sequence
  synthetic [barcode part1]
tagtcaaccagtcggt

SEQ ID NO: 7313 - DNA, 16 bp, Artificial Sequence
  synthetic [barcode part1]
ttggcagtacctccgt

SEQ ID NO: 7314 - DNA, 16 bp, Artificial Sequence
  synthetic [barcode part1]
gttacggtccaagact

SEQ ID NO: 7315 - DNA, 16 bp, Artificial Sequence
  synthetic [barcode part1]
caactacgtcttctag

SEQ ID NO: 7316 - DNA, 16 bp, Artificial Sequence
  synthetic [barcode part1]
tcctaccgttctactg

SEQ ID NO: 7317 - DNA, 16 bp, Artificial Sequence
  synthetic [barcode part1]
tacggtagacaagtac

SEQ ID NO: 7318 - DNA, 16 bp, Artificial Sequence
  synthetic [barcode part1]
gaataacgattgcacg

SEQ ID NO: 7319 - DNA, 16 bp, Artificial Sequence
  synthetic [barcode part1]
agaggacactcgagtc

SEQ ID NO: 7320 - DNA, 16 bp, Artificial Sequence
  synthetic [barcode part1]
cagtaacaactcggtc

SEQ ID NO: 7321 - DNA, 16 bp, Artificial Sequence
  synthetic [barcode part1]
tacgtctcggattact

SEQ ID NO: 7322 - DNA, 16 bp, Artificial Sequence
  synthetic [barcode part1]
caccgttacaaccgtc

SEQ ID NO: 7323 - DNA, 16 bp, Artificial Sequence
  synthetic [barcode part1]
tctagtccgtagttgt

SEQ ID NO: 7324 - DNA, 16 bp, Artificial Sequence
  synthetic [barcode part1]
tctccgatacaattgc

SEQ ID NO: 7325 - DNA, 16 bp, Artificial Sequence
  synthetic [barcode part1]
taacagacgaacgccg

SEQ ID NO: 7326 - DNA, 16 bp, Artificial Sequence
  synthetic [barcode part1]
aattctcgcgtctaac

SEQ ID NO: 7327 - DNA, 16 bp, Artificial Sequence
  synthetic [barcode part1]
gaacacgtagtaatcg

SEQ ID NO: 7328 - DNA, 16 bp, Artificial Sequence
  synthetic [barcode part1]
cgatacgaacctgtgt

SEQ ID NO: 7329 - DNA, 16 bp, Artificial Sequence
  synthetic [barcode part1]
cgagagtgaaccactg

SEQ ID NO: 7330 - DNA, 16 bp, Artificial Sequence
  synthetic [barcode part1]
tgcgtgcgattaatcg

SEQ ID NO: 7331 - DNA, 16 bp, Artificial Sequence
  synthetic [barcode part1]
gaacagagtgacactt

SEQ ID NO: 7332 - DNA, 16 bp, Artificial Sequence
  synthetic [barcode part1]
gcaatacttccggaac

SEQ ID NO: 7333 - DNA, 16 bp, Artificial Sequence
  synthetic [barcode part1]
cgtccagaaggatcag

SEQ ID NO: 7334 - DNA, 16 bp, Artificial Sequence
  synthetic [barcode part1]
ttcgatccaactacgt

SEQ ID NO: 7335 - DNA, 16 bp, Artificial Sequence
  synthetic [barcode part1]
tcgtgcggattcttcg

SEQ ID NO: 7336 - DNA, 16 bp, Artificial Sequence
  synthetic [barcode part1]
atactccggttactgt

SEQ ID NO: 7337 - DNA, 16 bp, Artificial Sequence
  synthetic [barcode part1]
agagttcggtgttacc

SEQ ID NO: 7338 - DNA, 16 bp, Artificial Sequence
  synthetic [barcode part1]
taaggtctccttctcc

SEQ ID NO: 7339 - DNA, 16 bp, Artificial Sequence
  synthetic [barcode part1]
cctcggtaatcgtatt

SEQ ID NO: 7340 - DNA, 16 bp, Artificial Sequence
  synthetic [barcode part1]
ttctctccaatcgacc

SEQ ID NO: 7341 - DNA, 16 bp, Artificial Sequence
  synthetic [barcode part1]
gtcctcgattctcgtt

SEQ ID NO: 7342 - DNA, 16 bp, Artificial Sequence
  synthetic [barcode part1]
gcaactaagttgagac

SEQ ID NO: 7343 - DNA, 16 bp, Artificial Sequence
  synthetic [barcode part1]
cacaacacttgaggtc

SEQ ID NO: 7344 - DNA, 16 bp, Artificial Sequence
  synthetic [barcode part1]
gccggacaacaatctt

SEQ ID NO: 7345 - DNA, 16 bp, Artificial Sequence
  synthetic [barcode part1]
aagaggtgaacacctt

SEQ ID NO: 7346 - DNA, 16 bp, Artificial Sequence
  synthetic [barcode part1]
tatcactgtaaccgtc

SEQ ID NO: 7347 - DNA, 16 bp, Artificial Sequence
  synthetic [barcode part1]
tgtacggtagacctgt

SEQ ID NO: 7348 - DNA, 16 bp, Artificial Sequence
  synthetic [barcode part1]
ttgcaccgagttgtcc

SEQ ID NO: 7349 - DNA, 16 bp, Artificial Sequence
  synthetic [barcode part1]
cggtcctatcagtatt

SEQ ID NO: 7350 - DNA, 16 bp, Artificial Sequence
  synthetic [barcode part1]
tgtccacgcaatattc

SEQ ID NO: 7351 - DNA, 16 bp, Artificial Sequence
  synthetic [barcode part1]
tcggatactacttcac

SEQ ID NO: 7352 - DNA, 16 bp, Artificial Sequence
  synthetic [barcode part1]
taactcgtggaagtag

SEQ ID NO: 7353 - DNA, 16 bp, Artificial Sequence
  synthetic [barcode part1]
atctatcgacaccgcc

SEQ ID NO: 7354 - DNA, 16 bp, Artificial Sequence
  synthetic [barcode part1]
acaggtcttaggcgtt

SEQ ID NO: 7355 - DNA, 16 bp, Artificial Sequence
  synthetic [barcode part1]
tctcgtatcagatcgt

SEQ ID NO: 7356 - DNA, 16 bp, Artificial Sequence
  synthetic [barcode part1]
tcgcgagtagaagacc

SEQ ID NO: 7357 - DNA, 16 bp, Artificial Sequence
  synthetic [barcode part1]
tcaatccttcgtgagt

SEQ ID NO: 7358 - DNA, 16 bp, Artificial Sequence
  synthetic [barcode part1]
tggattgaccgaactc

SEQ ID NO: 7359 - DNA, 16 bp, Artificial Sequence
  synthetic [barcode part1]
agtactgcacaacacc

SEQ ID NO: 7360 - DNA, 16 bp, Artificial Sequence
  synthetic [barcode part1]
tcggtatctctgattg

SEQ ID NO: 7361 - DNA, 16 bp, Artificial Sequence
  synthetic [barcode part1]
cgatcctgtgcgttac

SEQ ID NO: 7362 - DNA, 16 bp, Artificial Sequence
  synthetic [barcode part1]
gttggatctatacctc

SEQ ID NO: 7363 - DNA, 16 bp, Artificial Sequence
  synthetic [barcode part1]
cgcagacgacagaatc

SEQ ID NO: 7364 - DNA, 16 bp, Artificial Sequence
  synthetic [barcode part1]
cgttgttacgagacgt

SEQ ID NO: 7365 - DNA, 16 bp, Artificial Sequence
  synthetic [barcode part1]
gtacttccggtctggt

SEQ ID NO: 7366 - DNA, 16 bp, Artificial Sequence
  synthetic [barcode part1]
gtactggtcctcggtt

SEQ ID NO: 7367 - DNA, 16 bp, Artificial Sequence
  synthetic [barcode part1]
taaccagtcggttgac

SEQ ID NO: 7368 - DNA, 16 bp, Artificial Sequence
  synthetic [barcode part1]
cagtctcactacacgc

SEQ ID NO: 7369 - DNA, 16 bp, Artificial Sequence
  synthetic [barcode part1]
agagtgcctcttgtag

SEQ ID NO: 7370 - DNA, 16 bp, Artificial Sequence
  synthetic [barcode part1]
aagtacaatcaggtcg

SEQ ID NO: 7371 - DNA, 16 bp, Artificial Sequence
  synthetic [barcode part1]
agtattgcggtcgact

SEQ ID NO: 7372 - DNA, 16 bp, Artificial Sequence
  synthetic [barcode part1]
gaagtcggcacaactg

SEQ ID NO: 7373 - DNA, 16 bp, Artificial Sequence
  synthetic [barcode part1]
gagtaattacggactg

SEQ ID NO: 7374 - DNA, 16 bp, Artificial Sequence
  synthetic [barcode part1]
acacggactcaataag

SEQ ID NO: 7375 - DNA, 16 bp, Artificial Sequence
  synthetic [barcode part1]
cacttcgaacaggatc

SEQ ID NO: 7376 - DNA, 16 bp, Artificial Sequence
  synthetic [barcode part1]
tctcctgacagtcgtg

SEQ ID NO: 7377 - DNA, 16 bp, Artificial Sequence
  synthetic [barcode part1]
cgttccagaatctgcc

SEQ ID NO: 7378 - DNA, 16 bp, Artificial Sequence
  synthetic [barcode part1]
gagaacgccactagac

SEQ ID NO: 7379 - DNA, 16 bp, Artificial Sequence
  synthetic [barcode part1]
gtagacgcggaatctg

SEQ ID NO: 7380 - DNA, 16 bp, Artificial Sequence
  synthetic [barcode part1]
gatcacggccaatact

SEQ ID NO: 7381 - DNA, 16 bp, Artificial Sequence
  synthetic [barcode part1]
tgcgtaacttgattcc

SEQ ID NO: 7382 - DNA, 16 bp, Artificial Sequence
  synthetic [barcode part1]
gcacaacactgacact

SEQ ID NO: 7383 - DNA, 16 bp, Artificial Sequence
  synthetic [barcode part1]
acgtcttctgaactgt

SEQ ID NO: 7384 - DNA, 16 bp, Artificial Sequence
  synthetic [barcode part1]
tcacagtcaaccaacg

SEQ ID NO: 7385 - DNA, 16 bp, Artificial Sequence
  synthetic [barcode part1]
tccgtgtaattgccgc

SEQ ID NO: 7386 - DNA, 16 bp, Artificial Sequence
  synthetic [barcode part1]
tctgccgagaacaact

SEQ ID NO: 7387 - DNA, 16 bp, Artificial Sequence
  synthetic [barcode part1]
cagagagtagttgtac

SEQ ID NO: 7388 - DNA, 16 bp, Artificial Sequence
  synthetic [barcode part1]
gaggcgaacggattct

SEQ ID NO: 7389 - DNA, 16 bp, Artificial Sequence
  synthetic [barcode part1]
tgtgtacgtgtcacag

SEQ ID NO: 7390 - DNA, 16 bp, Artificial Sequence
  synthetic [barcode part1]
atctggatcgcgaatc

SEQ ID NO: 7391 - DNA, 16 bp, Artificial Sequence
  synthetic [barcode part1]
taactcgtccgcgttg

SEQ ID NO: 7392 - DNA, 16 bp, Artificial Sequence
  synthetic [barcode part1]
cgacttccttcgattc

SEQ ID NO: 7393 - DNA, 16 bp, Artificial Sequence
  synthetic [barcode part1]
agttccaggacaggtg

SEQ ID NO: 7394 - DNA, 16 bp, Artificial Sequence
  synthetic [barcode part1]
ttattgaggtctggcg

SEQ ID NO: 7395 - DNA, 16 bp, Artificial Sequence
  synthetic [barcode part1]
ccaatacctaattccg

SEQ ID NO: 7396 - DNA, 16 bp, Artificial Sequence
  synthetic [barcode part1]
tagtgcgtgatctctt

SEQ ID NO: 7397 - DNA, 16 bp, Artificial Sequence
  synthetic [barcode part1]
atcggccttaaggttg

SEQ ID NO: 7398 - DNA, 16 bp, Artificial Sequence
  synthetic [barcode part1]
tacgagtgagttcacc

SEQ ID NO: 7399 - DNA, 16 bp, Artificial Sequence
  synthetic [barcode part1]
ccggtaacgagaacgt

SEQ ID NO: 7400 - DNA, 16 bp, Artificial Sequence
  synthetic [barcode part1]
agttggtcgtatacgc

SEQ ID NO: 7401 - DNA, 16 bp, Artificial Sequence
  synthetic [barcode part1]
ttctcctgattccgac

SEQ ID NO: 7402 - DNA, 16 bp, Artificial Sequence
  synthetic [barcode part1]
caacgttcctatctag

SEQ ID NO: 7403 - DNA, 16 bp, Artificial Sequence
  synthetic [barcode part1]
gtcgtctgtggatctc

SEQ ID NO: 7404 - DNA, 16 bp, Artificial Sequence
  synthetic [barcode part1]
tcaagtgttcaggcac

SEQ ID NO: 7405 - DNA, 16 bp, Artificial Sequence
  synthetic [barcode part1]
acgttgaagttgcacc

SEQ ID NO: 7406 - DNA, 16 bp, Artificial Sequence
  synthetic [barcode part1]
acacactgttctctag

SEQ ID NO: 7407 - DNA, 16 bp, Artificial Sequence
  synthetic [barcode part1]
aacttaactcctgtgc

SEQ ID NO: 7408 - DNA, 16 bp, Artificial Sequence
  synthetic [barcode part1]
taggactaccacagtc

SEQ ID NO: 7409 - DNA, 16 bp, Artificial Sequence
  synthetic [barcode part1]
atctatcgcctgtctc

SEQ ID NO: 7410 - DNA, 16 bp, Artificial Sequence
  synthetic [barcode part1]
gaattccagagtctcg

SEQ ID NO: 7411 - DNA, 16 bp, Artificial Sequence
  synthetic [barcode part1]
agagatacaggaacgc

SEQ ID NO: 7412 - DNA, 16 bp, Artificial Sequence
  synthetic [barcode part1]
cggactaactaccagt

SEQ ID NO: 7413 - DNA, 16 bp, Artificial Sequence
  synthetic [barcode part1]
cagtacaactagagac

SEQ ID NO: 7414 - DNA, 16 bp, Artificial Sequence
  synthetic [barcode part1]
acacgtaggccaattc

SEQ ID NO: 7415 - DNA, 16 bp, Artificial Sequence
  synthetic [barcode part1]
ccagtctagtacgtcc

SEQ ID NO: 7416 - DNA, 16 bp, Artificial Sequence
  synthetic [barcode part1]
tcaacaccacagtcag

SEQ ID NO: 7417 - DNA, 16 bp, Artificial Sequence
  synthetic [barcode part1]
tgattccgtcggcgtt

SEQ ID NO: 7418 - DNA, 16 bp, Artificial Sequence
  synthetic [barcode part1]
tgtaaccacgtccaag

SEQ ID NO: 7419 - DNA, 16 bp, Artificial Sequence
  synthetic [barcode part1]
ttgattcgtgatcgtc

SEQ ID NO: 7420 - DNA, 16 bp, Artificial Sequence
  synthetic [barcode part1]
tgtaaccgatccacag

SEQ ID NO: 7421 - DNA, 16 bp, Artificial Sequence
  synthetic [barcode part1]
gccacagtgttcgttc

SEQ ID NO: 7422 - DNA, 16 bp, Artificial Sequence
  synthetic [barcode part1]
ccttagtgtgcctggt

SEQ ID NO: 7423 - DNA, 16 bp, Artificial Sequence
  synthetic [barcode part1]
taggtcagtcagatcc

SEQ ID NO: 7424 - DNA, 16 bp, Artificial Sequence
  synthetic [barcode part1]
tccggtccggtatact

SEQ ID NO: 7425 - DNA, 16 bp, Artificial Sequence
  synthetic [barcode part1]
tagtagtcgacctggt

SEQ ID NO: 7426 - DNA, 16 bp, Artificial Sequence
  synthetic [barcode part1]
ttctcctgaccgattc

SEQ ID NO: 7427 - DNA, 16 bp, Artificial Sequence
  synthetic [barcode part1]
tcacttgtctgaggtt

SEQ ID NO: 7428 - DNA, 16 bp, Artificial Sequence
  synthetic [barcode part1]
acgtgccaatagtaag

SEQ ID NO: 7429 - DNA, 16 bp, Artificial Sequence
  synthetic [barcode part1]
acctgaggtgaatcct

SEQ ID NO: 7430 - DNA, 16 bp, Artificial Sequence
  synthetic [barcode part1]
ttgtaccagatcacct

SEQ ID NO: 7431 - DNA, 16 bp, Artificial Sequence
  synthetic [barcode part1]
cacaagttctgccgtc

SEQ ID NO: 7432 - DNA, 16 bp, Artificial Sequence
  synthetic [barcode part1]
tgacgcactaacgtgt

SEQ ID NO: 7433 - DNA, 16 bp, Artificial Sequence
  synthetic [barcode part1]
tggaatacctgacctg

SEQ ID NO: 7434 - DNA, 16 bp, Artificial Sequence
  synthetic [barcode part1]
cagattgaggagtatc

SEQ ID NO: 7435 - DNA, 16 bp, Artificial Sequence
  synthetic [barcode part1]
agagtcgacgcaatcg

SEQ ID NO: 7436 - DNA, 16 bp, Artificial Sequence
  synthetic [barcode part1]
gaggacttcagagaag

SEQ ID NO: 7437 - DNA, 16 bp, Artificial Sequence
  synthetic [barcode part1]
aatccggatcgaacct

SEQ ID NO: 7438 - DNA, 16 bp, Artificial Sequence
  synthetic [barcode part1]
cacctcgcctgttatt

SEQ ID NO: 7439 - DNA, 16 bp, Artificial Sequence
  synthetic [barcode part1]
tacgtacgtaccacag

SEQ ID NO: 7440 - DNA, 16 bp, Artificial Sequence
  synthetic [barcode part1]
cgacgataacctggtt

SEQ ID NO: 7441 - DNA, 16 bp, Artificial Sequence
  synthetic [barcode part1]
caatccagacgattcg

SEQ ID NO: 7442 - DNA, 16 bp, Artificial Sequence
  synthetic [barcode part1]
tcacacaggccagaag

SEQ ID NO: 7443 - DNA, 16 bp, Artificial Sequence
  synthetic [barcode part1]
gcctggagtcctattc

SEQ ID NO: 7444 - DNA, 16 bp, Artificial Sequence
  synthetic [barcode part1]
gaggacaatcttcacc

SEQ ID NO: 7445 - DNA, 16 bp, Artificial Sequence
  synthetic [barcode part1]
aagaacggagttacct

SEQ ID NO: 7446 - DNA, 16 bp, Artificial Sequence
  synthetic [barcode part1]
ccggacgatcctactt

SEQ ID NO: 7447 - DNA, 16 bp, Artificial Sequence
  synthetic [barcode part1]
ccaacctcgagttcac

SEQ ID NO: 7448 - DNA, 16 bp, Artificial Sequence
  synthetic [barcode part1]
ccaccacttcactgtt

SEQ ID NO: 7449 - DNA, 16 bp, Artificial Sequence
  synthetic [barcode part1]
tctcctggtgatcgtg

SEQ ID NO: 7450 - DNA, 16 bp, Artificial Sequence
  synthetic [barcode part1]
gactcaggttgttggt

SEQ ID NO: 7451 - DNA, 16 bp, Artificial Sequence
  synthetic [barcode part1]
cgtccttctaataacg

SEQ ID NO: 7452 - DNA, 16 bp, Artificial Sequence
  synthetic [barcode part1]
tagtacgtcgagtacc

SEQ ID NO: 7453 - DNA, 16 bp, Artificial Sequence
  synthetic [barcode part1]
gccttcacaagttgcc

SEQ ID NO: 7454 - DNA, 16 bp, Artificial Sequence
  synthetic [barcode part1]
agtggagtataggttc

SEQ ID NO: 7455 - DNA, 16 bp, Artificial Sequence
  synthetic [barcode part1]
gactcaggatcgttgt

SEQ ID NO: 7456 - DNA, 16 bp, Artificial Sequence
  synthetic [barcode part1]
atcctatccacgtaac

SEQ ID NO: 7457 - DNA, 16 bp, Artificial Sequence
  synthetic [barcode part1]
tgaagataagtcaccg

SEQ ID NO: 7458 - DNA, 16 bp, Artificial Sequence
  synthetic [barcode part1]
gtcggtacgtctcgtt

SEQ ID NO: 7459 - DNA, 16 bp, Artificial Sequence
  synthetic [barcode part1]
tctccggtaattgtgt

SEQ ID NO: 7460 - DNA, 16 bp, Artificial Sequence
  synthetic [barcode part1]
cgtcttaccgtagatt

SEQ ID NO: 7461 - DNA, 16 bp, Artificial Sequence
  synthetic [barcode part1]
tgtgacaacttcaggc

SEQ ID NO: 7462 - DNA, 16 bp, Artificial Sequence
  synthetic [barcode part1]
gaagagtgagtatcct

SEQ ID NO: 7463 - DNA, 16 bp, Artificial Sequence
  synthetic [barcode part1]
tgccaatccgatcctg

SEQ ID NO: 7464 - DNA, 16 bp, Artificial Sequence
  synthetic [barcode part1]
tgactaggatcgactc

SEQ ID NO: 7465 - DNA, 16 bp, Artificial Sequence
  synthetic [barcode part1]
gccacacgttgagaag

SEQ ID NO: 7466 - DNA, 16 bp, Artificial Sequence
  synthetic [barcode part1]
ttacaaggtcctctgt

SEQ ID NO: 7467 - DNA, 16 bp, Artificial Sequence
  synthetic [barcode part1]
caacacgaccggaagt

SEQ ID NO: 7468 - DNA, 16 bp, Artificial Sequence
  synthetic [barcode part1]
ttcttagacgcactac

SEQ ID NO: 7469 - DNA, 16 bp, Artificial Sequence
  synthetic [barcode part1]
taagagtggcggtctg

SEQ ID NO: 7470 - DNA, 16 bp, Artificial Sequence
  synthetic [barcode part1]
acctattaggcgaacc

SEQ ID NO: 7471 - DNA, 16 bp, Artificial Sequence
  synthetic [barcode part1]
gacctctgcacagttc

SEQ ID NO: 7472 - DNA, 16 bp, Artificial Sequence
  synthetic [barcode part1]
tgtaccaacactgacg

SEQ ID NO: 7473 - DNA, 16 bp, Artificial Sequence
  synthetic [barcode part1]
tgaatcggactatcgc

SEQ ID NO: 7474 - DNA, 16 bp, Artificial Sequence
  synthetic [barcode part1]
cctgttccaggatctg

SEQ ID NO: 7475 - DNA, 16 bp, Artificial Sequence
  synthetic [barcode part1]
gtagaaggttactggt

SEQ ID NO: 7476 - DNA, 16 bp, Artificial Sequence
  synthetic [barcode part1]
agaatcaaccgaggag

SEQ ID NO: 7477 - DNA, 16 bp, Artificial Sequence
  synthetic [barcode part1]
ttctataccggtggtt

SEQ ID NO: 7478 - DNA, 16 bp, Artificial Sequence
  synthetic [barcode part1]
aataacgcctgtcgtg

SEQ ID NO: 7479 - DNA, 16 bp, Artificial Sequence
  synthetic [barcode part1]
tgtgtagacttcctac

SEQ ID NO: 7480 - DNA, 16 bp, Artificial Sequence
  synthetic [barcode part1]
tcacgatctgatcgag

SEQ ID NO: 7481 - DNA, 16 bp, Artificial Sequence
  synthetic [barcode part1]
tatcgttgcgaagtgc

SEQ ID NO: 7482 - DNA, 16 bp, Artificial Sequence
  synthetic [barcode part1]
tcgtgaattgcacgac

SEQ ID NO: 7483 - DNA, 16 bp, Artificial Sequence
  synthetic [barcode part1]
gtgacgataggtccag

SEQ ID NO: 7484 - DNA, 16 bp, Artificial Sequence
  synthetic [barcode part1]
attcttgcaggttgtc

SEQ ID NO: 7485 - DNA, 16 bp, Artificial Sequence
  synthetic [barcode part1]
cctctgagtgtcagtc

SEQ ID NO: 7486 - DNA, 16 bp, Artificial Sequence
  synthetic [barcode part1]
tgcgcacaactctaag

SEQ ID NO: 7487 - DNA, 16 bp, Artificial Sequence
  synthetic [barcode part1]
cgtaactggaagttag

SEQ ID NO: 7488 - DNA, 16 bp, Artificial Sequence
  synthetic [barcode part1]
taacggttcctgtgcc

SEQ ID NO: 7489 - DNA, 16 bp, Artificial Sequence
  synthetic [barcode part1]
aggcagatctattcgc

SEQ ID NO: 7490 - DNA, 16 bp, Artificial Sequence
  synthetic [barcode part1]
ccagagatcggtacag

SEQ ID NO: 7491 - DNA, 16 bp, Artificial Sequence
  synthetic [barcode part1]
acctgttccgtgacgt

SEQ ID NO: 7492 - DNA, 16 bp, Artificial Sequence
  synthetic [barcode part1]
cgccagtatattggtg

SEQ ID NO: 7493 - DNA, 16 bp, Artificial Sequence
  synthetic [barcode part1]
gtcgatagataacgac

SEQ ID NO: 7494 - DNA, 16 bp, Artificial Sequence
  synthetic [barcode part1]
acggtcgaactaggac

SEQ ID NO: 7495 - DNA, 16 bp, Artificial Sequence
  synthetic [barcode part1]
gccaggtacttgatac

SEQ ID NO: 7496 - DNA, 16 bp, Artificial Sequence
  synthetic [barcode part1]
cgttgccttcacaggt

SEQ ID NO: 7497 - DNA, 16 bp, Artificial Sequence
  synthetic [barcode part1]
agtgtgtgttgacacc

SEQ ID NO: 7498 - DNA, 16 bp, Artificial Sequence
  synthetic [barcode part1]
gtaggaagtcgccagt

SEQ ID NO: 7499 - DNA, 16 bp, Artificial Sequence
  synthetic [barcode part1]
tctattctcgcaacag

SEQ ID NO: 7500 - DNA, 16 bp, Artificial Sequence
  synthetic [barcode part1]
gattcgtcctattgtg

SEQ ID NO: 7501 - DNA, 16 bp, Artificial Sequence
  synthetic [barcode part1]
aactctcgcgtgacct

SEQ ID NO: 7502 - DNA, 16 bp, Artificial Sequence
  synthetic [barcode part1]
aacaccaactgtgacc

SEQ ID NO: 7503 - DNA, 16 bp, Artificial Sequence
  synthetic [barcode part1]
ttacgtctgaggacgt

SEQ ID NO: 7504 - DNA, 16 bp, Artificial Sequence
  synthetic [barcode part1]
gtagttcactcgacag

SEQ ID NO: 7505 - DNA, 16 bp, Artificial Sequence
  synthetic [barcode part1]
tgatacctctgtctag

SEQ ID NO: 7506 - DNA, 16 bp, Artificial Sequence
  synthetic [barcode part1]
tcgtctgaagtctcgc

SEQ ID NO: 7507 - DNA, 16 bp, Artificial Sequence
  synthetic [barcode part1]
tcgtagagttccttac

SEQ ID NO: 7508 - DNA, 16 bp, Artificial Sequence
  synthetic [barcode part1]
tcacaggactcctcgt

SEQ ID NO: 7509 - DNA, 16 bp, Artificial Sequence
  synthetic [barcode part1]
cgttaagtcgttaggc

SEQ ID NO: 7510 - DNA, 16 bp, Artificial Sequence
  synthetic [barcode part1]
cctgactcagtcgtac

SEQ ID NO: 7511 - DNA, 16 bp, Artificial Sequence
  synthetic [barcode part1]
tataactcggttctcg

SEQ ID NO: 7512 - DNA, 16 bp, Artificial Sequence
  synthetic [barcode part1]
aggtgtcgtggtaggt

SEQ ID NO: 7513 - DNA, 16 bp, Artificial Sequence
  synthetic [barcode part1]
acactgtgtggacgag

SEQ ID NO: 7514 - DNA, 16 bp, Artificial Sequence
  synthetic [barcode part1]
gacgattggtctagtc

SEQ ID NO: 7515 - DNA, 16 bp, Artificial Sequence
  synthetic [barcode part1]
ttggtcctgaggaatc

SEQ ID NO: 7516 - DNA, 16 bp, Artificial Sequence
  synthetic [barcode part1]
aatacacgatcgaggt

SEQ ID NO: 7517 - DNA, 16 bp, Artificial Sequence
  synthetic [barcode part1]
caatcagtggtcagtc

SEQ ID NO: 7518 - DNA, 16 bp, Artificial Sequence
  synthetic [barcode part1]
cgattcactcgtattg

SEQ ID NO: 7519 - DNA, 16 bp, Artificial Sequence
  synthetic [barcode part1]
atactattccgaggcg

SEQ ID NO: 7520 - DNA, 16 bp, Artificial Sequence
  synthetic [barcode part1]
tataggcaagtccgtc

SEQ ID NO: 7521 - DNA, 16 bp, Artificial Sequence
  synthetic [barcode part1]
gccaggtagacacaac

SEQ ID NO: 7522 - DNA, 16 bp, Artificial Sequence
  synthetic [barcode part1]
gattcacaagttcgcg

SEQ ID NO: 7523 - DNA, 16 bp, Artificial Sequence
  synthetic [barcode part1]
agttgactgacgtcac

SEQ ID NO: 7524 - DNA, 16 bp, Artificial Sequence
  synthetic [barcode part1]
gtcgaatcaggttacc

SEQ ID NO: 7525 - DNA, 16 bp, Artificial Sequence
  synthetic [barcode part1]
gtggatcggttgtgtt

SEQ ID NO: 7526 - DNA, 16 bp, Artificial Sequence
  synthetic [barcode part1]
ccaatcttgcctcact

SEQ ID NO: 7527 - DNA, 16 bp, Artificial Sequence
  synthetic [barcode part1]
cgaagagtgcgtagtc

SEQ ID NO: 7528 - DNA, 16 bp, Artificial Sequence
  synthetic [barcode part1]
cgttcactctggagtc

SEQ ID NO: 7529 - DNA, 16 bp, Artificial Sequence
  synthetic [barcode part1]
aggaagaagtcctgag

SEQ ID NO: 7530 - DNA, 16 bp, Artificial Sequence
  synthetic [barcode part1]
ttcaggtcgtcgatag

SEQ ID NO: 7531 - DNA, 16 bp, Artificial Sequence
  synthetic [barcode part1]
tgagtgttacgtcgac

SEQ ID NO: 7532 - DNA, 16 bp, Artificial Sequence
  synthetic [barcode part1]
tagtggtctagatcgc

SEQ ID NO: 7533 - DNA, 16 bp, Artificial Sequence
  synthetic [barcode part1]
aactacaacgcgtcgt

SEQ ID NO: 7534 - DNA, 16 bp, Artificial Sequence
  synthetic [barcode part1]
ttatagaggcagtgac

SEQ ID NO: 7535 - DNA, 16 bp, Artificial Sequence
  synthetic [barcode part1]
atacaccagactagag

SEQ ID NO: 7536 - DNA, 16 bp, Artificial Sequence
  synthetic [barcode part1]
gaatctcctctctctg

SEQ ID NO: 7537 - DNA, 16 bp, Artificial Sequence
  synthetic [barcode part1]
acgatcggatcggagt

SEQ ID NO: 7538 - DNA, 16 bp, Artificial Sequence
  synthetic [barcode part1]
tacctagtaatctccg

SEQ ID NO: 7539 - DNA, 16 bp, Artificial Sequence
  synthetic [barcode part1]
gagttcgactcggatt

SEQ ID NO: 7540 - DNA, 16 bp, Artificial Sequence
  synthetic [barcode part1]
tcaatctgtgatcgtc

SEQ ID NO: 7541 - DNA, 16 bp, Artificial Sequence
  synthetic [barcode part1]
tggtctctgcgtaacc

SEQ ID NO: 7542 - DNA, 16 bp, Artificial Sequence
  synthetic [barcode part1]
cgagtcgagttattgc

SEQ ID NO: 7543 - DNA, 16 bp, Artificial Sequence
  synthetic [barcode part1]
aggttgtacttggtgc

SEQ ID NO: 7544 - DNA, 16 bp, Artificial Sequence
  synthetic [barcode part1]
tcggttcgtaaccgtc

SEQ ID NO: 7545 - DNA, 16 bp, Artificial Sequence
  synthetic [barcode part1]
tgttgcaacacgtgtg

SEQ ID NO: 7546 - DNA, 16 bp, Artificial Sequence
  synthetic [barcode part1]
tgcagtgaacgtcact

SEQ ID NO: 7547 - DNA, 16 bp, Artificial Sequence
  synthetic [barcode part1]
aataccacacacgcgt

SEQ ID NO: 7548 - DNA, 16 bp, Artificial Sequence
  synthetic [barcode part1]
ccgaagtaagttccgt

SEQ ID NO: 7549 - DNA, 16 bp, Artificial Sequence
  synthetic [barcode part1]
ccaagtacctaccgtc

SEQ ID NO: 7550 - DNA, 16 bp, Artificial Sequence
  synthetic [barcode part1]
tctgagatcaaccgac

SEQ ID NO: 7551 - DNA, 16 bp, Artificial Sequence
  synthetic [barcode part1]
ttgacactgtgcaacg

SEQ ID NO: 7552 - DNA, 16 bp, Artificial Sequence
  synthetic [barcode part1]
agtaggcacaatatcg

SEQ ID NO: 7553 - DNA, 16 bp, Artificial Sequence
  synthetic [barcode part1]
gaagattgttagtgcg

SEQ ID NO: 7554 - DNA, 16 bp, Artificial Sequence
  synthetic [barcode part1]
gtgttggtcttactgt

SEQ ID NO: 7555 - DNA, 16 bp, Artificial Sequence
  synthetic [barcode part1]
cacacctcttgacgac

SEQ ID NO: 7556 - DNA, 16 bp, Artificial Sequence
  synthetic [barcode part1]
tagtgatccttgcact

SEQ ID NO: 7557 - DNA, 16 bp, Artificial Sequence
  synthetic [barcode part1]
tattggcgcactaacg

SEQ ID NO: 7558 - DNA, 16 bp, Artificial Sequence
  synthetic [barcode part1]
aacaaggaaggaccgt

SEQ ID NO: 7559 - DNA, 16 bp, Artificial Sequence
  synthetic [barcode part1]
tcggcctacgattatt

SEQ ID NO: 7560 - DNA, 16 bp, Artificial Sequence
  synthetic [barcode part1]
ttgacgtctagagaag

SEQ ID NO: 7561 - DNA, 16 bp, Artificial Sequence
  synthetic [barcode part1]
tagaccgtgattcggt

SEQ ID NO: 7562 - DNA, 16 bp, Artificial Sequence
  synthetic [barcode part1]
ttgtggaacttcctac

SEQ ID NO: 7563 - DNA, 16 bp, Artificial Sequence
  synthetic [barcode part1]
ccgtggaacagaacac

SEQ ID NO: 7564 - DNA, 16 bp, Artificial Sequence
  synthetic [barcode part1]
ttacggtcttccttcg

SEQ ID NO: 7565 - DNA, 16 bp, Artificial Sequence
  synthetic [barcode part1]
ccaatactgcggttag

SEQ ID NO: 7566 - DNA, 16 bp, Artificial Sequence
  synthetic [barcode part1]
tggtggagaacaacag

SEQ ID NO: 7567 - DNA, 16 bp, Artificial Sequence
  synthetic [barcode part1]
agagtggatagatctc

SEQ ID NO: 7568 - DNA, 16 bp, Artificial Sequence
  synthetic [barcode part1]
gtgaggaaccggattc

SEQ ID NO: 7569 - DNA, 16 bp, Artificial Sequence
  synthetic [barcode part1]
ttctggaggtagatag

SEQ ID NO: 7570 - DNA, 16 bp, Artificial Sequence
  synthetic [barcode part1]
tctccttgaccaatcc

SEQ ID NO: 7571 - DNA, 16 bp, Artificial Sequence
  synthetic [barcode part1]
ttccagtacgtaacct

SEQ ID NO: 7572 - DNA, 16 bp, Artificial Sequence
  synthetic [barcode part1]
gccggatcgaattatc

SEQ ID NO: 7573 - DNA, 16 bp, Artificial Sequence
  synthetic [barcode part1]
gatagagacgcctggt

SEQ ID NO: 7574 - DNA, 16 bp, Artificial Sequence
  synthetic [barcode part1]
ttgtcacacctgtagt

SEQ ID NO: 7575 - DNA, 16 bp, Artificial Sequence
  synthetic [barcode part1]
gtaagttcgtggacct

SEQ ID NO: 7576 - DNA, 16 bp, Artificial Sequence
  synthetic [barcode part1]
aataggacgtgttgac

SEQ ID NO: 7577 - DNA, 16 bp, Artificial Sequence
  synthetic [barcode part1]
gactgcgtctcctaac

SEQ ID NO: 7578 - DNA, 16 bp, Artificial Sequence
  synthetic [barcode part1]
gacctatcaaggcgag

SEQ ID NO: 7579 - DNA, 16 bp, Artificial Sequence
  synthetic [barcode part1]
ttgtgccgaactgtcc

SEQ ID NO: 7580 - DNA, 16 bp, Artificial Sequence
  synthetic [barcode part1]
cgattcagtgacctag

SEQ ID NO: 7581 - DNA, 16 bp, Artificial Sequence
  synthetic [barcode part1]
cctctagaccaacacc

SEQ ID NO: 7582 - DNA, 16 bp, Artificial Sequence
  synthetic [barcode part1]
cgaaggataacgtgcc

SEQ ID NO: 7583 - DNA, 16 bp, Artificial Sequence
  synthetic [barcode part1]
aacgtgttgacgtgtc

SEQ ID NO: 7584 - DNA, 16 bp, Artificial Sequence
  synthetic [barcode part1]
gtgacacttaaggcct

SEQ ID NO: 7585 - DNA, 16 bp, Artificial Sequence
  synthetic [barcode part1]
cgagtcagatctgact

SEQ ID NO: 7586 - DNA, 16 bp, Artificial Sequence
  synthetic [barcode part1]
tgcgttatctcgattg

SEQ ID NO: 7587 - DNA, 16 bp, Artificial Sequence
  synthetic [barcode part1]
gttatcgtcttgtgtg

SEQ ID NO: 7588 - DNA, 16 bp, Artificial Sequence
  synthetic [barcode part1]
acctaactcggatcag

SEQ ID NO: 7589 - DNA, 16 bp, Artificial Sequence
  synthetic [barcode part1]
gaccgcggtgttaatt

SEQ ID NO: 7590 - DNA, 16 bp, Artificial Sequence
  synthetic [barcode part1]
atagattcggtgagac

SEQ ID NO: 7591 - DNA, 16 bp, Artificial Sequence
  synthetic [barcode part1]
aacgccagaccaatct

SEQ ID NO: 7592 - DNA, 16 bp, Artificial Sequence
  synthetic [barcode part1]
atcagtggtgatcgtc

SEQ ID NO: 7593 - DNA, 16 bp, Artificial Sequence
  synthetic [barcode part1]
tcctcggacgccaatt

SEQ ID NO: 7594 - DNA, 16 bp, Artificial Sequence
  synthetic [barcode part1]
gacgcgtagttcttcc

SEQ ID NO: 7595 - DNA, 16 bp, Artificial Sequence
  synthetic [barcode part1]
taaccgttggaggacg

SEQ ID NO: 7596 - DNA, 16 bp, Artificial Sequence
  synthetic [barcode part1]
caagaggactgcgtac

SEQ ID NO: 7597 - DNA, 16 bp, Artificial Sequence
  synthetic [barcode part1]
ttaggactcgtaacgc

SEQ ID NO: 7598 - DNA, 16 bp, Artificial Sequence
  synthetic [barcode part1]
aattcgcgtaggtctg

SEQ ID NO: 7599 - DNA, 16 bp, Artificial Sequence
  synthetic [barcode part1]
gtggtgattgttgtcg

SEQ ID NO: 7600 - DNA, 16 bp, Artificial Sequence
  synthetic [barcode part1]
tgaattacgcgcctcc

SEQ ID NO: 7601 - DNA, 16 bp, Artificial Sequence
  synthetic [barcode part1]
tgaatacgcgtctggt

SEQ ID NO: 7602 - DNA, 16 bp, Artificial Sequence
  synthetic [barcode part1]
acgatcggttgtgtgt

SEQ ID NO: 7603 - DNA, 16 bp, Artificial Sequence
  synthetic [barcode part1]
tctgcaatcgcctcag

SEQ ID NO: 7604 - DNA, 16 bp, Artificial Sequence
  synthetic [barcode part1]
ttcagttcggtgcacc

SEQ ID NO: 7605 - DNA, 16 bp, Artificial Sequence
  synthetic [barcode part1]
tgtcgtcagtgtattc

SEQ ID NO: 7606 - DNA, 16 bp, Artificial Sequence
  synthetic [barcode part1]
gtcgccttgttatcct

SEQ ID NO: 7607 - DNA, 16 bp, Artificial Sequence
  synthetic [barcode part1]
tagagaggaccgaagt

SEQ ID NO: 7608 - DNA, 16 bp, Artificial Sequence
  synthetic [barcode part1]
gtagactcacagactc

SEQ ID NO: 7609 - DNA, 16 bp, Artificial Sequence
  synthetic [barcode part1]
cctgagaacgcgtatt

SEQ ID NO: 7610 - DNA, 16 bp, Artificial Sequence
  synthetic [barcode part1]
aggtgaggagttctgc

SEQ ID NO: 7611 - DNA, 16 bp, Artificial Sequence
  synthetic [barcode part1]
cgtatagttgcgtgac

SEQ ID NO: 7612 - DNA, 16 bp, Artificial Sequence
  synthetic [barcode part1]
gaatcaccggattgtc

SEQ ID NO: 7613 - DNA, 16 bp, Artificial Sequence
  synthetic [barcode part1]
gcacagttggtgtgtt

SEQ ID NO: 7614 - DNA, 16 bp, Artificial Sequence
  synthetic [barcode part1]
taagaacagactaccg

SEQ ID NO: 7615 - DNA, 16 bp, Artificial Sequence
  synthetic [barcode part1]
cacgaagtcaacgacg

SEQ ID NO: 7616 - DNA, 16 bp, Artificial Sequence
  synthetic [barcode part1]
cgatctccttcagttc

SEQ ID NO: 7617 - DNA, 16 bp, Artificial Sequence
  synthetic [barcode part1]
ttggacagagtaacac

SEQ ID NO: 7618 - DNA, 16 bp, Artificial Sequence
  synthetic [barcode part1]
cgcgttggactagaag

SEQ ID NO: 7619 - DNA, 16 bp, Artificial Sequence
  synthetic [barcode part1]
caagataacggccgtg

SEQ ID NO: 7620 - DNA, 16 bp, Artificial Sequence
  synthetic [barcode part1]
tatcggtagttccttg

SEQ ID NO: 7621 - DNA, 16 bp, Artificial Sequence
  synthetic [barcode part1]
cgcctcagtggatctt

SEQ ID NO: 7622 - DNA, 16 bp, Artificial Sequence
  synthetic [barcode part1]
tgtatatcaaccggcg

SEQ ID NO: 7623 - DNA, 16 bp, Artificial Sequence
  synthetic [barcode part1]
cgacgtatcgagtact

SEQ ID NO: 7624 - DNA, 16 bp, Artificial Sequence
  synthetic [barcode part1]
acaacgcctggaatct

SEQ ID NO: 7625 - DNA, 16 bp, Artificial Sequence
  synthetic [barcode part1]
gtacactatagtcgcg

SEQ ID NO: 7626 - DNA, 16 bp, Artificial Sequence
  synthetic [barcode part1]
tcgtcgttccactatc

SEQ ID NO: 7627 - DNA, 16 bp, Artificial Sequence
  synthetic [barcode part1]
tgttctaccgtcctac

SEQ ID NO: 7628 - DNA, 16 bp, Artificial Sequence
  synthetic [barcode part1]
gacagtcctccgtgtt

SEQ ID NO: 7629 - DNA, 16 bp, Artificial Sequence
  synthetic [barcode part1]
gtagaccaatctgcgt

SEQ ID NO: 7630 - DNA, 16 bp, Artificial Sequence
  synthetic [barcode part1]
gtcaagtgcagttcac

SEQ ID NO: 7631 - DNA, 16 bp, Artificial Sequence
  synthetic [barcode part1]
gactgacacgtgtgtt

SEQ ID NO: 7632 - DNA, 16 bp, Artificial Sequence
  synthetic [barcode part1]
accgaccaatctcaag

SEQ ID NO: 7633 - DNA, 16 bp, Artificial Sequence
  synthetic [barcode part1]
cctagaggttagtcgt

SEQ ID NO: 7634 - DNA, 16 bp, Artificial Sequence
  synthetic [barcode part1]
cacaatcaccgtctcg

SEQ ID NO: 7635 - DNA, 16 bp, Artificial Sequence
  synthetic [barcode part1]
tatcgagtaccgaacc

SEQ ID NO: 7636 - DNA, 16 bp, Artificial Sequence
  synthetic [barcode part1]
tgaggtgagatcagag

SEQ ID NO: 7637 - DNA, 16 bp, Artificial Sequence
  synthetic [barcode part1]
attggtggataacgac

SEQ ID NO: 7638 - DNA, 16 bp, Artificial Sequence
  synthetic [barcode part1]
gagataacaccgttcc

SEQ ID NO: 7639 - DNA, 16 bp, Artificial Sequence
  synthetic [barcode part1]
ttattgaagaggcacg

SEQ ID NO: 7640 - DNA, 16 bp, Artificial Sequence
  synthetic [barcode part1]
gtgaggtcaagacaag

SEQ ID NO: 7641 - DNA, 16 bp, Artificial Sequence
  synthetic [barcode part1]
atctccgtatctctgc

SEQ ID NO: 7642 - DNA, 16 bp, Artificial Sequence
  synthetic [barcode part1]
aagaacgcagactact

SEQ ID NO: 7643 - DNA, 16 bp, Artificial Sequence
  synthetic [barcode part1]
tccggaattccaaggt

SEQ ID NO: 7644 - DNA, 16 bp, Artificial Sequence
  synthetic [barcode part1]
tcttggcgagacaatc

SEQ ID NO: 7645 - DNA, 16 bp, Artificial Sequence
  synthetic [barcode part1]
gtgtcggaacttgtac

SEQ ID NO: 7646 - DNA, 16 bp, Artificial Sequence
  synthetic [barcode part1]
tggtcgcagactgaag

SEQ ID NO: 7647 - DNA, 16 bp, Artificial Sequence
  synthetic [barcode part1]
tgagactgatcggttc

SEQ ID NO: 7648 - DNA, 16 bp, Artificial Sequence
  synthetic [barcode part1]
tggcacaatcgcctct

SEQ ID NO: 7649 - DNA, 16 bp, Artificial Sequence
  synthetic [barcode part1]
cgacaattctctgtac

SEQ ID NO: 7650 - DNA, 16 bp, Artificial Sequence
  synthetic [barcode part1]
acctgaggcaagtctt

SEQ ID NO: 7651 - DNA, 16 bp, Artificial Sequence
  synthetic [barcode part1]
actgtcacaacggttg

SEQ ID NO: 7652 - DNA, 16 bp, Artificial Sequence
  synthetic [barcode part1]
taagtcgtcaacgacc

SEQ ID NO: 7653 - DNA, 16 bp, Artificial Sequence
  synthetic [barcode part1]
gagagaatcgagatcg

SEQ ID NO: 7654 - DNA, 16 bp, Artificial Sequence
  synthetic [barcode part1]
taagaccagttggtcc

SEQ ID NO: 7655 - DNA, 16 bp, Artificial Sequence
  synthetic [barcode part1]
gcaagaaggccgttgt

SEQ ID NO: 7656 - DNA, 16 bp, Artificial Sequence
  synthetic [barcode part1]
tagttggacgtgtgtc

SEQ ID NO: 7657 - DNA, 16 bp, Artificial Sequence
  synthetic [barcode part1]
tactcgattctaccag

SEQ ID NO: 7658 - DNA, 16 bp, Artificial Sequence
  synthetic [barcode part1]
gttctcaacctagtgt

SEQ ID NO: 7659 - DNA, 16 bp, Artificial Sequence
  synthetic [barcode part1]
tatacgatccgcaggt

SEQ ID NO: 7660 - DNA, 16 bp, Artificial Sequence
  synthetic [barcode part1]
tgattggtacgtacgc

SEQ ID NO: 7661 - DNA, 16 bp, Artificial Sequence
  synthetic [barcode part1]
ttcttccttgactggc

SEQ ID NO: 7662 - DNA, 16 bp, Artificial Sequence
  synthetic [barcode part1]
tctgtcacgtattggt

SEQ ID NO: 7663 - DNA, 16 bp, Artificial Sequence
  synthetic [barcode part1]
ccgaatacaccacctc

SEQ ID NO: 7664 - DNA, 16 bp, Artificial Sequence
  synthetic [barcode part1]
gaggcaatccggatac

SEQ ID NO: 7665 - DNA, 16 bp, Artificial Sequence
  synthetic [barcode part1]
ataacaccggcactgt

SEQ ID NO: 7666 - DNA, 16 bp, Artificial Sequence
  synthetic [barcode part1]
gcaacgagtaggatag

SEQ ID NO: 7667 - DNA, 16 bp, Artificial Sequence
  synthetic [barcode part1]
gtgcctgttgtaagtg

SEQ ID NO: 7668 - DNA, 16 bp, Artificial Sequence
  synthetic [barcode part1]
gaccacctgaggatag

SEQ ID NO: 7669 - DNA, 16 bp, Artificial Sequence
  synthetic [barcode part1]
cctatagtattgcctg

SEQ ID NO: 7670 - DNA, 16 bp, Artificial Sequence
  synthetic [barcode part1]
gcagaacacagactcg

SEQ ID NO: 7671 - DNA, 16 bp, Artificial Sequence
  synthetic [barcode part1]
gcgagaagatccaacc

SEQ ID NO: 7672 - DNA, 16 bp, Artificial Sequence
  synthetic [barcode part1]
tgtggcagtctcaagt

SEQ ID NO: 7673 - DNA, 16 bp, Artificial Sequence
  synthetic [barcode part1]
ttgtaccgtggaggtt

SEQ ID NO: 7674 - DNA, 16 bp, Artificial Sequence
  synthetic [barcode part1]
tattcggtgcggattg

SEQ ID NO: 7675 - DNA, 16 bp, Artificial Sequence
  synthetic [barcode part1]
gaaggactagacctgc

SEQ ID NO: 7676 - DNA, 16 bp, Artificial Sequence
  synthetic [barcode part1]
cgaatcacttcgcgtc

SEQ ID NO: 7677 - DNA, 16 bp, Artificial Sequence
  synthetic [barcode part1]
tctgtacgatccgatt

SEQ ID NO: 7678 - DNA, 16 bp, Artificial Sequence
  synthetic [barcode part1]
aagtgcgattggaccg

SEQ ID NO: 7679 - DNA, 16 bp, Artificial Sequence
  synthetic [barcode part1]
tggcggtcttcgtatc

SEQ ID NO: 7680 - DNA, 16 bp, Artificial Sequence
  synthetic [barcode part1]
cgacttccacgtgatc

SEQ ID NO: 7681 - DNA, 16 bp, Artificial Sequence
  synthetic [barcode part1]
ttgccactgagacaac

SEQ ID NO: 7682 - DNA, 16 bp, Artificial Sequence
  synthetic [barcode part1]
attggactgaaccgtc

SEQ ID NO: 7683 - DNA, 16 bp, Artificial Sequence
  synthetic [barcode part1]
gtgacactcagagtct

SEQ ID NO: 7684 - DNA, 16 bp, Artificial Sequence
  synthetic [barcode part1]
ttgagtcactgaaccg

SEQ ID NO: 7685 - DNA, 16 bp, Artificial Sequence
  synthetic [barcode part1]
gcgttggtgtgttaac

SEQ ID NO: 7686 - DNA, 16 bp, Artificial Sequence
  synthetic [barcode part1]
tgccttcactattgag

SEQ ID NO: 7687 - DNA, 16 bp, Artificial Sequence
  synthetic [barcode part1]
cgagtcggtatcttcc

SEQ ID NO: 7688 - DNA, 16 bp, Artificial Sequence
  synthetic [barcode part1]
cacgttcacaaggatc

SEQ ID NO: 7689 - DNA, 16 bp, Artificial Sequence
  synthetic [barcode part1]
actgcagtcacagtgt

SEQ ID NO: 7690 - DNA, 16 bp, Artificial Sequence
  synthetic [barcode part1]
caccttctaacgaccg

SEQ ID NO: 7691 - DNA, 16 bp, Artificial Sequence
  synthetic [barcode part1]
gatctgacgtacctcc

SEQ ID NO: 7692 - DNA, 16 bp, Artificial Sequence
  synthetic [barcode part1]
tggagaagactgaggt

SEQ ID NO: 7693 - DNA, 16 bp, Artificial Sequence
  synthetic [barcode part1]
taggtcgccagtagtt

SEQ ID NO: 7694 - DNA, 16 bp, Artificial Sequence
  synthetic [barcode part1]
gtatcgttgtctactg

SEQ ID NO: 7695 - DNA, 16 bp, Artificial Sequence
  synthetic [barcode part1]
acctagacggaacgac

SEQ ID NO: 7696 - DNA, 16 bp, Artificial Sequence
  synthetic [barcode part1]
agtcgttgcagtctag

SEQ ID NO: 7697 - DNA, 16 bp, Artificial Sequence
  synthetic [barcode part1]
agattgccgttcctgc

SEQ ID NO: 7698 - DNA, 16 bp, Artificial Sequence
  synthetic [barcode part1]
atcctcaatccagtgt

SEQ ID NO: 7699 - DNA, 16 bp, Artificial Sequence
  synthetic [barcode part1]
tgttctataggtgtcc

SEQ ID NO: 7700 - DNA, 16 bp, Artificial Sequence
  synthetic [barcode part1]
atcagtcggagtcttg

SEQ ID NO: 7701 - DNA, 16 bp, Artificial Sequence
  synthetic [barcode part1]
cggtcaaggaactctt

SEQ ID NO: 7702 - DNA, 16 bp, Artificial Sequence
  synthetic [barcode part1]
tctattccgtccactg

SEQ ID NO: 7703 - DNA, 16 bp, Artificial Sequence
  synthetic [barcode part1]
cagtcttcggcgtgtt

SEQ ID NO: 7704 - DNA, 16 bp, Artificial Sequence
  synthetic [barcode part1]
gtgtcctgagaatacc

SEQ ID NO: 7705 - DNA, 16 bp, Artificial Sequence
  synthetic [barcode part1]
actcaactacgttctg

SEQ ID NO: 7706 - DNA, 16 bp, Artificial Sequence
  synthetic [barcode part1]
gcggtgttgtgatatc

SEQ ID NO: 7707 - DNA, 16 bp, Artificial Sequence
  synthetic [barcode part1]
tgttgtcggcagtagt

SEQ ID NO: 7708 - DNA, 16 bp, Artificial Sequence
  synthetic [barcode part1]
gcacaatcttctcggc

SEQ ID NO: 7709 - DNA, 16 bp, Artificial Sequence
  synthetic [barcode part1]
ccacacgactatacag

SEQ ID NO: 7710 - DNA, 16 bp, Artificial Sequence
  synthetic [barcode part1]
caccttctagtgattg

SEQ ID NO: 7711 - DNA, 16 bp, Artificial Sequence
  synthetic [barcode part1]
tgtactcttcgcgtct

SEQ ID NO: 7712 - DNA, 16 bp, Artificial Sequence
  synthetic [barcode part1]
ccgtaggtgaggaatc

SEQ ID NO: 7713 - DNA, 16 bp, Artificial Sequence
  synthetic [barcode part1]
caatcctcacgcggtt

SEQ ID NO: 7714 - DNA, 16 bp, Artificial Sequence
  synthetic [barcode part1]
gtactgaactgaagac

SEQ ID NO: 7715 - DNA, 16 bp, Artificial Sequence
  synthetic [barcode part1]
gtcagttaggactctg

SEQ ID NO: 7716 - DNA, 16 bp, Artificial Sequence
  synthetic [barcode part1]
acttccgttacactcc

SEQ ID NO: 7717 - DNA, 16 bp, Artificial Sequence
  synthetic [barcode part1]
tcagttgagtcggttg

SEQ ID NO: 7718 - DNA, 16 bp, Artificial Sequence
  synthetic [barcode part1]
agaaggtaacgtacct

SEQ ID NO: 7719 - DNA, 16 bp, Artificial Sequence
  synthetic [barcode part1]
accaggcagtacgaac

SEQ ID NO: 7720 - DNA, 16 bp, Artificial Sequence
  synthetic [barcode part1]
agaatcaacgcgattg

SEQ ID NO: 7721 - DNA, 16 bp, Artificial Sequence
  synthetic [barcode part1]
ttccacctgttactcg

SEQ ID NO: 7722 - DNA, 16 bp, Artificial Sequence
  synthetic [barcode part1]
cacgtcttgaatcgcc

SEQ ID NO: 7723 - DNA, 16 bp, Artificial Sequence
  synthetic [barcode part1]
acgaggatcaacaatc

SEQ ID NO: 7724 - DNA, 16 bp, Artificial Sequence
  synthetic [barcode part1]
acgaccgttagaaggc

SEQ ID NO: 7725 - DNA, 16 bp, Artificial Sequence
  synthetic [barcode part1]
tgtaggtggtagaatc

SEQ ID NO: 7726 - DNA, 16 bp, Artificial Sequence
  synthetic [barcode part1]
tctgcggttcagatag

SEQ ID NO: 7727 - DNA, 16 bp, Artificial Sequence
  synthetic [barcode part1]
ttctgcggaccgttac

SEQ ID NO: 7728 - DNA, 16 bp, Artificial Sequence
  synthetic [barcode part1]
tctctgagtgttggtt

SEQ ID NO: 7729 - DNA, 16 bp, Artificial Sequence
  synthetic [barcode part1]
aggcgaacttatccac

SEQ ID NO: 7730 - DNA, 16 bp, Artificial Sequence
  synthetic [barcode part1]
aggtataactgagtcg

SEQ ID NO: 7731 - DNA, 16 bp, Artificial Sequence
  synthetic [barcode part1]
agtcctattgcgacag

SEQ ID NO: 7732 - DNA, 16 bp, Artificial Sequence
  synthetic [barcode part1]
tgtatcttgcctccac

SEQ ID NO: 7733 - DNA, 16 bp, Artificial Sequence
  synthetic [barcode part1]
gtcgacagtagtcgtt

SEQ ID NO: 7734 - DNA, 16 bp, Artificial Sequence
  synthetic [barcode part1]
tgtaggtgagttcacc

SEQ ID NO: 7735 - DNA, 16 bp, Artificial Sequence
  synthetic [barcode part1]
atcggacttcgtactt

SEQ ID NO: 7736 - DNA, 16 bp, Artificial Sequence
  synthetic [barcode part1]
cacaatctgatcttcg

SEQ ID NO: 7737 - DNA, 16 bp, Artificial Sequence
  synthetic [barcode part1]
cgtgtcttaccaggtc

SEQ ID NO: 7738 - DNA, 16 bp, Artificial Sequence
  synthetic [barcode part1]
gcacggtaggactaac

SEQ ID NO: 7739 - DNA, 16 bp, Artificial Sequence
  synthetic [barcode part1]
gtataacgtcgcgtgt

SEQ ID NO: 7740 - DNA, 16 bp, Artificial Sequence
  synthetic [barcode part1]
aagatacttccacgcg

SEQ ID NO: 7741 - DNA, 16 bp, Artificial Sequence
  synthetic [barcode part1]
acgtgcctatcagtag

SEQ ID NO: 7742 - DNA, 16 bp, Artificial Sequence
  synthetic [barcode part1]
cgttagtagagaatcg

SEQ ID NO: 7743 - DNA, 16 bp, Artificial Sequence
  synthetic [barcode part1]
tgtgacgtagagtcct

SEQ ID NO: 7744 - DNA, 16 bp, Artificial Sequence
  synthetic [barcode part1]
tctaccggtatccgac

SEQ ID NO: 7745 - DNA, 16 bp, Artificial Sequence
  synthetic [barcode part1]
ttggatcgtgttcttg

SEQ ID NO: 7746 - DNA, 16 bp, Artificial Sequence
  synthetic [barcode part1]
gtccagacgtctaagt

SEQ ID NO: 7747 - DNA, 16 bp, Artificial Sequence
  synthetic [barcode part1]
acactcagtggacttg

SEQ ID NO: 7748 - DNA, 16 bp, Artificial Sequence
  synthetic [barcode part1]
aagttcacctggttct

SEQ ID NO: 7749 - DNA, 16 bp, Artificial Sequence
  synthetic [barcode part1]
tggcgatactggactt

SEQ ID NO: 7750 - DNA, 16 bp, Artificial Sequence
  synthetic [barcode part1]
cctacaagttctactg

SEQ ID NO: 7751 - DNA, 16 bp, Artificial Sequence
  synthetic [barcode part1]
tgcgaccactatctcg

SEQ ID NO: 7752 - DNA, 16 bp, Artificial Sequence
  synthetic [barcode part1]
gatcgatccaatcgac

SEQ ID NO: 7753 - DNA, 16 bp, Artificial Sequence
  synthetic [barcode part1]
cgcgtcttgaattgtt

SEQ ID NO: 7754 - DNA, 16 bp, Artificial Sequence
  synthetic [barcode part1]
gcagtagtactggcag

SEQ ID NO: 7755 - DNA, 16 bp, Artificial Sequence
  synthetic [barcode part1]
taattgtgcctaggcg

SEQ ID NO: 7756 - DNA, 16 bp, Artificial Sequence
  synthetic [barcode part1]
accagagaaggtcaag

SEQ ID NO: 7757 - DNA, 16 bp, Artificial Sequence
  synthetic [barcode part1]
ccagttcagtatatcc

SEQ ID NO: 7758 - DNA, 16 bp, Artificial Sequence
  synthetic [barcode part1]
tctacgagaacaacag

SEQ ID NO: 7759 - DNA, 16 bp, Artificial Sequence
  synthetic [barcode part1]
tccttgcgtaatctag

SEQ ID NO: 7760 - DNA, 16 bp, Artificial Sequence
  synthetic [barcode part1]
gcaccttgaccactac

SEQ ID NO: 7761 - DNA, 16 bp, Artificial Sequence
  synthetic [barcode part1]
tggtgcctatctattg

SEQ ID NO: 7762 - DNA, 16 bp, Artificial Sequence
  synthetic [barcode part1]
tagttggcagtcagtc

SEQ ID NO: 7763 - DNA, 16 bp, Artificial Sequence
  synthetic [barcode part1]
ccagttcagattaggc

SEQ ID NO: 7764 - DNA, 16 bp, Artificial Sequence
  synthetic [barcode part1]
cctaattgtacgttgc

SEQ ID NO: 7765 - DNA, 16 bp, Artificial Sequence
  synthetic [barcode part1]
acgtaggttcaacaag

SEQ ID NO: 7766 - DNA, 16 bp, Artificial Sequence
  synthetic [barcode part1]
tcgttagtcctacgcg

SEQ ID NO: 7767 - DNA, 16 bp, Artificial Sequence
  synthetic [barcode part1]
tcgccttacgcaatcg

SEQ ID NO: 7768 - DNA, 16 bp, Artificial Sequence
  synthetic [barcode part1]
actgaacgtcctcgtc

SEQ ID NO: 7769 - DNA, 16 bp, Artificial Sequence
  synthetic [barcode part1]
tgtgccgttggttctg

SEQ ID NO: 7770 - DNA, 16 bp, Artificial Sequence
  synthetic [barcode part1]
ttaggtagacaggact

SEQ ID NO: 7771 - DNA, 16 bp, Artificial Sequence
  synthetic [barcode part1]
cgatctcaccggtatc

SEQ ID NO: 7772 - DNA, 16 bp, Artificial Sequence
  synthetic [barcode part1]
aacggaagtattcggt

SEQ ID NO: 7773 - DNA, 16 bp, Artificial Sequence
  synthetic [barcode part1]
acgacgacaagaagtg

SEQ ID NO: 7774 - DNA, 16 bp, Artificial Sequence
  synthetic [barcode part1]
caacgttcaggcagag

SEQ ID NO: 7775 - DNA, 16 bp, Artificial Sequence
  synthetic [barcode part1]
gtattccgttaggtct

SEQ ID NO: 7776 - DNA, 16 bp, Artificial Sequence
  synthetic [barcode part1]
gagaacgcctgtattc

SEQ ID NO: 7777 - DNA, 16 bp, Artificial Sequence
  synthetic [barcode part1]
tcaggtgcactcaagt

SEQ ID NO: 7778 - DNA, 16 bp, Artificial Sequence
  synthetic [barcode part1]
tggtgatccttacgcc

SEQ ID NO: 7779 - DNA, 16 bp, Artificial Sequence
  synthetic [barcode part1]
tagttccgaccgaagt

SEQ ID NO: 7780 - DNA, 16 bp, Artificial Sequence
  synthetic [barcode part1]
tacagtgagactccac

SEQ ID NO: 7781 - DNA, 16 bp, Artificial Sequence
  synthetic [barcode part1]
gtgtcgcgacaagtag

SEQ ID NO: 7782 - DNA, 16 bp, Artificial Sequence
  synthetic [barcode part1]
aaccgatctagtcgac

SEQ ID NO: 7783 - DNA, 16 bp, Artificial Sequence
  synthetic [barcode part1]
ttgtattatccggcgt

SEQ ID NO: 7784 - DNA, 16 bp, Artificial Sequence
  synthetic [barcode part1]
tcaccacggatagtac

SEQ ID NO: 7785 - DNA, 16 bp, Artificial Sequence
  synthetic [barcode part1]
ttcggtaattcggcag

SEQ ID NO: 7786 - DNA, 16 bp, Artificial Sequence
  synthetic [barcode part1]
ttaggtgagatagtgc

SEQ ID NO: 7787 - DNA, 16 bp, Artificial Sequence
  synthetic [barcode part1]
tacgtcaacaccagtg

SEQ ID NO: 7788 - DNA, 16 bp, Artificial Sequence
  synthetic [barcode part1]
acacaaccacaactgc

SEQ ID NO: 7789 - DNA, 16 bp, Artificial Sequence
  synthetic [barcode part1]
gacttctgtactcagt

SEQ ID NO: 7790 - DNA, 16 bp, Artificial Sequence
  synthetic [barcode part1]
taggttctcacgaacg

SEQ ID NO: 7791 - DNA, 16 bp, Artificial Sequence
  synthetic [barcode part1]
cagtgttggtactgtg

SEQ ID NO: 7792 - DNA, 16 bp, Artificial Sequence
  synthetic [barcode part1]
tcggttcttcgtggac

SEQ ID NO: 7793 - DNA, 16 bp, Artificial Sequence
  synthetic [barcode part1]
acttggaggatagtac

SEQ ID NO: 7794 - DNA, 16 bp, Artificial Sequence
  synthetic [barcode part1]
ttgacgagtccagtac

SEQ ID NO: 7795 - DNA, 16 bp, Artificial Sequence
  synthetic [barcode part1]
cgagttgtgacgactt

SEQ ID NO: 7796 - DNA, 16 bp, Artificial Sequence
  synthetic [barcode part1]
caatcagtcgagactc

SEQ ID NO: 7797 - DNA, 16 bp, Artificial Sequence
  synthetic [barcode part1]
actaacgtatcctgtc

SEQ ID NO: 7798 - DNA, 16 bp, Artificial Sequence
  synthetic [barcode part1]
gcggttagaagtcggt

SEQ ID NO: 7799 - DNA, 16 bp, Artificial Sequence
  synthetic [barcode part1]
tgactcaactcgacag

SEQ ID NO: 7800 - DNA, 16 bp, Artificial Sequence
  synthetic [barcode part1]
tgagaagtggcgcgtt

SEQ ID NO: 7801 - DNA, 16 bp, Artificial Sequence
  synthetic [barcode part1]
cgaatactggcgagac

SEQ ID NO: 7802 - DNA, 16 bp, Artificial Sequence
  synthetic [barcode part1]
tgacttggttcttacg

SEQ ID NO: 7803 - DNA, 16 bp, Artificial Sequence
  synthetic [barcode part1]
ttgcagaaggtcaggc

SEQ ID NO: 7804 - DNA, 16 bp, Artificial Sequence
  synthetic [barcode part1]
ccgacctctgttactt

SEQ ID NO: 7805 - DNA, 16 bp, Artificial Sequence
  synthetic [barcode part1]
ttaccaggcgtaggag

SEQ ID NO: 7806 - DNA, 16 bp, Artificial Sequence
  synthetic [barcode part1]
tgagacttcgagatcc

SEQ ID NO: 7807 - DNA, 16 bp, Artificial Sequence
  synthetic [barcode part1]
taggaggacaccagtc

SEQ ID NO: 7808 - DNA, 16 bp, Artificial Sequence
  synthetic [barcode part1]
gcagtaccgatcgatt

SEQ ID NO: 7809 - DNA, 16 bp, Artificial Sequence
  synthetic [barcode part1]
tgccgagtcgtacttc

SEQ ID NO: 7810 - DNA, 16 bp, Artificial Sequence
  synthetic [barcode part1]
ccaagacacgaacggt

SEQ ID NO: 7811 - DNA, 16 bp, Artificial Sequence
  synthetic [barcode part1]
atatctcctggtaacc

SEQ ID NO: 7812 - DNA, 16 bp, Artificial Sequence
  synthetic [barcode part1]
agtcctcacacggttc

SEQ ID NO: 7813 - DNA, 16 bp, Artificial Sequence
  synthetic [barcode part1]
tgtccgtagactctgc

SEQ ID NO: 7814 - DNA, 16 bp, Artificial Sequence
  synthetic [barcode part1]
tgcgtattacacgcag

SEQ ID NO: 7815 - DNA, 16 bp, Artificial Sequence
  synthetic [barcode part1]
caacgtaactggaggc

SEQ ID NO: 7816 - DNA, 16 bp, Artificial Sequence
  synthetic [barcode part1]
aaccgaccggttagtt

SEQ ID NO: 7817 - DNA, 16 bp, Artificial Sequence
  synthetic [barcode part1]
gtgaactctctaccgc

SEQ ID NO: 7818 - DNA, 16 bp, Artificial Sequence
  synthetic [barcode part1]
gtgattcacttctacg

SEQ ID NO: 7819 - DNA, 16 bp, Artificial Sequence
  synthetic [barcode part1]
cggaaggtgtacggtt

SEQ ID NO: 7820 - DNA, 16 bp, Artificial Sequence
  synthetic [barcode part1]
gcaatcggtaccgatt

SEQ ID NO: 7821 - DNA, 16 bp, Artificial Sequence
  synthetic [barcode part1]
tgtgtactaatcggcg

SEQ ID NO: 7822 - DNA, 16 bp, Artificial Sequence
  synthetic [barcode part1]
gaatctcgagaccttg

SEQ ID NO: 7823 - DNA, 16 bp, Artificial Sequence
  synthetic [barcode part1]
tatcctgtgaggcagt

SEQ ID NO: 7824 - DNA, 16 bp, Artificial Sequence
  synthetic [barcode part1]
aacggaccttgttcag

SEQ ID NO: 7825 - DNA, 16 bp, Artificial Sequence
  synthetic [barcode part1]
aggcctatccaattct

SEQ ID NO: 7826 - DNA, 16 bp, Artificial Sequence
  synthetic [barcode part1]
gcctgtctccagaact

SEQ ID NO: 7827 - DNA, 16 bp, Artificial Sequence
  synthetic [barcode part1]
cgatatcttacctgtg

SEQ ID NO: 7828 - DNA, 16 bp, Artificial Sequence
  synthetic [barcode part1]
agatccggtgactgtt

SEQ ID NO: 7829 - DNA, 16 bp, Artificial Sequence
  synthetic [barcode part1]
ccgcactcactagact

SEQ ID NO: 7830 - DNA, 16 bp, Artificial Sequence
  synthetic [barcode part1]
gtggaagtgatccgac

SEQ ID NO: 7831 - DNA, 16 bp, Artificial Sequence
  synthetic [barcode part1]
taagaaggtgcgttac

SEQ ID NO: 7832 - DNA, 16 bp, Artificial Sequence
  synthetic [barcode part1]
ttatccggaaccttgt

SEQ ID NO: 7833 - DNA, 16 bp, Artificial Sequence
  synthetic [barcode part1]
taacgcgaagacgatt

SEQ ID NO: 7834 - DNA, 16 bp, Artificial Sequence
  synthetic [barcode part1]
acagacctgtagacct

SEQ ID NO: 7835 - DNA, 16 bp, Artificial Sequence
  synthetic [barcode part1]
ccgtacctcaccaagt

SEQ ID NO: 7836 - DNA, 16 bp, Artificial Sequence
  synthetic [barcode part1]
cgttctaccgtgaatt

SEQ ID NO: 7837 - DNA, 16 bp, Artificial Sequence
  synthetic [barcode part1]
gatagtcaccagactc

SEQ ID NO: 7838 - DNA, 16 bp, Artificial Sequence
  synthetic [barcode part1]
acagtgtgtacacacc

SEQ ID NO: 7839 - DNA, 16 bp, Artificial Sequence
  synthetic [barcode part1]
cggcaattacactctt

SEQ ID NO: 7840 - DNA, 16 bp, Artificial Sequence
  synthetic [barcode part1]
tggaagacgcgtaatt

SEQ ID NO: 7841 - DNA, 16 bp, Artificial Sequence
  synthetic [barcode part1]
attccgtgagtcaggt

SEQ ID NO: 7842 - DNA, 16 bp, Artificial Sequence
  synthetic [barcode part1]
actcttagagtcactc

SEQ ID NO: 7843 - DNA, 16 bp, Artificial Sequence
  synthetic [barcode part1]
ttgcagttacgcgtag

SEQ ID NO: 7844 - DNA, 16 bp, Artificial Sequence
  synthetic [barcode part1]
agtatcgttggagtcc

SEQ ID NO: 7845 - DNA, 16 bp, Artificial Sequence
  synthetic [barcode part1]
ccttgcgaatccgact

SEQ ID NO: 7846 - DNA, 16 bp, Artificial Sequence
  synthetic [barcode part1]
acttgcagtcactccg

SEQ ID NO: 7847 - DNA, 16 bp, Artificial Sequence
  synthetic [barcode part1]
caaccagtctcgaagt

SEQ ID NO: 7848 - DNA, 16 bp, Artificial Sequence
  synthetic [barcode part1]
gcgtgacctagaagac

SEQ ID NO: 7849 - DNA, 16 bp, Artificial Sequence
  synthetic [barcode part1]
ccggtagtctagtaac

SEQ ID NO: 7850 - DNA, 16 bp, Artificial Sequence
  synthetic [barcode part1]
ccacgtcaataacctt

SEQ ID NO: 7851 - DNA, 16 bp, Artificial Sequence
  synthetic [barcode part1]
taaggaagaccaggac

SEQ ID NO: 7852 - DNA, 16 bp, Artificial Sequence
  synthetic [barcode part1]
ataaccgaatcgagac

SEQ ID NO: 7853 - DNA, 16 bp, Artificial Sequence
  synthetic [barcode part1]
accgaacggtaatcct

SEQ ID NO: 7854 - DNA, 16 bp, Artificial Sequence
  synthetic [barcode part1]
tcttatcgaacttgcg

SEQ ID NO: 7855 - DNA, 16 bp, Artificial Sequence
  synthetic [barcode part1]
gcgattgcgtgcaatt

SEQ ID NO: 7856 - DNA, 16 bp, Artificial Sequence
  synthetic [barcode part1]
atctcgcaggtacctc

SEQ ID NO: 7857 - DNA, 16 bp, Artificial Sequence
  synthetic [barcode part1]
tccacaccacaagaac

SEQ ID NO: 7858 - DNA, 16 bp, Artificial Sequence
  synthetic [barcode part1]
ttgaccagatctcgag

SEQ ID NO: 7859 - DNA, 16 bp, Artificial Sequence
  synthetic [barcode part1]
actggagtcttccaag

SEQ ID NO: 7860 - DNA, 16 bp, Artificial Sequence
  synthetic [barcode part1]
ccagaacctcgttcgt

SEQ ID NO: 7861 - DNA, 16 bp, Artificial Sequence
  synthetic [barcode part1]
aggactgacacaaccg

SEQ ID NO: 7862 - DNA, 16 bp, Artificial Sequence
  synthetic [barcode part1]
ttccagtggccacact

SEQ ID NO: 7863 - DNA, 16 bp, Artificial Sequence
  synthetic [barcode part1]
ccagtccgtagttatt

SEQ ID NO: 7864 - DNA, 16 bp, Artificial Sequence
  synthetic [barcode part1]
actattcgcctgtggc

SEQ ID NO: 7865 - DNA, 16 bp, Artificial Sequence
  synthetic [barcode part1]
aattcgccagagtaag

SEQ ID NO: 7866 - DNA, 16 bp, Artificial Sequence
  synthetic [barcode part1]
gtcgaattgaagacac

SEQ ID NO: 7867 - DNA, 16 bp, Artificial Sequence
  synthetic [barcode part1]
aatactaccgatcggc

SEQ ID NO: 7868 - DNA, 16 bp, Artificial Sequence
  synthetic [barcode part1]
cgtgacctctctaacg

SEQ ID NO: 7869 - DNA, 16 bp, Artificial Sequence
  synthetic [barcode part1]
tcactagaccaagtcg

SEQ ID NO: 7870 - DNA, 16 bp, Artificial Sequence
  synthetic [barcode part1]
gaccttcaaggcaatc

SEQ ID NO: 7871 - DNA, 16 bp, Artificial Sequence
  synthetic [barcode part1]
tgtaggtacagactcc

SEQ ID NO: 7872 - DNA, 16 bp, Artificial Sequence
  synthetic [barcode part1]
ttctcaaccaggagac

SEQ ID NO: 7873 - DNA, 16 bp, Artificial Sequence
  synthetic [barcode part1]
cgtatactagtgccag

SEQ ID NO: 7874 - DNA, 16 bp, Artificial Sequence
  synthetic [barcode part1]
accagagtgcgatcag

SEQ ID NO: 7875 - DNA, 16 bp, Artificial Sequence
  synthetic [barcode part1]
tgaagatactcggtag

SEQ ID NO: 7876 - DNA, 16 bp, Artificial Sequence
  synthetic [barcode part1]
ttcgccaatcaccttc

SEQ ID NO: 7877 - DNA, 16 bp, Artificial Sequence
  synthetic [barcode part1]
tcgattcaggtgtctt

SEQ ID NO: 7878 - DNA, 16 bp, Artificial Sequence
  synthetic [barcode part1]
atctgttgacaggcac

SEQ ID NO: 7879 - DNA, 16 bp, Artificial Sequence
  synthetic [barcode part1]
gactcggtgtacttcc

SEQ ID NO: 7880 - DNA, 16 bp, Artificial Sequence
  synthetic [barcode part1]
actggtaattctctgc

SEQ ID NO: 7881 - DNA, 16 bp, Artificial Sequence
  synthetic [barcode part1]
tacggtacgtcgtaac

SEQ ID NO: 7882 - DNA, 16 bp, Artificial Sequence
  synthetic [barcode part1]
aggttgtacgactcac

SEQ ID NO: 7883 - DNA, 16 bp, Artificial Sequence
  synthetic [barcode part1]
tacttacggcgttgcc

SEQ ID NO: 7884 - DNA, 16 bp, Artificial Sequence
  synthetic [barcode part1]
tctgacctgcgactac

SEQ ID NO: 7885 - DNA, 16 bp, Artificial Sequence
  synthetic [barcode part1]
taaccttgcactagtc

SEQ ID NO: 7886 - DNA, 16 bp, Artificial Sequence
  synthetic [barcode part1]
tgactaccaggagacg

SEQ ID NO: 7887 - DNA, 16 bp, Artificial Sequence
  synthetic [barcode part1]
ttcgagttgcctcacg

SEQ ID NO: 7888 - DNA, 16 bp, Artificial Sequence
  synthetic [barcode part1]
accactccggaataac

SEQ ID NO: 7889 - DNA, 16 bp, Artificial Sequence
  synthetic [barcode part1]
tacgactacgttcgag

SEQ ID NO: 7890 - DNA, 16 bp, Artificial Sequence
  synthetic [barcode part1]
cgagacttggtcagtt

SEQ ID NO: 7891 - DNA, 16 bp, Artificial Sequence
  synthetic [barcode part1]
tgttgtggtactgcag

SEQ ID NO: 7892 - DNA, 16 bp, Artificial Sequence
  synthetic [barcode part1]
aacactgtgtgcacac

SEQ ID NO: 7893 - DNA, 16 bp, Artificial Sequence
  synthetic [barcode part1]
aatagtgcctgagtag

SEQ ID NO: 7894 - DNA, 16 bp, Artificial Sequence
  synthetic [barcode part1]
tgattcgcctacgtcg

SEQ ID NO: 7895 - DNA, 16 bp, Artificial Sequence
  synthetic [barcode part1]
caagtgttcttaccac

SEQ ID NO: 7896 - DNA, 16 bp, Artificial Sequence
  synthetic [barcode part1]
cacctggagagtaacg

SEQ ID NO: 7897 - DNA, 16 bp, Artificial Sequence
  synthetic [barcode part1]
atcgccttgcctagac

SEQ ID NO: 7898 - DNA, 16 bp, Artificial Sequence
  synthetic [barcode part1]
cgcctattactgcgac

SEQ ID NO: 7899 - DNA, 16 bp, Artificial Sequence
  synthetic [barcode part1]
ttgtggatatcctacc

SEQ ID NO: 7900 - DNA, 16 bp, Artificial Sequence
  synthetic [barcode part1]
tcaacctaacacacct

SEQ ID NO: 7901 - DNA, 16 bp, Artificial Sequence
  synthetic [barcode part1]
agacactgaattcgcc

SEQ ID NO: 7902 - DNA, 16 bp, Artificial Sequence
  synthetic [barcode part1]
gcgcacagtactatac

SEQ ID NO: 7903 - DNA, 16 bp, Artificial Sequence
  synthetic [barcode part1]
aaggacggcgattcac

SEQ ID NO: 7904 - DNA, 16 bp, Artificial Sequence
  synthetic [barcode part1]
aggaatactcgcgttc

SEQ ID NO: 7905 - DNA, 16 bp, Artificial Sequence
  synthetic [barcode part1]
tcaatccgacgtgcct

SEQ ID NO: 7906 - DNA, 16 bp, Artificial Sequence
  synthetic [barcode part1]
cacgaaggccactaag

SEQ ID NO: 7907 - DNA, 16 bp, Artificial Sequence
  synthetic [barcode part1]
tcagacttggtaaccg

SEQ ID NO: 7908 - DNA, 16 bp, Artificial Sequence
  synthetic [barcode part1]
cgttctggcagatctc

SEQ ID NO: 7909 - DNA, 16 bp, Artificial Sequence
  synthetic [barcode part1]
taaggtagagtgttcg

SEQ ID NO: 7910 - DNA, 16 bp, Artificial Sequence
  synthetic [barcode part1]
ttatcgcgcggatcct

SEQ ID NO: 7911 - DNA, 16 bp, Artificial Sequence
  synthetic [barcode part1]
acgagagtccttgtac

SEQ ID NO: 7912 - DNA, 16 bp, Artificial Sequence
  synthetic [barcode part1]
ttagattcacgtcctg

SEQ ID NO: 7913 - DNA, 16 bp, Artificial Sequence
  synthetic [barcode part1]
cgttaacggaaccgag

SEQ ID NO: 7914 - DNA, 16 bp, Artificial Sequence
  synthetic [barcode part1]
agttgaattgccgtcg

SEQ ID NO: 7915 - DNA, 16 bp, Artificial Sequence
  synthetic [barcode part1]
tcgcgaaccaccactt

SEQ ID NO: 7916 - DNA, 16 bp, Artificial Sequence
  synthetic [barcode part1]
atcgagtaacggtctc

SEQ ID NO: 7917 - DNA, 16 bp, Artificial Sequence
  synthetic [barcode part1]
tatcgacgattccttg

SEQ ID NO: 7918 - DNA, 16 bp, Artificial Sequence
  synthetic [barcode part1]
taaccgaatcacggtc

SEQ ID NO: 7919 - DNA, 16 bp, Artificial Sequence
  synthetic [barcode part1]
gcctcagaattctgag

SEQ ID NO: 7920 - DNA, 16 bp, Artificial Sequence
  synthetic [barcode part1]
gtgattggtcggtatc

SEQ ID NO: 7921 - DNA, 16 bp, Artificial Sequence
  synthetic [barcode part1]
gtgagagaacttaacc

SEQ ID NO: 7922 - DNA, 16 bp, Artificial Sequence
  synthetic [barcode part1]
aacgtgttgactgcac

SEQ ID NO: 7923 - DNA, 16 bp, Artificial Sequence
  synthetic [barcode part1]
gccttcactattagac

SEQ ID NO: 7924 - DNA, 16 bp, Artificial Sequence
  synthetic [barcode part1]
tagtcgttcactatcg

SEQ ID NO: 7925 - DNA, 16 bp, Artificial Sequence
  synthetic [barcode part1]
tcttgagtgaggtctg

SEQ ID NO: 7926 - DNA, 16 bp, Artificial Sequence
  synthetic [barcode part1]
atcctgtcgagaggtt

SEQ ID NO: 7927 - DNA, 16 bp, Artificial Sequence
  synthetic [barcode part1]
acgttactggaatccg

SEQ ID NO: 7928 - DNA, 16 bp, Artificial Sequence
  synthetic [barcode part1]
ttagattctctgtgcg

SEQ ID NO: 7929 - DNA, 16 bp, Artificial Sequence
  synthetic [barcode part1]
tgtggatcctgttatc

SEQ ID NO: 7930 - DNA, 16 bp, Artificial Sequence
  synthetic [barcode part1]
gatccttgcgtccagt

SEQ ID NO: 7931 - DNA, 16 bp, Artificial Sequence
  synthetic [barcode part1]
acttcgagtcacaacg

SEQ ID NO: 7932 - DNA, 16 bp, Artificial Sequence
  synthetic [barcode part1]
attggtgcactccacc

SEQ ID NO: 7933 - DNA, 16 bp, Artificial Sequence
  synthetic [barcode part1]
tgcacttcttagtggt

SEQ ID NO: 7934 - DNA, 16 bp, Artificial Sequence
  synthetic [barcode part1]
gaggcaattacctcac

SEQ ID NO: 7935 - DNA, 16 bp, Artificial Sequence
  synthetic [barcode part1]
tcttaggcagaatccg

SEQ ID NO: 7936 - DNA, 16 bp, Artificial Sequence
  synthetic [barcode part1]
ttctctagtgattgcg

SEQ ID NO: 7937 - DNA, 16 bp, Artificial Sequence
  synthetic [barcode part1]
tctgcctggattccag

SEQ ID NO: 7938 - DNA, 16 bp, Artificial Sequence
  synthetic [barcode part1]
taacctcgcgcgttgt

SEQ ID NO: 7939 - DNA, 16 bp, Artificial Sequence
  synthetic [barcode part1]
taggcgacctaaggtg

SEQ ID NO: 7940 - DNA, 16 bp, Artificial Sequence
  synthetic [barcode part1]
ccaagtgccaccttgt

SEQ ID NO: 7941 - DNA, 16 bp, Artificial Sequence
  synthetic [barcode part1]
aacgtgtctgattctc

SEQ ID NO: 7942 - DNA, 16 bp, Artificial Sequence
  synthetic [barcode part1]
cctgactaaccaagac

SEQ ID NO: 7943 - DNA, 16 bp, Artificial Sequence
  synthetic [barcode part1]
gtcagattcgtattcc

SEQ ID NO: 7944 - DNA, 16 bp, Artificial Sequence
  synthetic [barcode part1]
acagtctcttgtgttg

SEQ ID NO: 7945 - DNA, 16 bp, Artificial Sequence
  synthetic [barcode part1]
gtacctaacaagtccg

SEQ ID NO: 7946 - DNA, 16 bp, Artificial Sequence
  synthetic [barcode part1]
tacctcggcaagtctc

SEQ ID NO: 7947 - DNA, 16 bp, Artificial Sequence
  synthetic [barcode part1]
aacctcactacttacg

SEQ ID NO: 7948 - DNA, 16 bp, Artificial Sequence
  synthetic [barcode part1]
tggtgcaaccaggagt

SEQ ID NO: 7949 - DNA, 16 bp, Artificial Sequence
  synthetic [barcode part1]
actgtaacactgcggt

SEQ ID NO: 7950 - DNA, 16 bp, Artificial Sequence
  synthetic [barcode part1]
gttacctaccttgcct

SEQ ID NO: 7951 - DNA, 16 bp, Artificial Sequence
  synthetic [barcode part1]
aagacctagatctcgc

SEQ ID NO: 7952 - DNA, 16 bp, Artificial Sequence
  synthetic [barcode part1]
gcgaaggtaacaatct

SEQ ID NO: 7953 - DNA, 16 bp, Artificial Sequence
  synthetic [barcode part1]
attctcagacgcagac

SEQ ID NO: 7954 - DNA, 16 bp, Artificial Sequence
  synthetic [barcode part1]
tgaacaacactacgag

SEQ ID NO: 7955 - DNA, 16 bp, Artificial Sequence
  synthetic [barcode part1]
ttctgtggactcgatt

SEQ ID NO: 7956 - DNA, 16 bp, Artificial Sequence
  synthetic [barcode part1]
acagtcactgacctcc

SEQ ID NO: 7957 - DNA, 16 bp, Artificial Sequence
  synthetic [barcode part1]
tgccggatattgagtc

SEQ ID NO: 7958 - DNA, 16 bp, Artificial Sequence
  synthetic [barcode part1]
ttggccgttaaccaag

SEQ ID NO: 7959 - DNA, 16 bp, Artificial Sequence
  synthetic [barcode part1]
agtgccgtatagtgtc

SEQ ID NO: 7960 - DNA, 16 bp, Artificial Sequence
  synthetic [barcode part1]
acacaactgcacaacc

SEQ ID NO: 7961 - DNA, 16 bp, Artificial Sequence
  synthetic [barcode part1]
tctcgtcagacttgcg

SEQ ID NO: 7962 - DNA, 16 bp, Artificial Sequence
  synthetic [barcode part1]
cacgcacactagttag

SEQ ID NO: 7963 - DNA, 16 bp, Artificial Sequence
  synthetic [barcode part1]
agtctccgcgcaattc

SEQ ID NO: 7964 - DNA, 16 bp, Artificial Sequence
  synthetic [barcode part1]
ataccttactaggtcc

SEQ ID NO: 7965 - DNA, 16 bp, Artificial Sequence
  synthetic [barcode part1]
tggatattgacgaggt

SEQ ID NO: 7966 - DNA, 16 bp, Artificial Sequence
  synthetic [barcode part1]
gttgacttggtcagtg

SEQ ID NO: 7967 - DNA, 16 bp, Artificial Sequence
  synthetic [barcode part1]
gagtcgaatattggtg

SEQ ID NO: 7968 - DNA, 16 bp, Artificial Sequence
  synthetic [barcode part1]
acgttacagtgagtag

SEQ ID NO: 7969 - DNA, 16 bp, Artificial Sequence
  synthetic [barcode part1]
atccgaagaacttgcc

SEQ ID NO: 7970 - DNA, 16 bp, Artificial Sequence
  synthetic [barcode part1]
tacggtatcgcaacac

SEQ ID NO: 7971 - DNA, 16 bp, Artificial Sequence
  synthetic [barcode part1]
gcgaatccgactcctt

SEQ ID NO: 7972 - DNA, 16 bp, Artificial Sequence
  synthetic [barcode part1]
ttgtaatccggccaag

SEQ ID NO: 7973 - DNA, 16 bp, Artificial Sequence
  synthetic [barcode part1]
cactccgtatcgtctt

SEQ ID NO: 7974 - DNA, 16 bp, Artificial Sequence
  synthetic [barcode part1]
tagtaacgaagtgcgt

SEQ ID NO: 7975 - DNA, 16 bp, Artificial Sequence
  synthetic [barcode part1]
gttacagaggtaggcc

SEQ ID NO: 7976 - DNA, 16 bp, Artificial Sequence
  synthetic [barcode part1]
gcagactacacaacct

SEQ ID NO: 7977 - DNA, 16 bp, Artificial Sequence
  synthetic [barcode part1]
gtaattgtctctcggt

SEQ ID NO: 7978 - DNA, 16 bp, Artificial Sequence
  synthetic [barcode part1]
gttcactgcgacgtct

SEQ ID NO: 7979 - DNA, 16 bp, Artificial Sequence
  synthetic [barcode part1]
acctcacaagtcgaac

SEQ ID NO: 7980 - DNA, 16 bp, Artificial Sequence
  synthetic [barcode part1]
tctccggattaacgtt

SEQ ID NO: 7981 - DNA, 16 bp, Artificial Sequence
  synthetic [barcode part1]
gatcctatacctatcg

SEQ ID NO: 7982 - DNA, 16 bp, Artificial Sequence
  synthetic [barcode part1]
tcaccacagtgaagtc

SEQ ID NO: 7983 - DNA, 16 bp, Artificial Sequence
  synthetic [barcode part1]
gagagaagatcaaccg

SEQ ID NO: 7984 - DNA, 16 bp, Artificial Sequence
  synthetic [barcode part1]
aagattggcgttcaag

SEQ ID NO: 7985 - DNA, 16 bp, Artificial Sequence
  synthetic [barcode part1]
gtgtaatccggttctt

SEQ ID NO: 7986 - DNA, 16 bp, Artificial Sequence
  synthetic [barcode part1]
ttgtagaacggagtgt

SEQ ID NO: 7987 - DNA, 16 bp, Artificial Sequence
  synthetic [barcode part1]
tcgacggtaagaacgc

SEQ ID NO: 7988 - DNA, 16 bp, Artificial Sequence
  synthetic [barcode part1]
aatccgaccagattgc

SEQ ID NO: 7989 - DNA, 16 bp, Artificial Sequence
  synthetic [barcode part1]
tggtcttgtgttggtt

SEQ ID NO: 7990 - DNA, 16 bp, Artificial Sequence
  synthetic [barcode part1]
caacttcggtccttct

SEQ ID NO: 7991 - DNA, 16 bp, Artificial Sequence
  synthetic [barcode part1]
tagttggacacgtacc

SEQ ID NO: 7992 - DNA, 16 bp, Artificial Sequence
  synthetic [barcode part1]
ttccttactgccgttg

SEQ ID NO: 7993 - DNA, 16 bp, Artificial Sequence
  synthetic [barcode part1]
gcacagtagtcctcct

SEQ ID NO: 7994 - DNA, 16 bp, Artificial Sequence
  synthetic [barcode part1]
gttcacaccaagtgtg

SEQ ID NO: 7995 - DNA, 16 bp, Artificial Sequence
  synthetic [barcode part1]
gtctaacctcttgtag

SEQ ID NO: 7996 - DNA, 16 bp, Artificial Sequence
  synthetic [barcode part1]
tgatcaacgaccggtt

SEQ ID NO: 7997 - DNA, 16 bp, Artificial Sequence
  synthetic [barcode part1]
gacgaagtgcgttgac

SEQ ID NO: 7998 - DNA, 16 bp, Artificial Sequence
  synthetic [barcode part1]
actcaccagaccttgc

SEQ ID NO: 7999 - DNA, 16 bp, Artificial Sequence
  synthetic [barcode part1]
cgagatcaaccgatct

SEQ ID NO: 8000 - DNA, 16 bp, Artificial Sequence
  synthetic [barcode part1]
tgaactggatccaacc

SEQ ID NO: 8001 - DNA, 16 bp, Artificial Sequence
  synthetic [barcode part1]
ttgatatactggcgcg

SEQ ID NO: 8002 - DNA, 16 bp, Artificial Sequence
  synthetic [barcode part1]
ccttccttgatcgact

SEQ ID NO: 8003 - DNA, 16 bp, Artificial Sequence
  synthetic [barcode part1]
cgttcgtggtgttacc

SEQ ID NO: 8004 - DNA, 16 bp, Artificial Sequence
  synthetic [barcode part1]
tgtgacaagacggacc

SEQ ID NO: 8005 - DNA, 16 bp, Artificial Sequence
  synthetic [barcode part1]
tattggatccggtggt

SEQ ID NO: 8006 - DNA, 16 bp, Artificial Sequence
  synthetic [barcode part1]
aaggagtctgcgcagt

SEQ ID NO: 8007 - DNA, 16 bp, Artificial Sequence
  synthetic [barcode part1]
gttagtctgcaacacg

SEQ ID NO: 8008 - DNA, 16 bp, Artificial Sequence
  synthetic [barcode part1]
ttactcagacgccgtc

SEQ ID NO: 8009 - DNA, 16 bp, Artificial Sequence
  synthetic [barcode part1]
cgtctgtcgttgcaac

SEQ ID NO: 8010 - DNA, 16 bp, Artificial Sequence
  synthetic [barcode part1]
tctagttcacgtggcc

SEQ ID NO: 8011 - DNA, 16 bp, Artificial Sequence
  synthetic [barcode part1]
caaccaatacggtacc

SEQ ID NO: 8012 - DNA, 16 bp, Artificial Sequence
  synthetic [barcode part1]
tcgaggttggacgagt

SEQ ID NO: 8013 - DNA, 16 bp, Artificial Sequence
  synthetic [barcode part1]
ccagtagacgattcgt

SEQ ID NO: 8014 - DNA, 16 bp, Artificial Sequence
  synthetic [barcode part1]
atctgactgacggttg

SEQ ID NO: 8015 - DNA, 16 bp, Artificial Sequence
  synthetic [barcode part1]
aacgttgactgcagtc

SEQ ID NO: 8016 - DNA, 16 bp, Artificial Sequence
  synthetic [barcode part1]
aatactaaccggtcgc

SEQ ID NO: 8017 - DNA, 16 bp, Artificial Sequence
  synthetic [barcode part1]
cctcacgttgaaccgt

SEQ ID NO: 8018 - DNA, 16 bp, Artificial Sequence
  synthetic [barcode part1]
gaactaccactcttac

SEQ ID NO: 8019 - DNA, 16 bp, Artificial Sequence
  synthetic [barcode part1]
tgcaagtcggagtgac

SEQ ID NO: 8020 - DNA, 16 bp, Artificial Sequence
  synthetic [barcode part1]
atcgttcgcaggtcct

SEQ ID NO: 8021 - DNA, 16 bp, Artificial Sequence
  synthetic [barcode part1]
gtatcgatcgagtacc

SEQ ID NO: 8022 - DNA, 16 bp, Artificial Sequence
  synthetic [barcode part1]
gttcgaagaactcgtc

SEQ ID NO: 8023 - DNA, 16 bp, Artificial Sequence
  synthetic [barcode part1]
gccttctaccagtgtg

SEQ ID NO: 8024 - DNA, 16 bp, Artificial Sequence
  synthetic [barcode part1]
ttaggtcttcctgtag

SEQ ID NO: 8025 - DNA, 16 bp, Artificial Sequence
  synthetic [barcode part1]
tctaacgtacttccag

SEQ ID NO: 8026 - DNA, 16 bp, Artificial Sequence
  synthetic [barcode part1]
tgccgacctaaggaag

SEQ ID NO: 8027 - DNA, 16 bp, Artificial Sequence
  synthetic [barcode part1]
caactacggtggtgag

SEQ ID NO: 8028 - DNA, 16 bp, Artificial Sequence
  synthetic [barcode part1]
atccagaagacaacac

SEQ ID NO: 8029 - DNA, 16 bp, Artificial Sequence
  synthetic [barcode part1]
ttgtaggattcttcgc

SEQ ID NO: 8030 - DNA, 16 bp, Artificial Sequence
  synthetic [barcode part1]
tgtaacaggtgccact

SEQ ID NO: 8031 - DNA, 16 bp, Artificial Sequence
  synthetic [barcode part1]
tagtgcagatccacac

SEQ ID NO: 8032 - DNA, 16 bp, Artificial Sequence
  synthetic [barcode part1]
caccagacagagacgt

SEQ ID NO: 8033 - DNA, 16 bp, Artificial Sequence
  synthetic [barcode part1]
aaggacgaacaacttc

SEQ ID NO: 8034 - DNA, 16 bp, Artificial Sequence
  synthetic [barcode part1]
gacttgaagaggtatc

SEQ ID NO: 8035 - DNA, 16 bp, Artificial Sequence
  synthetic [barcode part1]
gcacaacgtgttgact

SEQ ID NO: 8036 - DNA, 16 bp, Artificial Sequence
  synthetic [barcode part1]
gcctattagtaccgtt

SEQ ID NO: 8037 - DNA, 16 bp, Artificial Sequence
  synthetic [barcode part1]
attgacgcaggtctac

SEQ ID NO: 8038 - DNA, 16 bp, Artificial Sequence
  synthetic [barcode part1]
cacttgagattgtgcg

SEQ ID NO: 8039 - DNA, 16 bp, Artificial Sequence
  synthetic [barcode part1]
ccttgtgattagatcc

SEQ ID NO: 8040 - DNA, 16 bp, Artificial Sequence
  synthetic [barcode part1]
gtcaacaaggccgaac

SEQ ID NO: 8041 - DNA, 16 bp, Artificial Sequence
  synthetic [barcode part1]
acgtaacgtcgatacc

SEQ ID NO: 8042 - DNA, 16 bp, Artificial Sequence
  synthetic [barcode part1]
attccactggattcgt

SEQ ID NO: 8043 - DNA, 16 bp, Artificial Sequence
  synthetic [barcode part1]
aacgatacctaccacg

SEQ ID NO: 8044 - DNA, 16 bp, Artificial Sequence
  synthetic [barcode part1]
gagactgcacagatcg

SEQ ID NO: 8045 - DNA, 16 bp, Artificial Sequence
  synthetic [barcode part1]
tagtagatacctggag

SEQ ID NO: 8046 - DNA, 16 bp, Artificial Sequence
  synthetic [barcode part1]
aacaacacgagtactg

SEQ ID NO: 8047 - DNA, 16 bp, Artificial Sequence
  synthetic [barcode part1]
gagagacacttagatc

SEQ ID NO: 8048 - DNA, 16 bp, Artificial Sequence
  synthetic [barcode part1]
tatacggcgttctatc

SEQ ID NO: 8049 - DNA, 16 bp, Artificial Sequence
  synthetic [barcode part1]
ttcacgcaaggatacc

SEQ ID NO: 8050 - DNA, 16 bp, Artificial Sequence
  synthetic [barcode part1]
caaccgaccttaaggt

SEQ ID NO: 8051 - DNA, 16 bp, Artificial Sequence
  synthetic [barcode part1]
ttcttcctgataccgc

SEQ ID NO: 8052 - DNA, 16 bp, Artificial Sequence
  synthetic [barcode part1]
atacaaccggcacgtt

SEQ ID NO: 8053 - DNA, 16 bp, Artificial Sequence
  synthetic [barcode part1]
tccaatcgtgccaatt

SEQ ID NO: 8054 - DNA, 16 bp, Artificial Sequence
  synthetic [barcode part1]
ttaggattggacaggt

SEQ ID NO: 8055 - DNA, 16 bp, Artificial Sequence
  synthetic [barcode part1]
tggaccacagttcagt

SEQ ID NO: 8056 - DNA, 16 bp, Artificial Sequence
  synthetic [barcode part1]
tctaatctgcgtaacc

SEQ ID NO: 8057 - DNA, 16 bp, Artificial Sequence
  synthetic [barcode part1]
gagaacagttcagtgt

SEQ ID NO: 8058 - DNA, 16 bp, Artificial Sequence
  synthetic [barcode part1]
agtatcgttctgaggc

SEQ ID NO: 8059 - DNA, 16 bp, Artificial Sequence
  synthetic [barcode part1]
ttggtgaattcctacc

SEQ ID NO: 8060 - DNA, 16 bp, Artificial Sequence
  synthetic [barcode part1]
aacgaggaaccacgtc

SEQ ID NO: 8061 - DNA, 16 bp, Artificial Sequence
  synthetic [barcode part1]
atagagactggcaatc

SEQ ID NO: 8062 - DNA, 16 bp, Artificial Sequence
  synthetic [barcode part1]
gatcggtcacgatact

SEQ ID NO: 8063 - DNA, 16 bp, Artificial Sequence
  synthetic [barcode part1]
tcgtaaggttcggatc

SEQ ID NO: 8064 - DNA, 16 bp, Artificial Sequence
  synthetic [barcode part1]
aacaaccgactactgc

SEQ ID NO: 8065 - DNA, 16 bp, Artificial Sequence
  synthetic [barcode part1]
gccgttctcgtaggtt

SEQ ID NO: 8066 - DNA, 16 bp, Artificial Sequence
  synthetic [barcode part1]
ttcagtccggcgtgtt

SEQ ID NO: 8067 - DNA, 16 bp, Artificial Sequence
  synthetic [barcode part1]
agacaatccaggcacg

SEQ ID NO: 8068 - DNA, 16 bp, Artificial Sequence
  synthetic [barcode part1]
tgttccaggcacctgt

SEQ ID NO: 8069 - DNA, 16 bp, Artificial Sequence
  synthetic [barcode part1]
acgtcaagttaaggac

SEQ ID NO: 8070 - DNA, 16 bp, Artificial Sequence
  synthetic [barcode part1]
gtagaaggaaggcact

SEQ ID NO: 8071 - DNA, 16 bp, Artificial Sequence
  synthetic [barcode part1]
ttactcttacaggtcg

SEQ ID NO: 8072 - DNA, 16 bp, Artificial Sequence
  synthetic [barcode part1]
ttgtgtgcaacacacg

SEQ ID NO: 8073 - DNA, 16 bp, Artificial Sequence
  synthetic [barcode part1]
agtgcgtattggcgtt

SEQ ID NO: 8074 - DNA, 16 bp, Artificial Sequence
  synthetic [barcode part1]
gcgtgtaatcacgact

SEQ ID NO: 8075 - DNA, 16 bp, Artificial Sequence
  synthetic [barcode part1]
ataggcgcaccgtaag

SEQ ID NO: 8076 - DNA, 16 bp, Artificial Sequence
  synthetic [barcode part1]
attccttggtctctcg

SEQ ID NO: 8077 - DNA, 16 bp, Artificial Sequence
  synthetic [barcode part1]
tgtacaccacagtacg

SEQ ID NO: 8078 - DNA, 16 bp, Artificial Sequence
  synthetic [barcode part1]
aagaacgccgtatcct

SEQ ID NO: 8079 - DNA, 16 bp, Artificial Sequence
  synthetic [barcode part1]
gcgttcgaacagagtg

SEQ ID NO: 8080 - DNA, 16 bp, Artificial Sequence
  synthetic [barcode part1]
gttcggagtggattct

SEQ ID NO: 8081 - DNA, 16 bp, Artificial Sequence
  synthetic [barcode part1]
gcgagtacttgaggtg

SEQ ID NO: 8082 - DNA, 16 bp, Artificial Sequence
  synthetic [barcode part1]
cctacctcgagacttg

SEQ ID NO: 8083 - DNA, 16 bp, Artificial Sequence
  synthetic [barcode part1]
gtccgtctgagtaagt

SEQ ID NO: 8084 - DNA, 16 bp, Artificial Sequence
  synthetic [barcode part1]
ttgttcttgtgaaccg

SEQ ID NO: 8085 - DNA, 16 bp, Artificial Sequence
  synthetic [barcode part1]
tgtcaccggtatattc

SEQ ID NO: 8086 - DNA, 16 bp, Artificial Sequence
  synthetic [barcode part1]
aggattctctatccac

SEQ ID NO: 8087 - DNA, 16 bp, Artificial Sequence
  synthetic [barcode part1]
gactcaatctccacgc

SEQ ID NO: 8088 - DNA, 16 bp, Artificial Sequence
  synthetic [barcode part1]
gtgagagtccttacac

SEQ ID NO: 8089 - DNA, 16 bp, Artificial Sequence
  synthetic [barcode part1]
ttcgagattagtcggc

SEQ ID NO: 8090 - DNA, 16 bp, Artificial Sequence
  synthetic [barcode part1]
aactcttcggcaagac

SEQ ID NO: 8091 - DNA, 16 bp, Artificial Sequence
  synthetic [barcode part1]
tggtcgatcgattggt

SEQ ID NO: 8092 - DNA, 16 bp, Artificial Sequence
  synthetic [barcode part1]
cgagtcgttgaatcac

SEQ ID NO: 8093 - DNA, 16 bp, Artificial Sequence
  synthetic [barcode part1]
aggtcttccaatcgag

SEQ ID NO: 8094 - DNA, 16 bp, Artificial Sequence
  synthetic [barcode part1]
gaagtatcgcaggaag

SEQ ID NO: 8095 - DNA, 16 bp, Artificial Sequence
  synthetic [barcode part1]
aacactcgtggaatag

SEQ ID NO: 8096 - DNA, 16 bp, Artificial Sequence
  synthetic [barcode part1]
ttggaggtcttaccag

SEQ ID NO: 8097 - DNA, 16 bp, Artificial Sequence
  synthetic [barcode part1]
cacgttagtatcggtg

SEQ ID NO: 8098 - DNA, 16 bp, Artificial Sequence
  synthetic [barcode part1]
tgtattccacctccac

SEQ ID NO: 8099 - DNA, 16 bp, Artificial Sequence
  synthetic [barcode part1]
aacaaccttggcaacc

SEQ ID NO: 8100 - DNA, 16 bp, Artificial Sequence
  synthetic [barcode part1]
acgaatcagagtgatc

SEQ ID NO: 8101 - DNA, 16 bp, Artificial Sequence
  synthetic [barcode part1]
tggaccgtcaatagtc

SEQ ID NO: 8102 - DNA, 16 bp, Artificial Sequence
  synthetic [barcode part1]
tctctccacgtacact

SEQ ID NO: 8103 - DNA, 16 bp, Artificial Sequence
  synthetic [barcode part1]
ttgtgacacgtcacag

SEQ ID NO: 8104 - DNA, 16 bp, Artificial Sequence
  synthetic [barcode part1]
gatatccaacagtgag

SEQ ID NO: 8105 - DNA, 16 bp, Artificial Sequence
  synthetic [barcode part1]
gaacagatccggaatt

SEQ ID NO: 8106 - DNA, 16 bp, Artificial Sequence
  synthetic [barcode part1]
gagtatcgaacctgtc

SEQ ID NO: 8107 - DNA, 16 bp, Artificial Sequence
  synthetic [barcode part1]
tgaccgaagagttcct

SEQ ID NO: 8108 - DNA, 16 bp, Artificial Sequence
  synthetic [barcode part1]
gttacgttgtgagtcg

SEQ ID NO: 8109 - DNA, 16 bp, Artificial Sequence
  synthetic [barcode part1]
cgatcaagacctcaac

SEQ ID NO: 8110 - DNA, 16 bp, Artificial Sequence
  synthetic [barcode part1]
agagttatcaagtgcg

SEQ ID NO: 8111 - DNA, 16 bp, Artificial Sequence
  synthetic [barcode part1]
tcggttcaagtattcc

SEQ ID NO: 8112 - DNA, 16 bp, Artificial Sequence
  synthetic [barcode part1]
caagacctctcagagt

SEQ ID NO: 8113 - DNA, 16 bp, Artificial Sequence
  synthetic [barcode part1]
ataccgttatccactg

SEQ ID NO: 8114 - DNA, 16 bp, Artificial Sequence
  synthetic [barcode part1]
taagtccttgtggacg

SEQ ID NO: 8115 - DNA, 16 bp, Artificial Sequence
  synthetic [barcode part1]
tgcaatctaacctctg

SEQ ID NO: 8116 - DNA, 16 bp, Artificial Sequence
  synthetic [barcode part1]
ttggttggtcacagtg

SEQ ID NO: 8117 - DNA, 16 bp, Artificial Sequence
  synthetic [barcode part1]
cgccaagtaggttatc

SEQ ID NO: 8118 - DNA, 16 bp, Artificial Sequence
  synthetic [barcode part1]
gatacgtctccaattc

SEQ ID NO: 8119 - DNA, 16 bp, Artificial Sequence
  synthetic [barcode part1]
tagtagtgtcgccagt

SEQ ID NO: 8120 - DNA, 16 bp, Artificial Sequence
  synthetic [barcode part1]
cgtagagttagtggcg

SEQ ID NO: 8121 - DNA, 16 bp, Artificial Sequence
  synthetic [barcode part1]
tcagacacaagacggc

SEQ ID NO: 8122 - DNA, 16 bp, Artificial Sequence
  synthetic [barcode part1]
attattgccttgtgcg

SEQ ID NO: 8123 - DNA, 16 bp, Artificial Sequence
  synthetic [barcode part1]
agtggagaattgcgcc

SEQ ID NO: 8124 - DNA, 16 bp, Artificial Sequence
  synthetic [barcode part1]
cggttcctcaattcct

SEQ ID NO: 8125 - DNA, 16 bp, Artificial Sequence
  synthetic [barcode part1]
aatagtcgtcaccggt

SEQ ID NO: 8126 - DNA, 16 bp, Artificial Sequence
  synthetic [barcode part1]
acagtactcgagactc

SEQ ID NO: 8127 - DNA, 16 bp, Artificial Sequence
  synthetic [barcode part1]
gtacgttcgagaggtg

SEQ ID NO: 8128 - DNA, 16 bp, Artificial Sequence
  synthetic [barcode part1]
gtgtcaggactgtgtt

SEQ ID NO: 8129 - DNA, 16 bp, Artificial Sequence
  synthetic [barcode part1]
tggcgtcctattcacg

SEQ ID NO: 8130 - DNA, 16 bp, Artificial Sequence
  synthetic [barcode part1]
ttctgataatcgcacc

SEQ ID NO: 8131 - DNA, 16 bp, Artificial Sequence
  synthetic [barcode part1]
aatctccgcgcagtct

SEQ ID NO: 8132 - DNA, 16 bp, Artificial Sequence
  synthetic [barcode part1]
gttagtcaccacagtg

SEQ ID NO: 8133 - DNA, 16 bp, Artificial Sequence
  synthetic [barcode part1]
gaatagtgaccgcacg

SEQ ID NO: 8134 - DNA, 16 bp, Artificial Sequence
  synthetic [barcode part1]
agtcagttcgagatcc

SEQ ID NO: 8135 - DNA, 16 bp, Artificial Sequence
  synthetic [barcode part1]
gtgacgattactgtcg

SEQ ID NO: 8136 - DNA, 16 bp, Artificial Sequence
  synthetic [barcode part1]
actgcagacaacacct

SEQ ID NO: 8137 - DNA, 16 bp, Artificial Sequence
  synthetic [barcode part1]
ttctccgaatataccg

SEQ ID NO: 8138 - DNA, 16 bp, Artificial Sequence
  synthetic [barcode part1]
actgcaacgtcacaac

SEQ ID NO: 8139 - DNA, 16 bp, Artificial Sequence
  synthetic [barcode part1]
tgtcctacacttaggt

SEQ ID NO: 8140 - DNA, 16 bp, Artificial Sequence
  synthetic [barcode part1]
gaaggaacgacactag

SEQ ID NO: 8141 - DNA, 16 bp, Artificial Sequence
  synthetic [barcode part1]
ttctgtggtacggagt

SEQ ID NO: 8142 - DNA, 16 bp, Artificial Sequence
  synthetic [barcode part1]
aattcaacttccgtgc

SEQ ID NO: 8143 - DNA, 16 bp, Artificial Sequence
  synthetic [barcode part1]
tattgtccactgacac

SEQ ID NO: 8144 - DNA, 16 bp, Artificial Sequence
  synthetic [barcode part1]
gttggcagacgacagt

SEQ ID NO: 8145 - DNA, 16 bp, Artificial Sequence
  synthetic [barcode part1]
ttccgtcacgaatccg

SEQ ID NO: 8146 - DNA, 16 bp, Artificial Sequence
  synthetic [barcode part1]
gtcttactccggtctt

SEQ ID NO: 8147 - DNA, 16 bp, Artificial Sequence
  synthetic [barcode part1]
ccgttgtattccactc

SEQ ID NO: 8148 - DNA, 16 bp, Artificial Sequence
  synthetic [barcode part1]
tctattcgcggcactg

SEQ ID NO: 8149 - DNA, 16 bp, Artificial Sequence
  synthetic [barcode part1]
gagactgactgagaag

SEQ ID NO: 8150 - DNA, 16 bp, Artificial Sequence
  synthetic [barcode part1]
tgtctcacgagtactt

SEQ ID NO: 8151 - DNA, 16 bp, Artificial Sequence
  synthetic [barcode part1]
tggtacggtacttggt

SEQ ID NO: 8152 - DNA, 16 bp, Artificial Sequence
  synthetic [barcode part1]
atcctgtctacgtagt

SEQ ID NO: 8153 - DNA, 16 bp, Artificial Sequence
  synthetic [barcode part1]
gtagtaagttcagacg

SEQ ID NO: 8154 - DNA, 16 bp, Artificial Sequence
  synthetic [barcode part1]
acagacttaatcctcc

SEQ ID NO: 8155 - DNA, 16 bp, Artificial Sequence
  synthetic [barcode part1]
aggtcgtcctatatct

SEQ ID NO: 8156 - DNA, 16 bp, Artificial Sequence
  synthetic [barcode part1]
cgagttggaggacgtt

SEQ ID NO: 8157 - DNA, 16 bp, Artificial Sequence
  synthetic [barcode part1]
tccaggagagagaagt

SEQ ID NO: 8158 - DNA, 16 bp, Artificial Sequence
  synthetic [barcode part1]
agttacgtacgtggtc

SEQ ID NO: 8159 - DNA, 16 bp, Artificial Sequence
  synthetic [barcode part1]
acaggaccgttattcg

SEQ ID NO: 8160 - DNA, 16 bp, Artificial Sequence
  synthetic [barcode part1]
aggtggtgtgtaattg

SEQ ID NO: 8161 - DNA, 16 bp, Artificial Sequence
  synthetic [barcode part1]
gcggttatcctgacct

SEQ ID NO: 8162 - DNA, 16 bp, Artificial Sequence
  synthetic [barcode part1]
taaccacttgtgcgag

SEQ ID NO: 8163 - DNA, 16 bp, Artificial Sequence
  synthetic [barcode part1]
tcttgcctacttagag

SEQ ID NO: 8164 - DNA, 16 bp, Artificial Sequence
  synthetic [barcode part1]
acttcgacgtacgtag

SEQ ID NO: 8165 - DNA, 16 bp, Artificial Sequence
  synthetic [barcode part1]
actcacaggttcacag

SEQ ID NO: 8166 - DNA, 16 bp, Artificial Sequence
  synthetic [barcode part1]
cgaactacaattcggc

SEQ ID NO: 8167 - DNA, 16 bp, Artificial Sequence
  synthetic [barcode part1]
gtacttcgtgcgaagt

SEQ ID NO: 8168 - DNA, 16 bp, Artificial Sequence
  synthetic [barcode part1]
gcgtcttatcggactc

SEQ ID NO: 8169 - DNA, 16 bp, Artificial Sequence
  synthetic [barcode part1]
ttagtctacggagtgc

SEQ ID NO: 8170 - DNA, 16 bp, Artificial Sequence
  synthetic [barcode part1]
aattgttcaccggacg

SEQ ID NO: 8171 - DNA, 16 bp, Artificial Sequence
  synthetic [barcode part1]
gcgtgattcggttcct

SEQ ID NO: 8172 - DNA, 16 bp, Artificial Sequence
  synthetic [barcode part1]
ccactacagatctatc

SEQ ID NO: 8173 - DNA, 16 bp, Artificial Sequence
  synthetic [barcode part1]
atcgaacacagaagtc

SEQ ID NO: 8174 - DNA, 16 bp, Artificial Sequence
  synthetic [barcode part1]
acgtgatagagaatcc

SEQ ID NO: 8175 - DNA, 16 bp, Artificial Sequence
  synthetic [barcode part1]
tctgactgtcacgcgt

SEQ ID NO: 8176 - DNA, 16 bp, Artificial Sequence
  synthetic [barcode part1]
gtaggaatcggcggtt

SEQ ID NO: 8177 - DNA, 16 bp, Artificial Sequence
  synthetic [barcode part1]
ttgagtacggaacagt

SEQ ID NO: 8178 - DNA, 16 bp, Artificial Sequence
  synthetic [barcode part1]
cagagagaactctctc

SEQ ID NO: 8179 - DNA, 16 bp, Artificial Sequence
  synthetic [barcode part1]
tcgcctaggacttcac

SEQ ID NO: 8180 - DNA, 16 bp, Artificial Sequence
  synthetic [barcode part1]
accggacactcttgtc

SEQ ID NO: 8181 - DNA, 16 bp, Artificial Sequence
  synthetic [barcode part1]
ccaccacgtaggttct

SEQ ID NO: 8182 - DNA, 16 bp, Artificial Sequence
  synthetic [barcode part1]
taggaggcagtacacc

SEQ ID NO: 8183 - DNA, 16 bp, Artificial Sequence
  synthetic [barcode part1]
ttcaggtcagaggacg

SEQ ID NO: 8184 - DNA, 16 bp, Artificial Sequence
  synthetic [barcode part1]
caataccgttctggag

SEQ ID NO: 8185 - DNA, 16 bp, Artificial Sequence
  synthetic [barcode part1]
cgaagtcacacgtgtt

SEQ ID NO: 8186 - DNA, 16 bp, Artificial Sequence
  synthetic [barcode part1]
ccttacgaccaccaac

SEQ ID NO: 8187 - DNA, 16 bp, Artificial Sequence
  synthetic [barcode part1]
gcctgtgttcttgacg

SEQ ID NO: 8188 - DNA, 16 bp, Artificial Sequence
  synthetic [barcode part1]
gaagatatcgttaggc

SEQ ID NO: 8189 - DNA, 16 bp, Artificial Sequence
  synthetic [barcode part1]
gagacacgacttgacg

SEQ ID NO: 8190 - DNA, 16 bp, Artificial Sequence
  synthetic [barcode part1]
tccgagaactacgact

SEQ ID NO: 8191 - DNA, 16 bp, Artificial Sequence
  synthetic [barcode part1]
cctactccacttactg

SEQ ID NO: 8192 - DNA, 16 bp, Artificial Sequence
  synthetic [barcode part1]
tgttcaggactgtacg

SEQ ID NO: 8193 - DNA, 16 bp, Artificial Sequence
  synthetic [barcode part1]
cagaactccagaactc

SEQ ID NO: 8194 - DNA, 16 bp, Artificial Sequence
  synthetic [barcode part1]
cgattcttggtacgtt

SEQ ID NO: 8195 - DNA, 16 bp, Artificial Sequence
  synthetic [barcode part1]
gcaagttccagtgtac

SEQ ID NO: 8196 - DNA, 16 bp, Artificial Sequence
  synthetic [barcode part1]
ccacctaagtaagtgc

SEQ ID NO: 8197 - DNA, 16 bp, Artificial Sequence
  synthetic [barcode part1]
gaacgcctaaggcaac

SEQ ID NO: 8198 - DNA, 16 bp, Artificial Sequence
  synthetic [barcode part1]
ttctatcaggtccgcg

SEQ ID NO: 8199 - DNA, 16 bp, Artificial Sequence
  synthetic [barcode part1]
tcgcgttacaactcgc

SEQ ID NO: 8200 - DNA, 16 bp, Artificial Sequence
  synthetic [barcode part1]
ataccttaatcaccgc

SEQ ID NO: 8201 - DNA, 16 bp, Artificial Sequence
  synthetic [barcode part1]
agttgaccagtgtcac

SEQ ID NO: 8202 - DNA, 16 bp, Artificial Sequence
  synthetic [barcode part1]
aatctgagtgtctcct

SEQ ID NO: 8203 - DNA, 16 bp, Artificial Sequence
  synthetic [barcode part1]
caccttggtggacttc

SEQ ID NO: 8204 - DNA, 16 bp, Artificial Sequence
  synthetic [barcode part1]
acaacacaaccttggc

SEQ ID NO: 8205 - DNA, 16 bp, Artificial Sequence
  synthetic [barcode part1]
acggtaggtagtcgtg

SEQ ID NO: 8206 - DNA, 16 bp, Artificial Sequence
  synthetic [barcode part1]
tcgtctaataacgcct

SEQ ID NO: 8207 - DNA, 16 bp, Artificial Sequence
  synthetic [barcode part1]
aagtctggatagtgac

SEQ ID NO: 8208 - DNA, 16 bp, Artificial Sequence
  synthetic [barcode part1]
tgtgcaggcgactatt

SEQ ID NO: 8209 - DNA, 16 bp, Artificial Sequence
  synthetic [barcode part1]
tctcgaacacctattg

SEQ ID NO: 8210 - DNA, 16 bp, Artificial Sequence
  synthetic [barcode part1]
ttgtagaatcctccgt

SEQ ID NO: 8211 - DNA, 16 bp, Artificial Sequence
  synthetic [barcode part1]
caccagaagactgtct

SEQ ID NO: 8212 - DNA, 16 bp, Artificial Sequence
  synthetic [barcode part1]
cggtacgtgtgttaac

SEQ ID NO: 8213 - DNA, 16 bp, Artificial Sequence
  synthetic [barcode part1]
acactggtagtagagt

SEQ ID NO: 8214 - DNA, 16 bp, Artificial Sequence
  synthetic [barcode part1]
ttgtattcgccggatt

SEQ ID NO: 8215 - DNA, 16 bp, Artificial Sequence
  synthetic [barcode part1]
acgcgtagactaacct

SEQ ID NO: 8216 - DNA, 16 bp, Artificial Sequence
  synthetic [barcode part1]
acgaatcttcctgatc

SEQ ID NO: 8217 - DNA, 16 bp, Artificial Sequence
  synthetic [barcode part1]
tatagtactgtccacc

SEQ ID NO: 8218 - DNA, 16 bp, Artificial Sequence
  synthetic [barcode part1]
aggcgcgttaagtcag

SEQ ID NO: 8219 - DNA, 16 bp, Artificial Sequence
  synthetic [barcode part1]
tcaatctaacggtggc

SEQ ID NO: 8220 - DNA, 16 bp, Artificial Sequence
  synthetic [barcode part1]
gcaggagaagatacgt

SEQ ID NO: 8221 - DNA, 16 bp, Artificial Sequence
  synthetic [barcode part1]
aatcacaggttggagt

SEQ ID NO: 8222 - DNA, 16 bp, Artificial Sequence
  synthetic [barcode part1]
ccactcactacgacac

SEQ ID NO: 8223 - DNA, 16 bp, Artificial Sequence
  synthetic [barcode part1]
gtgttaggtgcgattc

SEQ ID NO: 8224 - DNA, 16 bp, Artificial Sequence
  synthetic [barcode part1]
tgaggttatcgactgc

SEQ ID NO: 8225 - DNA, 16 bp, Artificial Sequence
  synthetic [barcode part1]
acaagatcggaacgag

SEQ ID NO: 8226 - DNA, 16 bp, Artificial Sequence
  synthetic [barcode part1]
acacctcggttaccac

SEQ ID NO: 8227 - DNA, 16 bp, Artificial Sequence
  synthetic [barcode part1]
gtgtacacttcgagac

SEQ ID NO: 8228 - DNA, 16 bp, Artificial Sequence
  synthetic [barcode part1]
tgcaatcagttacgcg

SEQ ID NO: 8229 - DNA, 16 bp, Artificial Sequence
  synthetic [barcode part1]
cgactgcggtaacaag

SEQ ID NO: 8230 - DNA, 16 bp, Artificial Sequence
  synthetic [barcode part1]
ttaccgcggtgttcac

SEQ ID NO: 8231 - DNA, 16 bp, Artificial Sequence
  synthetic [barcode part1]
tggtcaggactctagt

SEQ ID NO: 8232 - DNA, 16 bp, Artificial Sequence
  synthetic [barcode part1]
tctggtaaggtcactg

SEQ ID NO: 8233 - DNA, 16 bp, Artificial Sequence
  synthetic [barcode part1]
atactatccgtctgtg

SEQ ID NO: 8234 - DNA, 16 bp, Artificial Sequence
  synthetic [barcode part1]
ccgtcagtcttgtgtg

SEQ ID NO: 8235 - DNA, 16 bp, Artificial Sequence
  synthetic [barcode part1]
cgcggcctatattaag

SEQ ID NO: 8236 - DNA, 16 bp, Artificial Sequence
  synthetic [barcode part1]
ttacacggattcttcg

SEQ ID NO: 8237 - DNA, 16 bp, Artificial Sequence
  synthetic [barcode part1]
tgtggatcttatcacc

SEQ ID NO: 8238 - DNA, 16 bp, Artificial Sequence
  synthetic [barcode part1]
taggagaccttccagt

SEQ ID NO: 8239 - DNA, 16 bp, Artificial Sequence
  synthetic [barcode part1]
agtctgagtacgaggc

SEQ ID NO: 8240 - DNA, 16 bp, Artificial Sequence
  synthetic [barcode part1]
cctcaaccgtattggc

SEQ ID NO: 8241 - DNA, 16 bp, Artificial Sequence
  synthetic [barcode part1]
accacgaggtatcgtt

SEQ ID NO: 8242 - DNA, 16 bp, Artificial Sequence
  synthetic [barcode part1]
cagtgcacctccaact

SEQ ID NO: 8243 - DNA, 16 bp, Artificial Sequence
  synthetic [barcode part1]
aattctaccgtctacg

SEQ ID NO: 8244 - DNA, 16 bp, Artificial Sequence
  synthetic [barcode part1]
agagacacctggtggt

SEQ ID NO: 8245 - DNA, 16 bp, Artificial Sequence
  synthetic [barcode part1]
gtaacgtccaagatcc

SEQ ID NO: 8246 - DNA, 16 bp, Artificial Sequence
  synthetic [barcode part1]
tgatacgagaacgatc

SEQ ID NO: 8247 - DNA, 16 bp, Artificial Sequence
  synthetic [barcode part1]
accttaccgaacttgt

SEQ ID NO: 8248 - DNA, 16 bp, Artificial Sequence
  synthetic [barcode part1]
aggcagttgactcttg

SEQ ID NO: 8249 - DNA, 16 bp, Artificial Sequence
  synthetic [barcode part1]
acttcttgatcctccg

SEQ ID NO: 8250 - DNA, 16 bp, Artificial Sequence
  synthetic [barcode part1]
tactactctatacggc

SEQ ID NO: 8251 - DNA, 16 bp, Artificial Sequence
  synthetic [barcode part1]
tggccgacaatcaatc

SEQ ID NO: 8252 - DNA, 16 bp, Artificial Sequence
  synthetic [barcode part1]
tcggacgttcgaatac

SEQ ID NO: 8253 - DNA, 16 bp, Artificial Sequence
  synthetic [barcode part1]
aacaactcgtgagagt

SEQ ID NO: 8254 - DNA, 16 bp, Artificial Sequence
  synthetic [barcode part1]
tatatcctgtctccgc

SEQ ID NO: 8255 - DNA, 16 bp, Artificial Sequence
  synthetic [barcode part1]
gtagaggaattatcgc

SEQ ID NO: 8256 - DNA, 16 bp, Artificial Sequence
  synthetic [barcode part1]
aagtccacaggagacc

SEQ ID NO: 8257 - DNA, 16 bp, Artificial Sequence
  synthetic [barcode part1]
acaaccaggaggactc

SEQ ID NO: 8258 - DNA, 16 bp, Artificial Sequence
  synthetic [barcode part1]
gcggtaacaggttcag

SEQ ID NO: 8259 - DNA, 16 bp, Artificial Sequence
  synthetic [barcode part1]
taggttgagtctgacc

SEQ ID NO: 8260 - DNA, 16 bp, Artificial Sequence
  synthetic [barcode part1]
tgaggcctgactaatc

SEQ ID NO: 8261 - DNA, 16 bp, Artificial Sequence
  synthetic [barcode part1]
cgcacagaataacggc

SEQ ID NO: 8262 - DNA, 16 bp, Artificial Sequence
  synthetic [barcode part1]
gtcttcaggcggtctt

SEQ ID NO: 8263 - DNA, 16 bp, Artificial Sequence
  synthetic [barcode part1]
ccaagatcggacagac

SEQ ID NO: 8264 - DNA, 16 bp, Artificial Sequence
  synthetic [barcode part1]
accaaggtagtgcacg

SEQ ID NO: 8265 - DNA, 16 bp, Artificial Sequence
  synthetic [barcode part1]
tcgcaggaagtatctc

SEQ ID NO: 8266 - DNA, 16 bp, Artificial Sequence
  synthetic [barcode part1]
cctaccgaatcgcgtt

SEQ ID NO: 8267 - DNA, 16 bp, Artificial Sequence
  synthetic [barcode part1]
aacttgacgcactctt

SEQ ID NO: 8268 - DNA, 16 bp, Artificial Sequence
  synthetic [barcode part1]
gttaccaatcgaaccg

SEQ ID NO: 8269 - DNA, 16 bp, Artificial Sequence
  synthetic [barcode part1]
aagatccgtggtatcc

SEQ ID NO: 8270 - DNA, 16 bp, Artificial Sequence
  synthetic [barcode part1]
actacctcaggcgtct

SEQ ID NO: 8271 - DNA, 16 bp, Artificial Sequence
  synthetic [barcode part1]
aggtacggttgttaag

SEQ ID NO: 8272 - DNA, 16 bp, Artificial Sequence
  synthetic [barcode part1]
acactagacgtagtcc

SEQ ID NO: 8273 - DNA, 16 bp, Artificial Sequence
  synthetic [barcode part1]
agactcggtgatcgtt

SEQ ID NO: 8274 - DNA, 16 bp, Artificial Sequence
  synthetic [barcode part1]
aaggaaggcactgtag

SEQ ID NO: 8275 - DNA, 16 bp, Artificial Sequence
  synthetic [barcode part1]
gttctccttctccaag

SEQ ID NO: 8276 - DNA, 16 bp, Artificial Sequence
  synthetic [barcode part1]
agaccagttccagttg

SEQ ID NO: 8277 - DNA, 16 bp, Artificial Sequence
  synthetic [barcode part1]
taagtagtccgcctag

SEQ ID NO: 8278 - DNA, 16 bp, Artificial Sequence
  synthetic [barcode part1]
ttggatctcgacaacg

SEQ ID NO: 8279 - DNA, 16 bp, Artificial Sequence
  synthetic [barcode part1]
aggtggttcgacacag

SEQ ID NO: 8280 - DNA, 16 bp, Artificial Sequence
  synthetic [barcode part1]
tcacctctgcaggttg

SEQ ID NO: 8281 - DNA, 16 bp, Artificial Sequence
  synthetic [barcode part1]
tatccgcacctacttc

SEQ ID NO: 8282 - DNA, 16 bp, Artificial Sequence
  synthetic [barcode part1]
cgcgttcagatcacct

SEQ ID NO: 8283 - DNA, 16 bp, Artificial Sequence
  synthetic [barcode part1]
cgtctgtgttctggac

SEQ ID NO: 8284 - DNA, 16 bp, Artificial Sequence
  synthetic [barcode part1]
atcaggtgacacggac

SEQ ID NO: 8285 - DNA, 16 bp, Artificial Sequence
  synthetic [barcode part1]
aatcaaggtccggacg

SEQ ID NO: 8286 - DNA, 16 bp, Artificial Sequence
  synthetic [barcode part1]
tctccgacggttacac

SEQ ID NO: 8287 - DNA, 16 bp, Artificial Sequence
  synthetic [barcode part1]
ttgtcacttgcctcgt

SEQ ID NO: 8288 - DNA, 16 bp, Artificial Sequence
  synthetic [barcode part1]
agtcacaacacactgc

SEQ ID NO: 8289 - DNA, 16 bp, Artificial Sequence
  synthetic [barcode part1]
atcacttgtgaacctc

SEQ ID NO: 8290 - DNA, 16 bp, Artificial Sequence
  synthetic [barcode part1]
gcggtctagattgttg

SEQ ID NO: 8291 - DNA, 16 bp, Artificial Sequence
  synthetic [barcode part1]
actcacttgtcgcggt

SEQ ID NO: 8292 - DNA, 16 bp, Artificial Sequence
  synthetic [barcode part1]
agtgcgacactgaacg

SEQ ID NO: 8293 - DNA, 16 bp, Artificial Sequence
  synthetic [barcode part1]
tggaaggcgcacaatc

SEQ ID NO: 8294 - DNA, 16 bp, Artificial Sequence
  synthetic [barcode part1]
tggatcactctacgcc

SEQ ID NO: 8295 - DNA, 16 bp, Artificial Sequence
  synthetic [barcode part1]
aagtctgtctgattcc

SEQ ID NO: 8296 - DNA, 16 bp, Artificial Sequence
  synthetic [barcode part1]
ccggtagtactagatc

SEQ ID NO: 8297 - DNA, 16 bp, Artificial Sequence
  synthetic [barcode part1]
cgacctgttacgttcg

SEQ ID NO: 8298 - DNA, 16 bp, Artificial Sequence
  synthetic [barcode part1]
tctctgcgagttgtcg

SEQ ID NO: 8299 - DNA, 16 bp, Artificial Sequence
  synthetic [barcode part1]
acttgttgtccgttcc

SEQ ID NO: 8300 - DNA, 16 bp, Artificial Sequence
  synthetic [barcode part1]
tgtgtgattcagttcc

SEQ ID NO: 8301 - DNA, 16 bp, Artificial Sequence
  synthetic [barcode part1]
tattccgtggagtggt

SEQ ID NO: 8302 - DNA, 16 bp, Artificial Sequence
  synthetic [barcode part1]
caattcgcaggttacg

SEQ ID NO: 8303 - DNA, 16 bp, Artificial Sequence
  synthetic [barcode part1]
aggcgattatatcgag

SEQ ID NO: 8304 - DNA, 16 bp, Artificial Sequence
  synthetic [barcode part1]
ttgttcttcgaacgtg

SEQ ID NO: 8305 - DNA, 16 bp, Artificial Sequence
  synthetic [barcode part1]
cgcctagaagaaccag

SEQ ID NO: 8306 - DNA, 16 bp, Artificial Sequence
  synthetic [barcode part1]
attcacttgtcgtgac

SEQ ID NO: 8307 - DNA, 16 bp, Artificial Sequence
  synthetic [barcode part1]
ccttcgaacgtactgc

SEQ ID NO: 8308 - DNA, 16 bp, Artificial Sequence
  synthetic [barcode part1]
tcacagtgtcagtcag

SEQ ID NO: 8309 - DNA, 16 bp, Artificial Sequence
  synthetic [barcode part1]
atagactccggacact

SEQ ID NO: 8310 - DNA, 16 bp, Artificial Sequence
  synthetic [barcode part1]
gccacaactacagtgt

SEQ ID NO: 8311 - DNA, 16 bp, Artificial Sequence
  synthetic [barcode part1]
tggtcagacgtacgtt

SEQ ID NO: 8312 - DNA, 16 bp, Artificial Sequence
  synthetic [barcode part1]
cgttgtctaagttcac

SEQ ID NO: 8313 - DNA, 16 bp, Artificial Sequence
  synthetic [barcode part1]
tgtactgtggtacacg

SEQ ID NO: 8314 - DNA, 16 bp, Artificial Sequence
  synthetic [barcode part1]
gttgcagttgcagtgt

SEQ ID NO: 8315 - DNA, 16 bp, Artificial Sequence
  synthetic [barcode part1]
tctccagttagtctcc

SEQ ID NO: 8316 - DNA, 16 bp, Artificial Sequence
  synthetic [barcode part1]
tcagaatcactcgtct

SEQ ID NO: 8317 - DNA, 16 bp, Artificial Sequence
  synthetic [barcode part1]
tcagtgaagactgtcc

SEQ ID NO: 8318 - DNA, 16 bp, Artificial Sequence
  synthetic [barcode part1]
gtacttgataggtccg

SEQ ID NO: 8319 - DNA, 16 bp, Artificial Sequence
  synthetic [barcode part1]
gcggtcagtgtattac

SEQ ID NO: 8320 - DNA, 16 bp, Artificial Sequence
  synthetic [barcode part1]
acaactgcagtgtgtc

SEQ ID NO: 8321 - DNA, 16 bp, Artificial Sequence
  synthetic [barcode part1]
accttactccgatcct

SEQ ID NO: 8322 - DNA, 16 bp, Artificial Sequence
  synthetic [barcode part1]
acgcgtatatacgcgt

SEQ ID NO: 8323 - DNA, 16 bp, Artificial Sequence
  synthetic [barcode part1]
gcgaagttcaccttag

SEQ ID NO: 8324 - DNA, 16 bp, Artificial Sequence
  synthetic [barcode part1]
taattacgcggagtag

SEQ ID NO: 8325 - DNA, 16 bp, Artificial Sequence
  synthetic [barcode part1]
taggcacttcctgatt

SEQ ID NO: 8326 - DNA, 16 bp, Artificial Sequence
  synthetic [barcode part1]
gtcggtgtattccacc

SEQ ID NO: 8327 - DNA, 16 bp, Artificial Sequence
  synthetic [barcode part1]
agagagtggatatcct

SEQ ID NO: 8328 - DNA, 16 bp, Artificial Sequence
  synthetic [barcode part1]
caggtagttcacctag

SEQ ID NO: 8329 - DNA, 16 bp, Artificial Sequence
  synthetic [barcode part1]
cctcaataactgcact

SEQ ID NO: 8330 - DNA, 16 bp, Artificial Sequence
  synthetic [barcode part1]
gacgaaggtatagttc

SEQ ID NO: 8331 - DNA, 16 bp, Artificial Sequence
  synthetic [barcode part1]
aaccgccgttcttacg

SEQ ID NO: 8332 - DNA, 16 bp, Artificial Sequence
  synthetic [barcode part1]
gtgcgaatctaacaag

SEQ ID NO: 8333 - DNA, 16 bp, Artificial Sequence
  synthetic [barcode part1]
tacagtctcgagtacg

SEQ ID NO: 8334 - DNA, 16 bp, Artificial Sequence
  synthetic [barcode part1]
aattggactcgtgaag

SEQ ID NO: 8335 - DNA, 16 bp, Artificial Sequence
  synthetic [barcode part1]
tataccgcacgactag

SEQ ID NO: 8336 - DNA, 16 bp, Artificial Sequence
  synthetic [barcode part1]
acacttctggcctggt

SEQ ID NO: 8337 - DNA, 16 bp, Artificial Sequence
  synthetic [barcode part1]
acactacggtgttacg

SEQ ID NO: 8338 - DNA, 16 bp, Artificial Sequence
  synthetic [barcode part1]
gacagtcactgtcagt

SEQ ID NO: 8339 - DNA, 16 bp, Artificial Sequence
  synthetic [barcode part1]
agaggacacaaccgtc

SEQ ID NO: 8340 - DNA, 16 bp, Artificial Sequence
  synthetic [barcode part1]
atacggcgtcaacact

SEQ ID NO: 8341 - DNA, 16 bp, Artificial Sequence
  synthetic [barcode part1]
ataagtggcctgttcg

SEQ ID NO: 8342 - DNA, 16 bp, Artificial Sequence
  synthetic [barcode part1]
tgtgtaaggcagtagt

SEQ ID NO: 8343 - DNA, 16 bp, Artificial Sequence
  synthetic [barcode part1]
gaaggcaagtacgaac

SEQ ID NO: 8344 - DNA, 16 bp, Artificial Sequence
  synthetic [barcode part1]
gtgtactctatcactg

SEQ ID NO: 8345 - DNA, 16 bp, Artificial Sequence
  synthetic [barcode part1]
tgaccttggtcaaggt

SEQ ID NO: 8346 - DNA, 16 bp, Artificial Sequence
  synthetic [barcode part1]
tacctgtctgtagtgt

SEQ ID NO: 8347 - DNA, 16 bp, Artificial Sequence
  synthetic [barcode part1]
gcaacttccgtactcg

SEQ ID NO: 8348 - DNA, 16 bp, Artificial Sequence
  synthetic [barcode part1]
aactgaacggagagtg

SEQ ID NO: 8349 - DNA, 16 bp, Artificial Sequence
  synthetic [barcode part1]
tacaccagtcacacag

SEQ ID NO: 8350 - DNA, 16 bp, Artificial Sequence
  synthetic [barcode part1]
accgtccagtggaatt

SEQ ID NO: 8351 - DNA, 16 bp, Artificial Sequence
  synthetic [barcode part1]
gtccgaacgtcgttct

SEQ ID NO: 8352 - DNA, 16 bp, Artificial Sequence
  synthetic [barcode part1]
atacctgacgatagag

SEQ ID NO: 8353 - DNA, 16 bp, Artificial Sequence
  synthetic [barcode part1]
agatacacgcactctg

SEQ ID NO: 8354 - DNA, 16 bp, Artificial Sequence
  synthetic [barcode part1]
tcagacggataagact

SEQ ID NO: 8355 - DNA, 16 bp, Artificial Sequence
  synthetic [barcode part1]
cagttgtattcctcag

SEQ ID NO: 8356 - DNA, 16 bp, Artificial Sequence
  synthetic [barcode part1]
tcgagtacgagtatcc

SEQ ID NO: 8357 - DNA, 16 bp, Artificial Sequence
  synthetic [barcode part1]
gacggagagtcgtgtt

SEQ ID NO: 8358 - DNA, 16 bp, Artificial Sequence
  synthetic [barcode part1]
cggaagtcactcttag

SEQ ID NO: 8359 - DNA, 16 bp, Artificial Sequence
  synthetic [barcode part1]
atcgaaccagactgtc

SEQ ID NO: 8360 - DNA, 16 bp, Artificial Sequence
  synthetic [barcode part1]
gtggtcaacactgact

SEQ ID NO: 8361 - DNA, 16 bp, Artificial Sequence
  synthetic [barcode part1]
actcaggtccactatt

SEQ ID NO: 8362 - DNA, 16 bp, Artificial Sequence
  synthetic [barcode part1]
tgtgcaatctagttcc

SEQ ID NO: 8363 - DNA, 16 bp, Artificial Sequence
  synthetic [barcode part1]
tatatccgacggcctc

SEQ ID NO: 8364 - DNA, 16 bp, Artificial Sequence
  synthetic [barcode part1]
cctgtaattgcgaacg

SEQ ID NO: 8365 - DNA, 16 bp, Artificial Sequence
  synthetic [barcode part1]
gcagtccttacgtctg

SEQ ID NO: 8366 - DNA, 16 bp, Artificial Sequence
  synthetic [barcode part1]
ttagttcttcgcagac

SEQ ID NO: 8367 - DNA, 16 bp, Artificial Sequence
  synthetic [barcode part1]
gattgtgagaagatcc

SEQ ID NO: 8368 - DNA, 16 bp, Artificial Sequence
  synthetic [barcode part1]
acgccaacagtgaggt

SEQ ID NO: 8369 - DNA, 16 bp, Artificial Sequence
  synthetic [barcode part1]
gcgtgacacactaatc

SEQ ID NO: 8370 - DNA, 16 bp, Artificial Sequence
  synthetic [barcode part1]
ccacaagtatcggtgt

SEQ ID NO: 8371 - DNA, 16 bp, Artificial Sequence
  synthetic [barcode part1]
aaggaagtcggtcaag

SEQ ID NO: 8372 - DNA, 16 bp, Artificial Sequence
  synthetic [barcode part1]
tgagactaccacaacc

SEQ ID NO: 8373 - DNA, 16 bp, Artificial Sequence
  synthetic [barcode part1]
tacttgtgtgaacggc

SEQ ID NO: 8374 - DNA, 16 bp, Artificial Sequence
  synthetic [barcode part1]
acgtggcctctagttc

SEQ ID NO: 8375 - DNA, 16 bp, Artificial Sequence
  synthetic [barcode part1]
gattgaagtctagacg

SEQ ID NO: 8376 - DNA, 16 bp, Artificial Sequence
  synthetic [barcode part1]
cctaccgtacactggt

SEQ ID NO: 8377 - DNA, 16 bp, Artificial Sequence
  synthetic [barcode part1]
cgccttgagtagagtt

SEQ ID NO: 8378 - DNA, 16 bp, Artificial Sequence
  synthetic [barcode part1]
ttgcctctcgagtacg

SEQ ID NO: 8379 - DNA, 16 bp, Artificial Sequence
  synthetic [barcode part1]
ttggtccgtagttatc

SEQ ID NO: 8380 - DNA, 16 bp, Artificial Sequence
  synthetic [barcode part1]
caagttggttgtcgac

SEQ ID NO: 8381 - DNA, 16 bp, Artificial Sequence
  synthetic [barcode part1]
cgaagagtgcgatcac

SEQ ID NO: 8382 - DNA, 16 bp, Artificial Sequence
  synthetic [barcode part1]
acagtaatcgtcaccg

SEQ ID NO: 8383 - DNA, 16 bp, Artificial Sequence
  synthetic [barcode part1]
gacaaggtagtgagac

SEQ ID NO: 8384 - DNA, 16 bp, Artificial Sequence
  synthetic [barcode part1]
cgattggcgcgatatt

SEQ ID NO: 8385 - DNA, 16 bp, Artificial Sequence
  synthetic [barcode part1]
aggagtggtgactcac

SEQ ID NO: 8386 - DNA, 16 bp, Artificial Sequence
  synthetic [barcode part1]
ccgatatcacagtcag

SEQ ID NO: 8387 - DNA, 16 bp, Artificial Sequence
  synthetic [barcode part1]
acaccttgcacctctt

SEQ ID NO: 8388 - DNA, 16 bp, Artificial Sequence
  synthetic [barcode part1]
aggcgagatagtatct

SEQ ID NO: 8389 - DNA, 16 bp, Artificial Sequence
  synthetic [barcode part1]
tcaagtgttactccac

SEQ ID NO: 8390 - DNA, 16 bp, Artificial Sequence
  synthetic [barcode part1]
gtactacttatccgtg

SEQ ID NO: 8391 - DNA, 16 bp, Artificial Sequence
  synthetic [barcode part1]
ccaaggactggtacag

SEQ ID NO: 8392 - DNA, 16 bp, Artificial Sequence
  synthetic [barcode part1]
gtcgacctagttaacg

SEQ ID NO: 8393 - DNA, 16 bp, Artificial Sequence
  synthetic [barcode part1]
acaagaagtcactgac

SEQ ID NO: 8394 - DNA, 16 bp, Artificial Sequence
  synthetic [barcode part1]
acggtgcgattctaac

SEQ ID NO: 8395 - DNA, 16 bp, Artificial Sequence
  synthetic [barcode part1]
atctcgttagacctgt

SEQ ID NO: 8396 - DNA, 16 bp, Artificial Sequence
  synthetic [barcode part1]
gaacttaccgtacggt

SEQ ID NO: 8397 - DNA, 16 bp, Artificial Sequence
  synthetic [barcode part1]
tacggtgtccacctgt

SEQ ID NO: 8398 - DNA, 16 bp, Artificial Sequence
  synthetic [barcode part1]
tcagtaaggactgcct

SEQ ID NO: 8399 - DNA, 16 bp, Artificial Sequence
  synthetic [barcode part1]
cctggttactggtacc

SEQ ID NO: 8400 - DNA, 16 bp, Artificial Sequence
  synthetic [barcode part1]
tgcaggagttactaag

SEQ ID NO: 8401 - DNA, 16 bp, Artificial Sequence
  synthetic [barcode part1]
acggccaaggagattc

SEQ ID NO: 8402 - DNA, 16 bp, Artificial Sequence
  synthetic [barcode part1]
cgacacgattggagac

SEQ ID NO: 8403 - DNA, 16 bp, Artificial Sequence
  synthetic [barcode part1]
tctgtcgcacggattc

SEQ ID NO: 8404 - DNA, 16 bp, Artificial Sequence
  synthetic [barcode part1]
taacctcttggcctct

SEQ ID NO: 8405 - DNA, 16 bp, Artificial Sequence
  synthetic [barcode part1]
tggcgcgattactcct

SEQ ID NO: 8406 - DNA, 16 bp, Artificial Sequence
  synthetic [barcode part1]
cgcgagtaataggacc

SEQ ID NO: 8407 - DNA, 16 bp, Artificial Sequence
  synthetic [barcode part1]
ttctgcgatactcctc

SEQ ID NO: 8408 - DNA, 16 bp, Artificial Sequence
  synthetic [barcode part1]
gactaattgcacgcgt

SEQ ID NO: 8409 - DNA, 16 bp, Artificial Sequence
  synthetic [barcode part1]
cgaattcgtaggtctg

SEQ ID NO: 8410 - DNA, 16 bp, Artificial Sequence
  synthetic [barcode part1]
gtaggttgccgttctc

SEQ ID NO: 8411 - DNA, 16 bp, Artificial Sequence
  synthetic [barcode part1]
tgcgttagttaacgcg

SEQ ID NO: 8412 - DNA, 16 bp, Artificial Sequence
  synthetic [barcode part1]
agacgttgaatagtgc

SEQ ID NO: 8413 - DNA, 16 bp, Artificial Sequence
  synthetic [barcode part1]
gaacttcggtcctaag

SEQ ID NO: 8414 - DNA, 16 bp, Artificial Sequence
  synthetic [barcode part1]
gactacagttacacgc

SEQ ID NO: 8415 - DNA, 16 bp, Artificial Sequence
  synthetic [barcode part1]
gcctgagaatatccac

SEQ ID NO: 8416 - DNA, 16 bp, Artificial Sequence
  synthetic [barcode part1]
ttaacgatcgccaggt

SEQ ID NO: 8417 - DNA, 16 bp, Artificial Sequence
  synthetic [barcode part1]
aagtaagaggcgaacc

SEQ ID NO: 8418 - DNA, 16 bp, Artificial Sequence
  synthetic [barcode part1]
gcctccacactaggtt

SEQ ID NO: 8419 - DNA, 16 bp, Artificial Sequence
  synthetic [barcode part1]
accgcaatctattcgt

SEQ ID NO: 8420 - DNA, 16 bp, Artificial Sequence
  synthetic [barcode part1]
tcggcgattcgtatcc

SEQ ID NO: 8421 - DNA, 16 bp, Artificial Sequence
  synthetic [barcode part1]
tcgtctggtggataac

SEQ ID NO: 8422 - DNA, 16 bp, Artificial Sequence
  synthetic [barcode part1]
cctagatctcaattcg

SEQ ID NO: 8423 - DNA, 16 bp, Artificial Sequence
  synthetic [barcode part1]
ccagtcctggaagatt

SEQ ID NO: 8424 - DNA, 16 bp, Artificial Sequence
  synthetic [barcode part1]
gcacagacgaactacg

SEQ ID NO: 8425 - DNA, 16 bp, Artificial Sequence
  synthetic [barcode part1]
tctgttactggcgcac

SEQ ID NO: 8426 - DNA, 16 bp, Artificial Sequence
  synthetic [barcode part1]
aacttaagatccggcc

SEQ ID NO: 8427 - DNA, 16 bp, Artificial Sequence
  synthetic [barcode part1]
gtacctacttgttacg

SEQ ID NO: 8428 - DNA, 16 bp, Artificial Sequence
  synthetic [barcode part1]
gtcaggtctatcaggt

SEQ ID NO: 8429 - DNA, 16 bp, Artificial Sequence
  synthetic [barcode part1]
gttagatcgccgagtt

SEQ ID NO: 8430 - DNA, 16 bp, Artificial Sequence
  synthetic [barcode part1]
aacagtcaaccactgc

SEQ ID NO: 8431 - DNA, 16 bp, Artificial Sequence
  synthetic [barcode part1]
gagtactccgtcttgc

SEQ ID NO: 8432 - DNA, 16 bp, Artificial Sequence
  synthetic [barcode part1]
cacgcgactgttactc

SEQ ID NO: 8433 - DNA, 16 bp, Artificial Sequence
  synthetic [barcode part1]
gcaggttgtcacctct

SEQ ID NO: 8434 - DNA, 16 bp, Artificial Sequence
  synthetic [barcode part1]
ccgtagacttgtgagt

SEQ ID NO: 8435 - DNA, 16 bp, Artificial Sequence
  synthetic [barcode part1]
actcagattgttctgc

SEQ ID NO: 8436 - DNA, 16 bp, Artificial Sequence
  synthetic [barcode part1]
gatacctctaccgtcg

SEQ ID NO: 8437 - DNA, 16 bp, Artificial Sequence
  synthetic [barcode part1]
acaccaggaagaccgt

SEQ ID NO: 8438 - DNA, 16 bp, Artificial Sequence
  synthetic [barcode part1]
tcaagtggaacggtgc

SEQ ID NO: 8439 - DNA, 16 bp, Artificial Sequence
  synthetic [barcode part1]
tgttgtcgtctggatt

SEQ ID NO: 8440 - DNA, 16 bp, Artificial Sequence
  synthetic [barcode part1]
ataaccgccagtctcc

SEQ ID NO: 8441 - DNA, 16 bp, Artificial Sequence
  synthetic [barcode part1]
agtctgttaaggcaag

SEQ ID NO: 8442 - DNA, 16 bp, Artificial Sequence
  synthetic [barcode part1]
aatcacacctcagtct

SEQ ID NO: 8443 - DNA, 16 bp, Artificial Sequence
  synthetic [barcode part1]
tcaaggcagtaccgtt

SEQ ID NO: 8444 - DNA, 16 bp, Artificial Sequence
  synthetic [barcode part1]
aggcagagagttctgc

SEQ ID NO: 8445 - DNA, 16 bp, Artificial Sequence
  synthetic [barcode part1]
tctctgacgtaatcgt

SEQ ID NO: 8446 - DNA, 16 bp, Artificial Sequence
  synthetic [barcode part1]
agaggactaagtccgc

SEQ ID NO: 8447 - DNA, 16 bp, Artificial Sequence
  synthetic [barcode part1]
cgtgtattccttctcg

SEQ ID NO: 8448 - DNA, 16 bp, Artificial Sequence
  synthetic [barcode part1]
cgttcctattgttgag

SEQ ID NO: 8449 - DNA, 16 bp, Artificial Sequence
  synthetic [barcode part1]
cctactactctcggtt

SEQ ID NO: 8450 - DNA, 16 bp, Artificial Sequence
  synthetic [barcode part1]
agacacgttgaatcag

SEQ ID NO: 8451 - DNA, 16 bp, Artificial Sequence
  synthetic [barcode part1]
aattccgtgaggtctg

SEQ ID NO: 8452 - DNA, 16 bp, Artificial Sequence
  synthetic [barcode part1]
ttgtgtggtcacacag

SEQ ID NO: 8453 - DNA, 16 bp, Artificial Sequence
  synthetic [barcode part1]
aaggttcactccagac

SEQ ID NO: 8454 - DNA, 16 bp, Artificial Sequence
  synthetic [barcode part1]
tattggacgtcttcgt

SEQ ID NO: 8455 - DNA, 16 bp, Artificial Sequence
  synthetic [barcode part1]
tctctgcggattaccg

SEQ ID NO: 8456 - DNA, 16 bp, Artificial Sequence
  synthetic [barcode part1]
gagatctcctgaagtc

SEQ ID NO: 8457 - DNA, 16 bp, Artificial Sequence
  synthetic [barcode part1]
atcggtaataaggcac

SEQ ID NO: 8458 - DNA, 16 bp, Artificial Sequence
  synthetic [barcode part1]
accgtgaccacttatt

SEQ ID NO: 8459 - DNA, 16 bp, Artificial Sequence
  synthetic [barcode part1]
gccttcttatacggcg

SEQ ID NO: 8460 - DNA, 16 bp, Artificial Sequence
  synthetic [barcode part1]
agaacagattcgtggt

SEQ ID NO: 8461 - DNA, 16 bp, Artificial Sequence
  synthetic [barcode part1]
ccgagaagtacttaag

SEQ ID NO: 8462 - DNA, 16 bp, Artificial Sequence
  synthetic [barcode part1]
gttccgtcagagaatc

SEQ ID NO: 8463 - DNA, 16 bp, Artificial Sequence
  synthetic [barcode part1]
tacacgattcaacctc

SEQ ID NO: 8464 - DNA, 16 bp, Artificial Sequence
  synthetic [barcode part1]
gccaataacttcttgc

SEQ ID NO: 8465 - DNA, 16 bp, Artificial Sequence
  synthetic [barcode part1]
actacgattgtggcac

SEQ ID NO: 8466 - DNA, 16 bp, Artificial Sequence
  synthetic [barcode part1]
gcactcttaacttgac

SEQ ID NO: 8467 - DNA, 16 bp, Artificial Sequence
  synthetic [barcode part1]
aattgccaggttaccg

SEQ ID NO: 8468 - DNA, 16 bp, Artificial Sequence
  synthetic [barcode part1]
tgttgacacactggtg

SEQ ID NO: 8469 - DNA, 16 bp, Artificial Sequence
  synthetic [barcode part1]
gatcgatctccagaac

SEQ ID NO: 8470 - DNA, 16 bp, Artificial Sequence
  synthetic [barcode part1]
cgcgtgaatctagatc

SEQ ID NO: 8471 - DNA, 16 bp, Artificial Sequence
  synthetic [barcode part1]
gacggtccaataactc

SEQ ID NO: 8472 - DNA, 16 bp, Artificial Sequence
  synthetic [barcode part1]
tgttaggttgtcggac

SEQ ID NO: 8473 - DNA, 16 bp, Artificial Sequence
  synthetic [barcode part1]
aagaataccaccgagt

SEQ ID NO: 8474 - DNA, 16 bp, Artificial Sequence
  synthetic [barcode part1]
taattgtacgaggcag

SEQ ID NO: 8475 - DNA, 16 bp, Artificial Sequence
  synthetic [barcode part1]
cgtgtagtactctact

SEQ ID NO: 8476 - DNA, 16 bp, Artificial Sequence
  synthetic [barcode part1]
cgtctatcaagatcct

SEQ ID NO: 8477 - DNA, 16 bp, Artificial Sequence
  synthetic [barcode part1]
tataggaatcaccgag

SEQ ID NO: 8478 - DNA, 16 bp, Artificial Sequence
  synthetic [barcode part1]
gttaggtatcttcgtc

SEQ ID NO: 8479 - DNA, 16 bp, Artificial Sequence
  synthetic [barcode part1]
ttccttcgcactgtac

SEQ ID NO: 8480 - DNA, 16 bp, Artificial Sequence
  synthetic [barcode part1]
tgtcagaagtgcaggc

SEQ ID NO: 8481 - DNA, 16 bp, Artificial Sequence
  synthetic [barcode part1]
tcaacagttcacactc

SEQ ID NO: 8482 - DNA, 16 bp, Artificial Sequence
  synthetic [barcode part1]
cgtagtgaggttctgt

SEQ ID NO: 8483 - DNA, 16 bp, Artificial Sequence
  synthetic [barcode part1]
gagtaattacgagtcg

SEQ ID NO: 8484 - DNA, 16 bp, Artificial Sequence
  synthetic [barcode part1]
gcgccggatataattc

SEQ ID NO: 8485 - DNA, 16 bp, Artificial Sequence
  synthetic [barcode part1]
tatacggactcgaacc

SEQ ID NO: 8486 - DNA, 16 bp, Artificial Sequence
  synthetic [barcode part1]
ttgacagtggaagtac

SEQ ID NO: 8487 - DNA, 16 bp, Artificial Sequence
  synthetic [barcode part1]
acctacaaccggagag

SEQ ID NO: 8488 - DNA, 16 bp, Artificial Sequence
  synthetic [barcode part1]
gtactgttgtctatcg

SEQ ID NO: 8489 - DNA, 16 bp, Artificial Sequence
  synthetic [barcode part1]
gattctgcctattcag

SEQ ID NO: 8490 - DNA, 16 bp, Artificial Sequence
  synthetic [barcode part1]
aggacgattcactgtc

SEQ ID NO: 8491 - DNA, 16 bp, Artificial Sequence
  synthetic [barcode part1]
agacgtcgcggtaagt

SEQ ID NO: 8492 - DNA, 16 bp, Artificial Sequence
  synthetic [barcode part1]
agttcagaccaccaac

SEQ ID NO: 8493 - DNA, 16 bp, Artificial Sequence
  synthetic [barcode part1]
tctctgaacgttgact

SEQ ID NO: 8494 - DNA, 16 bp, Artificial Sequence
  synthetic [barcode part1]
aggttctctccaagag

SEQ ID NO: 8495 - DNA, 16 bp, Artificial Sequence
  synthetic [barcode part1]
ttgaacgacttgcgac

SEQ ID NO: 8496 - DNA, 16 bp, Artificial Sequence
  synthetic [barcode part1]
ccacaattcggtcaag

SEQ ID NO: 8497 - DNA, 16 bp, Artificial Sequence
  synthetic [barcode part1]
tagtgcgactatctct

SEQ ID NO: 8498 - DNA, 16 bp, Artificial Sequence
  synthetic [barcode part1]
agacctaactcggatc

SEQ ID NO: 8499 - DNA, 16 bp, Artificial Sequence
  synthetic [barcode part1]
acgtgcactagtcagt

SEQ ID NO: 8500 - DNA, 16 bp, Artificial Sequence
  synthetic [barcode part1]
tgtcgaaggtagtctc

SEQ ID NO: 8501 - DNA, 16 bp, Artificial Sequence
  synthetic [barcode part1]
gttacctcggatatct

SEQ ID NO: 8502 - DNA, 16 bp, Artificial Sequence
  synthetic [barcode part1]
taaccaaccggttggt

SEQ ID NO: 8503 - DNA, 16 bp, Artificial Sequence
  synthetic [barcode part1]
ataaggtgcggacctg

SEQ ID NO: 8504 - DNA, 16 bp, Artificial Sequence
  synthetic [barcode part1]
gccttcgtagattact

SEQ ID NO: 8505 - DNA, 16 bp, Artificial Sequence
  synthetic [barcode part1]
tctattggcacgattc

SEQ ID NO: 8506 - DNA, 16 bp, Artificial Sequence
  synthetic [barcode part1]
agtacgcgcactgatt

SEQ ID NO: 8507 - DNA, 16 bp, Artificial Sequence
  synthetic [barcode part1]
tgagtaaggacgagtg

SEQ ID NO: 8508 - DNA, 16 bp, Artificial Sequence
  synthetic [barcode part1]
aacagttggtccgact

SEQ ID NO: 8509 - DNA, 16 bp, Artificial Sequence
  synthetic [barcode part1]
ttcctggagaggattc

SEQ ID NO: 8510 - DNA, 16 bp, Artificial Sequence
  synthetic [barcode part1]
gaccgatcctcttctt

SEQ ID NO: 8511 - DNA, 16 bp, Artificial Sequence
  synthetic [barcode part1]
tacagaccagagtggc

SEQ ID NO: 8512 - DNA, 16 bp, Artificial Sequence
  synthetic [barcode part1]
caccggtgattctctg

SEQ ID NO: 8513 - DNA, 16 bp, Artificial Sequence
  synthetic [barcode part1]
aacgcgaatccggtag

SEQ ID NO: 8514 - DNA, 16 bp, Artificial Sequence
  synthetic [barcode part1]
ttgacgaattcctgtc

SEQ ID NO: 8515 - DNA, 16 bp, Artificial Sequence
  synthetic [barcode part1]
gaccgtacgtacaact

SEQ ID NO: 8516 - DNA, 16 bp, Artificial Sequence
  synthetic [barcode part1]
gtgacgtactggttgt

SEQ ID NO: 8517 - DNA, 16 bp, Artificial Sequence
  synthetic [barcode part1]
caatagagacgtctag

SEQ ID NO: 8518 - DNA, 16 bp, Artificial Sequence
  synthetic [barcode part1]
tgaccgcagatatctg

SEQ ID NO: 8519 - DNA, 16 bp, Artificial Sequence
  synthetic [barcode part1]
aggcgagacaacacct

SEQ ID NO: 8520 - DNA, 16 bp, Artificial Sequence
  synthetic [barcode part1]
acgtgttgcaagatag

SEQ ID NO: 8521 - DNA, 16 bp, Artificial Sequence
  synthetic [barcode part1]
gtaactctgtcaggtg

SEQ ID NO: 8522 - DNA, 16 bp, Artificial Sequence
  synthetic [barcode part1]
aggatatagtcaccag

SEQ ID NO: 8523 - DNA, 16 bp, Artificial Sequence
  synthetic [barcode part1]
tacacgtgtgtacacg

SEQ ID NO: 8524 - DNA, 16 bp, Artificial Sequence
  synthetic [barcode part1]
tggaacctgactgact

SEQ ID NO: 8525 - DNA, 16 bp, Artificial Sequence
  synthetic [barcode part1]
gaattcgaagtcgaac

SEQ ID NO: 8526 - DNA, 16 bp, Artificial Sequence
  synthetic [barcode part1]
atcaagtggtggtcct

SEQ ID NO: 8527 - DNA, 16 bp, Artificial Sequence
  synthetic [barcode part1]
aacgatactcactgcg

SEQ ID NO: 8528 - DNA, 16 bp, Artificial Sequence
  synthetic [barcode part1]
agttcaggtacttctc

SEQ ID NO: 8529 - DNA, 16 bp, Artificial Sequence
  synthetic [barcode part1]
aggactggtacaattg

SEQ ID NO: 8530 - DNA, 16 bp, Artificial Sequence
  synthetic [barcode part1]
caatcactcactgccg

SEQ ID NO: 8531 - DNA, 16 bp, Artificial Sequence
  synthetic [barcode part1]
aaggtatccagtaacg

SEQ ID NO: 8532 - DNA, 16 bp, Artificial Sequence
  synthetic [barcode part1]
cggaagtacaatctag

SEQ ID NO: 8533 - DNA, 16 bp, Artificial Sequence
  synthetic [barcode part1]
taacggttgcgtcctc

SEQ ID NO: 8534 - DNA, 16 bp, Artificial Sequence
  synthetic [barcode part1]
agtacggttcggcaag

SEQ ID NO: 8535 - DNA, 16 bp, Artificial Sequence
  synthetic [barcode part1]
cgcagaactagattag

SEQ ID NO: 8536 - DNA, 16 bp, Artificial Sequence
  synthetic [barcode part1]
gtcacaatcacctatc

SEQ ID NO: 8537 - DNA, 16 bp, Artificial Sequence
  synthetic [barcode part1]
ttgaccagtgtcacag

SEQ ID NO: 8538 - DNA, 16 bp, Artificial Sequence
  synthetic [barcode part1]
ccaacttcgtcctact

SEQ ID NO: 8539 - DNA, 16 bp, Artificial Sequence
  synthetic [barcode part1]
atcaaccgtcacagtg

SEQ ID NO: 8540 - DNA, 16 bp, Artificial Sequence
  synthetic [barcode part1]
agacaggttgcaacgc

SEQ ID NO: 8541 - DNA, 16 bp, Artificial Sequence
  synthetic [barcode part1]
tgtgccttgccaagtc

SEQ ID NO: 8542 - DNA, 16 bp, Artificial Sequence
  synthetic [barcode part1]
tagatcgtaatccggc

SEQ ID NO: 8543 - DNA, 16 bp, Artificial Sequence
  synthetic [barcode part1]
tattgtcctacgcggc

SEQ ID NO: 8544 - DNA, 16 bp, Artificial Sequence
  synthetic [barcode part1]
tagatcgtggtggttc

SEQ ID NO: 8545 - DNA, 16 bp, Artificial Sequence
  synthetic [barcode part1]
gccggtgtccaattct

SEQ ID NO: 8546 - DNA, 16 bp, Artificial Sequence
  synthetic [barcode part1]
cacaggtgaacggtgt

SEQ ID NO: 8547 - DNA, 16 bp, Artificial Sequence
  synthetic [barcode part1]
gaggaatctcacaagt

SEQ ID NO: 8548 - DNA, 16 bp, Artificial Sequence
  synthetic [barcode part1]
ttgtaggtactgacgc

SEQ ID NO: 8549 - DNA, 16 bp, Artificial Sequence
  synthetic [barcode part1]
gcagaacaatacctag

SEQ ID NO: 8550 - DNA, 16 bp, Artificial Sequence
  synthetic [barcode part1]
gtaccagtctcgtcgt

SEQ ID NO: 8551 - DNA, 16 bp, Artificial Sequence
  synthetic [barcode part1]
tagacacagtctgcac

SEQ ID NO: 8552 - DNA, 16 bp, Artificial Sequence
  synthetic [barcode part1]
gattgcggagaggtct

SEQ ID NO: 8553 - DNA, 16 bp, Artificial Sequence
  synthetic [barcode part1]
tctgaagactaaccgc

SEQ ID NO: 8554 - DNA, 16 bp, Artificial Sequence
  synthetic [barcode part1]
acttacgtgtgagtcg

SEQ ID NO: 8555 - DNA, 16 bp, Artificial Sequence
  synthetic [barcode part1]
accacaatcacgacac

SEQ ID NO: 8556 - DNA, 16 bp, Artificial Sequence
  synthetic [barcode part1]
tgttcttagtcgtcag

SEQ ID NO: 8557 - DNA, 16 bp, Artificial Sequence
  synthetic [barcode part1]
tagttcctagttgcgt

SEQ ID NO: 8558 - DNA, 16 bp, Artificial Sequence
  synthetic [barcode part1]
actgccgcacaagaag

SEQ ID NO: 8559 - DNA, 16 bp, Artificial Sequence
  synthetic [barcode part1]
tatcgtcgcaatcact

SEQ ID NO: 8560 - DNA, 16 bp, Artificial Sequence
  synthetic [barcode part1]
agtaagtactcgtccg

SEQ ID NO: 8561 - DNA, 16 bp, Artificial Sequence
  synthetic [barcode part1]
tgttgtcctactgcct

SEQ ID NO: 8562 - DNA, 16 bp, Artificial Sequence
  synthetic [barcode part1]
cgacaatatacgagac

SEQ ID NO: 8563 - DNA, 16 bp, Artificial Sequence
  synthetic [barcode part1]
cgcctacaacactatt

SEQ ID NO: 8564 - DNA, 16 bp, Artificial Sequence
  synthetic [barcode part1]
tggttacgagttagag

SEQ ID NO: 8565 - DNA, 16 bp, Artificial Sequence
  synthetic [barcode part1]
gtgagtctcgagtact

SEQ ID NO: 8566 - DNA, 16 bp, Artificial Sequence
  synthetic [barcode part1]
cagtgattcggactac

SEQ ID NO: 8567 - DNA, 16 bp, Artificial Sequence
  synthetic [barcode part1]
taggcgaatcctggag

SEQ ID NO: 8568 - DNA, 16 bp, Artificial Sequence
  synthetic [barcode part1]
aggataatccgtcgtc

SEQ ID NO: 8569 - DNA, 16 bp, Artificial Sequence
  synthetic [barcode part1]
agaattggcgtctaag

SEQ ID NO: 8570 - DNA, 16 bp, Artificial Sequence
  synthetic [barcode part1]
taggaccactacggtt

SEQ ID NO: 8571 - DNA, 16 bp, Artificial Sequence
  synthetic [barcode part1]
cggacacagaacgatc

SEQ ID NO: 8572 - DNA, 16 bp, Artificial Sequence
  synthetic [barcode part1]
tccggtggataacttg

SEQ ID NO: 8573 - DNA, 16 bp, Artificial Sequence
  synthetic [barcode part1]
cgttccaagattcgcc

SEQ ID NO: 8574 - DNA, 16 bp, Artificial Sequence
  synthetic [barcode part1]
ccggtacaacctcttg

SEQ ID NO: 8575 - DNA, 16 bp, Artificial Sequence
  synthetic [barcode part1]
gtcgaataacacgaac

SEQ ID NO: 8576 - DNA, 16 bp, Artificial Sequence
  synthetic [barcode part1]
ttgaccaacacgtacg

SEQ ID NO: 8577 - DNA, 16 bp, Artificial Sequence
  synthetic [barcode part1]
gacttgatcctcgcac

SEQ ID NO: 8578 - DNA, 16 bp, Artificial Sequence
  synthetic [barcode part1]
aggcgatacgtgatcg

SEQ ID NO: 8579 - DNA, 16 bp, Artificial Sequence
  synthetic [barcode part1]
tatcttgcgcctggac

SEQ ID NO: 8580 - DNA, 16 bp, Artificial Sequence
  synthetic [barcode part1]
caacgcaggtcgtatt

SEQ ID NO: 8581 - DNA, 16 bp, Artificial Sequence
  synthetic [barcode part1]
tccttaacagtgtgtc

SEQ ID NO: 8582 - DNA, 16 bp, Artificial Sequence
  synthetic [barcode part1]
tattccactacggatc

SEQ ID NO: 8583 - DNA, 16 bp, Artificial Sequence
  synthetic [barcode part1]
cacttatagatcctgc

SEQ ID NO: 8584 - DNA, 16 bp, Artificial Sequence
  synthetic [barcode part1]
gaaggacgtaactgcc

SEQ ID NO: 8585 - DNA, 16 bp, Artificial Sequence
  synthetic [barcode part1]
gtcaaggaactcttcg

SEQ ID NO: 8586 - DNA, 16 bp, Artificial Sequence
  synthetic [barcode part1]
cgttcgtcacttgttc

SEQ ID NO: 8587 - DNA, 16 bp, Artificial Sequence
  synthetic [barcode part1]
actcttgtgtcggatt

SEQ ID NO: 8588 - DNA, 16 bp, Artificial Sequence
  synthetic [barcode part1]
attcttccgtgcggtg

SEQ ID NO: 8589 - DNA, 16 bp, Artificial Sequence
  synthetic [barcode part1]
gttggtgcactagtgt

SEQ ID NO: 8590 - DNA, 16 bp, Artificial Sequence
  synthetic [barcode part1]
tcactgttcgtgagtt

SEQ ID NO: 8591 - DNA, 16 bp, Artificial Sequence
  synthetic [barcode part1]
gattgtcagattgccg

SEQ ID NO: 8592 - DNA, 16 bp, Artificial Sequence
  synthetic [barcode part1]
aagtaagacaacgtcc

SEQ ID NO: 8593 - DNA, 16 bp, Artificial Sequence
  synthetic [barcode part1]
tggcaatctaacggtc

SEQ ID NO: 8594 - DNA, 16 bp, Artificial Sequence
  synthetic [barcode part1]
tctctctccagagttc

SEQ ID NO: 8595 - DNA, 16 bp, Artificial Sequence
  synthetic [barcode part1]
actcaggatccacagt

SEQ ID NO: 8596 - DNA, 16 bp, Artificial Sequence
  synthetic [barcode part1]
aatctgcagtgtccag

SEQ ID NO: 8597 - DNA, 16 bp, Artificial Sequence
  synthetic [barcode part1]
acgcggttcaatcctc

SEQ ID NO: 8598 - DNA, 16 bp, Artificial Sequence
  synthetic [barcode part1]
cgtatcacaatacgcg

SEQ ID NO: 8599 - DNA, 16 bp, Artificial Sequence
  synthetic [barcode part1]
gcctcacacaattgtt

SEQ ID NO: 8600 - DNA, 16 bp, Artificial Sequence
  synthetic [barcode part1]
aaggttccgttgcaac

SEQ ID NO: 8601 - DNA, 16 bp, Artificial Sequence
  synthetic [barcode part1]
acgacagtctagtctg

SEQ ID NO: 8602 - DNA, 16 bp, Artificial Sequence
  synthetic [barcode part1]
gactgcaagtcctcct

SEQ ID NO: 8603 - DNA, 16 bp, Artificial Sequence
  synthetic [barcode part1]
aatacgaggattgtcg

SEQ ID NO: 8604 - DNA, 16 bp, Artificial Sequence
  synthetic [barcode part1]
cagttgtattcggacg

SEQ ID NO: 8605 - DNA, 16 bp, Artificial Sequence
  synthetic [barcode part1]
gaactggattggtgcg

SEQ ID NO: 8606 - DNA, 16 bp, Artificial Sequence
  synthetic [barcode part1]
cctatagactctgttg

SEQ ID NO: 8607 - DNA, 16 bp, Artificial Sequence
  synthetic [barcode part1]
aatcgcactaatcctc

SEQ ID NO: 8608 - DNA, 16 bp, Artificial Sequence
  synthetic [barcode part1]
ttggtgaaggtcactc

SEQ ID NO: 8609 - DNA, 16 bp, Artificial Sequence
  synthetic [barcode part1]
tgagatcacgtgtacc

SEQ ID NO: 8610 - DNA, 16 bp, Artificial Sequence
  synthetic [barcode part1]
gtctggagtgagttct

SEQ ID NO: 8611 - DNA, 16 bp, Artificial Sequence
  synthetic [barcode part1]
aaggtgacacctaagt

SEQ ID NO: 8612 - DNA, 16 bp, Artificial Sequence
  synthetic [barcode part1]
gaacaaggcggatagt

SEQ ID NO: 8613 - DNA, 16 bp, Artificial Sequence
  synthetic [barcode part1]
cgtctattccgaagtt

SEQ ID NO: 8614 - DNA, 16 bp, Artificial Sequence
  synthetic [barcode part1]
tgactagtacgtgcac

SEQ ID NO: 8615 - DNA, 16 bp, Artificial Sequence
  synthetic [barcode part1]
ttgtactctcgcactc

SEQ ID NO: 8616 - DNA, 16 bp, Artificial Sequence
  synthetic [barcode part1]
tccagtccagttgcac

SEQ ID NO: 8617 - DNA, 16 bp, Artificial Sequence
  synthetic [barcode part1]
tcagtactggtacgtg

SEQ ID NO: 8618 - DNA, 16 bp, Artificial Sequence
  synthetic [barcode part1]
gccaagttcacgcctt

SEQ ID NO: 8619 - DNA, 16 bp, Artificial Sequence
  synthetic [barcode part1]
aaggaattgtcctgcc

SEQ ID NO: 8620 - DNA, 16 bp, Artificial Sequence
  synthetic [barcode part1]
attacgcacgcaatcg

SEQ ID NO: 8621 - DNA, 16 bp, Artificial Sequence
  synthetic [barcode part1]
cgttgaactcagtgac

SEQ ID NO: 8622 - DNA, 16 bp, Artificial Sequence
  synthetic [barcode part1]
actctagtgtggtacg

SEQ ID NO: 8623 - DNA, 16 bp, Artificial Sequence
  synthetic [barcode part1]
gcctgccaatactgtc

SEQ ID NO: 8624 - DNA, 16 bp, Artificial Sequence
  synthetic [barcode part1]
tcgactctattaacgc

SEQ ID NO: 8625 - DNA, 16 bp, Artificial Sequence
  synthetic [barcode part1]
accaactcttcgagag

SEQ ID NO: 8626 - DNA, 16 bp, Artificial Sequence
  synthetic [barcode part1]
gcgtctcgtcgttagt

SEQ ID NO: 8627 - DNA, 16 bp, Artificial Sequence
  synthetic [barcode part1]
aggcgtcgaacagtac

SEQ ID NO: 8628 - DNA, 16 bp, Artificial Sequence
  synthetic [barcode part1]
gcacgattgtgatcgt

SEQ ID NO: 8629 - DNA, 16 bp, Artificial Sequence
  synthetic [barcode part1]
gcctctaacagtccac

SEQ ID NO: 8630 - DNA, 16 bp, Artificial Sequence
  synthetic [barcode part1]
agatcaatctcgaccg

SEQ ID NO: 8631 - DNA, 16 bp, Artificial Sequence
  synthetic [barcode part1]
tgatcacgtggttgtg

SEQ ID NO: 8632 - DNA, 16 bp, Artificial Sequence
  synthetic [barcode part1]
agactgtgacgacttc

SEQ ID NO: 8633 - DNA, 16 bp, Artificial Sequence
  synthetic [barcode part1]
aacaacaggcaaggtg

SEQ ID NO: 8634 - DNA, 16 bp, Artificial Sequence
  synthetic [barcode part1]
accacgagaacagatt

SEQ ID NO: 8635 - DNA, 16 bp, Artificial Sequence
  synthetic [barcode part1]
tacgtaacggagagtt

SEQ ID NO: 8636 - DNA, 16 bp, Artificial Sequence
  synthetic [barcode part1]
aatcctgcaagtagag

SEQ ID NO: 8637 - DNA, 16 bp, Artificial Sequence
  synthetic [barcode part1]
tcttgcagatcgccgt

SEQ ID NO: 8638 - DNA, 16 bp, Artificial Sequence
  synthetic [barcode part1]
acgattgagttgagac

SEQ ID NO: 8639 - DNA, 16 bp, Artificial Sequence
  synthetic [barcode part1]
ccagattaatccgacg

SEQ ID NO: 8640 - DNA, 16 bp, Artificial Sequence
  synthetic [barcode part1]
tcacctcggttacacg

SEQ ID NO: 8641 - DNA, 16 bp, Artificial Sequence
  synthetic [barcode part1]
agatcgtcgagaatac

SEQ ID NO: 8642 - DNA, 16 bp, Artificial Sequence
  synthetic [barcode part1]
tgagtcttctgccgtg

SEQ ID NO: 8643 - DNA, 16 bp, Artificial Sequence
  synthetic [barcode part1]
ccttacgcagtgactc

SEQ ID NO: 8644 - DNA, 16 bp, Artificial Sequence
  synthetic [barcode part1]
gaccacctctatattg

SEQ ID NO: 8645 - DNA, 16 bp, Artificial Sequence
  synthetic [barcode part1]
cagtaactgcgccttc

SEQ ID NO: 8646 - DNA, 16 bp, Artificial Sequence
  synthetic [barcode part1]
ccagtcgtaacactag

SEQ ID NO: 8647 - DNA, 16 bp, Artificial Sequence
  synthetic [barcode part1]
ccgtctggttctaggt

SEQ ID NO: 8648 - DNA, 16 bp, Artificial Sequence
  synthetic [barcode part1]
gcctcacggtgtactt

SEQ ID NO: 8649 - DNA, 16 bp, Artificial Sequence
  synthetic [barcode part1]
cgactgactagtcagt

SEQ ID NO: 8650 - DNA, 16 bp, Artificial Sequence
  synthetic [barcode part1]
gtcgaacgacacgagt

SEQ ID NO: 8651 - DNA, 16 bp, Artificial Sequence
  synthetic [barcode part1]
gcgttgaacgcaactt

SEQ ID NO: 8652 - DNA, 16 bp, Artificial Sequence
  synthetic [barcode part1]
acgcctcctgacgatt

SEQ ID NO: 8653 - DNA, 16 bp, Artificial Sequence
  synthetic [barcode part1]
aggtccaacaaggcgt

SEQ ID NO: 8654 - DNA, 16 bp, Artificial Sequence
  synthetic [barcode part1]
ttgtgcactccgatcg

SEQ ID NO: 8655 - DNA, 16 bp, Artificial Sequence
  synthetic [barcode part1]
gtaactcacctgacag

SEQ ID NO: 8656 - DNA, 16 bp, Artificial Sequence
  synthetic [barcode part1]
tccaattctccggttc

SEQ ID NO: 8657 - DNA, 16 bp, Artificial Sequence
  synthetic [barcode part1]
ttctctatatcggcag

SEQ ID NO: 8658 - DNA, 16 bp, Artificial Sequence
  synthetic [barcode part1]
gatcagtggagtcttc

SEQ ID NO: 8659 - DNA, 16 bp, Artificial Sequence
  synthetic [barcode part1]
cgtctctcgacttgag

SEQ ID NO: 8660 - DNA, 16 bp, Artificial Sequence
  synthetic [barcode part1]
gacacgccttcaactc

SEQ ID NO: 8661 - DNA, 16 bp, Artificial Sequence
  synthetic [barcode part1]
cctcacgtagttcggt

SEQ ID NO: 8662 - DNA, 16 bp, Artificial Sequence
  synthetic [barcode part1]
accactcctacaggtc

SEQ ID NO: 8663 - DNA, 16 bp, Artificial Sequence
  synthetic [barcode part1]
atactctacgcgagac

SEQ ID NO: 8664 - DNA, 16 bp, Artificial Sequence
  synthetic [barcode part1]
agagatactcaacgac

SEQ ID NO: 8665 - DNA, 16 bp, Artificial Sequence
  synthetic [barcode part1]
tgtccggaattgtacg

SEQ ID NO: 8666 - DNA, 16 bp, Artificial Sequence
  synthetic [barcode part1]
gtacagtagaattggc

SEQ ID NO: 8667 - DNA, 16 bp, Artificial Sequence
  synthetic [barcode part1]
gtataccttcgattcg

SEQ ID NO: 8668 - DNA, 16 bp, Artificial Sequence
  synthetic [barcode part1]
acaggttagaagttgc

SEQ ID NO: 8669 - DNA, 16 bp, Artificial Sequence
  synthetic [barcode part1]
caattagtcggccagt

SEQ ID NO: 8670 - DNA, 16 bp, Artificial Sequence
  synthetic [barcode part1]
cggaattgtacgtgtc

SEQ ID NO: 8671 - DNA, 16 bp, Artificial Sequence
  synthetic [barcode part1]
tacgtacgatcctgag

SEQ ID NO: 8672 - DNA, 16 bp, Artificial Sequence
  synthetic [barcode part1]
gcaagtgttacctgtg

SEQ ID NO: 8673 - DNA, 16 bp, Artificial Sequence
  synthetic [barcode part1]
cctaggcagatcagag

SEQ ID NO: 8674 - DNA, 16 bp, Artificial Sequence
  synthetic [barcode part1]
gcgtcgttctgtctag

SEQ ID NO: 8675 - DNA, 16 bp, Artificial Sequence
  synthetic [barcode part1]
cgtgaatcacttaggc

SEQ ID NO: 8676 - DNA, 16 bp, Artificial Sequence
  synthetic [barcode part1]
cacacaggtccgaatt

SEQ ID NO: 8677 - DNA, 16 bp, Artificial Sequence
  synthetic [barcode part1]
taaggcctcttcctct

SEQ ID NO: 8678 - DNA, 16 bp, Artificial Sequence
  synthetic [barcode part1]
gccaggttactcttgc

SEQ ID NO: 8679 - DNA, 16 bp, Artificial Sequence
  synthetic [barcode part1]
tgttaatctgactccg

SEQ ID NO: 8680 - DNA, 16 bp, Artificial Sequence
  synthetic [barcode part1]
cacctgtgcagtatcc

SEQ ID NO: 8681 - DNA, 16 bp, Artificial Sequence
  synthetic [barcode part1]
tagtagacggaacgag

SEQ ID NO: 8682 - DNA, 16 bp, Artificial Sequence
  synthetic [barcode part1]
tcctgcaccaagttgc

SEQ ID NO: 8683 - DNA, 16 bp, Artificial Sequence
  synthetic [barcode part1]
cgtacaaggaccagac

SEQ ID NO: 8684 - DNA, 16 bp, Artificial Sequence
  synthetic [barcode part1]
gtctaactcctgtgcg

SEQ ID NO: 8685 - DNA, 16 bp, Artificial Sequence
  synthetic [barcode part1]
accgagttatctctgt

SEQ ID NO: 8686 - DNA, 16 bp, Artificial Sequence
  synthetic [barcode part1]
atacggtggtccttcc

SEQ ID NO: 8687 - DNA, 16 bp, Artificial Sequence
  synthetic [barcode part1]
cacgcctacagaagtt

SEQ ID NO: 8688 - DNA, 16 bp, Artificial Sequence
  synthetic [barcode part1]
accactccttgagtgc

SEQ ID NO: 8689 - DNA, 16 bp, Artificial Sequence
  synthetic [barcode part1]
tctcgtggtcgaatcc

SEQ ID NO: 8690 - DNA, 16 bp, Artificial Sequence
  synthetic [barcode part1]
cggagatcactgaacg

SEQ ID NO: 8691 - DNA, 16 bp, Artificial Sequence
  synthetic [barcode part1]
taggccacgtgtctct

SEQ ID NO: 8692 - DNA, 16 bp, Artificial Sequence
  synthetic [barcode part1]
cggtgtatcggatact

SEQ ID NO: 8693 - DNA, 16 bp, Artificial Sequence
  synthetic [barcode part1]
aagagttccgattccg

SEQ ID NO: 8694 - DNA, 16 bp, Artificial Sequence
  synthetic [barcode part1]
gtagactagtccacac

SEQ ID NO: 8695 - DNA, 16 bp, Artificial Sequence
  synthetic [barcode part1]
tctaggatcggagttc

SEQ ID NO: 8696 - DNA, 16 bp, Artificial Sequence
  synthetic [barcode part1]
tgttcgtctcaagact

SEQ ID NO: 8697 - DNA, 16 bp, Artificial Sequence
  synthetic [barcode part1]
gtatcgagaggtaatc

SEQ ID NO: 8698 - DNA, 16 bp, Artificial Sequence
  synthetic [barcode part1]
tcgaactgaagtgtag

SEQ ID NO: 8699 - DNA, 16 bp, Artificial Sequence
  synthetic [barcode part1]
ccttcacctactggag

SEQ ID NO: 8700 - DNA, 16 bp, Artificial Sequence
  synthetic [barcode part1]
ttgttggacacaagag

SEQ ID NO: 8701 - DNA, 16 bp, Artificial Sequence
  synthetic [barcode part1]
tccgcgtaactcggtt

SEQ ID NO: 8702 - DNA, 16 bp, Artificial Sequence
  synthetic [barcode part1]
aattggaaggtcggag

SEQ ID NO: 8703 - DNA, 16 bp, Artificial Sequence
  synthetic [barcode part1]
gaactactaccaggtc

SEQ ID NO: 8704 - DNA, 16 bp, Artificial Sequence
  synthetic [barcode part1]
gtctcgtactccttac

SEQ ID NO: 8705 - DNA, 16 bp, Artificial Sequence
  synthetic [barcode part1]
acctccttgattgtag

SEQ ID NO: 8706 - DNA, 16 bp, Artificial Sequence
  synthetic [barcode part1]
cggttctcaaccgtac

SEQ ID NO: 8707 - DNA, 16 bp, Artificial Sequence
  synthetic [barcode part1]
aacacgtgttgtgcac

SEQ ID NO: 8708 - DNA, 16 bp, Artificial Sequence
  synthetic [barcode part1]
tgtaggtgtagacctc

SEQ ID NO: 8709 - DNA, 16 bp, Artificial Sequence
  synthetic [barcode part1]
aagtaaccgcaggtcg

SEQ ID NO: 8710 - DNA, 16 bp, Artificial Sequence
  synthetic [barcode part1]
agatccgagactaagt

SEQ ID NO: 8711 - DNA, 16 bp, Artificial Sequence
  synthetic [barcode part1]
gacacactaatcgcgt

SEQ ID NO: 8712 - DNA, 16 bp, Artificial Sequence
  synthetic [barcode part1]
agagttccttggagtc

SEQ ID NO: 8713 - DNA, 16 bp, Artificial Sequence
  synthetic [barcode part1]
tgcaggacgacgattg

SEQ ID NO: 8714 - DNA, 16 bp, Artificial Sequence
  synthetic [barcode part1]
tcgacaggacaatcct

SEQ ID NO: 8715 - DNA, 16 bp, Artificial Sequence
  synthetic [barcode part1]
aacaagagttggaggc

SEQ ID NO: 8716 - DNA, 16 bp, Artificial Sequence
  synthetic [barcode part1]
tgaacggtaccgcaag

SEQ ID NO: 8717 - DNA, 16 bp, Artificial Sequence
  synthetic [barcode part1]
tccaagatacgacacc

SEQ ID NO: 8718 - DNA, 16 bp, Artificial Sequence
  synthetic [barcode part1]
ttgagatcgccacagt

SEQ ID NO: 8719 - DNA, 16 bp, Artificial Sequence
  synthetic [barcode part1]
tcaactctgaactcgt

SEQ ID NO: 8720 - DNA, 16 bp, Artificial Sequence
  synthetic [barcode part1]
caatctgactctcgcg

SEQ ID NO: 8721 - DNA, 16 bp, Artificial Sequence
  synthetic [barcode part1]
tcgactatctcgagag

SEQ ID NO: 8722 - DNA, 16 bp, Artificial Sequence
  synthetic [barcode part1]
tcgtagagtggaacgc

SEQ ID NO: 8723 - DNA, 16 bp, Artificial Sequence
  synthetic [barcode part1]
ttgacgaataaggacc

SEQ ID NO: 8724 - DNA, 16 bp, Artificial Sequence
  synthetic [barcode part1]
tcaattcgtgactgtc

SEQ ID NO: 8725 - DNA, 16 bp, Artificial Sequence
  synthetic [barcode part1]
gagagtctaatcgtag

SEQ ID NO: 8726 - DNA, 16 bp, Artificial Sequence
  synthetic [barcode part1]
ttctggattcaggacg

SEQ ID NO: 8727 - DNA, 16 bp, Artificial Sequence
  synthetic [barcode part1]
gaagtgaagacctact

SEQ ID NO: 8728 - DNA, 16 bp, Artificial Sequence
  synthetic [barcode part1]
gtccggactacttcac

SEQ ID NO: 8729 - DNA, 16 bp, Artificial Sequence
  synthetic [barcode part1]
ttgttgtccgttccac

SEQ ID NO: 8730 - DNA, 16 bp, Artificial Sequence
  synthetic [barcode part1]
tattaacttccgaccg

SEQ ID NO: 8731 - DNA, 16 bp, Artificial Sequence
  synthetic [barcode part1]
tggtaacaccgaactc

SEQ ID NO: 8732 - DNA, 16 bp, Artificial Sequence
  synthetic [barcode part1]
ccaatccgttcgagtc

SEQ ID NO: 8733 - DNA, 16 bp, Artificial Sequence
  synthetic [barcode part1]
cgtagttcggtctctg

SEQ ID NO: 8734 - DNA, 16 bp, Artificial Sequence
  synthetic [barcode part1]
gcaaggatccttacac

SEQ ID NO: 8735 - DNA, 16 bp, Artificial Sequence
  synthetic [barcode part1]
tgtatccacggcctgt

SEQ ID NO: 8736 - DNA, 16 bp, Artificial Sequence
  synthetic [barcode part1]
caatcgttaccttgtg

SEQ ID NO: 8737 - DNA, 16 bp, Artificial Sequence
  synthetic [barcode part1]
tacgcctggtaactcc

SEQ ID NO: 8738 - DNA, 16 bp, Artificial Sequence
  synthetic [barcode part1]
cactattaggccagac

SEQ ID NO: 8739 - DNA, 16 bp, Artificial Sequence
  synthetic [barcode part1]
taatctcgcgttggcc

SEQ ID NO: 8740 - DNA, 16 bp, Artificial Sequence
  synthetic [barcode part1]
tatcggacggattgtc

SEQ ID NO: 8741 - DNA, 16 bp, Artificial Sequence
  synthetic [barcode part1]
agaacctggacgaacc

SEQ ID NO: 8742 - DNA, 16 bp, Artificial Sequence
  synthetic [barcode part1]
gacagttccagtgatc

SEQ ID NO: 8743 - DNA, 16 bp, Artificial Sequence
  synthetic [barcode part1]
gtccactgaatagacc

SEQ ID NO: 8744 - DNA, 16 bp, Artificial Sequence
  synthetic [barcode part1]
caggtcgaacttgatc

SEQ ID NO: 8745 - DNA, 16 bp, Artificial Sequence
  synthetic [barcode part1]
actgatctcgactgag

SEQ ID NO: 8746 - DNA, 16 bp, Artificial Sequence
  synthetic [barcode part1]
acaccagactattcct

SEQ ID NO: 8747 - DNA, 16 bp, Artificial Sequence
  synthetic [barcode part1]
ttacctaatccgcctc

SEQ ID NO: 8748 - DNA, 16 bp, Artificial Sequence
  synthetic [barcode part1]
gccttggatatcgtag

SEQ ID NO: 8749 - DNA, 16 bp, Artificial Sequence
  synthetic [barcode part1]
gactggtcagtcaact

SEQ ID NO: 8750 - DNA, 16 bp, Artificial Sequence
  synthetic [barcode part1]
tcttcgagttgacgtt

SEQ ID NO: 8751 - DNA, 16 bp, Artificial Sequence
  synthetic [barcode part1]
agttctcgattgcgtt

SEQ ID NO: 8752 - DNA, 16 bp, Artificial Sequence
  synthetic [barcode part1]
tcgttgttactcaggt

SEQ ID NO: 8753 - DNA, 16 bp, Artificial Sequence
  synthetic [barcode part1]
actgtccttactccac

SEQ ID NO: 8754 - DNA, 16 bp, Artificial Sequence
  synthetic [barcode part1]
aaggtgaccacagatt

SEQ ID NO: 8755 - DNA, 16 bp, Artificial Sequence
  synthetic [barcode part1]
tacagtggtccacctc

SEQ ID NO: 8756 - DNA, 16 bp, Artificial Sequence
  synthetic [barcode part1]
gtatacgtgaccaacc

SEQ ID NO: 8757 - DNA, 16 bp, Artificial Sequence
  synthetic [barcode part1]
tcaccgttcgcgaatc

SEQ ID NO: 8758 - DNA, 16 bp, Artificial Sequence
  synthetic [barcode part1]
aaggacagtccgacgt

SEQ ID NO: 8759 - DNA, 16 bp, Artificial Sequence
  synthetic [barcode part1]
attaccttgtctggac

SEQ ID NO: 8760 - DNA, 16 bp, Artificial Sequence
  synthetic [barcode part1]
gactgatcggtcaatc

SEQ ID NO: 8761 - DNA, 16 bp, Artificial Sequence
  synthetic [barcode part1]
ttcaactgtcgatacc

SEQ ID NO: 8762 - DNA, 16 bp, Artificial Sequence
  synthetic [barcode part1]
tgtctagagaagtcag

SEQ ID NO: 8763 - DNA, 16 bp, Artificial Sequence
  synthetic [barcode part1]
ttctggcgattacgcc

SEQ ID NO: 8764 - DNA, 16 bp, Artificial Sequence
  synthetic [barcode part1]
gactatcagaccgttg

SEQ ID NO: 8765 - DNA, 16 bp, Artificial Sequence
  synthetic [barcode part1]
atcagtggtgaggtgc

SEQ ID NO: 8766 - DNA, 16 bp, Artificial Sequence
  synthetic [barcode part1]
cacgtaactcaacttc

SEQ ID NO: 8767 - DNA, 16 bp, Artificial Sequence
  synthetic [barcode part1]
tcgcagagtccaagtt

SEQ ID NO: 8768 - DNA, 16 bp, Artificial Sequence
  synthetic [barcode part1]
aagtctcctaagaccg

SEQ ID NO: 8769 - DNA, 16 bp, Artificial Sequence
  synthetic [barcode part1]
gaatcacgacgcgaac

SEQ ID NO: 8770 - DNA, 16 bp, Artificial Sequence
  synthetic [barcode part1]
actgtgaacagtgtcc

SEQ ID NO: 8771 - DNA, 16 bp, Artificial Sequence
  synthetic [barcode part1]
tgtctagagtcgtgtg

SEQ ID NO: 8772 - DNA, 16 bp, Artificial Sequence
  synthetic [barcode part1]
ttcagagtagtgccac

SEQ ID NO: 8773 - DNA, 16 bp, Artificial Sequence
  synthetic [barcode part1]
aggaacacgccagact

SEQ ID NO: 8774 - DNA, 16 bp, Artificial Sequence
  synthetic [barcode part1]
tggcgtattctcagtt

SEQ ID NO: 8775 - DNA, 16 bp, Artificial Sequence
  synthetic [barcode part1]
atattgaagaggccac

SEQ ID NO: 8776 - DNA, 16 bp, Artificial Sequence
  synthetic [barcode part1]
acctgagacagatcct

SEQ ID NO: 8777 - DNA, 16 bp, Artificial Sequence
  synthetic [barcode part1]
acctccaagattgttc

SEQ ID NO: 8778 - DNA, 16 bp, Artificial Sequence
  synthetic [barcode part1]
gtgttagaggaactac

SEQ ID NO: 8779 - DNA, 16 bp, Artificial Sequence
  synthetic [barcode part1]
tgattagacgcgcact

SEQ ID NO: 8780 - DNA, 16 bp, Artificial Sequence
  synthetic [barcode part1]
tgtctgaaccaagaag

SEQ ID NO: 8781 - DNA, 16 bp, Artificial Sequence
  synthetic [barcode part1]
gtggcgttgatcaatc

SEQ ID NO: 8782 - DNA, 16 bp, Artificial Sequence
  synthetic [barcode part1]
tcctcggaccggtatt

SEQ ID NO: 8783 - DNA, 16 bp, Artificial Sequence
  synthetic [barcode part1]
ccttctcgaccttagt

SEQ ID NO: 8784 - DNA, 16 bp, Artificial Sequence
  synthetic [barcode part1]
aggtatccgaagtaac

SEQ ID NO: 8785 - DNA, 16 bp, Artificial Sequence
  synthetic [barcode part1]
gtaagaagaggtgcac

SEQ ID NO: 8786 - DNA, 16 bp, Artificial Sequence
  synthetic [barcode part1]
tgtacggtcacgtagt

SEQ ID NO: 8787 - DNA, 16 bp, Artificial Sequence
  synthetic [barcode part1]
taaggtcctcttcctc

SEQ ID NO: 8788 - DNA, 16 bp, Artificial Sequence
  synthetic [barcode part1]
tacaggcggacctatt

SEQ ID NO: 8789 - DNA, 16 bp, Artificial Sequence
  synthetic [barcode part1]
gccacgtaacctatag

SEQ ID NO: 8790 - DNA, 16 bp, Artificial Sequence
  synthetic [barcode part1]
tggaaggtgtatagtc

SEQ ID NO: 8791 - DNA, 16 bp, Artificial Sequence
  synthetic [barcode part1]
ccgttaatacgaagag

SEQ ID NO: 8792 - DNA, 16 bp, Artificial Sequence
  synthetic [barcode part1]
gttacacactgagaag

SEQ ID NO: 8793 - DNA, 16 bp, Artificial Sequence
  synthetic [barcode part1]
actccgcgttcgagtt

SEQ ID NO: 8794 - DNA, 16 bp, Artificial Sequence
  synthetic [barcode part1]
ttcgttgtgacctcct

SEQ ID NO: 8795 - DNA, 16 bp, Artificial Sequence
  synthetic [barcode part1]
taactggtagtgtcgc

SEQ ID NO: 8796 - DNA, 16 bp, Artificial Sequence
  synthetic [barcode part1]
tcggttatagtcggtg

SEQ ID NO: 8797 - DNA, 16 bp, Artificial Sequence
  synthetic [barcode part1]
aaccacgcacgtagtt

SEQ ID NO: 8798 - DNA, 16 bp, Artificial Sequence
  synthetic [barcode part1]
ttccgcaccgataacc

SEQ ID NO: 8799 - DNA, 16 bp, Artificial Sequence
  synthetic [barcode part1]
taagtcgccagactac

SEQ ID NO: 8800 - DNA, 16 bp, Artificial Sequence
  synthetic [barcode part1]
gaagtgccgacaactg

SEQ ID NO: 8801 - DNA, 16 bp, Artificial Sequence
  synthetic [barcode part1]
cgccgtacgatattag

SEQ ID NO: 8802 - DNA, 16 bp, Artificial Sequence
  synthetic [barcode part1]
cctcaatctctcgact

SEQ ID NO: 8803 - DNA, 16 bp, Artificial Sequence
  synthetic [barcode part1]
taaggccaccagttgt

SEQ ID NO: 8804 - DNA, 16 bp, Artificial Sequence
  synthetic [barcode part1]
tacaagtcgcctaggt

SEQ ID NO: 8805 - DNA, 16 bp, Artificial Sequence
  synthetic [barcode part1]
tcctctgactcgagtg

SEQ ID NO: 8806 - DNA, 16 bp, Artificial Sequence
  synthetic [barcode part1]
taattcactgcgtctg

SEQ ID NO: 8807 - DNA, 16 bp, Artificial Sequence
  synthetic [barcode part1]
gtaggtgagtattacg

SEQ ID NO: 8808 - DNA, 16 bp, Artificial Sequence
  synthetic [barcode part1]
gagtcgatcagaagag

SEQ ID NO: 8809 - DNA, 16 bp, Artificial Sequence
  synthetic [barcode part1]
tagacacaattgcgcc

SEQ ID NO: 8810 - DNA, 16 bp, Artificial Sequence
  synthetic [barcode part1]
tatacctgtctccgtc

SEQ ID NO: 8811 - DNA, 16 bp, Artificial Sequence
  synthetic [barcode part1]
cgttggaggtacgagt

SEQ ID NO: 8812 - DNA, 16 bp, Artificial Sequence
  synthetic [barcode part1]
gtcctcttagtgtgcg

SEQ ID NO: 8813 - DNA, 16 bp, Artificial Sequence
  synthetic [barcode part1]
tgaaggcaagtgtgag

SEQ ID NO: 8814 - DNA, 16 bp, Artificial Sequence
  synthetic [barcode part1]
gtgtacgtacgacgtt

SEQ ID NO: 8815 - DNA, 16 bp, Artificial Sequence
  synthetic [barcode part1]
tatatctggatcgcct

SEQ ID NO: 8816 - DNA, 16 bp, Artificial Sequence
  synthetic [barcode part1]
tgtattctggaggtgc

SEQ ID NO: 8817 - DNA, 16 bp, Artificial Sequence
  synthetic [barcode part1]
gactgacgttggttgt

SEQ ID NO: 8818 - DNA, 16 bp, Artificial Sequence
  synthetic [barcode part1]
tgtagaacagtggttg

SEQ ID NO: 8819 - DNA, 16 bp, Artificial Sequence
  synthetic [barcode part1]
cggcgcagttatcctt

SEQ ID NO: 8820 - DNA, 16 bp, Artificial Sequence
  synthetic [barcode part1]
cagacacctagtacgt

SEQ ID NO: 8821 - DNA, 16 bp, Artificial Sequence
  synthetic [barcode part1]
taagtcggcacaaggc

SEQ ID NO: 8822 - DNA, 16 bp, Artificial Sequence
  synthetic [barcode part1]
gttagtcctagagtcg

SEQ ID NO: 8823 - DNA, 16 bp, Artificial Sequence
  synthetic [barcode part1]
tcgcgactaacgttag

SEQ ID NO: 8824 - DNA, 16 bp, Artificial Sequence
  synthetic [barcode part1]
ccgaattaacctggtg

SEQ ID NO: 8825 - DNA, 16 bp, Artificial Sequence
  synthetic [barcode part1]
gcggtcggtattgatt

SEQ ID NO: 8826 - DNA, 16 bp, Artificial Sequence
  synthetic [barcode part1]
cctccgagtattgatt

SEQ ID NO: 8827 - DNA, 16 bp, Artificial Sequence
  synthetic [barcode part1]
gataggaaccgtctct

SEQ ID NO: 8828 - DNA, 16 bp, Artificial Sequence
  synthetic [barcode part1]
cgtcttacctggacgt

SEQ ID NO: 8829 - DNA, 16 bp, Artificial Sequence
  synthetic [barcode part1]
gacaaccaccaagtct

SEQ ID NO: 8830 - DNA, 16 bp, Artificial Sequence
  synthetic [barcode part1]
cgacaactgtggaggt

SEQ ID NO: 8831 - DNA, 16 bp, Artificial Sequence
  synthetic [barcode part1]
gtatccaggcacttag

SEQ ID NO: 8832 - DNA, 16 bp, Artificial Sequence
  synthetic [barcode part1]
gacgatcagaatacgt

SEQ ID NO: 8833 - DNA, 16 bp, Artificial Sequence
  synthetic [barcode part1]
cgtgtccaacgtaagt

SEQ ID NO: 8834 - DNA, 16 bp, Artificial Sequence
  synthetic [barcode part1]
caccgtgaatcagttg

SEQ ID NO: 8835 - DNA, 16 bp, Artificial Sequence
  synthetic [barcode part1]
taggtcacgcgaagac

SEQ ID NO: 8836 - DNA, 16 bp, Artificial Sequence
  synthetic [barcode part1]
gactaattgacgccgt

SEQ ID NO: 8837 - DNA, 16 bp, Artificial Sequence
  synthetic [barcode part1]
aagaagtgttcagacc

SEQ ID NO: 8838 - DNA, 16 bp, Artificial Sequence
  synthetic [barcode part1]
gattcaacttcgcact

SEQ ID NO: 8839 - DNA, 16 bp, Artificial Sequence
  synthetic [barcode part1]
cgccttagtagtgaac

SEQ ID NO: 8840 - DNA, 16 bp, Artificial Sequence
  synthetic [barcode part1]
acgtgcggttagttac

SEQ ID NO: 8841 - DNA, 16 bp, Artificial Sequence
  synthetic [barcode part1]
tcgtagtgagattccg

SEQ ID NO: 8842 - DNA, 16 bp, Artificial Sequence
  synthetic [barcode part1]
gtataccgttctctag

SEQ ID NO: 8843 - DNA, 16 bp, Artificial Sequence
  synthetic [barcode part1]
aagtacctgtctaggc

SEQ ID NO: 8844 - DNA, 16 bp, Artificial Sequence
  synthetic [barcode part1]
actctgactccttctg

SEQ ID NO: 8845 - DNA, 16 bp, Artificial Sequence
  synthetic [barcode part1]
tctctggaactctctc

SEQ ID NO: 8846 - DNA, 16 bp, Artificial Sequence
  synthetic [barcode part1]
gcacaagaggtgtaag

SEQ ID NO: 8847 - DNA, 16 bp, Artificial Sequence
  synthetic [barcode part1]
tacaccacaactgcag

SEQ ID NO: 8848 - DNA, 16 bp, Artificial Sequence
  synthetic [barcode part1]
acctctgcactaggtc

SEQ ID NO: 8849 - DNA, 16 bp, Artificial Sequence
  synthetic [barcode part1]
cggccaattggttaac

SEQ ID NO: 8850 - DNA, 16 bp, Artificial Sequence
  synthetic [barcode part1]
accaatcgacctcaag

SEQ ID NO: 8851 - DNA, 16 bp, Artificial Sequence
  synthetic [barcode part1]
gtaataccacggcgtt

SEQ ID NO: 8852 - DNA, 16 bp, Artificial Sequence
  synthetic [barcode part1]
cgcgaatacctacagt

SEQ ID NO: 8853 - DNA, 16 bp, Artificial Sequence
  synthetic [barcode part1]
actacacgtcactccg

SEQ ID NO: 8854 - DNA, 16 bp, Artificial Sequence
  synthetic [barcode part1]
ccgtcgttcgtggatt

SEQ ID NO: 8855 - DNA, 16 bp, Artificial Sequence
  synthetic [barcode part1]
gttgcgcaagacaacg

SEQ ID NO: 8856 - DNA, 16 bp, Artificial Sequence
  synthetic [barcode part1]
gagactcggacgagtt

SEQ ID NO: 8857 - DNA, 16 bp, Artificial Sequence
  synthetic [barcode part1]
tgcggaaggtctagtg

SEQ ID NO: 8858 - DNA, 16 bp, Artificial Sequence
  synthetic [barcode part1]
acctcctattggcacg

SEQ ID NO: 8859 - DNA, 16 bp, Artificial Sequence
  synthetic [barcode part1]
aataacgtgccacctg

SEQ ID NO: 8860 - DNA, 16 bp, Artificial Sequence
  synthetic [barcode part1]
gaacgccgatacttac

SEQ ID NO: 8861 - DNA, 16 bp, Artificial Sequence
  synthetic [barcode part1]
gacgtcacacaacact

SEQ ID NO: 8862 - DNA, 16 bp, Artificial Sequence
  synthetic [barcode part1]
acgaggactctgtatc

SEQ ID NO: 8863 - DNA, 16 bp, Artificial Sequence
  synthetic [barcode part1]
cgttcgcaacgtcgtt

SEQ ID NO: 8864 - DNA, 16 bp, Artificial Sequence
  synthetic [barcode part1]
caacttccacgtaact

SEQ ID NO: 8865 - DNA, 16 bp, Artificial Sequence
  synthetic [barcode part1]
tgagtctggcaaggtg

SEQ ID NO: 8866 - DNA, 16 bp, Artificial Sequence
  synthetic [barcode part1]
tgtctgtcactcacct

SEQ ID NO: 8867 - DNA, 16 bp, Artificial Sequence
  synthetic [barcode part1]
gtacttcgagacacgt

SEQ ID NO: 8868 - DNA, 16 bp, Artificial Sequence
  synthetic [barcode part1]
aatacgaacgactcag

SEQ ID NO: 8869 - DNA, 16 bp, Artificial Sequence
  synthetic [barcode part1]
ccactgcaataggact

SEQ ID NO: 8870 - DNA, 16 bp, Artificial Sequence
  synthetic [barcode part1]
gacacgtgttggtact

SEQ ID NO: 8871 - DNA, 16 bp, Artificial Sequence
  synthetic [barcode part1]
tggtgtgtcttcagtt

SEQ ID NO: 8872 - DNA, 16 bp, Artificial Sequence
  synthetic [barcode part1]
atactctgcgtctctc

SEQ ID NO: 8873 - DNA, 16 bp, Artificial Sequence
  synthetic [barcode part1]
gcaacttacgacctag

SEQ ID NO: 8874 - DNA, 16 bp, Artificial Sequence
  synthetic [barcode part1]
gcaccactacttaccg

SEQ ID NO: 8875 - DNA, 16 bp, Artificial Sequence
  synthetic [barcode part1]
aagtgtaccgaatcag

SEQ ID NO: 8876 - DNA, 16 bp, Artificial Sequence
  synthetic [barcode part1]
gtatattaggcgcctg

SEQ ID NO: 8877 - DNA, 16 bp, Artificial Sequence
  synthetic [barcode part1]
cgcacgtatatacgtg

SEQ ID NO: 8878 - DNA, 16 bp, Artificial Sequence
  synthetic [barcode part1]
tagtacgtcgacacac

SEQ ID NO: 8879 - DNA, 16 bp, Artificial Sequence
  synthetic [barcode part1]
ttgtctgaacaccgtt

SEQ ID NO: 8880 - DNA, 16 bp, Artificial Sequence
  synthetic [barcode part1]
gaacaatctctgccag

SEQ ID NO: 8881 - DNA, 16 bp, Artificial Sequence
  synthetic [barcode part1]
tcctcgttcgtattcg

SEQ ID NO: 8882 - DNA, 16 bp, Artificial Sequence
  synthetic [barcode part1]
ttctaggcgtctgtcg

SEQ ID NO: 8883 - DNA, 16 bp, Artificial Sequence
  synthetic [barcode part1]
gttcaggacctcacct

SEQ ID NO: 8884 - DNA, 16 bp, Artificial Sequence
  synthetic [barcode part1]
aacagaggaccgtatt

SEQ ID NO: 8885 - DNA, 16 bp, Artificial Sequence
  synthetic [barcode part1]
tgaacgccttccaatt

SEQ ID NO: 8886 - DNA, 16 bp, Artificial Sequence
  synthetic [barcode part1]
ttgtggtggagagaag

SEQ ID NO: 8887 - DNA, 16 bp, Artificial Sequence
  synthetic [barcode part1]
agtggtgaagtccacg

SEQ ID NO: 8888 - DNA, 16 bp, Artificial Sequence
  synthetic [barcode part1]
gagttacaggtacggc

SEQ ID NO: 8889 - DNA, 16 bp, Artificial Sequence
  synthetic [barcode part1]
gaggtgttggtccaag

SEQ ID NO: 8890 - DNA, 16 bp, Artificial Sequence
  synthetic [barcode part1]
gtacactctgttatcg

SEQ ID NO: 8891 - DNA, 16 bp, Artificial Sequence
  synthetic [barcode part1]
cgagagtaggttgtcg

SEQ ID NO: 8892 - DNA, 16 bp, Artificial Sequence
  synthetic [barcode part1]
ccgcacttgtcagact

SEQ ID NO: 8893 - DNA, 16 bp, Artificial Sequence
  synthetic [barcode part1]
ttgtcacgatactcgt

SEQ ID NO: 8894 - DNA, 16 bp, Artificial Sequence
  synthetic [barcode part1]
gtattaacctccaacc

SEQ ID NO: 8895 - DNA, 16 bp, Artificial Sequence
  synthetic [barcode part1]
ttaaccgccagaactg

SEQ ID NO: 8896 - DNA, 16 bp, Artificial Sequence
  synthetic [barcode part1]
tacacgttggtgtcag

SEQ ID NO: 8897 - DNA, 16 bp, Artificial Sequence
  synthetic [barcode part1]
tgtggtaagtgttgcc

SEQ ID NO: 8898 - DNA, 16 bp, Artificial Sequence
  synthetic [barcode part1]
acgcaagtaggagtag

SEQ ID NO: 8899 - DNA, 16 bp, Artificial Sequence
  synthetic [barcode part1]
cgaagtcgtcacaact

SEQ ID NO: 8900 - DNA, 16 bp, Artificial Sequence
  synthetic [barcode part1]
cgcgcctataatctgc

SEQ ID NO: 8901 - DNA, 16 bp, Artificial Sequence
  synthetic [barcode part1]
tgcgttagattggaag

SEQ ID NO: 8902 - DNA, 16 bp, Artificial Sequence
  synthetic [barcode part1]
actgttgactgtcgag

SEQ ID NO: 8903 - DNA, 16 bp, Artificial Sequence
  synthetic [barcode part1]
cagttagaaggaaggc

SEQ ID NO: 8904 - DNA, 16 bp, Artificial Sequence
  synthetic [barcode part1]
gttctcaaggcgtagt

SEQ ID NO: 8905 - DNA, 16 bp, Artificial Sequence
  synthetic [barcode part1]
gaatattcttgccacc

SEQ ID NO: 8906 - DNA, 16 bp, Artificial Sequence
  synthetic [barcode part1]
tcggaccgtatcttcg

SEQ ID NO: 8907 - DNA, 16 bp, Artificial Sequence
  synthetic [barcode part1]
tatacgcaccgactag

SEQ ID NO: 8908 - DNA, 16 bp, Artificial Sequence
  synthetic [barcode part1]
gtcaaggcaatatacg

SEQ ID NO: 8909 - DNA, 16 bp, Artificial Sequence
  synthetic [barcode part1]
acacagtctgacctcc

SEQ ID NO: 8910 - DNA, 16 bp, Artificial Sequence
  synthetic [barcode part1]
tggattctgttcggag

SEQ ID NO: 8911 - DNA, 16 bp, Artificial Sequence
  synthetic [barcode part1]
aggttggaagaggttg

SEQ ID NO: 8912 - DNA, 16 bp, Artificial Sequence
  synthetic [barcode part1]
gtggttgtacgcgatt

SEQ ID NO: 8913 - DNA, 16 bp, Artificial Sequence
  synthetic [barcode part1]
tcaacttaggtgttcc

SEQ ID NO: 8914 - DNA, 16 bp, Artificial Sequence
  synthetic [barcode part1]
cgtcttgttatctcgc

SEQ ID NO: 8915 - DNA, 16 bp, Artificial Sequence
  synthetic [barcode part1]
gtagtacgtactacgc

SEQ ID NO: 8916 - DNA, 16 bp, Artificial Sequence
  synthetic [barcode part1]
ccagatacctattgtc

SEQ ID NO: 8917 - DNA, 16 bp, Artificial Sequence
  synthetic [barcode part1]
aacttccaactcgtgt

SEQ ID NO: 8918 - DNA, 16 bp, Artificial Sequence
  synthetic [barcode part1]
agtgatcaagaacgtc

SEQ ID NO: 8919 - DNA, 16 bp, Artificial Sequence
  synthetic [barcode part1]
tagtagaccgcgaacg

SEQ ID NO: 8920 - DNA, 16 bp, Artificial Sequence
  synthetic [barcode part1]
accaacaatagtcgcc

SEQ ID NO: 8921 - DNA, 16 bp, Artificial Sequence
  synthetic [barcode part1]
tctgtccaacgttgcg

SEQ ID NO: 8922 - DNA, 16 bp, Artificial Sequence
  synthetic [barcode part1]
gtctcggttagagttg

SEQ ID NO: 8923 - DNA, 16 bp, Artificial Sequence
  synthetic [barcode part1]
acgactgtgcacgatt

SEQ ID NO: 8924 - DNA, 16 bp, Artificial Sequence
  synthetic [barcode part1]
attgcaccgactcctg

SEQ ID NO: 8925 - DNA, 16 bp, Artificial Sequence
  synthetic [barcode part1]
tacacctggtgtgagt

SEQ ID NO: 8926 - DNA, 16 bp, Artificial Sequence
  synthetic [barcode part1]
gtgtgtgccaatcagt

SEQ ID NO: 8927 - DNA, 16 bp, Artificial Sequence
  synthetic [barcode part1]
gtagagagacctaact

SEQ ID NO: 8928 - DNA, 16 bp, Artificial Sequence
  synthetic [barcode part1]
acctgcgtacagattg

SEQ ID NO: 8929 - DNA, 16 bp, Artificial Sequence
  synthetic [barcode part1]
attaggacggtacgcg

SEQ ID NO: 8930 - DNA, 16 bp, Artificial Sequence
  synthetic [barcode part1]
cggtcagttaactgac

SEQ ID NO: 8931 - DNA, 16 bp, Artificial Sequence
  synthetic [barcode part1]
aggtgttccacctcac

SEQ ID NO: 8932 - DNA, 16 bp, Artificial Sequence
  synthetic [barcode part1]
tagtataggagtgacc

SEQ ID NO: 8933 - DNA, 16 bp, Artificial Sequence
  synthetic [barcode part1]
cagacgtcctcactgt

SEQ ID NO: 8934 - DNA, 16 bp, Artificial Sequence
  synthetic [barcode part1]
tcgaacgacagactct

SEQ ID NO: 8935 - DNA, 16 bp, Artificial Sequence
  synthetic [barcode part1]
gcgttaatcagtacgc

SEQ ID NO: 8936 - DNA, 16 bp, Artificial Sequence
  synthetic [barcode part1]
tcacgtctactgaatc

SEQ ID NO: 8937 - DNA, 16 bp, Artificial Sequence
  synthetic [barcode part1]
cagtgattgtaggaac

SEQ ID NO: 8938 - DNA, 16 bp, Artificial Sequence
  synthetic [barcode part1]
tgttactgtgaggtgc

SEQ ID NO: 8939 - DNA, 16 bp, Artificial Sequence
  synthetic [barcode part1]
tggttccaggatcaac

SEQ ID NO: 8940 - DNA, 16 bp, Artificial Sequence
  synthetic [barcode part1]
tcgattcagtgtgtct

SEQ ID NO: 8941 - DNA, 16 bp, Artificial Sequence
  synthetic [barcode part1]
gttcagatatcactcc

SEQ ID NO: 8942 - DNA, 16 bp, Artificial Sequence
  synthetic [barcode part1]
gatactctcgtgcaag

SEQ ID NO: 8943 - DNA, 16 bp, Artificial Sequence
  synthetic [barcode part1]
taaggaatcggtcctc

SEQ ID NO: 8944 - DNA, 16 bp, Artificial Sequence
  synthetic [barcode part1]
ttcgttggtcaggagt

SEQ ID NO: 8945 - DNA, 16 bp, Artificial Sequence
  synthetic [barcode part1]
tccaagttccaattcg

SEQ ID NO: 8946 - DNA, 16 bp, Artificial Sequence
  synthetic [barcode part1]
gaagttacgactcctg

SEQ ID NO: 8947 - DNA, 16 bp, Artificial Sequence
  synthetic [barcode part1]
agtcggtgcgtatact

SEQ ID NO: 8948 - DNA, 16 bp, Artificial Sequence
  synthetic [barcode part1]
atctagacactgtcct

SEQ ID NO: 8949 - DNA, 16 bp, Artificial Sequence
  synthetic [barcode part1]
tacgacaggcggatac

SEQ ID NO: 8950 - DNA, 16 bp, Artificial Sequence
  synthetic [barcode part1]
acacgttacaaccacg

SEQ ID NO: 8951 - DNA, 16 bp, Artificial Sequence
  synthetic [barcode part1]
cagacgactattcacg

SEQ ID NO: 8952 - DNA, 16 bp, Artificial Sequence
  synthetic [barcode part1]
atctatcctcgtccac

SEQ ID NO: 8953 - DNA, 16 bp, Artificial Sequence
  synthetic [barcode part1]
cggcctatccaataag

SEQ ID NO: 8954 - DNA, 16 bp, Artificial Sequence
  synthetic [barcode part1]
gtgacagacagagtag

SEQ ID NO: 8955 - DNA, 16 bp, Artificial Sequence
  synthetic [barcode part1]
gcctctattactagac

SEQ ID NO: 8956 - DNA, 16 bp, Artificial Sequence
  synthetic [barcode part1]
aggtgactgactcttg

SEQ ID NO: 8957 - DNA, 16 bp, Artificial Sequence
  synthetic [barcode part1]
ttagacgcctatcgcc

SEQ ID NO: 8958 - DNA, 16 bp, Artificial Sequence
  synthetic [barcode part1]
ataggccaaccgtact

SEQ ID NO: 8959 - DNA, 16 bp, Artificial Sequence
  synthetic [barcode part1]
tcggtctctcaatctc

SEQ ID NO: 8960 - DNA, 16 bp, Artificial Sequence
  synthetic [barcode part1]
cggtaattgtgagaac

SEQ ID NO: 8961 - DNA, 16 bp, Artificial Sequence
  synthetic [barcode part1]
cgatctaggcgtgaag

SEQ ID NO: 8962 - DNA, 16 bp, Artificial Sequence
  synthetic [barcode part1]
ttgacctctgtcacct

SEQ ID NO: 8963 - DNA, 16 bp, Artificial Sequence
  synthetic [barcode part1]
cgattcaagacacaag

SEQ ID NO: 8964 - DNA, 16 bp, Artificial Sequence
  synthetic [barcode part1]
tagtcggtaaccgact

SEQ ID NO: 8965 - DNA, 16 bp, Artificial Sequence
  synthetic [barcode part1]
gaattgcgtctgacac

SEQ ID NO: 8966 - DNA, 16 bp, Artificial Sequence
  synthetic [barcode part1]
attgcactgtaccgag

SEQ ID NO: 8967 - DNA, 16 bp, Artificial Sequence
  synthetic [barcode part1]
caccacttcacacgac

SEQ ID NO: 8968 - DNA, 16 bp, Artificial Sequence
  synthetic [barcode part1]
ttctctccgaccaatc

SEQ ID NO: 8969 - DNA, 16 bp, Artificial Sequence
  synthetic [barcode part1]
gactgagagtgacaag

SEQ ID NO: 8970 - DNA, 16 bp, Artificial Sequence
  synthetic [barcode part1]
gtgagtggaacctcag

SEQ ID NO: 8971 - DNA, 16 bp, Artificial Sequence
  synthetic [barcode part1]
ccttgactgcactgac

SEQ ID NO: 8972 - DNA, 16 bp, Artificial Sequence
  synthetic [barcode part1]
acgacagacttggacg

SEQ ID NO: 8973 - DNA, 16 bp, Artificial Sequence
  synthetic [barcode part1]
tgaacgtgtcagaggc

SEQ ID NO: 8974 - DNA, 16 bp, Artificial Sequence
  synthetic [barcode part1]
cgacggccgtattctt

SEQ ID NO: 8975 - DNA, 16 bp, Artificial Sequence
  synthetic [barcode part1]
tcttgccgaactcacg

SEQ ID NO: 8976 - DNA, 16 bp, Artificial Sequence
  synthetic [barcode part1]
gagtagataccacagt

SEQ ID NO: 8977 - DNA, 16 bp, Artificial Sequence
  synthetic [barcode part1]
atcgtccgagtaacac

SEQ ID NO: 8978 - DNA, 16 bp, Artificial Sequence
  synthetic [barcode part1]
tgtcaagtacttccac

SEQ ID NO: 8979 - DNA, 16 bp, Artificial Sequence
  synthetic [barcode part1]
gatcggaaccttctag

SEQ ID NO: 8980 - DNA, 16 bp, Artificial Sequence
  synthetic [barcode part1]
atcagtcaagactccg

SEQ ID NO: 8981 - DNA, 16 bp, Artificial Sequence
  synthetic [barcode part1]
gttaccacctcgtacg

SEQ ID NO: 8982 - DNA, 16 bp, Artificial Sequence
  synthetic [barcode part1]
ttagtctacggccgtc

SEQ ID NO: 8983 - DNA, 16 bp, Artificial Sequence
  synthetic [barcode part1]
tattctggacggaacc

SEQ ID NO: 8984 - DNA, 16 bp, Artificial Sequence
  synthetic [barcode part1]
tacttcaagacggcac

SEQ ID NO: 8985 - DNA, 16 bp, Artificial Sequence
  synthetic [barcode part1]
acagaaggcactcctt

SEQ ID NO: 8986 - DNA, 16 bp, Artificial Sequence
  synthetic [barcode part1]
cgcgacgttataacgt

SEQ ID NO: 8987 - DNA, 16 bp, Artificial Sequence
  synthetic [barcode part1]
ttactaaccttacgcg

SEQ ID NO: 8988 - DNA, 16 bp, Artificial Sequence
  synthetic [barcode part1]
tatataggttcctcgc

SEQ ID NO: 8989 - DNA, 16 bp, Artificial Sequence
  synthetic [barcode part1]
gtggtcacaactgtgt

SEQ ID NO: 8990 - DNA, 16 bp, Artificial Sequence
  synthetic [barcode part1]
ttgccgtaggtctgtc

SEQ ID NO: 8991 - DNA, 16 bp, Artificial Sequence
  synthetic [barcode part1]
gcagtgaattcaagtg

SEQ ID NO: 8992 - DNA, 16 bp, Artificial Sequence
  synthetic [barcode part1]
gagaggcgaattaggt

SEQ ID NO: 8993 - DNA, 16 bp, Artificial Sequence
  synthetic [barcode part1]
gtcgtcgtagtaatcg

SEQ ID NO: 8994 - DNA, 16 bp, Artificial Sequence
  synthetic [barcode part1]
gaatagactcacctgc

SEQ ID NO: 8995 - DNA, 16 bp, Artificial Sequence
  synthetic [barcode part1]
cgagatctgtgacact

SEQ ID NO: 8996 - DNA, 16 bp, Artificial Sequence
  synthetic [barcode part1]
tgatcgagatcagtcc

SEQ ID NO: 8997 - DNA, 16 bp, Artificial Sequence
  synthetic [barcode part1]
ttagacacctggacgt

SEQ ID NO: 8998 - DNA, 16 bp, Artificial Sequence
  synthetic [barcode part1]
tacggcgttgtagtac

SEQ ID NO: 8999 - DNA, 16 bp, Artificial Sequence
  synthetic [barcode part1]
agagtggtaaggcaac

SEQ ID NO: 9000 - DNA, 16 bp, Artificial Sequence
  synthetic [barcode part1]
taccaccgtagagtac

SEQ ID NO: 9001 - DNA, 16 bp, Artificial Sequence
  synthetic [barcode part1]
agtgcgcgttgatatc

SEQ ID NO: 9002 - DNA, 16 bp, Artificial Sequence
  synthetic [barcode part1]
gtcagagactagtgcg

SEQ ID NO: 9003 - DNA, 16 bp, Artificial Sequence
  synthetic [barcode part1]
tctgtataggacacgc

SEQ ID NO: 9004 - DNA, 16 bp, Artificial Sequence
  synthetic [barcode part1]
atcctgagtacacgtg

SEQ ID NO: 9005 - DNA, 16 bp, Artificial Sequence
  synthetic [barcode part1]
tcaacacttctggttg

SEQ ID NO: 9006 - DNA, 16 bp, Artificial Sequence
  synthetic [barcode part1]
accgtgatctatctgt

SEQ ID NO: 9007 - DNA, 16 bp, Artificial Sequence
  synthetic [barcode part1]
gcagttgcaacacgtt

SEQ ID NO: 9008 - DNA, 16 bp, Artificial Sequence
  synthetic [barcode part1]
aattgcgaggatcggc

SEQ ID NO: 9009 - DNA, 16 bp, Artificial Sequence
  synthetic [barcode part1]
atacgaacctgtgtcg

SEQ ID NO: 9010 - DNA, 16 bp, Artificial Sequence
  synthetic [barcode part1]
gtctacctgtctgttc

SEQ ID NO: 9011 - DNA, 16 bp, Artificial Sequence
  synthetic [barcode part1]
ttggacgtgtctaggt

SEQ ID NO: 9012 - DNA, 16 bp, Artificial Sequence
  synthetic [barcode part1]
caacacactgagtacc

SEQ ID NO: 9013 - DNA, 16 bp, Artificial Sequence
  synthetic [barcode part1]
gcaagttgcacctaac

SEQ ID NO: 9014 - DNA, 16 bp, Artificial Sequence
  synthetic [barcode part1]
gactagtgtcgtgatc

SEQ ID NO: 9015 - DNA, 16 bp, Artificial Sequence
  synthetic [barcode part1]
gaaccgtacagtctgt

SEQ ID NO: 9016 - DNA, 16 bp, Artificial Sequence
  synthetic [barcode part1]
cgaagaatacggccgt

SEQ ID NO: 9017 - DNA, 16 bp, Artificial Sequence
  synthetic [barcode part1]
gataacctaatccggc

SEQ ID NO: 9018 - DNA, 16 bp, Artificial Sequence
  synthetic [barcode part1]
cacgagtaggtctgtt

SEQ ID NO: 9019 - DNA, 16 bp, Artificial Sequence
  synthetic [barcode part1]
gagtgtcctacaggtt

SEQ ID NO: 9020 - DNA, 16 bp, Artificial Sequence
  synthetic [barcode part1]
agacggttcctatcag

SEQ ID NO: 9021 - DNA, 16 bp, Artificial Sequence
  synthetic [barcode part1]
gacgtcgaacttcaac

SEQ ID NO: 9022 - DNA, 16 bp, Artificial Sequence
  synthetic [barcode part1]
acttcgccgaatccac

SEQ ID NO: 9023 - DNA, 16 bp, Artificial Sequence
  synthetic [barcode part1]
aaccggaagatcagag

SEQ ID NO: 9024 - DNA, 16 bp, Artificial Sequence
  synthetic [barcode part1]
ttaatactggcgcacg

SEQ ID NO: 9025 - DNA, 16 bp, Artificial Sequence
  synthetic [barcode part1]
tgactacggtgtatcg

SEQ ID NO: 9026 - DNA, 16 bp, Artificial Sequence
  synthetic [barcode part1]
aattgtacggtgcacc

SEQ ID NO: 9027 - DNA, 16 bp, Artificial Sequence
  synthetic [barcode part1]
acttatacctccagtg

SEQ ID NO: 9028 - DNA, 16 bp, Artificial Sequence
  synthetic [barcode part1]
tccgactacacgtcac

SEQ ID NO: 9029 - DNA, 16 bp, Artificial Sequence
  synthetic [barcode part1]
gcgataccttctcctt

SEQ ID NO: 9030 - DNA, 16 bp, Artificial Sequence
  synthetic [barcode part1]
gacttaggtcggattc

SEQ ID NO: 9031 - DNA, 16 bp, Artificial Sequence
  synthetic [barcode part1]
ccaattcctgcacggt

SEQ ID NO: 9032 - DNA, 16 bp, Artificial Sequence
  synthetic [barcode part1]
cctcttcgaaggaagt

SEQ ID NO: 9033 - DNA, 16 bp, Artificial Sequence
  synthetic [barcode part1]
gaattccttcctctcg

SEQ ID NO: 9034 - DNA, 16 bp, Artificial Sequence
  synthetic [barcode part1]
atctccagtctggcgt

SEQ ID NO: 9035 - DNA, 16 bp, Artificial Sequence
  synthetic [barcode part1]
attgacgtgtcctgcc

SEQ ID NO: 9036 - DNA, 16 bp, Artificial Sequence
  synthetic [barcode part1]
cgcgccgattatatag

SEQ ID NO: 9037 - DNA, 16 bp, Artificial Sequence
  synthetic [barcode part1]
agtacaagacgatctg

SEQ ID NO: 9038 - DNA, 16 bp, Artificial Sequence
  synthetic [barcode part1]
ttgaacaacggtgagt

SEQ ID NO: 9039 - DNA, 16 bp, Artificial Sequence
  synthetic [barcode part1]
accactacgcagagag

SEQ ID NO: 9040 - DNA, 16 bp, Artificial Sequence
  synthetic [barcode part1]
tgcgtattggcgttag

SEQ ID NO: 9041 - DNA, 16 bp, Artificial Sequence
  synthetic [barcode part1]
tggcggttgtatcctc

SEQ ID NO: 9042 - DNA, 16 bp, Artificial Sequence
  synthetic [barcode part1]
acggactgttggaggt

SEQ ID NO: 9043 - DNA, 16 bp, Artificial Sequence
  synthetic [barcode part1]
acacttgttgccttag

SEQ ID NO: 9044 - DNA, 16 bp, Artificial Sequence
  synthetic [barcode part1]
cactagtgattcttcg

SEQ ID NO: 9045 - DNA, 16 bp, Artificial Sequence
  synthetic [barcode part1]
tacagtagtctgcctt

SEQ ID NO: 9046 - DNA, 16 bp, Artificial Sequence
  synthetic [barcode part1]
gttaataggcgacggc

SEQ ID NO: 9047 - DNA, 16 bp, Artificial Sequence
  synthetic [barcode part1]
aattaggtctacggag

SEQ ID NO: 9048 - DNA, 16 bp, Artificial Sequence
  synthetic [barcode part1]
aataggttaggactcg

SEQ ID NO: 9049 - DNA, 16 bp, Artificial Sequence
  synthetic [barcode part1]
cacactacaatcgcag

SEQ ID NO: 9050 - DNA, 16 bp, Artificial Sequence
  synthetic [barcode part1]
gagtccaacctagact

SEQ ID NO: 9051 - DNA, 16 bp, Artificial Sequence
  synthetic [barcode part1]
aggtctacgtctcacc

SEQ ID NO: 9052 - DNA, 16 bp, Artificial Sequence
  synthetic [barcode part1]
gagtaggatcttagac

SEQ ID NO: 9053 - DNA, 16 bp, Artificial Sequence
  synthetic [barcode part1]
gcgtgaactcaataag

SEQ ID NO: 9054 - DNA, 16 bp, Artificial Sequence
  synthetic [barcode part1]
ttctggcgattcacgc

SEQ ID NO: 9055 - DNA, 16 bp, Artificial Sequence
  synthetic [barcode part1]
cgtcgtgtacaatacg

SEQ ID NO: 9056 - DNA, 16 bp, Artificial Sequence
  synthetic [barcode part1]
atagtcaaccacgcgt

SEQ ID NO: 9057 - DNA, 16 bp, Artificial Sequence
  synthetic [barcode part1]
atagaagttgacgacc

SEQ ID NO: 9058 - DNA, 16 bp, Artificial Sequence
  synthetic [barcode part1]
attgttccgttgcctc

SEQ ID NO: 9059 - DNA, 16 bp, Artificial Sequence
  synthetic [barcode part1]
tgtctccgatccaacg

SEQ ID NO: 9060 - DNA, 16 bp, Artificial Sequence
  synthetic [barcode part1]
caggacaagactgaag

SEQ ID NO: 9061 - DNA, 16 bp, Artificial Sequence
  synthetic [barcode part1]
accgattctcttctcg

SEQ ID NO: 9062 - DNA, 16 bp, Artificial Sequence
  synthetic [barcode part1]
ataacacgcgcacgtt

SEQ ID NO: 9063 - DNA, 16 bp, Artificial Sequence
  synthetic [barcode part1]
gagacaccgataaccg

SEQ ID NO: 9064 - DNA, 16 bp, Artificial Sequence
  synthetic [barcode part1]
actaaccggttagtcg

SEQ ID NO: 9065 - DNA, 16 bp, Artificial Sequence
  synthetic [barcode part1]
tctggtccggtgtatc

SEQ ID NO: 9066 - DNA, 16 bp, Artificial Sequence
  synthetic [barcode part1]
cagaattgtgtcgcgt

SEQ ID NO: 9067 - DNA, 16 bp, Artificial Sequence
  synthetic [barcode part1]
gacctctaatcgtatc

SEQ ID NO: 9068 - DNA, 16 bp, Artificial Sequence
  synthetic [barcode part1]
tgccggacctatatcc

SEQ ID NO: 9069 - DNA, 16 bp, Artificial Sequence
  synthetic [barcode part1]
cgatatctgaggtctg

SEQ ID NO: 9070 - DNA, 16 bp, Artificial Sequence
  synthetic [barcode part1]
gttgtgtccaagtacg

SEQ ID NO: 9071 - DNA, 16 bp, Artificial Sequence
  synthetic [barcode part1]
tctgcaattgtaggcg

SEQ ID NO: 9072 - DNA, 16 bp, Artificial Sequence
  synthetic [barcode part1]
ttggaacaggttccac

SEQ ID NO: 9073 - DNA, 16 bp, Artificial Sequence
  synthetic [barcode part1]
agatattactccgtcc

SEQ ID NO: 9074 - DNA, 16 bp, Artificial Sequence
  synthetic [barcode part1]
aacgatctcagtgacc

SEQ ID NO: 9075 - DNA, 16 bp, Artificial Sequence
  synthetic [barcode part1]
tataggcaggcaatac

SEQ ID NO: 9076 - DNA, 16 bp, Artificial Sequence
  synthetic [barcode part1]
cacagatctcactatc

SEQ ID NO: 9077 - DNA, 16 bp, Artificial Sequence
  synthetic [barcode part1]
ccagaatataggtgac

SEQ ID NO: 9078 - DNA, 16 bp, Artificial Sequence
  synthetic [barcode part1]
cctagagaggatctct

SEQ ID NO: 9079 - DNA, 16 bp, Artificial Sequence
  synthetic [barcode part1]
gcaagaatcgaactgt

SEQ ID NO: 9080 - DNA, 16 bp, Artificial Sequence
  synthetic [barcode part1]
ccacacttaccttcac

SEQ ID NO: 9081 - DNA, 16 bp, Artificial Sequence
  synthetic [barcode part1]
ttgacgatactctcac

SEQ ID NO: 9082 - DNA, 16 bp, Artificial Sequence
  synthetic [barcode part1]
ataccttccttcgtgc

SEQ ID NO: 9083 - DNA, 16 bp, Artificial Sequence
  synthetic [barcode part1]
ttgaacgatctacggc

SEQ ID NO: 9084 - DNA, 16 bp, Artificial Sequence
  synthetic [barcode part1]
aagaggcacaactatc

SEQ ID NO: 9085 - DNA, 16 bp, Artificial Sequence
  synthetic [barcode part1]
aaccgatccggttaac

SEQ ID NO: 9086 - DNA, 16 bp, Artificial Sequence
  synthetic [barcode part1]
tggtgtactctatcac

SEQ ID NO: 9087 - DNA, 16 bp, Artificial Sequence
  synthetic [barcode part1]
tcgtcgtacggattcc

SEQ ID NO: 9088 - DNA, 16 bp, Artificial Sequence
  synthetic [barcode part1]
gttagacaggttgtcc

SEQ ID NO: 9089 - DNA, 16 bp, Artificial Sequence
  synthetic [barcode part1]
cctgtgtgtcactgac

SEQ ID NO: 9090 - DNA, 16 bp, Artificial Sequence
  synthetic [barcode part1]
ccgcactcttgtatct

SEQ ID NO: 9091 - DNA, 16 bp, Artificial Sequence
  synthetic [barcode part1]
gagtatcgagtggtgc

SEQ ID NO: 9092 - DNA, 16 bp, Artificial Sequence
  synthetic [barcode part1]
cagatcagtgcaggac

SEQ ID NO: 9093 - DNA, 16 bp, Artificial Sequence
  synthetic [barcode part1]
cgttcaagattgcgtg

SEQ ID NO: 9094 - DNA, 16 bp, Artificial Sequence
  synthetic [barcode part1]
ccaccgtaacgagatt

SEQ ID NO: 9095 - DNA, 16 bp, Artificial Sequence
  synthetic [barcode part1]
gcgtctctaacctggt

SEQ ID NO: 9096 - DNA, 16 bp, Artificial Sequence
  synthetic [barcode part1]
gtctgcgtgtattgag

SEQ ID NO: 9097 - DNA, 16 bp, Artificial Sequence
  synthetic [barcode part1]
cgattccaatcaaggc

SEQ ID NO: 9098 - DNA, 16 bp, Artificial Sequence
  synthetic [barcode part1]
cagttccagttgagac

SEQ ID NO: 9099 - DNA, 16 bp, Artificial Sequence
  synthetic [barcode part1]
cgcgcctataactcac

SEQ ID NO: 9100 - DNA, 16 bp, Artificial Sequence
  synthetic [barcode part1]
gaggcgcgactattag

SEQ ID NO: 9101 - DNA, 16 bp, Artificial Sequence
  synthetic [barcode part1]
tatccgcagatcttac

SEQ ID NO: 9102 - DNA, 16 bp, Artificial Sequence
  synthetic [barcode part1]
gtctgtcttcggaacc

SEQ ID NO: 9103 - DNA, 16 bp, Artificial Sequence
  synthetic [barcode part1]
tccaccacgtatcgac

SEQ ID NO: 9104 - DNA, 16 bp, Artificial Sequence
  synthetic [barcode part1]
gacaagagtacgatct

SEQ ID NO: 9105 - DNA, 16 bp, Artificial Sequence
  synthetic [barcode part1]
atcacctcgttcaagt

SEQ ID NO: 9106 - DNA, 16 bp, Artificial Sequence
  synthetic [barcode part1]
gtgagagaactgccac

SEQ ID NO: 9107 - DNA, 16 bp, Artificial Sequence
  synthetic [barcode part1]
atcggagagaatcgag

SEQ ID NO: 9108 - DNA, 16 bp, Artificial Sequence
  synthetic [barcode part1]
caatcctcttctcggt

SEQ ID NO: 9109 - DNA, 16 bp, Artificial Sequence
  synthetic [barcode part1]
gcaacttgtccagtag

SEQ ID NO: 9110 - DNA, 16 bp, Artificial Sequence
  synthetic [barcode part1]
cgcgttcttgccaagt

SEQ ID NO: 9111 - DNA, 16 bp, Artificial Sequence
  synthetic [barcode part1]
ttggatagacggaact

SEQ ID NO: 9112 - DNA, 16 bp, Artificial Sequence
  synthetic [barcode part1]
gaccgacgttagttac

SEQ ID NO: 9113 - DNA, 16 bp, Artificial Sequence
  synthetic [barcode part1]
cgtacgcactataacg

SEQ ID NO: 9114 - DNA, 16 bp, Artificial Sequence
  synthetic [barcode part1]
cacaccttagaccacc

SEQ ID NO: 9115 - DNA, 16 bp, Artificial Sequence
  synthetic [barcode part1]
gaatacacgcaccttg

SEQ ID NO: 9116 - DNA, 16 bp, Artificial Sequence
  synthetic [barcode part1]
aagtaaccgtgtcaag

SEQ ID NO: 9117 - DNA, 16 bp, Artificial Sequence
  synthetic [barcode part1]
gatcacgttagtcctt

SEQ ID NO: 9118 - DNA, 16 bp, Artificial Sequence
  synthetic [barcode part1]
tgtagaacggcgatcg

SEQ ID NO: 9119 - DNA, 16 bp, Artificial Sequence
  synthetic [barcode part1]
aattaggaacggcgag

SEQ ID NO: 9120 - DNA, 16 bp, Artificial Sequence
  synthetic [barcode part1]
tcacacttaccaggtt

SEQ ID NO: 9121 - DNA, 16 bp, Artificial Sequence
  synthetic [barcode part1]
cacttgatagtcttcg

SEQ ID NO: 9122 - DNA, 16 bp, Artificial Sequence
  synthetic [barcode part1]
aaggacgatagttcac

SEQ ID NO: 9123 - DNA, 16 bp, Artificial Sequence
  synthetic [barcode part1]
ttaccttgattgcacg

SEQ ID NO: 9124 - DNA, 16 bp, Artificial Sequence
  synthetic [barcode part1]
tacgaacgtgagttcc

SEQ ID NO: 9125 - DNA, 16 bp, Artificial Sequence
  synthetic [barcode part1]
ttcaaggccttaggac

SEQ ID NO: 9126 - DNA, 16 bp, Artificial Sequence
  synthetic [barcode part1]
acttgcctcgcgatac

SEQ ID NO: 9127 - DNA, 16 bp, Artificial Sequence
  synthetic [barcode part1]
tccgtacgttgttaac

SEQ ID NO: 9128 - DNA, 16 bp, Artificial Sequence
  synthetic [barcode part1]
caccaggcctatactc

SEQ ID NO: 9129 - DNA, 16 bp, Artificial Sequence
  synthetic [barcode part1]
gttgcaagtccactcc

SEQ ID NO: 9130 - DNA, 16 bp, Artificial Sequence
  synthetic [barcode part1]
acaagtcgccgttctc

SEQ ID NO: 9131 - DNA, 16 bp, Artificial Sequence
  synthetic [barcode part1]
cacgagaagttactag

SEQ ID NO: 9132 - DNA, 16 bp, Artificial Sequence
  synthetic [barcode part1]
tctaaccaccagtact

SEQ ID NO: 9133 - DNA, 16 bp, Artificial Sequence
  synthetic [barcode part1]
agagtcgagagtagtg

SEQ ID NO: 9134 - DNA, 16 bp, Artificial Sequence
  synthetic [barcode part1]
caaggactagagacag

SEQ ID NO: 9135 - DNA, 16 bp, Artificial Sequence
  synthetic [barcode part1]
cagaatcacgcgtatc

SEQ ID NO: 9136 - DNA, 16 bp, Artificial Sequence
  synthetic [barcode part1]
gtctctcaccgtacag

SEQ ID NO: 9137 - DNA, 16 bp, Artificial Sequence
  synthetic [barcode part1]
tggaccaacacctcct

SEQ ID NO: 9138 - DNA, 16 bp, Artificial Sequence
  synthetic [barcode part1]
attacggactcacttc

SEQ ID NO: 9139 - DNA, 16 bp, Artificial Sequence
  synthetic [barcode part1]
cgtgaaggttattgag

SEQ ID NO: 9140 - DNA, 16 bp, Artificial Sequence
  synthetic [barcode part1]
cctctactattaggtg

SEQ ID NO: 9141 - DNA, 16 bp, Artificial Sequence
  synthetic [barcode part1]
tcgagatccgcaatac

SEQ ID NO: 9142 - DNA, 16 bp, Artificial Sequence
  synthetic [barcode part1]
gaacctgacttggact

SEQ ID NO: 9143 - DNA, 16 bp, Artificial Sequence
  synthetic [barcode part1]
gaaccgttgagtcact

SEQ ID NO: 9144 - DNA, 16 bp, Artificial Sequence
  synthetic [barcode part1]
attgaacggcgatcct

SEQ ID NO: 9145 - DNA, 16 bp, Artificial Sequence
  synthetic [barcode part1]
aagatcacggtggaag

SEQ ID NO: 9146 - DNA, 16 bp, Artificial Sequence
  synthetic [barcode part1]
cgcacagacttctcac

SEQ ID NO: 9147 - DNA, 16 bp, Artificial Sequence
  synthetic [barcode part1]
cgagtgtgatctgtgt

SEQ ID NO: 9148 - DNA, 16 bp, Artificial Sequence
  synthetic [barcode part1]
cgcgtaagtaaccgtt

SEQ ID NO: 9149 - DNA, 16 bp, Artificial Sequence
  synthetic [barcode part1]
gaaggactaagaggtc

SEQ ID NO: 9150 - DNA, 16 bp, Artificial Sequence
  synthetic [barcode part1]
taacaacggaggtact

SEQ ID NO: 9151 - DNA, 16 bp, Artificial Sequence
  synthetic [barcode part1]
ttgatcgacgtcgtag

SEQ ID NO: 9152 - DNA, 16 bp, Artificial Sequence
  synthetic [barcode part1]
cctacaattgcgagtg

SEQ ID NO: 9153 - DNA, 16 bp, Artificial Sequence
  synthetic [barcode part1]
tgagttcacctcaccg

SEQ ID NO: 9154 - DNA, 16 bp, Artificial Sequence
  synthetic [barcode part1]
cgaatctagacggcag

SEQ ID NO: 9155 - DNA, 16 bp, Artificial Sequence
  synthetic [barcode part1]
tgcggtaacttgtctt

SEQ ID NO: 9156 - DNA, 16 bp, Artificial Sequence
  synthetic [barcode part1]
tgaactcgaatctgcg

SEQ ID NO: 9157 - DNA, 16 bp, Artificial Sequence
  synthetic [barcode part1]
ttgccgtgaactcacc

SEQ ID NO: 9158 - DNA, 16 bp, Artificial Sequence
  synthetic [barcode part1]
tggtgttaacggatag

SEQ ID NO: 9159 - DNA, 16 bp, Artificial Sequence
  synthetic [barcode part1]
atctgtgtgactcttg

SEQ ID NO: 9160 - DNA, 16 bp, Artificial Sequence
  synthetic [barcode part1]
gagatcctgtctatct

SEQ ID NO: 9161 - DNA, 16 bp, Artificial Sequence
  synthetic [barcode part1]
gttggttcgtaacgtg

SEQ ID NO: 9162 - DNA, 16 bp, Artificial Sequence
  synthetic [barcode part1]
gtctgtcttatccgtc

SEQ ID NO: 9163 - DNA, 16 bp, Artificial Sequence
  synthetic [barcode part1]
acctgtctcacttgtc

SEQ ID NO: 9164 - DNA, 16 bp, Artificial Sequence
  synthetic [barcode part1]
tcttctcgtatcgcac

SEQ ID NO: 9165 - DNA, 16 bp, Artificial Sequence
  synthetic [barcode part1]
tgcaagttaccacttc

SEQ ID NO: 9166 - DNA, 16 bp, Artificial Sequence
  synthetic [barcode part1]
accgtctcttgttacc

SEQ ID NO: 9167 - DNA, 16 bp, Artificial Sequence
  synthetic [barcode part1]
actcctccgtacaacg

SEQ ID NO: 9168 - DNA, 16 bp, Artificial Sequence
  synthetic [barcode part1]
gaggtaagttcgtagt

SEQ ID NO: 9169 - DNA, 16 bp, Artificial Sequence
  synthetic [barcode part1]
ccttaatcacaccaac

SEQ ID NO: 9170 - DNA, 16 bp, Artificial Sequence
  synthetic [barcode part1]
gcacacaggagttctt

SEQ ID NO: 9171 - DNA, 16 bp, Artificial Sequence
  synthetic [barcode part1]
gatctggtgtattcct

SEQ ID NO: 9172 - DNA, 16 bp, Artificial Sequence
  synthetic [barcode part1]
tgacgatcgatagtcc

SEQ ID NO: 9173 - DNA, 16 bp, Artificial Sequence
  synthetic [barcode part1]
cagtagttcaacggtc

SEQ ID NO: 9174 - DNA, 16 bp, Artificial Sequence
  synthetic [barcode part1]
gcgattgaggattagt

SEQ ID NO: 9175 - DNA, 16 bp, Artificial Sequence
  synthetic [barcode part1]
acgattaagtcctcct

SEQ ID NO: 9176 - DNA, 16 bp, Artificial Sequence
  synthetic [barcode part1]
aactctcggtcgtatt

SEQ ID NO: 9177 - DNA, 16 bp, Artificial Sequence
  synthetic [barcode part1]
tgtaccttgtctccgt

SEQ ID NO: 9178 - DNA, 16 bp, Artificial Sequence
  synthetic [barcode part1]
tggatcttaggcactg

SEQ ID NO: 9179 - DNA, 16 bp, Artificial Sequence
  synthetic [barcode part1]
tctagtcttggcctct

SEQ ID NO: 9180 - DNA, 16 bp, Artificial Sequence
  synthetic [barcode part1]
gtccgactgtacttcg

SEQ ID NO: 9181 - DNA, 16 bp, Artificial Sequence
  synthetic [barcode part1]
tcggaactctacttgt

SEQ ID NO: 9182 - DNA, 16 bp, Artificial Sequence
  synthetic [barcode part1]
ccaagataggcgagtc

SEQ ID NO: 9183 - DNA, 16 bp, Artificial Sequence
  synthetic [barcode part1]
tagtacaacgcgacct

SEQ ID NO: 9184 - DNA, 16 bp, Artificial Sequence
  synthetic [barcode part1]
tcgcctagacgaatac

SEQ ID NO: 9185 - DNA, 16 bp, Artificial Sequence
  synthetic [barcode part1]
atcacgacctgtctgc

SEQ ID NO: 9186 - DNA, 16 bp, Artificial Sequence
  synthetic [barcode part1]
tccaccgtgtaggtct

SEQ ID NO: 9187 - DNA, 16 bp, Artificial Sequence
  synthetic [barcode part1]
gaccagtgccgtaatt

SEQ ID NO: 9188 - DNA, 16 bp, Artificial Sequence
  synthetic [barcode part1]
tgacgttggactctag

SEQ ID NO: 9189 - DNA, 16 bp, Artificial Sequence
  synthetic [barcode part1]
gtaggagaaccgttgc

SEQ ID NO: 9190 - DNA, 16 bp, Artificial Sequence
  synthetic [barcode part1]
tccaagtcgttctgcg

SEQ ID NO: 9191 - DNA, 16 bp, Artificial Sequence
  synthetic [barcode part1]
atcaccacaacggttg

SEQ ID NO: 9192 - DNA, 16 bp, Artificial Sequence
  synthetic [barcode part1]
gttaattgccgaccag

SEQ ID NO: 9193 - DNA, 16 bp, Artificial Sequence
  synthetic [barcode part1]
actgcgacttgagact

SEQ ID NO: 9194 - DNA, 16 bp, Artificial Sequence
  synthetic [barcode part1]
cctctgttagattgtg

SEQ ID NO: 9195 - DNA, 16 bp, Artificial Sequence
  synthetic [barcode part1]
gcctctgcaggttact

SEQ ID NO: 9196 - DNA, 16 bp, Artificial Sequence
  synthetic [barcode part1]
cctacaccagtctgac

SEQ ID NO: 9197 - DNA, 16 bp, Artificial Sequence
  synthetic [barcode part1]
ttgtctacgtctgtcc

SEQ ID NO: 9198 - DNA, 16 bp, Artificial Sequence
  synthetic [barcode part1]
cacacaggacaacggt

SEQ ID NO: 9199 - DNA, 16 bp, Artificial Sequence
  synthetic [barcode part1]
ttggcagatagtccgt

SEQ ID NO: 9200 - DNA, 16 bp, Artificial Sequence
  synthetic [barcode part1]
cgtcaggtaaggacac

SEQ ID NO: 9201 - DNA, 16 bp, Artificial Sequence
  synthetic [barcode part1]
tgaccaagtacgtacc

SEQ ID NO: 9202 - DNA, 16 bp, Artificial Sequence
  synthetic [barcode part1]
ccacttacgaagtctt

SEQ ID NO: 9203 - DNA, 16 bp, Artificial Sequence
  synthetic [barcode part1]
cacaaggtcaagttag

SEQ ID NO: 9204 - DNA, 16 bp, Artificial Sequence
  synthetic [barcode part1]
gagactccttggaact

SEQ ID NO: 9205 - DNA, 16 bp, Artificial Sequence
  synthetic [barcode part1]
gcgtagttaactgcgt

SEQ ID NO: 9206 - DNA, 16 bp, Artificial Sequence
  synthetic [barcode part1]
tcctccaggtgataag

SEQ ID NO: 9207 - DNA, 16 bp, Artificial Sequence
  synthetic [barcode part1]
tacagtctcagtgcag

SEQ ID NO: 9208 - DNA, 16 bp, Artificial Sequence
  synthetic [barcode part1]
gttagtgcaccttatc

SEQ ID NO: 9209 - DNA, 16 bp, Artificial Sequence
  synthetic [barcode part1]
tcttcaacgacacgcc

SEQ ID NO: 9210 - DNA, 16 bp, Artificial Sequence
  synthetic [barcode part1]
ccggacgagatctatt

SEQ ID NO: 9211 - DNA, 16 bp, Artificial Sequence
  synthetic [barcode part1]
agtgcgttgattgcgt

SEQ ID NO: 9212 - DNA, 16 bp, Artificial Sequence
  synthetic [barcode part1]
agtcaacggttgactc

SEQ ID NO: 9213 - DNA, 16 bp, Artificial Sequence
  synthetic [barcode part1]
cacgcagttattgttc

SEQ ID NO: 9214 - DNA, 16 bp, Artificial Sequence
  synthetic [barcode part1]
gtaacctgtctccgtg

SEQ ID NO: 9215 - DNA, 16 bp, Artificial Sequence
  synthetic [barcode part1]
aatcgtctctacgttg

SEQ ID NO: 9216 - DNA, 16 bp, Artificial Sequence
  synthetic [barcode part1]
cgttctgacctacgac

SEQ ID NO: 9217 - DNA, 16 bp, Artificial Sequence
  synthetic [barcode part1]
cgattcctagtgtgcc

SEQ ID NO: 9218 - DNA, 16 bp, Artificial Sequence
  synthetic [barcode part1]
ttccacggagagtatc

SEQ ID NO: 9219 - DNA, 16 bp, Artificial Sequence
  synthetic [barcode part1]
gatatattacggccgc

SEQ ID NO: 9220 - DNA, 16 bp, Artificial Sequence
  synthetic [barcode part1]
ccgccaaggttattag

SEQ ID NO: 9221 - DNA, 16 bp, Artificial Sequence
  synthetic [barcode part1]
tcgtaggttacgtggt

SEQ ID NO: 9222 - DNA, 16 bp, Artificial Sequence
  synthetic [barcode part1]
ttccgattacgaacct

SEQ ID NO: 9223 - DNA, 16 bp, Artificial Sequence
  synthetic [barcode part1]
gtaacgtaacctcgac

SEQ ID NO: 9224 - DNA, 16 bp, Artificial Sequence
  synthetic [barcode part1]
agtaaccgtgtgaggc

SEQ ID NO: 9225 - DNA, 16 bp, Artificial Sequence
  synthetic [barcode part1]
gcgtagacctaataag

SEQ ID NO: 9226 - DNA, 16 bp, Artificial Sequence
  synthetic [barcode part1]
cctaatccggtcacgt

SEQ ID NO: 9227 - DNA, 16 bp, Artificial Sequence
  synthetic [barcode part1]
atctacggaggtgacg

SEQ ID NO: 9228 - DNA, 16 bp, Artificial Sequence
  synthetic [barcode part1]
taccaccaacgcgttc

SEQ ID NO: 9229 - DNA, 16 bp, Artificial Sequence
  synthetic [barcode part1]
tgtgtcacagtacgtg

SEQ ID NO: 9230 - DNA, 16 bp, Artificial Sequence
  synthetic [barcode part1]
atacgtgccgagattc

SEQ ID NO: 9231 - DNA, 16 bp, Artificial Sequence
  synthetic [barcode part1]
ttatcctcgtgtcaag

SEQ ID NO: 9232 - DNA, 16 bp, Artificial Sequence
  synthetic [barcode part1]
gagttattgaaggcgt

SEQ ID NO: 9233 - DNA, 16 bp, Artificial Sequence
  synthetic [barcode part1]
aatactacgtggcgtc

SEQ ID NO: 9234 - DNA, 16 bp, Artificial Sequence
  synthetic [barcode part1]
acacgacgcactagtt

SEQ ID NO: 9235 - DNA, 16 bp, Artificial Sequence
  synthetic [barcode part1]
gataggcgatactgcg

SEQ ID NO: 9236 - DNA, 16 bp, Artificial Sequence
  synthetic [barcode part1]
cagattacgcggaggt

SEQ ID NO: 9237 - DNA, 16 bp, Artificial Sequence
  synthetic [barcode part1]
gacttggtcagtggtt

SEQ ID NO: 9238 - DNA, 16 bp, Artificial Sequence
  synthetic [barcode part1]
tatcagaagacgcagt

SEQ ID NO: 9239 - DNA, 16 bp, Artificial Sequence
  synthetic [barcode part1]
cgaactgttggactgt

SEQ ID NO: 9240 - DNA, 16 bp, Artificial Sequence
  synthetic [barcode part1]
aactgcgccttccagt

SEQ ID NO: 9241 - DNA, 16 bp, Artificial Sequence
  synthetic [barcode part1]
tagactgtggtagtcc

SEQ ID NO: 9242 - DNA, 16 bp, Artificial Sequence
  synthetic [barcode part1]
cagaatattcacggag

SEQ ID NO: 9243 - DNA, 16 bp, Artificial Sequence
  synthetic [barcode part1]
ttctacgcgataacct

SEQ ID NO: 9244 - DNA, 16 bp, Artificial Sequence
  synthetic [barcode part1]
taggaatactcggtag

SEQ ID NO: 9245 - DNA, 16 bp, Artificial Sequence
  synthetic [barcode part1]
tgcctatcctgaagtt

SEQ ID NO: 9246 - DNA, 16 bp, Artificial Sequence
  synthetic [barcode part1]
gcggtaagttcgaacg

SEQ ID NO: 9247 - DNA, 16 bp, Artificial Sequence
  synthetic [barcode part1]
tcggcctcaagttcgt

SEQ ID NO: 9248 - DNA, 16 bp, Artificial Sequence
  synthetic [barcode part1]
tctacttgacactgtg

SEQ ID NO: 9249 - DNA, 16 bp, Artificial Sequence
  synthetic [barcode part1]
tattcggaaggtaacg

SEQ ID NO: 9250 - DNA, 16 bp, Artificial Sequence
  synthetic [barcode part1]
gcaggagttaacagtt

SEQ ID NO: 9251 - DNA, 16 bp, Artificial Sequence
  synthetic [barcode part1]
ccgattaccaaggttg

SEQ ID NO: 9252 - DNA, 16 bp, Artificial Sequence
  synthetic [barcode part1]
agaacggttgcggatc

SEQ ID NO: 9253 - DNA, 16 bp, Artificial Sequence
  synthetic [barcode part1]
gagtgtgaccagactg

SEQ ID NO: 9254 - DNA, 16 bp, Artificial Sequence
  synthetic [barcode part1]
gactggtctagagtct

SEQ ID NO: 9255 - DNA, 16 bp, Artificial Sequence
  synthetic [barcode part1]
tacacggtgtcaacgt

SEQ ID NO: 9256 - DNA, 16 bp, Artificial Sequence
  synthetic [barcode part1]
tgattcgttcgtactg

SEQ ID NO: 9257 - DNA, 16 bp, Artificial Sequence
  synthetic [barcode part1]
gacgtgtgtaccagtt

SEQ ID NO: 9258 - DNA, 16 bp, Artificial Sequence
  synthetic [barcode part1]
ccttggttacgttggc

SEQ ID NO: 9259 - DNA, 16 bp, Artificial Sequence
  synthetic [barcode part1]
cagtgagtactactcg

SEQ ID NO: 9260 - DNA, 16 bp, Artificial Sequence
  synthetic [barcode part1]
tagattacctcgcgcc

SEQ ID NO: 9261 - DNA, 16 bp, Artificial Sequence
  synthetic [barcode part1]
tgatataggccgtgtc

SEQ ID NO: 9262 - DNA, 16 bp, Artificial Sequence
  synthetic [barcode part1]
actggataggtcactc

SEQ ID NO: 9263 - DNA, 16 bp, Artificial Sequence
  synthetic [barcode part1]
ttcgagaccttcttcc

SEQ ID NO: 9264 - DNA, 16 bp, Artificial Sequence
  synthetic [barcode part1]
tagaaccggccaattc

SEQ ID NO: 9265 - DNA, 16 bp, Artificial Sequence
  synthetic [barcode part1]
gtgaactagttcgtgc

SEQ ID NO: 9266 - DNA, 16 bp, Artificial Sequence
  synthetic [barcode part1]
atctcgtcctataggt

SEQ ID NO: 9267 - DNA, 16 bp, Artificial Sequence
  synthetic [barcode part1]
gcagtaggcaactacg

SEQ ID NO: 9268 - DNA, 16 bp, Artificial Sequence
  synthetic [barcode part1]
acgagttctctcaatc

SEQ ID NO: 9269 - DNA, 16 bp, Artificial Sequence
  synthetic [barcode part1]
gacgtgaaggtacaag

SEQ ID NO: 9270 - DNA, 16 bp, Artificial Sequence
  synthetic [barcode part1]
acgccggttctgttgt

SEQ ID NO: 9271 - DNA, 16 bp, Artificial Sequence
  synthetic [barcode part1]
ttgttctggagtggtg

SEQ ID NO: 9272 - DNA, 16 bp, Artificial Sequence
  synthetic [barcode part1]
agaacttcctgttcgt

SEQ ID NO: 9273 - DNA, 16 bp, Artificial Sequence
  synthetic [barcode part1]
acttctaagacgtggc

SEQ ID NO: 9274 - DNA, 16 bp, Artificial Sequence
  synthetic [barcode part1]
ccactcgatctgttct

SEQ ID NO: 9275 - DNA, 16 bp, Artificial Sequence
  synthetic [barcode part1]
acgtacgcaaccagtt

SEQ ID NO: 9276 - DNA, 16 bp, Artificial Sequence
  synthetic [barcode part1]
gtgttacagactccag

SEQ ID NO: 9277 - DNA, 16 bp, Artificial Sequence
  synthetic [barcode part1]
gccttgttgaggaatc

SEQ ID NO: 9278 - DNA, 16 bp, Artificial Sequence
  synthetic [barcode part1]
agacgttatagtggac

SEQ ID NO: 9279 - DNA, 16 bp, Artificial Sequence
  synthetic [barcode part1]
gtgaagagttgccggt

SEQ ID NO: 9280 - DNA, 16 bp, Artificial Sequence
  synthetic [barcode part1]
atcgagtcgtcagatc

SEQ ID NO: 9281 - DNA, 16 bp, Artificial Sequence
  synthetic [barcode part1]
tcctgacttaagtgtc

SEQ ID NO: 9282 - DNA, 16 bp, Artificial Sequence
  synthetic [barcode part1]
atacacggtcgtgatc

SEQ ID NO: 9283 - DNA, 16 bp, Artificial Sequence
  synthetic [barcode part1]
cgataacctggattgc

SEQ ID NO: 9284 - DNA, 16 bp, Artificial Sequence
  synthetic [barcode part1]
gtactcctatagaggc

SEQ ID NO: 9285 - DNA, 16 bp, Artificial Sequence
  synthetic [barcode part1]
tgagatcacgtcacac

SEQ ID NO: 9286 - DNA, 16 bp, Artificial Sequence
  synthetic [barcode part1]
cagaataccgttaccg

SEQ ID NO: 9287 - DNA, 16 bp, Artificial Sequence
  synthetic [barcode part1]
tactgcacaactggtg

SEQ ID NO: 9288 - DNA, 16 bp, Artificial Sequence
  synthetic [barcode part1]
cgtactcagattatcc

SEQ ID NO: 9289 - DNA, 16 bp, Artificial Sequence
  synthetic [barcode part1]
caacggagaattcgcg

SEQ ID NO: 9290 - DNA, 16 bp, Artificial Sequence
  synthetic [barcode part1]
atcgaggatcgacgtg

SEQ ID NO: 9291 - DNA, 16 bp, Artificial Sequence
  synthetic [barcode part1]
gtgccagtagtaaggc

SEQ ID NO: 9292 - DNA, 16 bp, Artificial Sequence
  synthetic [barcode part1]
ttgagaacgtagactg

SEQ ID NO: 9293 - DNA, 16 bp, Artificial Sequence
  synthetic [barcode part1]
tatcactgttcgagtc

SEQ ID NO: 9294 - DNA, 16 bp, Artificial Sequence
  synthetic [barcode part1]
ttggacaacttcactc

SEQ ID NO: 9295 - DNA, 16 bp, Artificial Sequence
  synthetic [barcode part1]
tagttctacgtcaacc

SEQ ID NO: 9296 - DNA, 16 bp, Artificial Sequence
  synthetic [barcode part1]
tggaatatccgatccg

SEQ ID NO: 9297 - DNA, 16 bp, Artificial Sequence
  synthetic [barcode part1]
gactctaggataagtg

SEQ ID NO: 9298 - DNA, 16 bp, Artificial Sequence
  synthetic [barcode part1]
aggcgttgtaacaagt

SEQ ID NO: 9299 - DNA, 16 bp, Artificial Sequence
  synthetic [barcode part1]
gcggaagttagattgt

SEQ ID NO: 9300 - DNA, 16 bp, Artificial Sequence
  synthetic [barcode part1]
gattcggtcctgcgtt

SEQ ID NO: 9301 - DNA, 16 bp, Artificial Sequence
  synthetic [barcode part1]
tgacacacgataagac

SEQ ID NO: 9302 - DNA, 16 bp, Artificial Sequence
  synthetic [barcode part1]
gacacgtgttgacgtt

SEQ ID NO: 9303 - DNA, 16 bp, Artificial Sequence
  synthetic [barcode part1]
tggttccgtcgtgtac

SEQ ID NO: 9304 - DNA, 16 bp, Artificial Sequence
  synthetic [barcode part1]
tacggagttaacaacg

SEQ ID NO: 9305 - DNA, 16 bp, Artificial Sequence
  synthetic [barcode part1]
gcactccgtacttctt

SEQ ID NO: 9306 - DNA, 16 bp, Artificial Sequence
  synthetic [barcode part1]
tgccactacaaccgtc

SEQ ID NO: 9307 - DNA, 16 bp, Artificial Sequence
  synthetic [barcode part1]
tcttatctcgcaagtg

SEQ ID NO: 9308 - DNA, 16 bp, Artificial Sequence
  synthetic [barcode part1]
ttcacaccggcgactt

SEQ ID NO: 9309 - DNA, 16 bp, Artificial Sequence
  synthetic [barcode part1]
cactggcaatctctcg

SEQ ID NO: 9310 - DNA, 16 bp, Artificial Sequence
  synthetic [barcode part1]
agaatcacgacggaag

SEQ ID NO: 9311 - DNA, 16 bp, Artificial Sequence
  synthetic [barcode part1]
ttcactagagaaccgc

SEQ ID NO: 9312 - DNA, 16 bp, Artificial Sequence
  synthetic [barcode part1]
ttacgagtgaatccgc

SEQ ID NO: 9313 - DNA, 16 bp, Artificial Sequence
  synthetic [barcode part1]
ttgatccggtgcgtct

SEQ ID NO: 9314 - DNA, 16 bp, Artificial Sequence
  synthetic [barcode part1]
ccaaggattgaacgcg

SEQ ID NO: 9315 - DNA, 16 bp, Artificial Sequence
  synthetic [barcode part1]
cacgtctaagttgttc

SEQ ID NO: 9316 - DNA, 16 bp, Artificial Sequence
  synthetic [barcode part1]
ttactgcgtgaactct

SEQ ID NO: 9317 - DNA, 16 bp, Artificial Sequence
  synthetic [barcode part1]
ttcactaccgacacgc

SEQ ID NO: 9318 - DNA, 16 bp, Artificial Sequence
  synthetic [barcode part1]
tggcgtgtcctgttac

SEQ ID NO: 9319 - DNA, 16 bp, Artificial Sequence
  synthetic [barcode part1]
cagagaagactggagt

SEQ ID NO: 9320 - DNA, 16 bp, Artificial Sequence
  synthetic [barcode part1]
cggtggtaagagtacc

SEQ ID NO: 9321 - DNA, 16 bp, Artificial Sequence
  synthetic [barcode part1]
gtgcacgtaacactac

SEQ ID NO: 9322 - DNA, 16 bp, Artificial Sequence
  synthetic [barcode part1]
caggagactctctaac

SEQ ID NO: 9323 - DNA, 16 bp, Artificial Sequence
  synthetic [barcode part1]
tggtgcgatacctaac

SEQ ID NO: 9324 - DNA, 16 bp, Artificial Sequence
  synthetic [barcode part1]
aattcggcgacaactc

SEQ ID NO: 9325 - DNA, 16 bp, Artificial Sequence
  synthetic [barcode part1]
actggtagtaggacgc

SEQ ID NO: 9326 - DNA, 16 bp, Artificial Sequence
  synthetic [barcode part1]
gcgtgcaacactatac

SEQ ID NO: 9327 - DNA, 16 bp, Artificial Sequence
  synthetic [barcode part1]
cgcgtaactgttatct

SEQ ID NO: 9328 - DNA, 16 bp, Artificial Sequence
  synthetic [barcode part1]
cgttaggaacgacctt

SEQ ID NO: 9329 - DNA, 16 bp, Artificial Sequence
  synthetic [barcode part1]
cggtcttacgttggtc

SEQ ID NO: 9330 - DNA, 16 bp, Artificial Sequence
  synthetic [barcode part1]
gaacaggtattacgac

SEQ ID NO: 9331 - DNA, 16 bp, Artificial Sequence
  synthetic [barcode part1]
cgcgtgatactgatac

SEQ ID NO: 9332 - DNA, 16 bp, Artificial Sequence
  synthetic [barcode part1]
gacgtgtgtgttggtt

SEQ ID NO: 9333 - DNA, 16 bp, Artificial Sequence
  synthetic [barcode part1]
taggaaggcaccaatt

SEQ ID NO: 9334 - DNA, 16 bp, Artificial Sequence
  synthetic [barcode part1]
tcgacagacgaggact

SEQ ID NO: 9335 - DNA, 16 bp, Artificial Sequence
  synthetic [barcode part1]
tggaggtccactagag

SEQ ID NO: 9336 - DNA, 16 bp, Artificial Sequence
  synthetic [barcode part1]
gtccgtcaatactgtt

SEQ ID NO: 9337 - DNA, 16 bp, Artificial Sequence
  synthetic [barcode part1]
aatcggttcctcttcc

SEQ ID NO: 9338 - DNA, 16 bp, Artificial Sequence
  synthetic [barcode part1]
tcctgactacgaattc

SEQ ID NO: 9339 - DNA, 16 bp, Artificial Sequence
  synthetic [barcode part1]
cagaagacagttacgt

SEQ ID NO: 9340 - DNA, 16 bp, Artificial Sequence
  synthetic [barcode part1]
acggacaatctgttcg

SEQ ID NO: 9341 - DNA, 16 bp, Artificial Sequence
  synthetic [barcode part1]
agaatcacgcactaag

SEQ ID NO: 9342 - DNA, 16 bp, Artificial Sequence
  synthetic [barcode part1]
cacctgccgaagttct

SEQ ID NO: 9343 - DNA, 16 bp, Artificial Sequence
  synthetic [barcode part1]
attggtgtgaagagtc

SEQ ID NO: 9344 - DNA, 16 bp, Artificial Sequence
  synthetic [barcode part1]
tcgtgatccagaactg

SEQ ID NO: 9345 - DNA, 16 bp, Artificial Sequence
  synthetic [barcode part1]
aaccgtaactgcgtac

SEQ ID NO: 9346 - DNA, 16 bp, Artificial Sequence
  synthetic [barcode part1]
ccttcagacgtgttgc

SEQ ID NO: 9347 - DNA, 16 bp, Artificial Sequence
  synthetic [barcode part1]
tcgtacctctggtgac

SEQ ID NO: 9348 - DNA, 16 bp, Artificial Sequence
  synthetic [barcode part1]
tcctcagtataaccac

SEQ ID NO: 9349 - DNA, 16 bp, Artificial Sequence
  synthetic [barcode part1]
gaacttgtcacgtgac

SEQ ID NO: 9350 - DNA, 16 bp, Artificial Sequence
  synthetic [barcode part1]
gtgtcctatcaccgac

SEQ ID NO: 9351 - DNA, 16 bp, Artificial Sequence
  synthetic [barcode part1]
tccgtataactaccgt

SEQ ID NO: 9352 - DNA, 16 bp, Artificial Sequence
  synthetic [barcode part1]
tgtggcgaggtagatc

SEQ ID NO: 9353 - DNA, 16 bp, Artificial Sequence
  synthetic [barcode part1]
gatagttgccagacct

SEQ ID NO: 9354 - DNA, 16 bp, Artificial Sequence
  synthetic [barcode part1]
atatccttagtctggc

SEQ ID NO: 9355 - DNA, 16 bp, Artificial Sequence
  synthetic [barcode part1]
tcggtggtctgataac

SEQ ID NO: 9356 - DNA, 16 bp, Artificial Sequence
  synthetic [barcode part1]
tattccgtgagtgtct

SEQ ID NO: 9357 - DNA, 16 bp, Artificial Sequence
  synthetic [barcode part1]
taacctgtccggtaag

SEQ ID NO: 9358 - DNA, 16 bp, Artificial Sequence
  synthetic [barcode part1]
acgtctattgtggacg

SEQ ID NO: 9359 - DNA, 16 bp, Artificial Sequence
  synthetic [barcode part1]
atacgtccaccttgcg

SEQ ID NO: 9360 - DNA, 16 bp, Artificial Sequence
  synthetic [barcode part1]
ttatcacaggcagtgc

SEQ ID NO: 9361 - DNA, 16 bp, Artificial Sequence
  synthetic [barcode part1]
cggagtaacctgagtg

SEQ ID NO: 9362 - DNA, 16 bp, Artificial Sequence
  synthetic [barcode part1]
gaaggcgttaccaggt

SEQ ID NO: 9363 - DNA, 16 bp, Artificial Sequence
  synthetic [barcode part1]
caaggttgtgtcacac

SEQ ID NO: 9364 - DNA, 16 bp, Artificial Sequence
  synthetic [barcode part1]
gtgttaggtatccgac

SEQ ID NO: 9365 - DNA, 16 bp, Artificial Sequence
  synthetic [barcode part1]
agactggtaaccgcag

SEQ ID NO: 9366 - DNA, 16 bp, Artificial Sequence
  synthetic [barcode part1]
tacggtagaacagatc

SEQ ID NO: 9367 - DNA, 16 bp, Artificial Sequence
  synthetic [barcode part1]
ccaataccttcgattg

SEQ ID NO: 9368 - DNA, 16 bp, Artificial Sequence
  synthetic [barcode part1]
ttatacagtgccggtg

SEQ ID NO: 9369 - DNA, 16 bp, Artificial Sequence
  synthetic [barcode part1]
tgttgtgactggtcag

SEQ ID NO: 9370 - DNA, 16 bp, Artificial Sequence
  synthetic [barcode part1]
gttcgtcacttgttcc

SEQ ID NO: 9371 - DNA, 16 bp, Artificial Sequence
  synthetic [barcode part1]
tcaattccttacaggc

SEQ ID NO: 9372 - DNA, 16 bp, Artificial Sequence
  synthetic [barcode part1]
tgtgtctctgtcaagt

SEQ ID NO: 9373 - DNA, 16 bp, Artificial Sequence
  synthetic [barcode part1]
acgaccgtcctgattc

SEQ ID NO: 9374 - DNA, 16 bp, Artificial Sequence
  synthetic [barcode part1]
agaacggaagtccacc

SEQ ID NO: 9375 - DNA, 16 bp, Artificial Sequence
  synthetic [barcode part1]
actggttgtgtgtgtg

SEQ ID NO: 9376 - DNA, 16 bp, Artificial Sequence
  synthetic [barcode part1]
tagaggcctaccagag

SEQ ID NO: 9377 - DNA, 16 bp, Artificial Sequence
  synthetic [barcode part1]
aatagagacgcggtcc

SEQ ID NO: 9378 - DNA, 16 bp, Artificial Sequence
  synthetic [barcode part1]
aggcagatcgcgatac

SEQ ID NO: 9379 - DNA, 16 bp, Artificial Sequence
  synthetic [barcode part1]
agagtcgatcagagag

SEQ ID NO: 9380 - DNA, 16 bp, Artificial Sequence
  synthetic [barcode part1]
aggacctggtgaacgt

SEQ ID NO: 9381 - DNA, 16 bp, Artificial Sequence
  synthetic [barcode part1]
acaactatcctggtct

SEQ ID NO: 9382 - DNA, 16 bp, Artificial Sequence
  synthetic [barcode part1]
gtctggactgcgaatt

SEQ ID NO: 9383 - DNA, 16 bp, Artificial Sequence
  synthetic [barcode part1]
atcacggcgagtgagt

SEQ ID NO: 9384 - DNA, 16 bp, Artificial Sequence
  synthetic [barcode part1]
cctgagatcggttagt

SEQ ID NO: 9385 - DNA, 16 bp, Artificial Sequence
  synthetic [barcode part1]
caggactagtctcagt

SEQ ID NO: 9386 - DNA, 16 bp, Artificial Sequence
  synthetic [barcode part1]
tagtggtgaggtgtgc

SEQ ID NO: 9387 - DNA, 16 bp, Artificial Sequence
  synthetic [barcode part1]
aaggtaacctatcgcc

SEQ ID NO: 9388 - DNA, 16 bp, Artificial Sequence
  synthetic [barcode part1]
tcagtgtgtcacacag

SEQ ID NO: 9389 - DNA, 16 bp, Artificial Sequence
  synthetic [barcode part1]
agtctctaggacggtt

SEQ ID NO: 9390 - DNA, 16 bp, Artificial Sequence
  synthetic [barcode part1]
actcgccgtcttgagt

SEQ ID NO: 9391 - DNA, 16 bp, Artificial Sequence
  synthetic [barcode part1]
ttggtctctgtacagt

SEQ ID NO: 9392 - DNA, 16 bp, Artificial Sequence
  synthetic [barcode part1]
tgaccaagactggttc

SEQ ID NO: 9393 - DNA, 16 bp, Artificial Sequence
  synthetic [barcode part1]
cctctgacaactgtgc

SEQ ID NO: 9394 - DNA, 16 bp, Artificial Sequence
  synthetic [barcode part1]
agacaattgcgaatcg

SEQ ID NO: 9395 - DNA, 16 bp, Artificial Sequence
  synthetic [barcode part1]
gtggatcggagactgt

SEQ ID NO: 9396 - DNA, 16 bp, Artificial Sequence
  synthetic [barcode part1]
agatccgtactgacgt

SEQ ID NO: 9397 - DNA, 16 bp, Artificial Sequence
  synthetic [barcode part1]
gaggagtacgagatac

SEQ ID NO: 9398 - DNA, 16 bp, Artificial Sequence
  synthetic [barcode part1]
aatatacctggtcctc

SEQ ID NO: 9399 - DNA, 16 bp, Artificial Sequence
  synthetic [barcode part1]
agttacgacaccgatc

SEQ ID NO: 9400 - DNA, 16 bp, Artificial Sequence
  synthetic [barcode part1]
gtgtgtgtcgaagtct

SEQ ID NO: 9401 - DNA, 16 bp, Artificial Sequence
  synthetic [barcode part1]
cacaatcgtgcaatcg

SEQ ID NO: 9402 - DNA, 16 bp, Artificial Sequence
  synthetic [barcode part1]
gtgagtcctcctggtt

SEQ ID NO: 9403 - DNA, 16 bp, Artificial Sequence
  synthetic [barcode part1]
agtcctaacggtatcg

SEQ ID NO: 9404 - DNA, 16 bp, Artificial Sequence
  synthetic [barcode part1]
gaactctgaagaggag

SEQ ID NO: 9405 - DNA, 16 bp, Artificial Sequence
  synthetic [barcode part1]
cagaggtgcaactcag

SEQ ID NO: 9406 - DNA, 16 bp, Artificial Sequence
  synthetic [barcode part1]
cgtagactgccgtctt

SEQ ID NO: 9407 - DNA, 16 bp, Artificial Sequence
  synthetic [barcode part1]
cgatcaacgactagtc

SEQ ID NO: 9408 - DNA, 16 bp, Artificial Sequence
  synthetic [barcode part1]
acggtgacttagttcg

SEQ ID NO: 9409 - DNA, 16 bp, Artificial Sequence
  synthetic [barcode part1]
ccagtgaattcctact

SEQ ID NO: 9410 - DNA, 16 bp, Artificial Sequence
  synthetic [barcode part1]
agtcacagtgttgacc

SEQ ID NO: 9411 - DNA, 16 bp, Artificial Sequence
  synthetic [barcode part1]
acaggtgtcacttgtg

SEQ ID NO: 9412 - DNA, 16 bp, Artificial Sequence
  synthetic [barcode part1]
gacagagaaggatcac

SEQ ID NO: 9413 - DNA, 16 bp, Artificial Sequence
  synthetic [barcode part1]
ttgagtcctgacaacg

SEQ ID NO: 9414 - DNA, 16 bp, Artificial Sequence
  synthetic [barcode part1]
gtccgtcgaacagatt

SEQ ID NO: 9415 - DNA, 16 bp, Artificial Sequence
  synthetic [barcode part1]
taactctcggtgtatc

SEQ ID NO: 9416 - DNA, 16 bp, Artificial Sequence
  synthetic [barcode part1]
cagagactaggaacag

SEQ ID NO: 9417 - DNA, 16 bp, Artificial Sequence
  synthetic [barcode part1]
tcgtacctaccgaacc

SEQ ID NO: 9418 - DNA, 16 bp, Artificial Sequence
  synthetic [barcode part1]
gcgattaaccacacac

SEQ ID NO: 9419 - DNA, 16 bp, Artificial Sequence
  synthetic [barcode part1]
aacacctaagtcagag

SEQ ID NO: 9420 - DNA, 16 bp, Artificial Sequence
  synthetic [barcode part1]
agaagaccgaatctgt

SEQ ID NO: 9421 - DNA, 16 bp, Artificial Sequence
  synthetic [barcode part1]
aggcctgacttctcac

SEQ ID NO: 9422 - DNA, 16 bp, Artificial Sequence
  synthetic [barcode part1]
cactgtacgacactag

SEQ ID NO: 9423 - DNA, 16 bp, Artificial Sequence
  synthetic [barcode part1]
cgtacagaacggcagt

SEQ ID NO: 9424 - DNA, 16 bp, Artificial Sequence
  synthetic [barcode part1]
cagacagtggaatccg

SEQ ID NO: 9425 - DNA, 16 bp, Artificial Sequence
  synthetic [barcode part1]
cagttggacacgtgtt

SEQ ID NO: 9426 - DNA, 16 bp, Artificial Sequence
  synthetic [barcode part1]
tgaatccgaatccacg

SEQ ID NO: 9427 - DNA, 16 bp, Artificial Sequence
  synthetic [barcode part1]
gtctgccttgtggtgt

SEQ ID NO: 9428 - DNA, 16 bp, Artificial Sequence
  synthetic [barcode part1]
acgtgtgaccacgatt

SEQ ID NO: 9429 - DNA, 16 bp, Artificial Sequence
  synthetic [barcode part1]
tcttaattgtgccggt

SEQ ID NO: 9430 - DNA, 16 bp, Artificial Sequence
  synthetic [barcode part1]
gacaggtccgtaacag

SEQ ID NO: 9431 - DNA, 16 bp, Artificial Sequence
  synthetic [barcode part1]
aacggcactgtgagtg

SEQ ID NO: 9432 - DNA, 16 bp, Artificial Sequence
  synthetic [barcode part1]
attggtcaccggttag

SEQ ID NO: 9433 - DNA, 16 bp, Artificial Sequence
  synthetic [barcode part1]
tcggcagagatataac

SEQ ID NO: 9434 - DNA, 16 bp, Artificial Sequence
  synthetic [barcode part1]
tgtggttactgcctcg

SEQ ID NO: 9435 - DNA, 16 bp, Artificial Sequence
  synthetic [barcode part1]
cggacaagatagacag

SEQ ID NO: 9436 - DNA, 16 bp, Artificial Sequence
  synthetic [barcode part1]
ttcgtgagaactcgtg

SEQ ID NO: 9437 - DNA, 16 bp, Artificial Sequence
  synthetic [barcode part1]
tccaacctgtgattac

SEQ ID NO: 9438 - DNA, 16 bp, Artificial Sequence
  synthetic [barcode part1]
aacggtgactctgttg

SEQ ID NO: 9439 - DNA, 16 bp, Artificial Sequence
  synthetic [barcode part1]
gtggtccgaacgtaag

SEQ ID NO: 9440 - DNA, 16 bp, Artificial Sequence
  synthetic [barcode part1]
tgcacttacgaggact

SEQ ID NO: 9441 - DNA, 16 bp, Artificial Sequence
  synthetic [barcode part1]
tgcaacttagtggaag

SEQ ID NO: 9442 - DNA, 16 bp, Artificial Sequence
  synthetic [barcode part1]
aggttgtggattgtcc

SEQ ID NO: 9443 - DNA, 16 bp, Artificial Sequence
  synthetic [barcode part1]
tgacacttagacgaag

SEQ ID NO: 9444 - DNA, 16 bp, Artificial Sequence
  synthetic [barcode part1]
ttgactcgcgattact

SEQ ID NO: 9445 - DNA, 16 bp, Artificial Sequence
  synthetic [barcode part1]
gattcgaggaggtgtc

SEQ ID NO: 9446 - DNA, 16 bp, Artificial Sequence
  synthetic [barcode part1]
ttccagtgtgtggcct

SEQ ID NO: 9447 - DNA, 16 bp, Artificial Sequence
  synthetic [barcode part1]
cgttacttccgcaggt

SEQ ID NO: 9448 - DNA, 16 bp, Artificial Sequence
  synthetic [barcode part1]
tgtggatagacagtac

SEQ ID NO: 9449 - DNA, 16 bp, Artificial Sequence
  synthetic [barcode part1]
ccttgacaagagttgc

SEQ ID NO: 9450 - DNA, 16 bp, Artificial Sequence
  synthetic [barcode part1]
ttactgtgttcgcggc

SEQ ID NO: 9451 - DNA, 16 bp, Artificial Sequence
  synthetic [barcode part1]
gactgttgcaactcag

SEQ ID NO: 9452 - DNA, 16 bp, Artificial Sequence
  synthetic [barcode part1]
atactcgccgtaagtg

SEQ ID NO: 9453 - DNA, 16 bp, Artificial Sequence
  synthetic [barcode part1]
acacacaaccagtcac

SEQ ID NO: 9454 - DNA, 16 bp, Artificial Sequence
  synthetic [barcode part1]
gattgacgtgttacgc

SEQ ID NO: 9455 - DNA, 16 bp, Artificial Sequence
  synthetic [barcode part1]
cgttgagatcttcact

SEQ ID NO: 9456 - DNA, 16 bp, Artificial Sequence
  synthetic [barcode part1]
gttagacctatcggac

SEQ ID NO: 9457 - DNA, 16 bp, Artificial Sequence
  synthetic [barcode part1]
attataccgacggaag

SEQ ID NO: 9458 - DNA, 16 bp, Artificial Sequence
  synthetic [barcode part1]
caaggtctaacaccgt

SEQ ID NO: 9459 - DNA, 16 bp, Artificial Sequence
  synthetic [barcode part1]
acaggagattatcgac

SEQ ID NO: 9460 - DNA, 16 bp, Artificial Sequence
  synthetic [barcode part1]
tcgatacaatcctctg

SEQ ID NO: 9461 - DNA, 16 bp, Artificial Sequence
  synthetic [barcode part1]
tgcgttacaatacgcg

SEQ ID NO: 9462 - DNA, 16 bp, Artificial Sequence
  synthetic [barcode part1]
tacgcggattcttcgc

SEQ ID NO: 9463 - DNA, 16 bp, Artificial Sequence
  synthetic [barcode part1]
tgtgccgtgactatag

SEQ ID NO: 9464 - DNA, 16 bp, Artificial Sequence
  synthetic [barcode part1]
acactcaggtggaacg

SEQ ID NO: 9465 - DNA, 16 bp, Artificial Sequence
  synthetic [barcode part1]
tagtgacgatcgtcac

SEQ ID NO: 9466 - DNA, 16 bp, Artificial Sequence
  synthetic [barcode part1]
acctgttgcaagtggt

SEQ ID NO: 9467 - DNA, 16 bp, Artificial Sequence
  synthetic [barcode part1]
cgtaggagaccactag

SEQ ID NO: 9468 - DNA, 16 bp, Artificial Sequence
  synthetic [barcode part1]
ttccaagttacggcag

SEQ ID NO: 9469 - DNA, 16 bp, Artificial Sequence
  synthetic [barcode part1]
acgaataattccggag

SEQ ID NO: 9470 - DNA, 16 bp, Artificial Sequence
  synthetic [barcode part1]
caggtcctggatattg

SEQ ID NO: 9471 - DNA, 16 bp, Artificial Sequence
  synthetic [barcode part1]
aacagatcaggattcg

SEQ ID NO: 9472 - DNA, 16 bp, Artificial Sequence
  synthetic [barcode part1]
gtggtacacgtgtact

SEQ ID NO: 9473 - DNA, 16 bp, Artificial Sequence
  synthetic [barcode part1]
acaccaactagtgcac

SEQ ID NO: 9474 - DNA, 16 bp, Artificial Sequence
  synthetic [barcode part1]
gattagaggcacaccg

SEQ ID NO: 9475 - DNA, 16 bp, Artificial Sequence
  synthetic [barcode part1]
atcgactgaggttctg

SEQ ID NO: 9476 - DNA, 16 bp, Artificial Sequence
  synthetic [barcode part1]
ccaagtaacggcgaac

SEQ ID NO: 9477 - DNA, 16 bp, Artificial Sequence
  synthetic [barcode part1]
cctccaggcactagtt

SEQ ID NO: 9478 - DNA, 16 bp, Artificial Sequence
  synthetic [barcode part1]
atctacttctaggacc

SEQ ID NO: 9479 - DNA, 16 bp, Artificial Sequence
  synthetic [barcode part1]
tgcgtctggtgatctc

SEQ ID NO: 9480 - DNA, 16 bp, Artificial Sequence
  synthetic [barcode part1]
tggactacgacctaac

SEQ ID NO: 9481 - DNA, 16 bp, Artificial Sequence
  synthetic [barcode part1]
tggacgcagagactac

SEQ ID NO: 9482 - DNA, 16 bp, Artificial Sequence
  synthetic [barcode part1]
caatcttggaggactc

SEQ ID NO: 9483 - DNA, 16 bp, Artificial Sequence
  synthetic [barcode part1]
aggaggttactagtac

SEQ ID NO: 9484 - DNA, 16 bp, Artificial Sequence
  synthetic [barcode part1]
tgttcttaattcggcg

SEQ ID NO: 9485 - DNA, 16 bp, Artificial Sequence
  synthetic [barcode part1]
tgttgacttcttcgag

SEQ ID NO: 9486 - DNA, 16 bp, Artificial Sequence
  synthetic [barcode part1]
tgagtgccaattctct

SEQ ID NO: 9487 - DNA, 16 bp, Artificial Sequence
  synthetic [barcode part1]
acaagagtaacggtct

SEQ ID NO: 9488 - DNA, 16 bp, Artificial Sequence
  synthetic [barcode part1]
cacgttcgcagttcac

SEQ ID NO: 9489 - DNA, 16 bp, Artificial Sequence
  synthetic [barcode part1]
tgcctctaatcgccag

SEQ ID NO: 9490 - DNA, 16 bp, Artificial Sequence
  synthetic [barcode part1]
actgaaccgtcagatc

SEQ ID NO: 9491 - DNA, 16 bp, Artificial Sequence
  synthetic [barcode part1]
acagttatcggaaggt

SEQ ID NO: 9492 - DNA, 16 bp, Artificial Sequence
  synthetic [barcode part1]
gacgattgagaacgcc

SEQ ID NO: 9493 - DNA, 16 bp, Artificial Sequence
  synthetic [barcode part1]
gagatatcagtctgag

SEQ ID NO: 9494 - DNA, 16 bp, Artificial Sequence
  synthetic [barcode part1]
ttcgccagtgcctaac

SEQ ID NO: 9495 - DNA, 16 bp, Artificial Sequence
  synthetic [barcode part1]
tctctcttgcgatacc

SEQ ID NO: 9496 - DNA, 16 bp, Artificial Sequence
  synthetic [barcode part1]
acggacaacgacgttg

SEQ ID NO: 9497 - DNA, 16 bp, Artificial Sequence
  synthetic [barcode part1]
gcgaggattagattgt

SEQ ID NO: 9498 - DNA, 16 bp, Artificial Sequence
  synthetic [barcode part1]
tacgtggactcctcgt

SEQ ID NO: 9499 - DNA, 16 bp, Artificial Sequence
  synthetic [barcode part1]
ccttgtgtcaggttgc

SEQ ID NO: 9500 - DNA, 16 bp, Artificial Sequence
  synthetic [barcode part1]
gtcctgtgatacgtcc

SEQ ID NO: 9501 - DNA, 16 bp, Artificial Sequence
  synthetic [barcode part1]
gcctagatacctgagt

SEQ ID NO: 9502 - DNA, 16 bp, Artificial Sequence
  synthetic [barcode part1]
cacgacgtattacgac

SEQ ID NO: 9503 - DNA, 16 bp, Artificial Sequence
  synthetic [barcode part1]
gaacgaatcgcctgtt

SEQ ID NO: 9504 - DNA, 16 bp, Artificial Sequence
  synthetic [barcode part1]
acgttggtcttcgatt

SEQ ID NO: 9505 - DNA, 16 bp, Artificial Sequence
  synthetic [barcode part1]
cagtgacttctgtact

SEQ ID NO: 9506 - DNA, 16 bp, Artificial Sequence
  synthetic [barcode part1]
agttgtccggagacag

SEQ ID NO: 9507 - DNA, 16 bp, Artificial Sequence
  synthetic [barcode part1]
gcctataacgtggttg

SEQ ID NO: 9508 - DNA, 16 bp, Artificial Sequence
  synthetic [barcode part1]
gaagtagtggaacggt

SEQ ID NO: 9509 - DNA, 16 bp, Artificial Sequence
  synthetic [barcode part1]
cggagaacgtaaccac

SEQ ID NO: 9510 - DNA, 16 bp, Artificial Sequence
  synthetic [barcode part1]
gcgacacagtcttaac

SEQ ID NO: 9511 - DNA, 16 bp, Artificial Sequence
  synthetic [barcode part1]
atccgaataggacggc

SEQ ID NO: 9512 - DNA, 16 bp, Artificial Sequence
  synthetic [barcode part1]
tcaccacgtgagttcc

SEQ ID NO: 9513 - DNA, 16 bp, Artificial Sequence
  synthetic [barcode part1]
tgttgtgaagacctcg

SEQ ID NO: 9514 - DNA, 16 bp, Artificial Sequence
  synthetic [barcode part1]
gagtgagatcttgaac

SEQ ID NO: 9515 - DNA, 16 bp, Artificial Sequence
  synthetic [barcode part1]
gagataggtggatctt

SEQ ID NO: 9516 - DNA, 16 bp, Artificial Sequence
  synthetic [barcode part1]
ttcctctcttcctctc

SEQ ID NO: 9517 - DNA, 16 bp, Artificial Sequence
  synthetic [barcode part1]
actaacgttactgtcc

SEQ ID NO: 9518 - DNA, 16 bp, Artificial Sequence
  synthetic [barcode part1]
tcacgtaatcgtgcag

SEQ ID NO: 9519 - DNA, 16 bp, Artificial Sequence
  synthetic [barcode part1]
ttcaatcggtccttcc

SEQ ID NO: 9520 - DNA, 16 bp, Artificial Sequence
  synthetic [barcode part1]
attcttctagtgcacg

SEQ ID NO: 9521 - DNA, 16 bp, Artificial Sequence
  synthetic [barcode part1]
gataattgccgttggc

SEQ ID NO: 9522 - DNA, 16 bp, Artificial Sequence
  synthetic [barcode part1]
gatcggtcttcctctt

SEQ ID NO: 9523 - DNA, 16 bp, Artificial Sequence
  synthetic [barcode part1]
atcacaccaacctccg

SEQ ID NO: 9524 - DNA, 16 bp, Artificial Sequence
  synthetic [barcode part1]
tgattccggtctctct

SEQ ID NO: 9525 - DNA, 16 bp, Artificial Sequence
  synthetic [barcode part1]
tacggatcgtcgttcc

SEQ ID NO: 9526 - DNA, 16 bp, Artificial Sequence
  synthetic [barcode part1]
gacgagtacttgtctg

SEQ ID NO: 9527 - DNA, 16 bp, Artificial Sequence
  synthetic [barcode part1]
cgtacttgtgattcgt

SEQ ID NO: 9528 - DNA, 16 bp, Artificial Sequence
  synthetic [barcode part1]
tgtcctgtgagtgtcc

SEQ ID NO: 9529 - DNA, 16 bp, Artificial Sequence
  synthetic [barcode part1]
ttccgatcgtactagt

SEQ ID NO: 9530 - DNA, 16 bp, Artificial Sequence
  synthetic [barcode part1]
cgtactacttcctaag

SEQ ID NO: 9531 - DNA, 16 bp, Artificial Sequence
  synthetic [barcode part1]
gtgcgattcttggcct

SEQ ID NO: 9532 - DNA, 16 bp, Artificial Sequence
  synthetic [barcode part1]
ataattggccacacgc

SEQ ID NO: 9533 - DNA, 16 bp, Artificial Sequence
  synthetic [barcode part1]
gaaccgaaggactaag

SEQ ID NO: 9534 - DNA, 16 bp, Artificial Sequence
  synthetic [barcode part1]
gtatacagtcgcggtt

SEQ ID NO: 9535 - DNA, 16 bp, Artificial Sequence
  synthetic [barcode part1]
tcagaacacgagtaac

SEQ ID NO: 9536 - DNA, 16 bp, Artificial Sequence
  synthetic [barcode part1]
gatcgcagagattagt

SEQ ID NO: 9537 - DNA, 16 bp, Artificial Sequence
  synthetic [barcode part1]
gtacggagacgatctg

SEQ ID NO: 9538 - DNA, 16 bp, Artificial Sequence
  synthetic [barcode part1]
cgtcacctactggtgt

SEQ ID NO: 9539 - DNA, 16 bp, Artificial Sequence
  synthetic [barcode part1]
accacttcgaagtggt

SEQ ID NO: 9540 - DNA, 16 bp, Artificial Sequence
  synthetic [barcode part1]
caggttaccagtagtc

SEQ ID NO: 9541 - DNA, 16 bp, Artificial Sequence
  synthetic [barcode part1]
taacctcacaccgatt

SEQ ID NO: 9542 - DNA, 16 bp, Artificial Sequence
  synthetic [barcode part1]
tcgtctggtctcgaac

SEQ ID NO: 9543 - DNA, 16 bp, Artificial Sequence
  synthetic [barcode part1]
gataagtggcaggtag

SEQ ID NO: 9544 - DNA, 16 bp, Artificial Sequence
  synthetic [barcode part1]
taggtgtaagacgatc

SEQ ID NO: 9545 - DNA, 16 bp, Artificial Sequence
  synthetic [barcode part1]
gtacgcgagaatcttc

SEQ ID NO: 9546 - DNA, 16 bp, Artificial Sequence
  synthetic [barcode part1]
tccgtggcactacttg

SEQ ID NO: 9547 - DNA, 16 bp, Artificial Sequence
  synthetic [barcode part1]
acgttccgacctaacc

SEQ ID NO: 9548 - DNA, 16 bp, Artificial Sequence
  synthetic [barcode part1]
ttacttgaggcaggtc

SEQ ID NO: 9549 - DNA, 16 bp, Artificial Sequence
  synthetic [barcode part1]
cagttaactgaccggt

SEQ ID NO: 9550 - DNA, 16 bp, Artificial Sequence
  synthetic [barcode part1]
gcaccttgttagattc

SEQ ID NO: 9551 - DNA, 16 bp, Artificial Sequence
  synthetic [barcode part1]
attgtgagacagacgt

SEQ ID NO: 9552 - DNA, 16 bp, Artificial Sequence
  synthetic [barcode part1]
ttctcctcggtgttac

SEQ ID NO: 9553 - DNA, 16 bp, Artificial Sequence
  synthetic [barcode part1]
cgccgagatccttgtt

SEQ ID NO: 9554 - DNA, 16 bp, Artificial Sequence
  synthetic [barcode part1]
atcaggtacttctgtc

SEQ ID NO: 9555 - DNA, 16 bp, Artificial Sequence
  synthetic [barcode part1]
gcacgatactgtacgt

SEQ ID NO: 9556 - DNA, 16 bp, Artificial Sequence
  synthetic [barcode part1]
gtgaggtgtgaacctg

SEQ ID NO: 9557 - DNA, 16 bp, Artificial Sequence
  synthetic [barcode part1]
agaagtggcctctact

SEQ ID NO: 9558 - DNA, 16 bp, Artificial Sequence
  synthetic [barcode part1]
cggtgtgattagaggc

SEQ ID NO: 9559 - DNA, 16 bp, Artificial Sequence
  synthetic [barcode part1]
cagaggtaggtgtaag

SEQ ID NO: 9560 - DNA, 16 bp, Artificial Sequence
  synthetic [barcode part1]
cggttatcactgacag

SEQ ID NO: 9561 - DNA, 16 bp, Artificial Sequence
  synthetic [barcode part1]
gccaggtattcaacac

SEQ ID NO: 9562 - DNA, 16 bp, Artificial Sequence
  synthetic [barcode part1]
gtctgaatcgtcttac

SEQ ID NO: 9563 - DNA, 16 bp, Artificial Sequence
  synthetic [barcode part1]
ttgtcttcgtaggttg

SEQ ID NO: 9564 - DNA, 16 bp, Artificial Sequence
  synthetic [barcode part1]
tagactgccaacagtc

SEQ ID NO: 9565 - DNA, 16 bp, Artificial Sequence
  synthetic [barcode part1]
tgcaagtcctattacc

SEQ ID NO: 9566 - DNA, 16 bp, Artificial Sequence
  synthetic [barcode part1]
tgcctggatacctaag

SEQ ID NO: 9567 - DNA, 16 bp, Artificial Sequence
  synthetic [barcode part1]
ttactgtcgaggtgac

SEQ ID NO: 9568 - DNA, 16 bp, Artificial Sequence
  synthetic [barcode part1]
tatctcagtggatctc

SEQ ID NO: 9569 - DNA, 16 bp, Artificial Sequence
  synthetic [barcode part1]
cgcagtggacaagtac

SEQ ID NO: 9570 - DNA, 16 bp, Artificial Sequence
  synthetic [barcode part1]
actagtcaacctcgag

SEQ ID NO: 9571 - DNA, 16 bp, Artificial Sequence
  synthetic [barcode part1]
gtctggattcactact

SEQ ID NO: 9572 - DNA, 16 bp, Artificial Sequence
  synthetic [barcode part1]
ttgttgtacttgtggc

SEQ ID NO: 9573 - DNA, 16 bp, Artificial Sequence
  synthetic [barcode part1]
cgaggtctaactagtc

SEQ ID NO: 9574 - DNA, 16 bp, Artificial Sequence
  synthetic [barcode part1]
acgtgtacacgtgtac

SEQ ID NO: 9575 - DNA, 16 bp, Artificial Sequence
  synthetic [barcode part1]
acacacggaagttcct

SEQ ID NO: 9576 - DNA, 16 bp, Artificial Sequence
  synthetic [barcode part1]
gcgcgagttatatctg

SEQ ID NO: 9577 - DNA, 16 bp, Artificial Sequence
  synthetic [barcode part1]
gtgtgtatcctctctc

SEQ ID NO: 9578 - DNA, 16 bp, Artificial Sequence
  synthetic [barcode part1]
caggtgtgttggaggt

SEQ ID NO: 9579 - DNA, 16 bp, Artificial Sequence
  synthetic [barcode part1]
gcagtattcggtcaac

SEQ ID NO: 9580 - DNA, 16 bp, Artificial Sequence
  synthetic [barcode part1]
ccacaagacaggacgt

SEQ ID NO: 9581 - DNA, 16 bp, Artificial Sequence
  synthetic [barcode part1]
cgaggagtgcacgatt

SEQ ID NO: 9582 - DNA, 16 bp, Artificial Sequence
  synthetic [barcode part1]
tgacctccgcgattac

SEQ ID NO: 9583 - DNA, 16 bp, Artificial Sequence
  synthetic [barcode part1]
gtatagatccacaccg

SEQ ID NO: 9584 - DNA, 16 bp, Artificial Sequence
  synthetic [barcode part1]
acacgttcactgacag

SEQ ID NO: 9585 - DNA, 16 bp, Artificial Sequence
  synthetic [barcode part1]
tgcaggcacaacagac

SEQ ID NO: 9586 - DNA, 16 bp, Artificial Sequence
  synthetic [barcode part1]
taggcaggtggtactg

SEQ ID NO: 9587 - DNA, 16 bp, Artificial Sequence
  synthetic [barcode part1]
acacgatatcgacacc

SEQ ID NO: 9588 - DNA, 16 bp, Artificial Sequence
  synthetic [barcode part1]
cctccgcagtaacttg

SEQ ID NO: 9589 - DNA, 16 bp, Artificial Sequence
  synthetic [barcode part1]
cggtagtcacgtcctt

SEQ ID NO: 9590 - DNA, 16 bp, Artificial Sequence
  synthetic [barcode part1]
acgtgttacagtcacg

SEQ ID NO: 9591 - DNA, 16 bp, Artificial Sequence
  synthetic [barcode part1]
caccacgaactaatcg

SEQ ID NO: 9592 - DNA, 16 bp, Artificial Sequence
  synthetic [barcode part1]
tacactctgaaggcgt

SEQ ID NO: 9593 - DNA, 16 bp, Artificial Sequence
  synthetic [barcode part1]
caatctcgcgttgatt

SEQ ID NO: 9594 - DNA, 16 bp, Artificial Sequence
  synthetic [barcode part1]
gaagagtcagaggact

SEQ ID NO: 9595 - DNA, 16 bp, Artificial Sequence
  synthetic [barcode part1]
agatcacgtctgacac

SEQ ID NO: 9596 - DNA, 16 bp, Artificial Sequence
  synthetic [barcode part1]
cgcgcaggatatactt

SEQ ID NO: 9597 - DNA, 16 bp, Artificial Sequence
  synthetic [barcode part1]
atactctctggcggtc

SEQ ID NO: 9598 - DNA, 16 bp, Artificial Sequence
  synthetic [barcode part1]
agagtctggacgagtc

SEQ ID NO: 9599 - DNA, 16 bp, Artificial Sequence
  synthetic [barcode part1]
caggattactacggtc

SEQ ID NO: 9600 - DNA, 16 bp, Artificial Sequence
  synthetic [barcode part1]
tctgatcactgtacgt

SEQ ID NO: 9601 - DNA, 16 bp, Artificial Sequence
  synthetic [barcode part1]
gtcgtcttacctggac

SEQ ID NO: 9602 - DNA, 16 bp, Artificial Sequence
  synthetic [barcode part1]
attgcgattcgttcac

SEQ ID NO: 9603 - DNA, 16 bp, Artificial Sequence
  synthetic [barcode part1]
tactatctgttggcac

SEQ ID NO: 9604 - DNA, 16 bp, Artificial Sequence
  synthetic [barcode part1]
agacctgcgaaggact

SEQ ID NO: 9605 - DNA, 16 bp, Artificial Sequence
  synthetic [barcode part1]
aattggcggtcttgac

SEQ ID NO: 9606 - DNA, 16 bp, Artificial Sequence
  synthetic [barcode part1]
atcgtgttggtaagag

SEQ ID NO: 9607 - DNA, 16 bp, Artificial Sequence
  synthetic [barcode part1]
gcaccactgttcactg

SEQ ID NO: 9608 - DNA, 16 bp, Artificial Sequence
  synthetic [barcode part1]
gtcaactgagaaggag

SEQ ID NO: 9609 - DNA, 16 bp, Artificial Sequence
  synthetic [barcode part1]
tgttgcagtgtgtgtg

SEQ ID NO: 9610 - DNA, 16 bp, Artificial Sequence
  synthetic [barcode part1]
aaggtcctctacttgt

SEQ ID NO: 9611 - DNA, 16 bp, Artificial Sequence
  synthetic [barcode part1]
tggtagtcacgaaggc

SEQ ID NO: 9612 - DNA, 16 bp, Artificial Sequence
  synthetic [barcode part1]
aggtggtacacctgag

SEQ ID NO: 9613 - DNA, 16 bp, Artificial Sequence
  synthetic [barcode part1]
cgtaatctcctgttag

SEQ ID NO: 9614 - DNA, 16 bp, Artificial Sequence
  synthetic [barcode part1]
gtcgataggtgtatcc

SEQ ID NO: 9615 - DNA, 16 bp, Artificial Sequence
  synthetic [barcode part1]
agtagaactaggtgtc

SEQ ID NO: 9616 - DNA, 16 bp, Artificial Sequence
  synthetic [barcode part1]
acgataaccgtcactg

SEQ ID NO: 9617 - DNA, 16 bp, Artificial Sequence
  synthetic [barcode part1]
cagtgacggagtacgt

SEQ ID NO: 9618 - DNA, 16 bp, Artificial Sequence
  synthetic [barcode part1]
cctagaagactagtcc

SEQ ID NO: 9619 - DNA, 16 bp, Artificial Sequence
  synthetic [barcode part1]
gatctactacctggag

SEQ ID NO: 9620 - DNA, 16 bp, Artificial Sequence
  synthetic [barcode part1]
cctgactcgtaactgc

SEQ ID NO: 9621 - DNA, 16 bp, Artificial Sequence
  synthetic [barcode part1]
accgcaattacctgtt

SEQ ID NO: 9622 - DNA, 16 bp, Artificial Sequence
  synthetic [barcode part1]
acgattcagaccactg

SEQ ID NO: 9623 - DNA, 16 bp, Artificial Sequence
  synthetic [barcode part1]
cggtaacaactgtcgt

SEQ ID NO: 9624 - DNA, 16 bp, Artificial Sequence
  synthetic [barcode part1]
ttgtacctgaaccgtt

SEQ ID NO: 9625 - DNA, 16 bp, Artificial Sequence
  synthetic [barcode part1]
tggacagttgttcacg

SEQ ID NO: 9626 - DNA, 16 bp, Artificial Sequence
  synthetic [barcode part1]
tggattcctattccag

SEQ ID NO: 9627 - DNA, 16 bp, Artificial Sequence
  synthetic [barcode part1]
cctcgattgtgttaac

SEQ ID NO: 9628 - DNA, 16 bp, Artificial Sequence
  synthetic [barcode part1]
gtaatcgatatcggcc

SEQ ID NO: 9629 - DNA, 16 bp, Artificial Sequence
  synthetic [barcode part1]
gcgcgaggaattatcg

SEQ ID NO: 9630 - DNA, 16 bp, Artificial Sequence
  synthetic [barcode part1]
gcgtagatcactggag

SEQ ID NO: 9631 - DNA, 16 bp, Artificial Sequence
  synthetic [barcode part1]
ccgtcgtagatagtgt

SEQ ID NO: 9632 - DNA, 16 bp, Artificial Sequence
  synthetic [barcode part1]
cgttccttctctgtag

SEQ ID NO: 9633 - DNA, 16 bp, Artificial Sequence
  synthetic [barcode part1]
tccagtcctgaagaac

SEQ ID NO: 9634 - DNA, 16 bp, Artificial Sequence
  synthetic [barcode part1]
attcgagtcactccgc

SEQ ID NO: 9635 - DNA, 16 bp, Artificial Sequence
  synthetic [barcode part1]
cagactaacgcctctc

SEQ ID NO: 9636 - DNA, 16 bp, Artificial Sequence
  synthetic [barcode part1]
aagactcgcgatactc

SEQ ID NO: 9637 - DNA, 16 bp, Artificial Sequence
  synthetic [barcode part1]
ccgttcttgtgagtcg

SEQ ID NO: 9638 - DNA, 16 bp, Artificial Sequence
  synthetic [barcode part1]
caataatccggtggtc

SEQ ID NO: 9639 - DNA, 16 bp, Artificial Sequence
  synthetic [barcode part1]
gagtaccagatccact

SEQ ID NO: 9640 - DNA, 16 bp, Artificial Sequence
  synthetic [barcode part1]
ttgcgttaggcacagt

SEQ ID NO: 9641 - DNA, 16 bp, Artificial Sequence
  synthetic [barcode part1]
gacgagacgcactaac

SEQ ID NO: 9642 - DNA, 16 bp, Artificial Sequence
  synthetic [barcode part1]
tgtgtgtactgtggtg

SEQ ID NO: 9643 - DNA, 16 bp, Artificial Sequence
  synthetic [barcode part1]
cggaatcttccttcct

SEQ ID NO: 9644 - DNA, 16 bp, Artificial Sequence
  synthetic [barcode part1]
acaagtcctccaccac

SEQ ID NO: 9645 - DNA, 16 bp, Artificial Sequence
  synthetic [barcode part1]
ttgtcgtggacttact

SEQ ID NO: 9646 - DNA, 16 bp, Artificial Sequence
  synthetic [barcode part1]
tggtgttagacggacg

SEQ ID NO: 9647 - DNA, 16 bp, Artificial Sequence
  synthetic [barcode part1]
aatacacgccggtact

SEQ ID NO: 9648 - DNA, 16 bp, Artificial Sequence
  synthetic [barcode part1]
gcaccgtggtagatag

SEQ ID NO: 9649 - DNA, 16 bp, Artificial Sequence
  synthetic [barcode part1]
cgtgtatatacacgcg

SEQ ID NO: 9650 - DNA, 16 bp, Artificial Sequence
  synthetic [barcode part1]
cggttaaccaattggc

SEQ ID NO: 9651 - DNA, 16 bp, Artificial Sequence
  synthetic [barcode part1]
gcggaatcttggacag

SEQ ID NO: 9652 - DNA, 16 bp, Artificial Sequence
  synthetic [barcode part1]
gaagttcctcacttac

SEQ ID NO: 9653 - DNA, 16 bp, Artificial Sequence
  synthetic [barcode part1]
agatagacctagagtc

SEQ ID NO: 9654 - DNA, 16 bp, Artificial Sequence
  synthetic [barcode part1]
cggacaagatattacg

SEQ ID NO: 9655 - DNA, 16 bp, Artificial Sequence
  synthetic [barcode part1]
gttggtatccgactcc

SEQ ID NO: 9656 - DNA, 16 bp, Artificial Sequence
  synthetic [barcode part1]
gaatcggttagaggag

SEQ ID NO: 9657 - DNA, 16 bp, Artificial Sequence
  synthetic [barcode part1]
gagtgtgtatactccg

SEQ ID NO: 9658 - DNA, 16 bp, Artificial Sequence
  synthetic [barcode part1]
agtcctactgttcgcg

SEQ ID NO: 9659 - DNA, 16 bp, Artificial Sequence
  synthetic [barcode part1]
attcttcgcgtgccag

SEQ ID NO: 9660 - DNA, 16 bp, Artificial Sequence
  synthetic [barcode part1]
tgcctacgtggtactc

SEQ ID NO: 9661 - DNA, 16 bp, Artificial Sequence
  synthetic [barcode part1]
ccactaagattgccag

SEQ ID NO: 9662 - DNA, 16 bp, Artificial Sequence
  synthetic [barcode part1]
gagtactacgaacctc

SEQ ID NO: 9663 - DNA, 16 bp, Artificial Sequence
  synthetic [barcode part1]
cgagagacttcaactc

SEQ ID NO: 9664 - DNA, 16 bp, Artificial Sequence
  synthetic [barcode part1]
ccagtcgcaatatcag

SEQ ID NO: 9665 - DNA, 16 bp, Artificial Sequence
  synthetic [barcode part1]
ccagtgattgtcaggt

SEQ ID NO: 9666 - DNA, 16 bp, Artificial Sequence
  synthetic [barcode part1]
gaggatctggtacacg

SEQ ID NO: 9667 - DNA, 16 bp, Artificial Sequence
  synthetic [barcode part1]
tctagaggttaaccgc

SEQ ID NO: 9668 - DNA, 16 bp, Artificial Sequence
  synthetic [barcode part1]
cagtgagatctgtaag

SEQ ID NO: 9669 - DNA, 16 bp, Artificial Sequence
  synthetic [barcode part1]
tggcaccgtgagtaag

SEQ ID NO: 9670 - DNA, 16 bp, Artificial Sequence
  synthetic [barcode part1]
ccttgtccactatctg

SEQ ID NO: 9671 - DNA, 16 bp, Artificial Sequence
  synthetic [barcode part1]
tcgtccttcggatacg

SEQ ID NO: 9672 - DNA, 16 bp, Artificial Sequence
  synthetic [barcode part1]
acctgaacgagtatcc

SEQ ID NO: 9673 - DNA, 16 bp, Artificial Sequence
  synthetic [barcode part1]
gaataacagaggccag

SEQ ID NO: 9674 - DNA, 16 bp, Artificial Sequence
  synthetic [barcode part1]
gataagaacactcgac

SEQ ID NO: 9675 - DNA, 16 bp, Artificial Sequence
  synthetic [barcode part1]
tgtgagtaataaggcc

SEQ ID NO: 9676 - DNA, 16 bp, Artificial Sequence
  synthetic [barcode part1]
aggaggtaacggtaac

SEQ ID NO: 9677 - DNA, 16 bp, Artificial Sequence
  synthetic [barcode part1]
gcagtgcaactaactc

SEQ ID NO: 9678 - DNA, 16 bp, Artificial Sequence
  synthetic [barcode part1]
attggcagttcttcac

SEQ ID NO: 9679 - DNA, 16 bp, Artificial Sequence
  synthetic [barcode part1]
tgtagactccgttgcc

SEQ ID NO: 9680 - DNA, 16 bp, Artificial Sequence
  synthetic [barcode part1]
acaactgttggaagac

SEQ ID NO: 9681 - DNA, 16 bp, Artificial Sequence
  synthetic [barcode part1]
tgaggtggtctgagtg

SEQ ID NO: 9682 - DNA, 16 bp, Artificial Sequence
  synthetic [barcode part1]
agagattgcactggcg

SEQ ID NO: 9683 - DNA, 16 bp, Artificial Sequence
  synthetic [barcode part1]
taactggaccgattgc

SEQ ID NO: 9684 - DNA, 16 bp, Artificial Sequence
  synthetic [barcode part1]
gaaccttcaattggcg

SEQ ID NO: 9685 - DNA, 16 bp, Artificial Sequence
  synthetic [barcode part1]
aattgcggattaaggc

SEQ ID NO: 9686 - DNA, 16 bp, Artificial Sequence
  synthetic [barcode part1]
gagtcgccttacactc

SEQ ID NO: 9687 - DNA, 16 bp, Artificial Sequence
  synthetic [barcode part1]
cgattagattggtcgc

SEQ ID NO: 9688 - DNA, 16 bp, Artificial Sequence
  synthetic [barcode part1]
tgccgagtagaagtgc

SEQ ID NO: 9689 - DNA, 16 bp, Artificial Sequence
  synthetic [barcode part1]
tctctcgtgccagtag

SEQ ID NO: 9690 - DNA, 16 bp, Artificial Sequence
  synthetic [barcode part1]
tctcctcgatcgactt

SEQ ID NO: 9691 - DNA, 16 bp, Artificial Sequence
  synthetic [barcode part1]
ataggtccgcactaac

SEQ ID NO: 9692 - DNA, 16 bp, Artificial Sequence
  synthetic [barcode part1]
gttctgatcagaaccg

SEQ ID NO: 9693 - DNA, 16 bp, Artificial Sequence
  synthetic [barcode part1]
caactaggaggaagac

SEQ ID NO: 9694 - DNA, 16 bp, Artificial Sequence
  synthetic [barcode part1]
gcagtattaacaccgc

SEQ ID NO: 9695 - DNA, 16 bp, Artificial Sequence
  synthetic [barcode part1]
gcggtcaattaacacc

SEQ ID NO: 9696 - DNA, 16 bp, Artificial Sequence
  synthetic [barcode part1]
caacggtctggtgatt

SEQ ID NO: 9697 - DNA, 16 bp, Artificial Sequence
  synthetic [barcode part1]
tctcggcagaagttgt

SEQ ID NO: 9698 - DNA, 16 bp, Artificial Sequence
  synthetic [barcode part1]
gttgtctcaggtgcct

SEQ ID NO: 9699 - DNA, 16 bp, Artificial Sequence
  synthetic [barcode part1]
aacaaggtcggcacgt

SEQ ID NO: 9700 - DNA, 16 bp, Artificial Sequence
  synthetic [barcode part1]
tcctctgactcttcag

SEQ ID NO: 9701 - DNA, 16 bp, Artificial Sequence
  synthetic [barcode part1]
gaaggcgattctcact

SEQ ID NO: 9702 - DNA, 16 bp, Artificial Sequence
  synthetic [barcode part1]
ccaagtaacggatctc

SEQ ID NO: 9703 - DNA, 16 bp, Artificial Sequence
  synthetic [barcode part1]
gatcttccgtgaactt

SEQ ID NO: 9704 - DNA, 16 bp, Artificial Sequence
  synthetic [barcode part1]
tagattggaccgtcgt

SEQ ID NO: 9705 - DNA, 16 bp, Artificial Sequence
  synthetic [barcode part1]
gttatctgaacggtgc

SEQ ID NO: 9706 - DNA, 16 bp, Artificial Sequence
  synthetic [barcode part1]
tctccaatacgactgt

SEQ ID NO: 9707 - DNA, 16 bp, Artificial Sequence
  synthetic [barcode part1]
aagttgccggagacac

SEQ ID NO: 9708 - DNA, 16 bp, Artificial Sequence
  synthetic [barcode part1]
ccaggacagatcttac

SEQ ID NO: 9709 - DNA, 16 bp, Artificial Sequence
  synthetic [barcode part1]
taccggacactgagtt

SEQ ID NO: 9710 - DNA, 16 bp, Artificial Sequence
  synthetic [barcode part1]
cgtaacgaggtagatt

SEQ ID NO: 9711 - DNA, 16 bp, Artificial Sequence
  synthetic [barcode part1]
gacggcgataagtctg

SEQ ID NO: 9712 - DNA, 16 bp, Artificial Sequence
  synthetic [barcode part1]
cagttgtgcaactgtg

SEQ ID NO: 9713 - DNA, 16 bp, Artificial Sequence
  synthetic [barcode part1]
gcacagtctccagtct

SEQ ID NO: 9714 - DNA, 16 bp, Artificial Sequence
  synthetic [barcode part1]
ttaccgcacctgtgac

SEQ ID NO: 9715 - DNA, 16 bp, Artificial Sequence
  synthetic [barcode part1]
cacgacaccgttcact

SEQ ID NO: 9716 - DNA, 16 bp, Artificial Sequence
  synthetic [barcode part1]
tgacgtagatccgtac

SEQ ID NO: 9717 - DNA, 16 bp, Artificial Sequence
  synthetic [barcode part1]
gtacttccgactcggt

SEQ ID NO: 9718 - DNA, 16 bp, Artificial Sequence
  synthetic [barcode part1]
gtgtcctcgacagttc

SEQ ID NO: 9719 - DNA, 16 bp, Artificial Sequence
  synthetic [barcode part1]
tagacctcttgccacg

SEQ ID NO: 9720 - DNA, 16 bp, Artificial Sequence
  synthetic [barcode part1]
tctgatcctccaacct

SEQ ID NO: 9721 - DNA, 16 bp, Artificial Sequence
  synthetic [barcode part1]
ttacgtcggtaatcct

SEQ ID NO: 9722 - DNA, 16 bp, Artificial Sequence
  synthetic [barcode part1]
accgaagactaatacg

SEQ ID NO: 9723 - DNA, 16 bp, Artificial Sequence
  synthetic [barcode part1]
taacggcggagatatt

SEQ ID NO: 9724 - DNA, 16 bp, Artificial Sequence
  synthetic [barcode part1]
tccaattgttgcgcgc

SEQ ID NO: 9725 - DNA, 16 bp, Artificial Sequence
  synthetic [barcode part1]
tgtactctctggtagt

SEQ ID NO: 9726 - DNA, 16 bp, Artificial Sequence
  synthetic [barcode part1]
gacctcctgacttctt

SEQ ID NO: 9727 - DNA, 16 bp, Artificial Sequence
  synthetic [barcode part1]
gtaactctcaccgaag

SEQ ID NO: 9728 - DNA, 16 bp, Artificial Sequence
  synthetic [barcode part1]
ccgtggtattaaccag

SEQ ID NO: 9729 - DNA, 16 bp, Artificial Sequence
  synthetic [barcode part1]
ttcgacaagacgcgag

SEQ ID NO: 9730 - DNA, 16 bp, Artificial Sequence
  synthetic [barcode part1]
cggtaacagagatact

SEQ ID NO: 9731 - DNA, 16 bp, Artificial Sequence
  synthetic [barcode part1]
tcgcggagaatatctc

SEQ ID NO: 9732 - DNA, 16 bp, Artificial Sequence
  synthetic [barcode part1]
caggaggtgacacgtt

SEQ ID NO: 9733 - DNA, 16 bp, Artificial Sequence
  synthetic [barcode part1]
cgatcgacgatcaact

SEQ ID NO: 9734 - DNA, 16 bp, Artificial Sequence
  synthetic [barcode part1]
attcctgcctgtgtct

SEQ ID NO: 9735 - DNA, 16 bp, Artificial Sequence
  synthetic [barcode part1]
gagtgtcgtcttgcct

SEQ ID NO: 9736 - DNA, 16 bp, Artificial Sequence
  synthetic [barcode part1]
gtgcgatagaattggt

SEQ ID NO: 9737 - DNA, 16 bp, Artificial Sequence
  synthetic [barcode part1]
tgactcaagatacgag

SEQ ID NO: 9738 - DNA, 16 bp, Artificial Sequence
  synthetic [barcode part1]
gaattgactggaggag

SEQ ID NO: 9739 - DNA, 16 bp, Artificial Sequence
  synthetic [barcode part1]
gccgtgatctacttgc

SEQ ID NO: 9740 - DNA, 16 bp, Artificial Sequence
  synthetic [barcode part1]
tacgactaagacaacg

SEQ ID NO: 9741 - DNA, 16 bp, Artificial Sequence
  synthetic [barcode part1]
gtgtgcagacttcagt

SEQ ID NO: 9742 - DNA, 16 bp, Artificial Sequence
  synthetic [barcode part1]
tgttcagttctaccag

SEQ ID NO: 9743 - DNA, 16 bp, Artificial Sequence
  synthetic [barcode part1]
cggcaatcgtgtctct

SEQ ID NO: 9744 - DNA, 16 bp, Artificial Sequence
  synthetic [barcode part1]
tggattacctcgtgtt

SEQ ID NO: 9745 - DNA, 16 bp, Artificial Sequence
  synthetic [barcode part1]
gcaatactacacgcac

SEQ ID NO: 9746 - DNA, 16 bp, Artificial Sequence
  synthetic [barcode part1]
ttgacaggcaatctgc

SEQ ID NO: 9747 - DNA, 16 bp, Artificial Sequence
  synthetic [barcode part1]
gtattaggaccgcgtt

SEQ ID NO: 9748 - DNA, 16 bp, Artificial Sequence
  synthetic [barcode part1]
tagtcttcgcgtgacc

SEQ ID NO: 9749 - DNA, 16 bp, Artificial Sequence
  synthetic [barcode part1]
tgcggtatactcgcct

SEQ ID NO: 9750 - DNA, 16 bp, Artificial Sequence
  synthetic [barcode part1]
aaggcaaccgtcttgt

SEQ ID NO: 9751 - DNA, 16 bp, Artificial Sequence
  synthetic [barcode part1]
attcgccttcgaggtc

SEQ ID NO: 9752 - DNA, 16 bp, Artificial Sequence
  synthetic [barcode part1]
tcgtgaacgttctgcc

SEQ ID NO: 9753 - DNA, 16 bp, Artificial Sequence
  synthetic [barcode part1]
gatataccttcggtct

SEQ ID NO: 9754 - DNA, 16 bp, Artificial Sequence
  synthetic [barcode part1]
gattgtgccaacctcc

SEQ ID NO: 9755 - DNA, 16 bp, Artificial Sequence
  synthetic [barcode part1]
tcagacagtgacaggc

SEQ ID NO: 9756 - DNA, 16 bp, Artificial Sequence
  synthetic [barcode part1]
ccaagtgacaggttct

SEQ ID NO: 9757 - DNA, 16 bp, Artificial Sequence
  synthetic [barcode part1]
gagttacaggtcactc

SEQ ID NO: 9758 - DNA, 16 bp, Artificial Sequence
  synthetic [barcode part1]
ataggccgaggtaatt

SEQ ID NO: 9759 - DNA, 16 bp, Artificial Sequence
  synthetic [barcode part1]
acctgtagattcgcag

SEQ ID NO: 9760 - DNA, 16 bp, Artificial Sequence
  synthetic [barcode part1]
actccgcgtctgaact

SEQ ID NO: 9761 - DNA, 16 bp, Artificial Sequence
  synthetic [barcode part1]
tctctgcacgacctag

SEQ ID NO: 9762 - DNA, 16 bp, Artificial Sequence
  synthetic [barcode part1]
aacctacgcgacgaag

SEQ ID NO: 9763 - DNA, 16 bp, Artificial Sequence
  synthetic [barcode part1]
gattgtcacaagagtg

SEQ ID NO: 9764 - DNA, 16 bp, Artificial Sequence
  synthetic [barcode part1]
gaagtagacaggtctt

SEQ ID NO: 9765 - DNA, 16 bp, Artificial Sequence
  synthetic [barcode part1]
aggagaccaagtccac

SEQ ID NO: 9766 - DNA, 16 bp, Artificial Sequence
  synthetic [barcode part1]
gcggatacactacgag

SEQ ID NO: 9767 - DNA, 16 bp, Artificial Sequence
  synthetic [barcode part1]
tcggaacggtactact

SEQ ID NO: 9768 - DNA, 16 bp, Artificial Sequence
  synthetic [barcode part1]
tcctgtgcagtccaac

SEQ ID NO: 9769 - DNA, 16 bp, Artificial Sequence
  synthetic [barcode part1]
gatccaaggttcgatc

SEQ ID NO: 9770 - DNA, 16 bp, Artificial Sequence
  synthetic [barcode part1]
attcaagacttcgcct

SEQ ID NO: 9771 - DNA, 16 bp, Artificial Sequence
  synthetic [barcode part1]
agagatagacgatctc

SEQ ID NO: 9772 - DNA, 16 bp, Artificial Sequence
  synthetic [barcode part1]
tccgactaattcctcc

SEQ ID NO: 9773 - DNA, 16 bp, Artificial Sequence
  synthetic [barcode part1]
cgaggaacgcaatcac

SEQ ID NO: 9774 - DNA, 16 bp, Artificial Sequence
  synthetic [barcode part1]
gtgcgactgtacaatc

SEQ ID NO: 9775 - DNA, 16 bp, Artificial Sequence
  synthetic [barcode part1]
gttctcagaatcacct

SEQ ID NO: 9776 - DNA, 16 bp, Artificial Sequence
  synthetic [barcode part1]
ttacctggcaagtggt

SEQ ID NO: 9777 - DNA, 16 bp, Artificial Sequence
  synthetic [barcode part1]
tgttattggtgcgtct

SEQ ID NO: 9778 - DNA, 16 bp, Artificial Sequence
  synthetic [barcode part1]
gaagttccacttactc

SEQ ID NO: 9779 - DNA, 16 bp, Artificial Sequence
  synthetic [barcode part1]
cactgttgagtactct

SEQ ID NO: 9780 - DNA, 16 bp, Artificial Sequence
  synthetic [barcode part1]
cgaccttctcttcaac

SEQ ID NO: 9781 - DNA, 16 bp, Artificial Sequence
  synthetic [barcode part1]
gactagtagagaaggc

SEQ ID NO: 9782 - DNA, 16 bp, Artificial Sequence
  synthetic [barcode part1]
gtgtgacaccagtact

SEQ ID NO: 9783 - DNA, 16 bp, Artificial Sequence
  synthetic [barcode part1]
gaatatctcgcggact

SEQ ID NO: 9784 - DNA, 16 bp, Artificial Sequence
  synthetic [barcode part1]
acagactgtactcgac

SEQ ID NO: 9785 - DNA, 16 bp, Artificial Sequence
  synthetic [barcode part1]
gtgcacggtattacac

SEQ ID NO: 9786 - DNA, 16 bp, Artificial Sequence
  synthetic [barcode part1]
agtgcagactcttacg

SEQ ID NO: 9787 - DNA, 16 bp, Artificial Sequence
  synthetic [barcode part1]
tgatacctccacttag

SEQ ID NO: 9788 - DNA, 16 bp, Artificial Sequence
  synthetic [barcode part1]
tggaactattgaccgc

SEQ ID NO: 9789 - DNA, 16 bp, Artificial Sequence
  synthetic [barcode part1]
tgtaaccttcttgacg

SEQ ID NO: 9790 - DNA, 16 bp, Artificial Sequence
  synthetic [barcode part1]
gtagtgttgcacgtac

SEQ ID NO: 9791 - DNA, 16 bp, Artificial Sequence
  synthetic [barcode part1]
tggacagacgagtaag

SEQ ID NO: 9792 - DNA, 16 bp, Artificial Sequence
  synthetic [barcode part1]
tgcgaacggtacttgt

SEQ ID NO: 9793 - DNA, 16 bp, Artificial Sequence
  synthetic [barcode part1]
tggtcagaaccgactt

SEQ ID NO: 9794 - DNA, 16 bp, Artificial Sequence
  synthetic [barcode part1]
tcaacacgttggtgtg

SEQ ID NO: 9795 - DNA, 16 bp, Artificial Sequence
  synthetic [barcode part1]
cagtgtgacgtgatct

SEQ ID NO: 9796 - DNA, 16 bp, Artificial Sequence
  synthetic [barcode part1]
ttcaacgattctcacg

SEQ ID NO: 9797 - DNA, 16 bp, Artificial Sequence
  synthetic [barcode part1]
caggaacgacaacctg

SEQ ID NO: 9798 - DNA, 16 bp, Artificial Sequence
  synthetic [barcode part1]
gtgtctcgtcgtcaac

SEQ ID NO: 9799 - DNA, 16 bp, Artificial Sequence
  synthetic [barcode part1]
attcacgccagatacg

SEQ ID NO: 9800 - DNA, 16 bp, Artificial Sequence
  synthetic [barcode part1]
aatacacgtacgccgt

SEQ ID NO: 9801 - DNA, 16 bp, Artificial Sequence
  synthetic [barcode part1]
aacaacctgtggaggc

SEQ ID NO: 9802 - DNA, 16 bp, Artificial Sequence
  synthetic [barcode part1]
tgtctcaccgcggatt

SEQ ID NO: 9803 - DNA, 16 bp, Artificial Sequence
  synthetic [barcode part1]
gactgttattcctacg

SEQ ID NO: 9804 - DNA, 16 bp, Artificial Sequence
  synthetic [barcode part1]
aaggtgcgtattcctg

SEQ ID NO: 9805 - DNA, 16 bp, Artificial Sequence
  synthetic [barcode part1]
cgtgaatagtagagtc

SEQ ID NO: 9806 - DNA, 16 bp, Artificial Sequence
  synthetic [barcode part1]
attgaccaggaaggag

SEQ ID NO: 9807 - DNA, 16 bp, Artificial Sequence
  synthetic [barcode part1]
actcctcgttgcgtag

SEQ ID NO: 9808 - DNA, 16 bp, Artificial Sequence
  synthetic [barcode part1]
caacggcaagatatac

SEQ ID NO: 9809 - DNA, 16 bp, Artificial Sequence
  synthetic [barcode part1]
gtatcaacgactctct

SEQ ID NO: 9810 - DNA, 16 bp, Artificial Sequence
  synthetic [barcode part1]
gtaattgtcggtctct

SEQ ID NO: 9811 - DNA, 16 bp, Artificial Sequence
  synthetic [barcode part1]
gttagtcactgtggtg

SEQ ID NO: 9812 - DNA, 16 bp, Artificial Sequence
  synthetic [barcode part1]
ccggagtaataggcac

SEQ ID NO: 9813 - DNA, 16 bp, Artificial Sequence
  synthetic [barcode part1]
tccacgtaacctaatc

SEQ ID NO: 9814 - DNA, 16 bp, Artificial Sequence
  synthetic [barcode part1]
agactacgacgtggac

SEQ ID NO: 9815 - DNA, 16 bp, Artificial Sequence
  synthetic [barcode part1]
ccgccaaggagtatag

SEQ ID NO: 9816 - DNA, 16 bp, Artificial Sequence
  synthetic [barcode part1]
caggtgtgacttgtgt

SEQ ID NO: 9817 - DNA, 16 bp, Artificial Sequence
  synthetic [barcode part1]
tagtcggccttcttct

SEQ ID NO: 9818 - DNA, 16 bp, Artificial Sequence
  synthetic [barcode part1]
tattgcgaggacttcg

SEQ ID NO: 9819 - DNA, 16 bp, Artificial Sequence
  synthetic [barcode part1]
cgagaagtaacgtgcc

SEQ ID NO: 9820 - DNA, 16 bp, Artificial Sequence
  synthetic [barcode part1]
cgcgatcactgttctg

SEQ ID NO: 9821 - DNA, 16 bp, Artificial Sequence
  synthetic [barcode part1]
aaggacggtctctatc

SEQ ID NO: 9822 - DNA, 16 bp, Artificial Sequence
  synthetic [barcode part1]
tcgcgtggtattaacg

SEQ ID NO: 9823 - DNA, 16 bp, Artificial Sequence
  synthetic [barcode part1]
acttgactgacctgag

SEQ ID NO: 9824 - DNA, 16 bp, Artificial Sequence
  synthetic [barcode part1]
gatactacacgtgcgt

SEQ ID NO: 9825 - DNA, 16 bp, Artificial Sequence
  synthetic [barcode part1]
ttcacgacagagtaag

SEQ ID NO: 9826 - DNA, 16 bp, Artificial Sequence
  synthetic [barcode part1]
gtcgtgcggaatagtg

SEQ ID NO: 9827 - DNA, 16 bp, Artificial Sequence
  synthetic [barcode part1]
aacttccgcgtaactt

SEQ ID NO: 9828 - DNA, 16 bp, Artificial Sequence
  synthetic [barcode part1]
agtcgtgccagtctct

SEQ ID NO: 9829 - DNA, 16 bp, Artificial Sequence
  synthetic [barcode part1]
aacgacgtcaccttag

SEQ ID NO: 9830 - DNA, 16 bp, Artificial Sequence
  synthetic [barcode part1]
aaggacggataattcc

SEQ ID NO: 9831 - DNA, 16 bp, Artificial Sequence
  synthetic [barcode part1]
aggccgtatctgatac

SEQ ID NO: 9832 - DNA, 16 bp, Artificial Sequence
  synthetic [barcode part1]
agtgtgcgcgttgatt

SEQ ID NO: 9833 - DNA, 16 bp, Artificial Sequence
  synthetic [barcode part1]
cagagagaggattgac

SEQ ID NO: 9834 - DNA, 16 bp, Artificial Sequence
  synthetic [barcode part1]
cggacctcgttacttg

SEQ ID NO: 9835 - DNA, 16 bp, Artificial Sequence
  synthetic [barcode part1]
ttcgtccttacaacag

SEQ ID NO: 9836 - DNA, 16 bp, Artificial Sequence
  synthetic [barcode part1]
gtaatagatccgaacg

SEQ ID NO: 9837 - DNA, 16 bp, Artificial Sequence
  synthetic [barcode part1]
gtggatcggagtgact

SEQ ID NO: 9838 - DNA, 16 bp, Artificial Sequence
  synthetic [barcode part1]
cgtaagtcgagtatcc

SEQ ID NO: 9839 - DNA, 16 bp, Artificial Sequence
  synthetic [barcode part1]
aatcctgtgttcgttg

SEQ ID NO: 9840 - DNA, 16 bp, Artificial Sequence
  synthetic [barcode part1]
accgtctgtctgtgac

SEQ ID NO: 9841 - DNA, 16 bp, Artificial Sequence
  synthetic [barcode part1]
gcaacttccgtgtctg

SEQ ID NO: 9842 - DNA, 16 bp, Artificial Sequence
  synthetic [barcode part1]
gcagagtgagtaacag

SEQ ID NO: 9843 - DNA, 16 bp, Artificial Sequence
  synthetic [barcode part1]
aagactcgacgaacgc

SEQ ID NO: 9844 - DNA, 16 bp, Artificial Sequence
  synthetic [barcode part1]
tggcagttgacctagt

SEQ ID NO: 9845 - DNA, 16 bp, Artificial Sequence
  synthetic [barcode part1]
ttctctcgttacgacc

SEQ ID NO: 9846 - DNA, 16 bp, Artificial Sequence
  synthetic [barcode part1]
tgagttacggtgacct

SEQ ID NO: 9847 - DNA, 16 bp, Artificial Sequence
  synthetic [barcode part1]
gcgaattacacctgac

SEQ ID NO: 9848 - DNA, 16 bp, Artificial Sequence
  synthetic [barcode part1]
acggtgtagaacctct

SEQ ID NO: 9849 - DNA, 16 bp, Artificial Sequence
  synthetic [barcode part1]
atcgtcagtcaggttg

SEQ ID NO: 9850 - DNA, 16 bp, Artificial Sequence
  synthetic [barcode part1]
tattcgtggcactgcc

SEQ ID NO: 9851 - DNA, 16 bp, Artificial Sequence
  synthetic [barcode part1]
tagataccgactcctt

SEQ ID NO: 9852 - DNA, 16 bp, Artificial Sequence
  synthetic [barcode part1]
aatctgattctcgcgt

SEQ ID NO: 9853 - DNA, 16 bp, Artificial Sequence
  synthetic [barcode part1]
cgactccaccaatatt

SEQ ID NO: 9854 - DNA, 16 bp, Artificial Sequence
  synthetic [barcode part1]
accgaacaacgatcct

SEQ ID NO: 9855 - DNA, 16 bp, Artificial Sequence
  synthetic [barcode part1]
tatccgatcctactag

SEQ ID NO: 9856 - DNA, 16 bp, Artificial Sequence
  synthetic [barcode part1]
ccagtatccgaccttg

SEQ ID NO: 9857 - DNA, 16 bp, Artificial Sequence
  synthetic [barcode part1]
tccaactaggaggtct

SEQ ID NO: 9858 - DNA, 16 bp, Artificial Sequence
  synthetic [barcode part1]
gtacggtctcttcggt

SEQ ID NO: 9859 - DNA, 16 bp, Artificial Sequence
  synthetic [barcode part1]
gttgcgacgttcacct

SEQ ID NO: 9860 - DNA, 16 bp, Artificial Sequence
  synthetic [barcode part1]
gtctggataggtacct

SEQ ID NO: 9861 - DNA, 16 bp, Artificial Sequence
  synthetic [barcode part1]
cgaccagtgatatcac

SEQ ID NO: 9862 - DNA, 16 bp, Artificial Sequence
  synthetic [barcode part1]
tgcacgaacttggact

SEQ ID NO: 9863 - DNA, 16 bp, Artificial Sequence
  synthetic [barcode part1]
tcgatacaggagaccg

SEQ ID NO: 9864 - DNA, 16 bp, Artificial Sequence
  synthetic [barcode part1]
actaccagtacaagag

SEQ ID NO: 9865 - DNA, 16 bp, Artificial Sequence
  synthetic [barcode part1]
gtgacacgtgttgtgt

SEQ ID NO: 9866 - DNA, 16 bp, Artificial Sequence
  synthetic [barcode part1]
tgtccacagactccac

SEQ ID NO: 9867 - DNA, 16 bp, Artificial Sequence
  synthetic [barcode part1]
gttaggtctcgcgttc

SEQ ID NO: 9868 - DNA, 16 bp, Artificial Sequence
  synthetic [barcode part1]
cgatagtataccttcc

SEQ ID NO: 9869 - DNA, 16 bp, Artificial Sequence
  synthetic [barcode part1]
acggtcaagaattggt

SEQ ID NO: 9870 - DNA, 16 bp, Artificial Sequence
  synthetic [barcode part1]
agaacggtcgtgaacc

SEQ ID NO: 9871 - DNA, 16 bp, Artificial Sequence
  synthetic [barcode part1]
cacacgcaactaatcg

SEQ ID NO: 9872 - DNA, 16 bp, Artificial Sequence
  synthetic [barcode part1]
tcgcaggatagaatac

SEQ ID NO: 9873 - DNA, 16 bp, Artificial Sequence
  synthetic [barcode part1]
gtaagttcggtagagt

SEQ ID NO: 9874 - DNA, 16 bp, Artificial Sequence
  synthetic [barcode part1]
ttccaagtaggtagag

SEQ ID NO: 9875 - DNA, 16 bp, Artificial Sequence
  synthetic [barcode part1]
tgtaggcgaatagtgt

SEQ ID NO: 9876 - DNA, 16 bp, Artificial Sequence
  synthetic [barcode part1]
ttgtcaccgagtatct

SEQ ID NO: 9877 - DNA, 16 bp, Artificial Sequence
  synthetic [barcode part1]
tgtactgcagtgtacg

SEQ ID NO: 9878 - DNA, 16 bp, Artificial Sequence
  synthetic [barcode part1]
tgttctgtcgtcctgt

SEQ ID NO: 9879 - DNA, 16 bp, Artificial Sequence
  synthetic [barcode part1]
aatacacctgaggagt

SEQ ID NO: 9880 - DNA, 16 bp, Artificial Sequence
  synthetic [barcode part1]
atctcaggtacgtacg

SEQ ID NO: 9881 - DNA, 16 bp, Artificial Sequence
  synthetic [barcode part1]
aactgcaacacactgc

SEQ ID NO: 9882 - DNA, 16 bp, Artificial Sequence
  synthetic [barcode part1]
agtcggaactcaggtg

SEQ ID NO: 9883 - DNA, 16 bp, Artificial Sequence
  synthetic [barcode part1]
cagattcagacggcag

SEQ ID NO: 9884 - DNA, 16 bp, Artificial Sequence
  synthetic [barcode part1]
aaggtcgacgcaactg

SEQ ID NO: 9885 - DNA, 16 bp, Artificial Sequence
  synthetic [barcode part1]
cgattctgatcggagt

SEQ ID NO: 9886 - DNA, 16 bp, Artificial Sequence
  synthetic [barcode part1]
agatcgttctggcaac

SEQ ID NO: 9887 - DNA, 16 bp, Artificial Sequence
  synthetic [barcode part1]
tctcggtaatctgcgc

SEQ ID NO: 9888 - DNA, 16 bp, Artificial Sequence
  synthetic [barcode part1]
gcgtattacaactgcg

SEQ ID NO: 9889 - DNA, 16 bp, Artificial Sequence
  synthetic [barcode part1]
gtctctaaggtacggt

SEQ ID NO: 9890 - DNA, 16 bp, Artificial Sequence
  synthetic [barcode part1]
aacgtcttgtcggtag

SEQ ID NO: 9891 - DNA, 16 bp, Artificial Sequence
  synthetic [barcode part1]
aggagtgtactgaatc

SEQ ID NO: 9892 - DNA, 16 bp, Artificial Sequence
  synthetic [barcode part1]
gaagattgcgtcgacg

SEQ ID NO: 9893 - DNA, 16 bp, Artificial Sequence
  synthetic [barcode part1]
cgtagtggtgagtggt

SEQ ID NO: 9894 - DNA, 16 bp, Artificial Sequence
  synthetic [barcode part1]
acttaccaacaccgtt

SEQ ID NO: 9895 - DNA, 16 bp, Artificial Sequence
  synthetic [barcode part1]
ccgcactaagtcgtct

SEQ ID NO: 9896 - DNA, 16 bp, Artificial Sequence
  synthetic [barcode part1]
gcaggcgtactgtaag

SEQ ID NO: 9897 - DNA, 16 bp, Artificial Sequence
  synthetic [barcode part1]
acaggtgcggaatctg

SEQ ID NO: 9898 - DNA, 16 bp, Artificial Sequence
  synthetic [barcode part1]
agtacgtgtgtactgc

SEQ ID NO: 9899 - DNA, 16 bp, Artificial Sequence
  synthetic [barcode part1]
agtgtggagattactg

SEQ ID NO: 9900 - DNA, 16 bp, Artificial Sequence
  synthetic [barcode part1]
cacagagtagtaactg

SEQ ID NO: 9901 - DNA, 16 bp, Artificial Sequence
  synthetic [barcode part1]
gtcgagtaatacaggt

SEQ ID NO: 9902 - DNA, 16 bp, Artificial Sequence
  synthetic [barcode part1]
attacgacagacgagt

SEQ ID NO: 9903 - DNA, 16 bp, Artificial Sequence
  synthetic [barcode part1]
gttcgcggacttatag

SEQ ID NO: 9904 - DNA, 16 bp, Artificial Sequence
  synthetic [barcode part1]
aatctcttctccggtc

SEQ ID NO: 9905 - DNA, 16 bp, Artificial Sequence
  synthetic [barcode part1]
ttctcaggttggtact

SEQ ID NO: 9906 - DNA, 16 bp, Artificial Sequence
  synthetic [barcode part1]
gtaggtcaactcgtgt

SEQ ID NO: 9907 - DNA, 16 bp, Artificial Sequence
  synthetic [barcode part1]
tggtcagacacacact

SEQ ID NO: 9908 - DNA, 16 bp, Artificial Sequence
  synthetic [barcode part1]
gttctgtcaggagact

SEQ ID NO: 9909 - DNA, 16 bp, Artificial Sequence
  synthetic [barcode part1]
cggtccaacctaatag

SEQ ID NO: 9910 - DNA, 16 bp, Artificial Sequence
  synthetic [barcode part1]
agtgaagtacaggtct

SEQ ID NO: 9911 - DNA, 16 bp, Artificial Sequence
  synthetic [barcode part1]
caccagaattcctgtt

SEQ ID NO: 9912 - DNA, 16 bp, Artificial Sequence
  synthetic [barcode part1]
cgtaccgaactggaag

SEQ ID NO: 9913 - DNA, 16 bp, Artificial Sequence
  synthetic [barcode part1]
tacttgccgccgtagt

SEQ ID NO: 9914 - DNA, 16 bp, Artificial Sequence
  synthetic [barcode part1]
aggtatctctaggtgc

SEQ ID NO: 9915 - DNA, 16 bp, Artificial Sequence
  synthetic [barcode part1]
tcaaccacacagtacg

SEQ ID NO: 9916 - DNA, 16 bp, Artificial Sequence
  synthetic [barcode part1]
agatccgcgtcttatt

SEQ ID NO: 9917 - DNA, 16 bp, Artificial Sequence
  synthetic [barcode part1]
tccgaatcactggtag

SEQ ID NO: 9918 - DNA, 16 bp, Artificial Sequence
  synthetic [barcode part1]
tgtacaggtgattgcc

SEQ ID NO: 9919 - DNA, 16 bp, Artificial Sequence
  synthetic [barcode part1]
gacggattgagtagag

SEQ ID NO: 9920 - DNA, 16 bp, Artificial Sequence
  synthetic [barcode part1]
ccaattgcaattggcg

SEQ ID NO: 9921 - DNA, 16 bp, Artificial Sequence
  synthetic [barcode part1]
gttacttggtacttgc

SEQ ID NO: 9922 - DNA, 16 bp, Artificial Sequence
  synthetic [barcode part1]
aggtaccgatactcgt

SEQ ID NO: 9923 - DNA, 16 bp, Artificial Sequence
  synthetic [barcode part1]
gacgtacctccgatct

SEQ ID NO: 9924 - DNA, 16 bp, Artificial Sequence
  synthetic [barcode part1]
actctcactgttgagt

SEQ ID NO: 9925 - DNA, 16 bp, Artificial Sequence
  synthetic [barcode part1]
cgtgaaggattgttag

SEQ ID NO: 9926 - DNA, 16 bp, Artificial Sequence
  synthetic [barcode part1]
tccactgacacagtcc

SEQ ID NO: 9927 - DNA, 16 bp, Artificial Sequence
  synthetic [barcode part1]
tcttggttcagacact

SEQ ID NO: 9928 - DNA, 16 bp, Artificial Sequence
  synthetic [barcode part1]
ttctgagttgtctgtg

SEQ ID NO: 9929 - DNA, 16 bp, Artificial Sequence
  synthetic [barcode part1]
cgaatacttagacgcc

SEQ ID NO: 9930 - DNA, 16 bp, Artificial Sequence
  synthetic [barcode part1]
tctcttacgaatccag

SEQ ID NO: 9931 - DNA, 16 bp, Artificial Sequence
  synthetic [barcode part1]
tagttatcggaagacg

SEQ ID NO: 9932 - DNA, 16 bp, Artificial Sequence
  synthetic [barcode part1]
agtgaaggagaaccgt

SEQ ID NO: 9933 - DNA, 16 bp, Artificial Sequence
  synthetic [barcode part1]
ccgtatcagtgacctc

SEQ ID NO: 9934 - DNA, 16 bp, Artificial Sequence
  synthetic [barcode part1]
tggtgacggagtgtgt

SEQ ID NO: 9935 - DNA, 16 bp, Artificial Sequence
  synthetic [barcode part1]
gtcttgatctcttccg

SEQ ID NO: 9936 - DNA, 16 bp, Artificial Sequence
  synthetic [barcode part1]
ttgagatcggagtcct

SEQ ID NO: 9937 - DNA, 16 bp, Artificial Sequence
  synthetic [barcode part1]
gcagtacttctggagt

SEQ ID NO: 9938 - DNA, 16 bp, Artificial Sequence
  synthetic [barcode part1]
tgtcactatccgagtt

SEQ ID NO: 9939 - DNA, 16 bp, Artificial Sequence
  synthetic [barcode part1]
gtccttcaatccttcg

SEQ ID NO: 9940 - DNA, 16 bp, Artificial Sequence
  synthetic [barcode part1]
ttccttcgtatcgcac

SEQ ID NO: 9941 - DNA, 16 bp, Artificial Sequence
  synthetic [barcode part1]
accacagaataggtgt

SEQ ID NO: 9942 - DNA, 16 bp, Artificial Sequence
  synthetic [barcode part1]
agtaccacagtgttgc

SEQ ID NO: 9943 - DNA, 16 bp, Artificial Sequence
  synthetic [barcode part1]
tactactctgcgtggc

SEQ ID NO: 9944 - DNA, 16 bp, Artificial Sequence
  synthetic [barcode part1]
tgcgttaccttaatcg

SEQ ID NO: 9945 - DNA, 16 bp, Artificial Sequence
  synthetic [barcode part1]
ccagacagaactcact

SEQ ID NO: 9946 - DNA, 16 bp, Artificial Sequence
  synthetic [barcode part1]
agagattaccgcgcag

SEQ ID NO: 9947 - DNA, 16 bp, Artificial Sequence
  synthetic [barcode part1]
atcacacttctcggcg

SEQ ID NO: 9948 - DNA, 16 bp, Artificial Sequence
  synthetic [barcode part1]
tgaggagattagtgtc

SEQ ID NO: 9949 - DNA, 16 bp, Artificial Sequence
  synthetic [barcode part1]
cgaagagtctctcaac

SEQ ID NO: 9950 - DNA, 16 bp, Artificial Sequence
  synthetic [barcode part1]
attgagacacgcgacg

SEQ ID NO: 9951 - DNA, 16 bp, Artificial Sequence
  synthetic [barcode part1]
gttgactgactaaccg

SEQ ID NO: 9952 - DNA, 16 bp, Artificial Sequence
  synthetic [barcode part1]
ttccttagagtactcg

SEQ ID NO: 9953 - DNA, 16 bp, Artificial Sequence
  synthetic [barcode part1]
ccgtaggtggaagatc

SEQ ID NO: 9954 - DNA, 16 bp, Artificial Sequence
  synthetic [barcode part1]
aataccgtgtagtgcc

SEQ ID NO: 9955 - DNA, 16 bp, Artificial Sequence
  synthetic [barcode part1]
cgatcgcgcaagatag

SEQ ID NO: 9956 - DNA, 16 bp, Artificial Sequence
  synthetic [barcode part1]
atcgtccttacggacc

SEQ ID NO: 9957 - DNA, 16 bp, Artificial Sequence
  synthetic [barcode part1]
acaaccgtcggtctct

SEQ ID NO: 9958 - DNA, 16 bp, Artificial Sequence
  synthetic [barcode part1]
aattggaccactaccg

SEQ ID NO: 9959 - DNA, 16 bp, Artificial Sequence
  synthetic [barcode part1]
gacgaccaactattgc

SEQ ID NO: 9960 - DNA, 16 bp, Artificial Sequence
  synthetic [barcode part1]
gttaggccgagagtgt

SEQ ID NO: 9961 - DNA, 16 bp, Artificial Sequence
  synthetic [barcode part1]
gaacggaacctacttc

SEQ ID NO: 9962 - DNA, 16 bp, Artificial Sequence
  synthetic [barcode part1]
gcggacttcagatatc

SEQ ID NO: 9963 - DNA, 16 bp, Artificial Sequence
  synthetic [barcode part1]
caagtgtatatccggc

SEQ ID NO: 9964 - DNA, 16 bp, Artificial Sequence
  synthetic [barcode part1]
taggtatcgcaccagt

SEQ ID NO: 9965 - DNA, 16 bp, Artificial Sequence
  synthetic [barcode part1]
agactacgttcagtgc

SEQ ID NO: 9966 - DNA, 16 bp, Artificial Sequence
  synthetic [barcode part1]
tacgttctctggtagt

SEQ ID NO: 9967 - DNA, 16 bp, Artificial Sequence
  synthetic [barcode part1]
atagtcggcactaacc

SEQ ID NO: 9968 - DNA, 16 bp, Artificial Sequence
  synthetic [barcode part1]
attgttccggatactc

SEQ ID NO: 9969 - DNA, 16 bp, Artificial Sequence
  synthetic [barcode part1]
ttcggcgaggtgtaag

SEQ ID NO: 9970 - DNA, 16 bp, Artificial Sequence
  synthetic [barcode part1]
aacttatccgcgagtg

SEQ ID NO: 9971 - DNA, 16 bp, Artificial Sequence
  synthetic [barcode part1]
gatcagttcagtcgac

SEQ ID NO: 9972 - DNA, 16 bp, Artificial Sequence
  synthetic [barcode part1]
aacttcggaatagacg

SEQ ID NO: 9973 - DNA, 16 bp, Artificial Sequence
  synthetic [barcode part1]
aagagtactaccagac

SEQ ID NO: 9974 - DNA, 16 bp, Artificial Sequence
  synthetic [barcode part1]
caacctcggttaagac

SEQ ID NO: 9975 - DNA, 16 bp, Artificial Sequence
  synthetic [barcode part1]
tacctacaacaccgtt

SEQ ID NO: 9976 - DNA, 16 bp, Artificial Sequence
  synthetic [barcode part1]
gcgtgcgactacaatt

SEQ ID NO: 9977 - DNA, 16 bp, Artificial Sequence
  synthetic [barcode part1]
actcttgatccagtgt

SEQ ID NO: 9978 - DNA, 16 bp, Artificial Sequence
  synthetic [barcode part1]
agttgacactgtgacc

SEQ ID NO: 9979 - DNA, 16 bp, Artificial Sequence
  synthetic [barcode part1]
atagaaccgtcgttcg

SEQ ID NO: 9980 - DNA, 16 bp, Artificial Sequence
  synthetic [barcode part1]
tatcgttcgttgacac

SEQ ID NO: 9981 - DNA, 16 bp, Artificial Sequence
  synthetic [barcode part1]
gcacaaggcctaacag

SEQ ID NO: 9982 - DNA, 16 bp, Artificial Sequence
  synthetic [barcode part1]
tactggaacgattcgc

SEQ ID NO: 9983 - DNA, 16 bp, Artificial Sequence
  synthetic [barcode part1]
tcggcaaccgtgtctt

SEQ ID NO: 9984 - DNA, 16 bp, Artificial Sequence
  synthetic [barcode part1]
atcaagacagtcacag

SEQ ID NO: 9985 - DNA, 16 bp, Artificial Sequence
  synthetic [barcode part1]
gtcaagtataggaacc

SEQ ID NO: 9986 - DNA, 16 bp, Artificial Sequence
  synthetic [barcode part1]
tacacggcggaagact

SEQ ID NO: 9987 - DNA, 16 bp, Artificial Sequence
  synthetic [barcode part1]
tgttacttggatccac

SEQ ID NO: 9988 - DNA, 16 bp, Artificial Sequence
  synthetic [barcode part1]
agataacagttacgcg

SEQ ID NO: 9989 - DNA, 16 bp, Artificial Sequence
  synthetic [barcode part1]
tcaaggtgccttagac

SEQ ID NO: 9990 - DNA, 16 bp, Artificial Sequence
  synthetic [barcode part1]
gtcgcacgttacttcg

SEQ ID NO: 9991 - DNA, 16 bp, Artificial Sequence
  synthetic [barcode part1]
gacgtcacgatcgatt

SEQ ID NO: 9992 - DNA, 16 bp, Artificial Sequence
  synthetic [barcode part1]
agtccaacgtattctc

SEQ ID NO: 9993 - DNA, 16 bp, Artificial Sequence
  synthetic [barcode part1]
cagacaggccttgaag

SEQ ID NO: 9994 - DNA, 16 bp, Artificial Sequence
  synthetic [barcode part1]
tgcgtagacgatcact

SEQ ID NO: 9995 - DNA, 16 bp, Artificial Sequence
  synthetic [barcode part1]
cgacgaactataggcg

SEQ ID NO: 9996 - DNA, 16 bp, Artificial Sequence
  synthetic [barcode part1]
gcaagtctataccggt

SEQ ID NO: 9997 - DNA, 16 bp, Artificial Sequence
  synthetic [barcode part1]
ccaccaccaagtgtct

SEQ ID NO: 9998 - DNA, 16 bp, Artificial Sequence
  synthetic [barcode part1]
gaatcaccactggatc

SEQ ID NO: 9999 - DNA, 16 bp, Artificial Sequence
  synthetic [barcode part1]
tcgcggtaatcaatcg

SEQ ID NO: 10000 - DNA, 16 bp, Artificial Sequence
  synthetic [barcode part1]
tcacgcctgaaccgtt

SEQ ID NO: 10001 - DNA, 16 bp, Artificial Sequence
  synthetic [barcode part1]
aagacagtggatacct

SEQ ID NO: 10002 - DNA, 16 bp, Artificial Sequence
  synthetic [barcode part1]
ttgtctacgtcacggc

SEQ ID NO: 10003 - DNA, 16 bp, Artificial Sequence
  synthetic [barcode part1]
gataattggccgttgc

SEQ ID NO: 10004 - DNA, 16 bp, Artificial Sequence
  synthetic [barcode part1]
caactggcgtggtatt

SEQ ID NO: 10005 - DNA, 16 bp, Artificial Sequence
  synthetic [barcode part1]
atccttaccactgaac

SEQ ID NO: 10006 - DNA, 16 bp, Artificial Sequence
  synthetic [barcode part1]
gttccacaatacgttc

SEQ ID NO: 10007 - DNA, 16 bp, Artificial Sequence
  synthetic [barcode part1]
atactaatcctcggtc

SEQ ID NO: 10008 - DNA, 16 bp, Artificial Sequence
  synthetic [barcode part1]
cgtggaagaagatacg

SEQ ID NO: 10009 - DNA, 16 bp, Artificial Sequence
  synthetic [barcode part1]
ttagtgccggtatacg

SEQ ID NO: 10010 - DNA, 16 bp, Artificial Sequence
  synthetic [barcode part1]
acacggaagatacgag

SEQ ID NO: 10011 - DNA, 16 bp, Artificial Sequence
  synthetic [barcode part1]
actccgtgacacgttc

SEQ ID NO: 10012 - DNA, 16 bp, Artificial Sequence
  synthetic [barcode part1]
tgcacgaagaccgagt

SEQ ID NO: 10013 - DNA, 16 bp, Artificial Sequence
  synthetic [barcode part1]
taggaggtaattacgc

SEQ ID NO: 10014 - DNA, 16 bp, Artificial Sequence
  synthetic [barcode part1]
tagacactcagtacgc

SEQ ID NO: 10015 - DNA, 16 bp, Artificial Sequence
  synthetic [barcode part1]
ccttgaagtggtatcg

SEQ ID NO: 10016 - DNA, 16 bp, Artificial Sequence
  synthetic [barcode part1]
gatcttcaactcgtgt

SEQ ID NO: 10017 - DNA, 16 bp, Artificial Sequence
  synthetic [barcode part1]
ttgtgcacagtacacg

SEQ ID NO: 10018 - DNA, 16 bp, Artificial Sequence
  synthetic [barcode part1]
tgtcctatctgaacgt

SEQ ID NO: 10019 - DNA, 16 bp, Artificial Sequence
  synthetic [barcode part1]
cgcaacgaacgagtac

SEQ ID NO: 10020 - DNA, 16 bp, Artificial Sequence
  synthetic [barcode part1]
cggcaatccttcacgt

SEQ ID NO: 10021 - DNA, 16 bp, Artificial Sequence
  synthetic [barcode part1]
ttcaacgaacgtagag

SEQ ID NO: 10022 - DNA, 16 bp, Artificial Sequence
  synthetic [barcode part1]
agagtatcgacttgag

SEQ ID NO: 10023 - DNA, 16 bp, Artificial Sequence
  synthetic [barcode part1]
ttgcgtacgatcacag

SEQ ID NO: 10024 - DNA, 16 bp, Artificial Sequence
  synthetic [barcode part1]
taacggcgatctggtt

SEQ ID NO: 10025 - DNA, 16 bp, Artificial Sequence
  synthetic [barcode part1]
tcggttatcggagttg

SEQ ID NO: 10026 - DNA, 16 bp, Artificial Sequence
  synthetic [barcode part1]
gacacagagacgtaag

SEQ ID NO: 10027 - DNA, 16 bp, Artificial Sequence
  synthetic [barcode part1]
tcttgagaataccgcg

SEQ ID NO: 10028 - DNA, 16 bp, Artificial Sequence
  synthetic [barcode part1]
ttgcagaaggttgaac

SEQ ID NO: 10029 - DNA, 16 bp, Artificial Sequence
  synthetic [barcode part1]
cgataacgaaggtgcc

SEQ ID NO: 10030 - DNA, 16 bp, Artificial Sequence
  synthetic [barcode part1]
attcctgcgaactact

SEQ ID NO: 10031 - DNA, 16 bp, Artificial Sequence
  synthetic [barcode part1]
tgtacgaggattagac

SEQ ID NO: 10032 - DNA, 16 bp, Artificial Sequence
  synthetic [barcode part1]
gtcagagagagtcaag

SEQ ID NO: 10033 - DNA, 16 bp, Artificial Sequence
  synthetic [barcode part1]
tcgtgtctctgtatcc

SEQ ID NO: 10034 - DNA, 16 bp, Artificial Sequence
  synthetic [barcode part1]
ttccacggattaccgc

SEQ ID NO: 10035 - DNA, 16 bp, Artificial Sequence
  synthetic [barcode part1]
cactcacgaatctcgc

SEQ ID NO: 10036 - DNA, 16 bp, Artificial Sequence
  synthetic [barcode part1]
agtctaactcttgcgt

SEQ ID NO: 10037 - DNA, 16 bp, Artificial Sequence
  synthetic [barcode part1]
aggagtacactaggtt

SEQ ID NO: 10038 - DNA, 16 bp, Artificial Sequence
  synthetic [barcode part1]
tgttatctgttggtgc

SEQ ID NO: 10039 - DNA, 16 bp, Artificial Sequence
  synthetic [barcode part1]
tcgtgtacgtgtaacg

SEQ ID NO: 10040 - DNA, 16 bp, Artificial Sequence
  synthetic [barcode part1]
gaccacgtacacaatc

SEQ ID NO: 10041 - DNA, 16 bp, Artificial Sequence
  synthetic [barcode part1]
aagtacttgccacctt

SEQ ID NO: 10042 - DNA, 16 bp, Artificial Sequence
  synthetic [barcode part1]
gttcagtcagtccaag

SEQ ID NO: 10043 - DNA, 16 bp, Artificial Sequence
  synthetic [barcode part1]
ccgtcgacaacaattg

SEQ ID NO: 10044 - DNA, 16 bp, Artificial Sequence
  synthetic [barcode part1]
atagacctctctgatc

SEQ ID NO: 10045 - DNA, 16 bp, Artificial Sequence
  synthetic [barcode part1]
caggaagttccgattc

SEQ ID NO: 10046 - DNA, 16 bp, Artificial Sequence
  synthetic [barcode part1]
gtcctaacgacgttag

SEQ ID NO: 10047 - DNA, 16 bp, Artificial Sequence
  synthetic [barcode part1]
tcctgcgtctcgtatt

SEQ ID NO: 10048 - DNA, 16 bp, Artificial Sequence
  synthetic [barcode part1]
gcggataagtatcgcg

SEQ ID NO: 10049 - DNA, 16 bp, Artificial Sequence
  synthetic [barcode part1]
actctgaaccacaacg

SEQ ID NO: 10050 - DNA, 16 bp, Artificial Sequence
  synthetic [barcode part1]
ttcctggaatcggaac

SEQ ID NO: 10051 - DNA, 16 bp, Artificial Sequence
  synthetic [barcode part1]
tagagtactacacgag

SEQ ID NO: 10052 - DNA, 16 bp, Artificial Sequence
  synthetic [barcode part1]
gaggaacttactgtcc

SEQ ID NO: 10053 - DNA, 16 bp, Artificial Sequence
  synthetic [barcode part1]
tacaggcagtaagact

SEQ ID NO: 10054 - DNA, 16 bp, Artificial Sequence
  synthetic [barcode part1]
gcgttaggaagattgt

SEQ ID NO: 10055 - DNA, 16 bp, Artificial Sequence
  synthetic [barcode part1]
aattctcctaacgtgc

SEQ ID NO: 10056 - DNA, 16 bp, Artificial Sequence
  synthetic [barcode part1]
taagtgattcaggacg

SEQ ID NO: 10057 - DNA, 16 bp, Artificial Sequence
  synthetic [barcode part1]
aggacctgtaacgtct

SEQ ID NO: 10058 - DNA, 16 bp, Artificial Sequence
  synthetic [barcode part1]
cacgttctattcctgc

SEQ ID NO: 10059 - DNA, 16 bp, Artificial Sequence
  synthetic [barcode part1]
tgcgacaattcacctt

SEQ ID NO: 10060 - DNA, 16 bp, Artificial Sequence
  synthetic [barcode part1]
aggtggagtgaacaac

SEQ ID NO: 10061 - DNA, 16 bp, Artificial Sequence
  synthetic [barcode part1]
ttcgagtacgactacg

SEQ ID NO: 10062 - DNA, 16 bp, Artificial Sequence
  synthetic [barcode part1]
gtacgcaatcagtcgt

SEQ ID NO: 10063 - DNA, 16 bp, Artificial Sequence
  synthetic [barcode part1]
gtgttcctggcagttc

SEQ ID NO: 10064 - DNA, 16 bp, Artificial Sequence
  synthetic [barcode part1]
ccgtgtccactagact

SEQ ID NO: 10065 - DNA, 16 bp, Artificial Sequence
  synthetic [barcode part1]
tgattcggttcctgcg

SEQ ID NO: 10066 - DNA, 16 bp, Artificial Sequence
  synthetic [barcode part1]
gaatcactctgtgttc

SEQ ID NO: 10067 - DNA, 16 bp, Artificial Sequence
  synthetic [barcode part1]
tccacaacctatcgcg

SEQ ID NO: 10068 - DNA, 16 bp, Artificial Sequence
  synthetic [barcode part1]
taggcgttgtagacct

SEQ ID NO: 10069 - DNA, 16 bp, Artificial Sequence
  synthetic [barcode part1]
aacggccttaagttgc

SEQ ID NO: 10070 - DNA, 16 bp, Artificial Sequence
  synthetic [barcode part1]
gtgccttgaccgttac

SEQ ID NO: 10071 - DNA, 16 bp, Artificial Sequence
  synthetic [barcode part1]
gttctatagaccggac

SEQ ID NO: 10072 - DNA, 16 bp, Artificial Sequence
  synthetic [barcode part1]
cgtagttctctcggtg

SEQ ID NO: 10073 - DNA, 16 bp, Artificial Sequence
  synthetic [barcode part1]
cctctgaattatacgc

SEQ ID NO: 10074 - DNA, 16 bp, Artificial Sequence
  synthetic [barcode part1]
gtcgagaccttaatcg

SEQ ID NO: 10075 - DNA, 16 bp, Artificial Sequence
  synthetic [barcode part1]
aggcgaggaattccgt

SEQ ID NO: 10076 - DNA, 16 bp, Artificial Sequence
  synthetic [barcode part1]
tacctagtcttcggcg

SEQ ID NO: 10077 - DNA, 16 bp, Artificial Sequence
  synthetic [barcode part1]
cgaccgatagtgttac

SEQ ID NO: 10078 - DNA, 16 bp, Artificial Sequence
  synthetic [barcode part1]
actgaactgttctcac

SEQ ID NO: 10079 - DNA, 16 bp, Artificial Sequence
  synthetic [barcode part1]
gtgacagttgtgtaag

SEQ ID NO: 10080 - DNA, 16 bp, Artificial Sequence
  synthetic [barcode part1]
aagaggaccttgagag

SEQ ID NO: 10081 - DNA, 16 bp, Artificial Sequence
  synthetic [barcode part1]
cctacgtcgtaagaac

SEQ ID NO: 10082 - DNA, 16 bp, Artificial Sequence
  synthetic [barcode part1]
caggattgaaggagac

SEQ ID NO: 10083 - DNA, 16 bp, Artificial Sequence
  synthetic [barcode part1]
gttaggtataaggacc

SEQ ID NO: 10084 - DNA, 16 bp, Artificial Sequence
  synthetic [barcode part1]
cgttacctgtcagtgc

SEQ ID NO: 10085 - DNA, 16 bp, Artificial Sequence
  synthetic [barcode part1]
gtaggcacaggatctg

SEQ ID NO: 10086 - DNA, 16 bp, Artificial Sequence
  synthetic [barcode part1]
attcgtgactagagag

SEQ ID NO: 10087 - DNA, 16 bp, Artificial Sequence
  synthetic [barcode part1]
gacaggagagacaatc

SEQ ID NO: 10088 - DNA, 16 bp, Artificial Sequence
  synthetic [barcode part1]
cggaagaactgtgcac

SEQ ID NO: 10089 - DNA, 16 bp, Artificial Sequence
  synthetic [barcode part1]
tcgtgtcttgccagac

SEQ ID NO: 10090 - DNA, 16 bp, Artificial Sequence
  synthetic [barcode part1]
gatcacacgtacaacc

SEQ ID NO: 10091 - DNA, 16 bp, Artificial Sequence
  synthetic [barcode part1]
gtctaagttgccttac

SEQ ID NO: 10092 - DNA, 16 bp, Artificial Sequence
  synthetic [barcode part1]
gagacgattacgaatc

SEQ ID NO: 10093 - DNA, 16 bp, Artificial Sequence
  synthetic [barcode part1]
tggaactgattccgac

SEQ ID NO: 10094 - DNA, 16 bp, Artificial Sequence
  synthetic [barcode part1]
acgcgaattgttgaag

SEQ ID NO: 10095 - DNA, 16 bp, Artificial Sequence
  synthetic [barcode part1]
tataggcgcgacgaac

SEQ ID NO: 10096 - DNA, 16 bp, Artificial Sequence
  synthetic [barcode part1]
ttagataggcaagacc

SEQ ID NO: 10097 - DNA, 16 bp, Artificial Sequence
  synthetic [barcode part1]
attgttactctgtgcg

SEQ ID NO: 10098 - DNA, 16 bp, Artificial Sequence
  synthetic [barcode part1]
tcctgacctgaatatc

SEQ ID NO: 10099 - DNA, 16 bp, Artificial Sequence
  synthetic [barcode part1]
acgttctcggcaacct

SEQ ID NO: 10100 - DNA, 16 bp, Artificial Sequence
  synthetic [barcode part1]
ttcaacgattcctgtg

SEQ ID NO: 10101 - DNA, 16 bp, Artificial Sequence
  synthetic [barcode part1]
agagaccgcgtgttag

SEQ ID NO: 10102 - DNA, 16 bp, Artificial Sequence
  synthetic [barcode part1]
tacctgccgaagtctc

SEQ ID NO: 10103 - DNA, 16 bp, Artificial Sequence
  synthetic [barcode part1]
ttcgacttacgactgt

SEQ ID NO: 10104 - DNA, 16 bp, Artificial Sequence
  synthetic [barcode part1]
gtctaagtctgttacc

SEQ ID NO: 10105 - DNA, 16 bp, Artificial Sequence
  synthetic [barcode part1]
taacgactgatctggc

SEQ ID NO: 10106 - DNA, 16 bp, Artificial Sequence
  synthetic [barcode part1]
cgttctgttcgaatac

SEQ ID NO: 10107 - DNA, 16 bp, Artificial Sequence
  synthetic [barcode part1]
cgacgcgttctatcgt

SEQ ID NO: 10108 - DNA, 16 bp, Artificial Sequence
  synthetic [barcode part1]
tgcgtgatctaacctt

SEQ ID NO: 10109 - DNA, 16 bp, Artificial Sequence
  synthetic [barcode part1]
gacacagaggtacaag

SEQ ID NO: 10110 - DNA, 16 bp, Artificial Sequence
  synthetic [barcode part1]
tgaatatcgcggactc

SEQ ID NO: 10111 - DNA, 16 bp, Artificial Sequence
  synthetic [barcode part1]
ttacgccacctctatc

SEQ ID NO: 10112 - DNA, 16 bp, Artificial Sequence
  synthetic [barcode part1]
ccgcggataaggaact

SEQ ID NO: 10113 - DNA, 16 bp, Artificial Sequence
  synthetic [barcode part1]
gagtacggccgttaag

SEQ ID NO: 10114 - DNA, 16 bp, Artificial Sequence
  synthetic [barcode part1]
tccttattcaccagag

SEQ ID NO: 10115 - DNA, 16 bp, Artificial Sequence
  synthetic [barcode part1]
caatcctgaaggacct

SEQ ID NO: 10116 - DNA, 16 bp, Artificial Sequence
  synthetic [barcode part1]
taacgcgcacagatct

SEQ ID NO: 10117 - DNA, 16 bp, Artificial Sequence
  synthetic [barcode part1]
gtaggaaccgacaatt

SEQ ID NO: 10118 - DNA, 16 bp, Artificial Sequence
  synthetic [barcode part1]
gcacggtggaattgac

SEQ ID NO: 10119 - DNA, 16 bp, Artificial Sequence
  synthetic [barcode part1]
gtccaagatcttacct

SEQ ID NO: 10120 - DNA, 16 bp, Artificial Sequence
  synthetic [barcode part1]
gcaactggtcagtact

SEQ ID NO: 10121 - DNA, 16 bp, Artificial Sequence
  synthetic [barcode part1]
cacttgaagagtggcg

SEQ ID NO: 10122 - DNA, 16 bp, Artificial Sequence
  synthetic [barcode part1]
cgcgaggatcgaattg

SEQ ID NO: 10123 - DNA, 16 bp, Artificial Sequence
  synthetic [barcode part1]
aatctggccagtgatc

SEQ ID NO: 10124 - DNA, 16 bp, Artificial Sequence
  synthetic [barcode part1]
ttcgcgcaccagatct

SEQ ID NO: 10125 - DNA, 16 bp, Artificial Sequence
  synthetic [barcode part1]
tgaacaaggacgaacg

SEQ ID NO: 10126 - DNA, 16 bp, Artificial Sequence
  synthetic [barcode part1]
gttcttatatcaggcc

SEQ ID NO: 10127 - DNA, 16 bp, Artificial Sequence
  synthetic [barcode part1]
aacaaccggagtacgc

SEQ ID NO: 10128 - DNA, 16 bp, Artificial Sequence
  synthetic [barcode part1]
gtcgcgtgaagtagtg

SEQ ID NO: 10129 - DNA, 16 bp, Artificial Sequence
  synthetic [barcode part1]
ttccgacaactacgcc

SEQ ID NO: 10130 - DNA, 16 bp, Artificial Sequence
  synthetic [barcode part1]
gagtgttcgaagtggc

SEQ ID NO: 10131 - DNA, 16 bp, Artificial Sequence
  synthetic [barcode part1]
tacacagtgccagtac

SEQ ID NO: 10132 - DNA, 16 bp, Artificial Sequence
  synthetic [barcode part1]
taatcgatcgaccggt

SEQ ID NO: 10133 - DNA, 16 bp, Artificial Sequence
  synthetic [barcode part1]
caccaatcgcaactag

SEQ ID NO: 10134 - DNA, 16 bp, Artificial Sequence
  synthetic [barcode part1]
agaggacgtggttacc

SEQ ID NO: 10135 - DNA, 16 bp, Artificial Sequence
  synthetic [barcode part1]
actaggtgcaagaatc

SEQ ID NO: 10136 - DNA, 16 bp, Artificial Sequence
  synthetic [barcode part1]
atctcttcagtgtacg

SEQ ID NO: 10137 - DNA, 16 bp, Artificial Sequence
  synthetic [barcode part1]
acgcaattgcgcaatc

SEQ ID NO: 10138 - DNA, 16 bp, Artificial Sequence
  synthetic [barcode part1]
tcgtagttctcctctg

SEQ ID NO: 10139 - DNA, 16 bp, Artificial Sequence
  synthetic [barcode part1]
gaagaagatacgcgtg

SEQ ID NO: 10140 - DNA, 16 bp, Artificial Sequence
  synthetic [barcode part1]
atacgtccaccgatag

SEQ ID NO: 10141 - DNA, 16 bp, Artificial Sequence
  synthetic [barcode part1]
tcgtccgtaggtaagt

SEQ ID NO: 10142 - DNA, 16 bp, Artificial Sequence
  synthetic [barcode part1]
actgacaccactattc

SEQ ID NO: 10143 - DNA, 16 bp, Artificial Sequence
  synthetic [barcode part1]
gattctggtctcgaag

SEQ ID NO: 10144 - DNA, 16 bp, Artificial Sequence
  synthetic [barcode part1]
acaccgacttccgact

SEQ ID NO: 10145 - DNA, 16 bp, Artificial Sequence
  synthetic [barcode part1]
gactccttgtaggtcc

SEQ ID NO: 10146 - DNA, 16 bp, Artificial Sequence
  synthetic [barcode part1]
ttaggcacactgcctc

SEQ ID NO: 10147 - DNA, 16 bp, Artificial Sequence
  synthetic [barcode part1]
gattgtactctccagt

SEQ ID NO: 10148 - DNA, 16 bp, Artificial Sequence
  synthetic [barcode part1]
ttgcacctactctcac

SEQ ID NO: 10149 - DNA, 16 bp, Artificial Sequence
  synthetic [barcode part1]
acgcgcaattggttac

SEQ ID NO: 10150 - DNA, 16 bp, Artificial Sequence
  synthetic [barcode part1]
atcggtagacagtggc

SEQ ID NO: 10151 - DNA, 16 bp, Artificial Sequence
  synthetic [barcode part1]
cagtggtgtgtcctct

SEQ ID NO: 10152 - DNA, 16 bp, Artificial Sequence
  synthetic [barcode part1]
tgacttgtcaccgaag

SEQ ID NO: 10153 - DNA, 16 bp, Artificial Sequence
  synthetic [barcode part1]
tagatatcgcgccaac

SEQ ID NO: 10154 - DNA, 16 bp, Artificial Sequence
  synthetic [barcode part1]
gtgcggtctctagttc

SEQ ID NO: 10155 - DNA, 16 bp, Artificial Sequence
  synthetic [barcode part1]
gtgtggcctaatctcc

SEQ ID NO: 10156 - DNA, 16 bp, Artificial Sequence
  synthetic [barcode part1]
attctcgcgaagacgt

SEQ ID NO: 10157 - DNA, 16 bp, Artificial Sequence
  synthetic [barcode part1]
gacctgaaccagatct

SEQ ID NO: 10158 - DNA, 16 bp, Artificial Sequence
  synthetic [barcode part1]
ccagtctaccttctac

SEQ ID NO: 10159 - DNA, 16 bp, Artificial Sequence
  synthetic [barcode part1]
ataggttctccactgt

SEQ ID NO: 10160 - DNA, 16 bp, Artificial Sequence
  synthetic [barcode part1]
tcaacgtaccagtacg

SEQ ID NO: 10161 - DNA, 16 bp, Artificial Sequence
  synthetic [barcode part1]
caaccagttgactggt

SEQ ID NO: 10162 - DNA, 16 bp, Artificial Sequence
  synthetic [barcode part1]
taagttaaggagtgcc

SEQ ID NO: 10163 - DNA, 16 bp, Artificial Sequence
  synthetic [barcode part1]
cgagtgtgtgtgactt

SEQ ID NO: 10164 - DNA, 16 bp, Artificial Sequence
  synthetic [barcode part1]
gaacaattacaggtcg

SEQ ID NO: 10165 - DNA, 16 bp, Artificial Sequence
  synthetic [barcode part1]
cggtctctcctaactt

SEQ ID NO: 10166 - DNA, 16 bp, Artificial Sequence
  synthetic [barcode part1]
tcggaatcgagattcc

SEQ ID NO: 10167 - DNA, 16 bp, Artificial Sequence
  synthetic [barcode part1]
ccaattgccgatcaag

SEQ ID NO: 10168 - DNA, 16 bp, Artificial Sequence
  synthetic [barcode part1]
taataggtctaggcag

SEQ ID NO: 10169 - DNA, 16 bp, Artificial Sequence
  synthetic [barcode part1]
acgtgttctattgtcg

SEQ ID NO: 10170 - DNA, 16 bp, Artificial Sequence
  synthetic [barcode part1]
agtggaactggcacgt

SEQ ID NO: 10171 - DNA, 16 bp, Artificial Sequence
  synthetic [barcode part1]
cgaccgtaggttgaag

SEQ ID NO: 10172 - DNA, 16 bp, Artificial Sequence
  synthetic [barcode part1]
agtgtgttcgagaggc

SEQ ID NO: 10173 - DNA, 16 bp, Artificial Sequence
  synthetic [barcode part1]
taggcgtattgaaggt

SEQ ID NO: 10174 - DNA, 16 bp, Artificial Sequence
  synthetic [barcode part1]
caaccggtaatcaacc

SEQ ID NO: 10175 - DNA, 16 bp, Artificial Sequence
  synthetic [barcode part1]
tcttgcacgtacctct

SEQ ID NO: 10176 - DNA, 16 bp, Artificial Sequence
  synthetic [barcode part1]
gccagtgttacacaac

SEQ ID NO: 10177 - DNA, 16 bp, Artificial Sequence
  synthetic [barcode part1]
taaggcgtacttcacg

SEQ ID NO: 10178 - DNA, 16 bp, Artificial Sequence
  synthetic [barcode part1]
tacaagttaccgcctt

SEQ ID NO: 10179 - DNA, 16 bp, Artificial Sequence
  synthetic [barcode part1]
ttcaggaccttaaggc

SEQ ID NO: 10180 - DNA, 16 bp, Artificial Sequence
  synthetic [barcode part1]
gagtgaatctgcctgt

SEQ ID NO: 10181 - DNA, 16 bp, Artificial Sequence
  synthetic [barcode part1]
tacgtgttaatcggcg

SEQ ID NO: 10182 - DNA, 16 bp, Artificial Sequence
  synthetic [barcode part1]
attgaccgtatcgcag

SEQ ID NO: 10183 - DNA, 16 bp, Artificial Sequence
  synthetic [barcode part1]
cctgttgcgtattggc

SEQ ID NO: 10184 - DNA, 16 bp, Artificial Sequence
  synthetic [barcode part1]
ccgttaacacaagaag

SEQ ID NO: 10185 - DNA, 16 bp, Artificial Sequence
  synthetic [barcode part1]
tcttgtacgtgtcctc

SEQ ID NO: 10186 - DNA, 16 bp, Artificial Sequence
  synthetic [barcode part1]
aaggtgaaggtgacgt

SEQ ID NO: 10187 - DNA, 16 bp, Artificial Sequence
  synthetic [barcode part1]
caatagagtggtggag

SEQ ID NO: 10188 - DNA, 16 bp, Artificial Sequence
  synthetic [barcode part1]
gttggatctgcactcc

SEQ ID NO: 10189 - DNA, 16 bp, Artificial Sequence
  synthetic [barcode part1]
acaccgccttgtctag

SEQ ID NO: 10190 - DNA, 16 bp, Artificial Sequence
  synthetic [barcode part1]
tgttctaccgtagatc

SEQ ID NO: 10191 - DNA, 16 bp, Artificial Sequence
  synthetic [barcode part1]
caacctaactcgacag

SEQ ID NO: 10192 - DNA, 16 bp, Artificial Sequence
  synthetic [barcode part1]
ttccaagttcaggacg

SEQ ID NO: 10193 - DNA, 16 bp, Artificial Sequence
  synthetic [barcode part1]
acaactacttctcggt

SEQ ID NO: 10194 - DNA, 16 bp, Artificial Sequence
  synthetic [barcode part1]
ttcagttataccgacc

SEQ ID NO: 10195 - DNA, 16 bp, Artificial Sequence
  synthetic [barcode part1]
tgcaacacaggatctc

SEQ ID NO: 10196 - DNA, 16 bp, Artificial Sequence
  synthetic [barcode part1]
tgcaggacggtagttg

SEQ ID NO: 10197 - DNA, 16 bp, Artificial Sequence
  synthetic [barcode part1]
actggttgttggtcag

SEQ ID NO: 10198 - DNA, 16 bp, Artificial Sequence
  synthetic [barcode part1]
agtgacgacctataag

SEQ ID NO: 10199 - DNA, 16 bp, Artificial Sequence
  synthetic [barcode part1]
ttgtacggactcctcg

SEQ ID NO: 10200 - DNA, 16 bp, Artificial Sequence
  synthetic [barcode part1]
cagtacactaacgcac

SEQ ID NO: 10201 - DNA, 16 bp, Artificial Sequence
  synthetic [barcode part1]
tcaagtctggttcgag

SEQ ID NO: 10202 - DNA, 16 bp, Artificial Sequence
  synthetic [barcode part1]
ttgactggatcctgag

SEQ ID NO: 10203 - DNA, 16 bp, Artificial Sequence
  synthetic [barcode part1]
actgcagacggacagt

SEQ ID NO: 10204 - DNA, 16 bp, Artificial Sequence
  synthetic [barcode part1]
tactggaccgtgtctc

SEQ ID NO: 10205 - DNA, 16 bp, Artificial Sequence
  synthetic [barcode part1]
tggtggtaccactagt

SEQ ID NO: 10206 - DNA, 16 bp, Artificial Sequence
  synthetic [barcode part1]
cgagttattcctacac

SEQ ID NO: 10207 - DNA, 16 bp, Artificial Sequence
  synthetic [barcode part1]
accgacgtagagaacc

SEQ ID NO: 10208 - DNA, 16 bp, Artificial Sequence
  synthetic [barcode part1]
agtacctacaactgcg

SEQ ID NO: 10209 - DNA, 16 bp, Artificial Sequence
  synthetic [barcode part1]
cgacagatatcactcg

SEQ ID NO: 10210 - DNA, 16 bp, Artificial Sequence
  synthetic [barcode part1]
taacacgcggtaaggc

SEQ ID NO: 10211 - DNA, 16 bp, Artificial Sequence
  synthetic [barcode part1]
cacacaacttgcagac

SEQ ID NO: 10212 - DNA, 16 bp, Artificial Sequence
  synthetic [barcode part1]
tccagattgtcctgcg

SEQ ID NO: 10213 - DNA, 16 bp, Artificial Sequence
  synthetic [barcode part1]
aacggcacacttggag

SEQ ID NO: 10214 - DNA, 16 bp, Artificial Sequence
  synthetic [barcode part1]
cgttaacgattcttcg

SEQ ID NO: 10215 - DNA, 16 bp, Artificial Sequence
  synthetic [barcode part1]
ataagaccttaggcag

SEQ ID NO: 10216 - DNA, 16 bp, Artificial Sequence
  synthetic [barcode part1]
cactcaagtgcaatcg

SEQ ID NO: 10217 - DNA, 16 bp, Artificial Sequence
  synthetic [barcode part1]
ttaatcacgtgacgcg

SEQ ID NO: 10218 - DNA, 16 bp, Artificial Sequence
  synthetic [barcode part1]
gcaactactcttcggc

SEQ ID NO: 10219 - DNA, 16 bp, Artificial Sequence
  synthetic [barcode part1]
cctcaactcgaacacc

SEQ ID NO: 10220 - DNA, 16 bp, Artificial Sequence
  synthetic [barcode part1]
tccaacctcttctgac

SEQ ID NO: 10221 - DNA, 16 bp, Artificial Sequence
  synthetic [barcode part1]
tcgtgtcgaatacgac

SEQ ID NO: 10222 - DNA, 16 bp, Artificial Sequence
  synthetic [barcode part1]
acctctcgaagaactg

SEQ ID NO: 10223 - DNA, 16 bp, Artificial Sequence
  synthetic [barcode part1]
tagtctgcgttcttag

SEQ ID NO: 10224 - DNA, 16 bp, Artificial Sequence
  synthetic [barcode part1]
aacctcaagtatcgcg

SEQ ID NO: 10225 - DNA, 16 bp, Artificial Sequence
  synthetic [barcode part1]
gagtaccttgcgagtt

SEQ ID NO: 10226 - DNA, 16 bp, Artificial Sequence
  synthetic [barcode part1]
gatactcctgttactg

SEQ ID NO: 10227 - DNA, 16 bp, Artificial Sequence
  synthetic [barcode part1]
tctccttgacctcaac

SEQ ID NO: 10228 - DNA, 16 bp, Artificial Sequence
  synthetic [barcode part1]
agaccaggtatcgacg

SEQ ID NO: 10229 - DNA, 16 bp, Artificial Sequence
  synthetic [barcode part1]
aactcgagatccaacc

SEQ ID NO: 10230 - DNA, 16 bp, Artificial Sequence
  synthetic [barcode part1]
attgatacacttcgcc

SEQ ID NO: 10231 - DNA, 16 bp, Artificial Sequence
  synthetic [barcode part1]
gaacacttgtcgcctc

SEQ ID NO: 10232 - DNA, 16 bp, Artificial Sequence
  synthetic [barcode part1]
actcacacaacaagag

SEQ ID NO: 10233 - DNA, 16 bp, Artificial Sequence
  synthetic [barcode part1]
tccacggatcctatcg

SEQ ID NO: 10234 - DNA, 16 bp, Artificial Sequence
  synthetic [barcode part1]
cgtcttgcctaggtac

SEQ ID NO: 10235 - DNA, 16 bp, Artificial Sequence
  synthetic [barcode part1]
tcttctccttctcctc

SEQ ID NO: 10236 - DNA, 16 bp, Artificial Sequence
  synthetic [barcode part1]
atagtgaccgttaccg

SEQ ID NO: 10237 - DNA, 16 bp, Artificial Sequence
  synthetic [barcode part1]
tggacttatctgcgag

SEQ ID NO: 10238 - DNA, 16 bp, Artificial Sequence
  synthetic [barcode part1]
gaggaactctacggac

SEQ ID NO: 10239 - DNA, 16 bp, Artificial Sequence
  synthetic [barcode part1]
gcgatcagtcgatact

SEQ ID NO: 10240 - DNA, 16 bp, Artificial Sequence
  synthetic [barcode part1]
taaggaggaggtcagt

SEQ ID NO: 10241 - DNA, 16 bp, Artificial Sequence
  synthetic [barcode part1]
tgcctgtgacgttacc

SEQ ID NO: 10242 - DNA, 16 bp, Artificial Sequence
  synthetic [barcode part1]
atcgcgaactctgagt

SEQ ID NO: 10243 - DNA, 16 bp, Artificial Sequence
  synthetic [barcode part1]
ttctactctcgaacag

SEQ ID NO: 10244 - DNA, 16 bp, Artificial Sequence
  synthetic [barcode part1]
taggtcgcgtggaagt

SEQ ID NO: 10245 - DNA, 16 bp, Artificial Sequence
  synthetic [barcode part1]
ccacgtgaggatcaag

SEQ ID NO: 10246 - DNA, 16 bp, Artificial Sequence
  synthetic [barcode part1]
gagaccaatattcgag

SEQ ID NO: 10247 - DNA, 16 bp, Artificial Sequence
  synthetic [barcode part1]
cacctcgtctaggtgt

SEQ ID NO: 10248 - DNA, 16 bp, Artificial Sequence
  synthetic [barcode part1]
aattcctcgacctctc

SEQ ID NO: 10249 - DNA, 16 bp, Artificial Sequence
  synthetic [barcode part1]
cactcacaacagacac

SEQ ID NO: 10250 - DNA, 16 bp, Artificial Sequence
  synthetic [barcode part1]
tctcgtggattatcac

SEQ ID NO: 10251 - DNA, 16 bp, Artificial Sequence
  synthetic [barcode part1]
gtcggtcttgagattg

SEQ ID NO: 10252 - DNA, 16 bp, Artificial Sequence
  synthetic [barcode part1]
gcgttcctcaacaatt

SEQ ID NO: 10253 - DNA, 16 bp, Artificial Sequence
  synthetic [barcode part1]
caggtgttataggcct

SEQ ID NO: 10254 - DNA, 16 bp, Artificial Sequence
  synthetic [barcode part1]
attcgagtgaacgtcc

SEQ ID NO: 10255 - DNA, 16 bp, Artificial Sequence
  synthetic [barcode part1]
cgtcgttacctagacc

SEQ ID NO: 10256 - DNA, 16 bp, Artificial Sequence
  synthetic [barcode part1]
atccacaggagtgacg

SEQ ID NO: 10257 - DNA, 16 bp, Artificial Sequence
  synthetic [barcode part1]
aacacacggccagaac

SEQ ID NO: 10258 - DNA, 16 bp, Artificial Sequence
  synthetic [barcode part1]
gagaggcagtacgtct

SEQ ID NO: 10259 - DNA, 16 bp, Artificial Sequence
  synthetic [barcode part1]
gttcacagttgagaag

SEQ ID NO: 10260 - DNA, 16 bp, Artificial Sequence
  synthetic [barcode part1]
tgtagtggtcctgaac

SEQ ID NO: 10261 - DNA, 16 bp, Artificial Sequence
  synthetic [barcode part1]
acctacaagttacgcg

SEQ ID NO: 10262 - DNA, 16 bp, Artificial Sequence
  synthetic [barcode part1]
acggactgtacgactt

SEQ ID NO: 10263 - DNA, 16 bp, Artificial Sequence
  synthetic [barcode part1]
aggcgaatatctgtcc

SEQ ID NO: 10264 - DNA, 16 bp, Artificial Sequence
  synthetic [barcode part1]
ttgaaccgacttgacg

SEQ ID NO: 10265 - DNA, 16 bp, Artificial Sequence
  synthetic [barcode part1]
cgaggatcgaagatag

SEQ ID NO: 10266 - DNA, 16 bp, Artificial Sequence
  synthetic [barcode part1]
cctgttggatctacgc

SEQ ID NO: 10267 - DNA, 16 bp, Artificial Sequence
  synthetic [barcode part1]
caccaggaacaacttc

SEQ ID NO: 10268 - DNA, 16 bp, Artificial Sequence
  synthetic [barcode part1]
gacgaggtcttcagtt

SEQ ID NO: 10269 - DNA, 16 bp, Artificial Sequence
  synthetic [barcode part1]
tcgtctgtagaacttc

SEQ ID NO: 10270 - DNA, 16 bp, Artificial Sequence
  synthetic [barcode part1]
tgagatattgcgcaag

SEQ ID NO: 10271 - DNA, 16 bp, Artificial Sequence
  synthetic [barcode part1]
aggaaccactgacacg

SEQ ID NO: 10272 - DNA, 16 bp, Artificial Sequence
  synthetic [barcode part1]
cgttctgtcacagacc

SEQ ID NO: 10273 - DNA, 16 bp, Artificial Sequence
  synthetic [barcode part1]
ttgtcgccttaggcac

SEQ ID NO: 10274 - DNA, 16 bp, Artificial Sequence
  synthetic [barcode part1]
gcagttgtgcaactgt

SEQ ID NO: 10275 - DNA, 16 bp, Artificial Sequence
  synthetic [barcode part1]
gatatcgaccagttgc

SEQ ID NO: 10276 - DNA, 16 bp, Artificial Sequence
  synthetic [barcode part1]
gtctactggtactact

SEQ ID NO: 10277 - DNA, 16 bp, Artificial Sequence
  synthetic [barcode part1]
aggttatcgccggatt

SEQ ID NO: 10278 - DNA, 16 bp, Artificial Sequence
  synthetic [barcode part1]
acaagttcgactcctt

SEQ ID NO: 10279 - DNA, 16 bp, Artificial Sequence
  synthetic [barcode part1]
actcagttcttgtgtg

SEQ ID NO: 10280 - DNA, 16 bp, Artificial Sequence
  synthetic [barcode part1]
ccgagtgtactactcc

SEQ ID NO: 10281 - DNA, 16 bp, Artificial Sequence
  synthetic [barcode part1]
gatctaacgcactctt

SEQ ID NO: 10282 - DNA, 16 bp, Artificial Sequence
  synthetic [barcode part1]
ttgcagaataaggtgc

SEQ ID NO: 10283 - DNA, 16 bp, Artificial Sequence
  synthetic [barcode part1]
atccgattgtgagaag

SEQ ID NO: 10284 - DNA, 16 bp, Artificial Sequence
  synthetic [barcode part1]
agacaggttcgtctac

SEQ ID NO: 10285 - DNA, 16 bp, Artificial Sequence
  synthetic [barcode part1]
tactctgttgcctcgt

SEQ ID NO: 10286 - DNA, 16 bp, Artificial Sequence
  synthetic [barcode part1]
tcacaggttcgtaggt

SEQ ID NO: 10287 - DNA, 16 bp, Artificial Sequence
  synthetic [barcode part1]
atagtgccgtgtacac

SEQ ID NO: 10288 - DNA, 16 bp, Artificial Sequence
  synthetic [barcode part1]
cagatctaggtctgtg

SEQ ID NO: 10289 - DNA, 16 bp, Artificial Sequence
  synthetic [barcode part1]
acttccggcaacttgc

SEQ ID NO: 10290 - DNA, 16 bp, Artificial Sequence
  synthetic [barcode part1]
agtccaacgatagtcc

SEQ ID NO: 10291 - DNA, 16 bp, Artificial Sequence
  synthetic [barcode part1]
attacggtgaacagac

SEQ ID NO: 10292 - DNA, 16 bp, Artificial Sequence
  synthetic [barcode part1]
gccttaacacagtgtg

SEQ ID NO: 10293 - DNA, 16 bp, Artificial Sequence
  synthetic [barcode part1]
tcgaggtcgaagttct

SEQ ID NO: 10294 - DNA, 16 bp, Artificial Sequence
  synthetic [barcode part1]
gattaccttgccgaag

SEQ ID NO: 10295 - DNA, 16 bp, Artificial Sequence
  synthetic [barcode part1]
ttaggtccacgccttg

SEQ ID NO: 10296 - DNA, 16 bp, Artificial Sequence
  synthetic [barcode part1]
gtaggaacggtggtct

SEQ ID NO: 10297 - DNA, 16 bp, Artificial Sequence
  synthetic [barcode part1]
atccgttgcgatatct

SEQ ID NO: 10298 - DNA, 16 bp, Artificial Sequence
  synthetic [barcode part1]
tgtaccttcacgtcct

SEQ ID NO: 10299 - DNA, 16 bp, Artificial Sequence
  synthetic [barcode part1]
tatacaacaggagacc

SEQ ID NO: 10300 - DNA, 16 bp, Artificial Sequence
  synthetic [barcode part1]
cctggacgaatcgaag

SEQ ID NO: 10301 - DNA, 16 bp, Artificial Sequence
  synthetic [barcode part1]
caagtactgactcttc

SEQ ID NO: 10302 - DNA, 16 bp, Artificial Sequence
  synthetic [barcode part1]
acctctcgtgcactag

SEQ ID NO: 10303 - DNA, 16 bp, Artificial Sequence
  synthetic [barcode part1]
aatcttcgattacgcc

SEQ ID NO: 10304 - DNA, 16 bp, Artificial Sequence
  synthetic [barcode part1]
ttccacctgttgtctg

SEQ ID NO: 10305 - DNA, 16 bp, Artificial Sequence
  synthetic [barcode part1]
gcaagtgacgaacaag

SEQ ID NO: 10306 - DNA, 16 bp, Artificial Sequence
  synthetic [barcode part1]
acacaacactgacgtc

SEQ ID NO: 10307 - DNA, 16 bp, Artificial Sequence
  synthetic [barcode part1]
tattgaacggaggtac

SEQ ID NO: 10308 - DNA, 16 bp, Artificial Sequence
  synthetic [barcode part1]
gatagagtgtactggt

SEQ ID NO: 10309 - DNA, 16 bp, Artificial Sequence
  synthetic [barcode part1]
atacacgccttaaggc

SEQ ID NO: 10310 - DNA, 16 bp, Artificial Sequence
  synthetic [barcode part1]
acaatattgcacgcgc

SEQ ID NO: 10311 - DNA, 16 bp, Artificial Sequence
  synthetic [barcode part1]
tcagaacttacctacc

SEQ ID NO: 10312 - DNA, 16 bp, Artificial Sequence
  synthetic [barcode part1]
cgtcctaggacaatac

SEQ ID NO: 10313 - DNA, 16 bp, Artificial Sequence
  synthetic [barcode part1]
aaccgtgcacgtgatt

SEQ ID NO: 10314 - DNA, 16 bp, Artificial Sequence
  synthetic [barcode part1]
gatcgaggatacgtcg

SEQ ID NO: 10315 - DNA, 16 bp, Artificial Sequence
  synthetic [barcode part1]
tggataccaatcttcc

SEQ ID NO: 10316 - DNA, 16 bp, Artificial Sequence
  synthetic [barcode part1]
tggttaggccaattgc

SEQ ID NO: 10317 - DNA, 16 bp, Artificial Sequence
  synthetic [barcode part1]
attcactcaggacttc

SEQ ID NO: 10318 - DNA, 16 bp, Artificial Sequence
  synthetic [barcode part1]
acctcaccggacttac

SEQ ID NO: 10319 - DNA, 16 bp, Artificial Sequence
  synthetic [barcode part1]
cggttgaatacgcact

SEQ ID NO: 10320 - DNA, 16 bp, Artificial Sequence
  synthetic [barcode part1]
cacaactaaggactag

SEQ ID NO: 10321 - DNA, 16 bp, Artificial Sequence
  synthetic [barcode part1]
tcctacgattaccggc

SEQ ID NO: 10322 - DNA, 16 bp, Artificial Sequence
  synthetic [barcode part1]
gagtccacaggaggtt

SEQ ID NO: 10323 - DNA, 16 bp, Artificial Sequence
  synthetic [barcode part1]
ccgagtaactcgtagt

SEQ ID NO: 10324 - DNA, 16 bp, Artificial Sequence
  synthetic [barcode part1]
gtgactacacgtaacc

SEQ ID NO: 10325 - DNA, 16 bp, Artificial Sequence
  synthetic [barcode part1]
ttcctatcgtcaagtg

SEQ ID NO: 10326 - DNA, 16 bp, Artificial Sequence
  synthetic [barcode part1]
tactgtggtgttgcag

SEQ ID NO: 10327 - DNA, 16 bp, Artificial Sequence
  synthetic [barcode part1]
gttgttgattaggccg

SEQ ID NO: 10328 - DNA, 16 bp, Artificial Sequence
  synthetic [barcode part1]
tagacggtagaattcg

SEQ ID NO: 10329 - DNA, 16 bp, Artificial Sequence
  synthetic [barcode part1]
taccagagagtgtggc

SEQ ID NO: 10330 - DNA, 16 bp, Artificial Sequence
  synthetic [barcode part1]
gcacacctactctgtg

SEQ ID NO: 10331 - DNA, 16 bp, Artificial Sequence
  synthetic [barcode part1]
cctacgttacgagaac

SEQ ID NO: 10332 - DNA, 16 bp, Artificial Sequence
  synthetic [barcode part1]
cgtcttaatctacggt

SEQ ID NO: 10333 - DNA, 16 bp, Artificial Sequence
  synthetic [barcode part1]
gtgactgaagattggt

SEQ ID NO: 10334 - DNA, 16 bp, Artificial Sequence
  synthetic [barcode part1]
taattcctaaccgtgc

SEQ ID NO: 10335 - DNA, 16 bp, Artificial Sequence
  synthetic [barcode part1]
tccttctggccttaac

SEQ ID NO: 10336 - DNA, 16 bp, Artificial Sequence
  synthetic [barcode part1]
cggattagaggtgtgc

SEQ ID NO: 10337 - DNA, 16 bp, Artificial Sequence
  synthetic [barcode part1]
aacaaccgactgtcac

SEQ ID NO: 10338 - DNA, 16 bp, Artificial Sequence
  synthetic [barcode part1]
caaggcagacgtactg

SEQ ID NO: 10339 - DNA, 16 bp, Artificial Sequence
  synthetic [barcode part1]
ttgagtcaaccgtcag

SEQ ID NO: 10340 - DNA, 16 bp, Artificial Sequence
  synthetic [barcode part1]
accgataatccgagtc

SEQ ID NO: 10341 - DNA, 16 bp, Artificial Sequence
  synthetic [barcode part1]
gagaatactcggtaac

SEQ ID NO: 10342 - DNA, 16 bp, Artificial Sequence
  synthetic [barcode part1]
tagacgtacgtagtcc

SEQ ID NO: 10343 - DNA, 16 bp, Artificial Sequence
  synthetic [barcode part1]
agtggttcgcgaagac

SEQ ID NO: 10344 - DNA, 16 bp, Artificial Sequence
  synthetic [barcode part1]
gtccgcagtataatcg

SEQ ID NO: 10345 - DNA, 16 bp, Artificial Sequence
  synthetic [barcode part1]
cacgtgcgtattacag

SEQ ID NO: 10346 - DNA, 16 bp, Artificial Sequence
  synthetic [barcode part1]
acgtctctagtaatcc

SEQ ID NO: 10347 - DNA, 16 bp, Artificial Sequence
  synthetic [barcode part1]
gtctcctggaactaag

SEQ ID NO: 10348 - DNA, 16 bp, Artificial Sequence
  synthetic [barcode part1]
caaccgcaagtatctg

SEQ ID NO: 10349 - DNA, 16 bp, Artificial Sequence
  synthetic [barcode part1]
actcaagtatccggac

SEQ ID NO: 10350 - DNA, 16 bp, Artificial Sequence
  synthetic [barcode part1]
gcgtcttaacctgacc

SEQ ID NO: 10351 - DNA, 16 bp, Artificial Sequence
  synthetic [barcode part1]
ccgttgcacaagtcct

SEQ ID NO: 10352 - DNA, 16 bp, Artificial Sequence
  synthetic [barcode part1]
ttctgcagtgtctcct

SEQ ID NO: 10353 - DNA, 16 bp, Artificial Sequence
  synthetic [barcode part1]
agactattgcctctgt

SEQ ID NO: 10354 - DNA, 16 bp, Artificial Sequence
  synthetic [barcode part1]
gcgttatactcacttg

SEQ ID NO: 10355 - DNA, 16 bp, Artificial Sequence
  synthetic [barcode part1]
ttgatctcaccaacac

SEQ ID NO: 10356 - DNA, 16 bp, Artificial Sequence
  synthetic [barcode part1]
gacacgtcacagttgt

SEQ ID NO: 10357 - DNA, 16 bp, Artificial Sequence
  synthetic [barcode part1]
gacgcgcaattggagt

SEQ ID NO: 10358 - DNA, 16 bp, Artificial Sequence
  synthetic [barcode part1]
gtgccgtaacgagtag

SEQ ID NO: 10359 - DNA, 16 bp, Artificial Sequence
  synthetic [barcode part1]
caaggtgtctgcagag

SEQ ID NO: 10360 - DNA, 16 bp, Artificial Sequence
  synthetic [barcode part1]
gttgcgcgtgtaattg

SEQ ID NO: 10361 - DNA, 16 bp, Artificial Sequence
  synthetic [barcode part1]
cgtccagaggagttag

SEQ ID NO: 10362 - DNA, 16 bp, Artificial Sequence
  synthetic [barcode part1]
gtcactacgtgtcctg

SEQ ID NO: 10363 - DNA, 16 bp, Artificial Sequence
  synthetic [barcode part1]
gcgaactgtcgttcct

SEQ ID NO: 10364 - DNA, 16 bp, Artificial Sequence
  synthetic [barcode part1]
tagattgcacgagagt

SEQ ID NO: 10365 - DNA, 16 bp, Artificial Sequence
  synthetic [barcode part1]
aacgactcagtggttc

SEQ ID NO: 10366 - DNA, 16 bp, Artificial Sequence
  synthetic [barcode part1]
aactgcaaccaacgtc

SEQ ID NO: 10367 - DNA, 16 bp, Artificial Sequence
  synthetic [barcode part1]
tcacttgtgtcgtagt

SEQ ID NO: 10368 - DNA, 16 bp, Artificial Sequence
  synthetic [barcode part1]
aacgaatcgccacgag

SEQ ID NO: 10369 - DNA, 16 bp, Artificial Sequence
  synthetic [barcode part1]
caagaggcgattgtgc

SEQ ID NO: 10370 - DNA, 16 bp, Artificial Sequence
  synthetic [barcode part1]
attcgtgtgatccttg

SEQ ID NO: 10371 - DNA, 16 bp, Artificial Sequence
  synthetic [barcode part1]
aatcgcactctctggc

SEQ ID NO: 10372 - DNA, 16 bp, Artificial Sequence
  synthetic [barcode part1]
gacgtacacacactgt

SEQ ID NO: 10373 - DNA, 16 bp, Artificial Sequence
  synthetic [barcode part1]
acgccgttactcactg

SEQ ID NO: 10374 - DNA, 16 bp, Artificial Sequence
  synthetic [barcode part1]
gaggtggagtaggatt

SEQ ID NO: 10375 - DNA, 16 bp, Artificial Sequence
  synthetic [barcode part1]
gccgtcttgtctgagt

SEQ ID NO: 10376 - DNA, 16 bp, Artificial Sequence
  synthetic [barcode part1]
ttgaacgtatcacctc

SEQ ID NO: 10377 - DNA, 16 bp, Artificial Sequence
  synthetic [barcode part1]
ccgttcacttaggacc

SEQ ID NO: 10378 - DNA, 16 bp, Artificial Sequence
  synthetic [barcode part1]
atcttcacttagtggc

SEQ ID NO: 10379 - DNA, 16 bp, Artificial Sequence
  synthetic [barcode part1]
cgtcgacgaagaactg

SEQ ID NO: 10380 - DNA, 16 bp, Artificial Sequence
  synthetic [barcode part1]
ttggagtaggtggacc

SEQ ID NO: 10381 - DNA, 16 bp, Artificial Sequence
  synthetic [barcode part1]
taacgcgcagtcctct

SEQ ID NO: 10382 - DNA, 16 bp, Artificial Sequence
  synthetic [barcode part1]
tagaaggcggtcgtgt

SEQ ID NO: 10383 - DNA, 16 bp, Artificial Sequence
  synthetic [barcode part1]
gtcgcacgaagtaacg

SEQ ID NO: 10384 - DNA, 16 bp, Artificial Sequence
  synthetic [barcode part1]
caatcctaccgcgtgt

SEQ ID NO: 10385 - DNA, 16 bp, Artificial Sequence
  synthetic [barcode part1]
gtcgagtcagatcact

SEQ ID NO: 10386 - DNA, 16 bp, Artificial Sequence
  synthetic [barcode part1]
ttaacaacgcctctac

SEQ ID NO: 10387 - DNA, 16 bp, Artificial Sequence
  synthetic [barcode part1]
gagtctggaatcaagt

SEQ ID NO: 10388 - DNA, 16 bp, Artificial Sequence
  synthetic [barcode part1]
acgtggaattcgatag

SEQ ID NO: 10389 - DNA, 16 bp, Artificial Sequence
  synthetic [barcode part1]
aggacttacttactcc

SEQ ID NO: 10390 - DNA, 16 bp, Artificial Sequence
  synthetic [barcode part1]
gtataccaacaacgag

SEQ ID NO: 10391 - DNA, 16 bp, Artificial Sequence
  synthetic [barcode part1]
gagttcacaagaggcc

SEQ ID NO: 10392 - DNA, 16 bp, Artificial Sequence
  synthetic [barcode part1]
gttgtgttgtggatcg

SEQ ID NO: 10393 - DNA, 16 bp, Artificial Sequence
  synthetic [barcode part1]
agtcaacagtcggttc

SEQ ID NO: 10394 - DNA, 16 bp, Artificial Sequence
  synthetic [barcode part1]
cgagttggtacgaggt

SEQ ID NO: 10395 - DNA, 16 bp, Artificial Sequence
  synthetic [barcode part1]
tacaggtacgagtctc

SEQ ID NO: 10396 - DNA, 16 bp, Artificial Sequence
  synthetic [barcode part1]
gcagttgtcttgatct

SEQ ID NO: 10397 - DNA, 16 bp, Artificial Sequence
  synthetic [barcode part1]
ccaggtctgatctaag

SEQ ID NO: 10398 - DNA, 16 bp, Artificial Sequence
  synthetic [barcode part1]
tcttggaggcggatag

SEQ ID NO: 10399 - DNA, 16 bp, Artificial Sequence
  synthetic [barcode part1]
ttactctgccaggaag

SEQ ID NO: 10400 - DNA, 16 bp, Artificial Sequence
  synthetic [barcode part1]
tcagtgtacgttgacg

SEQ ID NO: 10401 - DNA, 16 bp, Artificial Sequence
  synthetic [barcode part1]
aatcgtgttccagttc

SEQ ID NO: 10402 - DNA, 16 bp, Artificial Sequence
  synthetic [barcode part1]
ttgtgtcagatcgtct

SEQ ID NO: 10403 - DNA, 16 bp, Artificial Sequence
  synthetic [barcode part1]
gtgagttatactcggc

SEQ ID NO: 10404 - DNA, 16 bp, Artificial Sequence
  synthetic [barcode part1]
atcacttcaaggtggc

SEQ ID NO: 10405 - DNA, 16 bp, Artificial Sequence
  synthetic [barcode part1]
gcctgtctacctatct

SEQ ID NO: 10406 - DNA, 16 bp, Artificial Sequence
  synthetic [barcode part1]
tacgttcgacgatctt

SEQ ID NO: 10407 - DNA, 16 bp, Artificial Sequence
  synthetic [barcode part1]
tggcggttgattcaac

SEQ ID NO: 10408 - DNA, 16 bp, Artificial Sequence
  synthetic [barcode part1]
acgaatccttccggtc

SEQ ID NO: 10409 - DNA, 16 bp, Artificial Sequence
  synthetic [barcode part1]
ccaacttgaacactct

SEQ ID NO: 10410 - DNA, 16 bp, Artificial Sequence
  synthetic [barcode part1]
gcactaaccagtacac

SEQ ID NO: 10411 - DNA, 16 bp, Artificial Sequence
  synthetic [barcode part1]
ttcctggtaactgtac

SEQ ID NO: 10412 - DNA, 16 bp, Artificial Sequence
  synthetic [barcode part1]
acggtgtgactgatct

SEQ ID NO: 10413 - DNA, 16 bp, Artificial Sequence
  synthetic [barcode part1]
tgcgagaattggattg

SEQ ID NO: 10414 - DNA, 16 bp, Artificial Sequence
  synthetic [barcode part1]
attcaggtgtcacttc

SEQ ID NO: 10415 - DNA, 16 bp, Artificial Sequence
  synthetic [barcode part1]
atagtgcacgcgtatc

SEQ ID NO: 10416 - DNA, 16 bp, Artificial Sequence
  synthetic [barcode part1]
atctacgagaagtcag

SEQ ID NO: 10417 - DNA, 16 bp, Artificial Sequence
  synthetic [barcode part1]
cgtaatcaaggactag

SEQ ID NO: 10418 - DNA, 16 bp, Artificial Sequence
  synthetic [barcode part1]
tcactgtagtactcgt

SEQ ID NO: 10419 - DNA, 16 bp, Artificial Sequence
  synthetic [barcode part1]
ttgtgtcctgtcaagt

SEQ ID NO: 10420 - DNA, 16 bp, Artificial Sequence
  synthetic [barcode part1]
cgagaagtgtacgacc

SEQ ID NO: 10421 - DNA, 16 bp, Artificial Sequence
  synthetic [barcode part1]
cgttaagactcagtgc

SEQ ID NO: 10422 - DNA, 16 bp, Artificial Sequence
  synthetic [barcode part1]
caacctacttgtatcg

SEQ ID NO: 10423 - DNA, 16 bp, Artificial Sequence
  synthetic [barcode part1]
caaggagttctggttc

SEQ ID NO: 10424 - DNA, 16 bp, Artificial Sequence
  synthetic [barcode part1]
cggaattgtcaactgc

SEQ ID NO: 10425 - DNA, 16 bp, Artificial Sequence
  synthetic [barcode part1]
aacacaattcggcaag

SEQ ID NO: 10426 - DNA, 16 bp, Artificial Sequence
  synthetic [barcode part1]
gtgccaggattgtatc

SEQ ID NO: 10427 - DNA, 16 bp, Artificial Sequence
  synthetic [barcode part1]
ttgtaggccactattc

SEQ ID NO: 10428 - DNA, 16 bp, Artificial Sequence
  synthetic [barcode part1]
gacggttactgttggt

SEQ ID NO: 10429 - DNA, 16 bp, Artificial Sequence
  synthetic [barcode part1]
tctcggcacgtgactt

SEQ ID NO: 10430 - DNA, 16 bp, Artificial Sequence
  synthetic [barcode part1]
aacggagttctgttgc

SEQ ID NO: 10431 - DNA, 16 bp, Artificial Sequence
  synthetic [barcode part1]
ttgcgatatcgtggtg

SEQ ID NO: 10432 - DNA, 16 bp, Artificial Sequence
  synthetic [barcode part1]
ttcagacggtacactg

SEQ ID NO: 10433 - DNA, 16 bp, Artificial Sequence
  synthetic [barcode part1]
tatctggcgacggaag

SEQ ID NO: 10434 - DNA, 16 bp, Artificial Sequence
  synthetic [barcode part1]
cgaagtcgtgtacact

SEQ ID NO: 10435 - DNA, 16 bp, Artificial Sequence
  synthetic [barcode part1]
tcgtgattcaagaccg

SEQ ID NO: 10436 - DNA, 16 bp, Artificial Sequence
  synthetic [barcode part1]
acttgaacgccgtcct

SEQ ID NO: 10437 - DNA, 16 bp, Artificial Sequence
  synthetic [barcode part1]
aactaagttcgcagag

SEQ ID NO: 10438 - DNA, 16 bp, Artificial Sequence
  synthetic [barcode part1]
acgtggtacgtatcgt

SEQ ID NO: 10439 - DNA, 16 bp, Artificial Sequence
  synthetic [barcode part1]
agacagatctaggact

SEQ ID NO: 10440 - DNA, 16 bp, Artificial Sequence
  synthetic [barcode part1]
aagtagtgcgtggtcg

SEQ ID NO: 10441 - DNA, 16 bp, Artificial Sequence
  synthetic [barcode part1]
cgcggtagaacaagtc

SEQ ID NO: 10442 - DNA, 16 bp, Artificial Sequence
  synthetic [barcode part1]
attcttccggttacag

SEQ ID NO: 10443 - DNA, 16 bp, Artificial Sequence
  synthetic [barcode part1]
gacttgttactatccg

SEQ ID NO: 10444 - DNA, 16 bp, Artificial Sequence
  synthetic [barcode part1]
tataagtggcaggatc

SEQ ID NO: 10445 - DNA, 16 bp, Artificial Sequence
  synthetic [barcode part1]
caatctggttcctgcg

SEQ ID NO: 10446 - DNA, 16 bp, Artificial Sequence
  synthetic [barcode part1]
gagtacgaacctggtg

SEQ ID NO: 10447 - DNA, 16 bp, Artificial Sequence
  synthetic [barcode part1]
tgtgatcacgtggttg

SEQ ID NO: 10448 - DNA, 16 bp, Artificial Sequence
  synthetic [barcode part1]
tcgtattgtcttcgcc

SEQ ID NO: 10449 - DNA, 16 bp, Artificial Sequence
  synthetic [barcode part1]
gacagagttaggtgcc

SEQ ID NO: 10450 - DNA, 16 bp, Artificial Sequence
  synthetic [barcode part1]
tgcctgcacgacactt

SEQ ID NO: 10451 - DNA, 16 bp, Artificial Sequence
  synthetic [barcode part1]
acgttgtctattcacg

SEQ ID NO: 10452 - DNA, 16 bp, Artificial Sequence
  synthetic [barcode part1]
gaacgtgccgataacg

SEQ ID NO: 10453 - DNA, 16 bp, Artificial Sequence
  synthetic [barcode part1]
tgtggtgtcacagtgt

SEQ ID NO: 10454 - DNA, 16 bp, Artificial Sequence
  synthetic [barcode part1]
aggcgaattcaagatc

SEQ ID NO: 10455 - DNA, 16 bp, Artificial Sequence
  synthetic [barcode part1]
cgtgttcctacacttc

SEQ ID NO: 10456 - DNA, 16 bp, Artificial Sequence
  synthetic [barcode part1]
gtcgttattccacgcg

SEQ ID NO: 10457 - DNA, 16 bp, Artificial Sequence
  synthetic [barcode part1]
ccttctggtctcttag

SEQ ID NO: 10458 - DNA, 16 bp, Artificial Sequence
  synthetic [barcode part1]
tagactcagatctgcg

SEQ ID NO: 10459 - DNA, 16 bp, Artificial Sequence
  synthetic [barcode part1]
taaggaagttacgtgc

SEQ ID NO: 10460 - DNA, 16 bp, Artificial Sequence
  synthetic [barcode part1]
caggtgaggattccag

SEQ ID NO: 10461 - DNA, 16 bp, Artificial Sequence
  synthetic [barcode part1]
tcagtgtacaccaacg

SEQ ID NO: 10462 - DNA, 16 bp, Artificial Sequence
  synthetic [barcode part1]
atcgcgacctactcgt

SEQ ID NO: 10463 - DNA, 16 bp, Artificial Sequence
  synthetic [barcode part1]
acttactgacaccgcc

SEQ ID NO: 10464 - DNA, 16 bp, Artificial Sequence
  synthetic [barcode part1]
gtgagtgaacgagtag

SEQ ID NO: 10465 - DNA, 16 bp, Artificial Sequence
  synthetic [barcode part1]
aacggactccaagacg

SEQ ID NO: 10466 - DNA, 16 bp, Artificial Sequence
  synthetic [barcode part1]
gccagtggagttgaac

SEQ ID NO: 10467 - DNA, 16 bp, Artificial Sequence
  synthetic [barcode part1]
cagtacacttcgccac

SEQ ID NO: 10468 - DNA, 16 bp, Artificial Sequence
  synthetic [barcode part1]
ccttgtaagttgtcgt

SEQ ID NO: 10469 - DNA, 16 bp, Artificial Sequence
  synthetic [barcode part1]
tcacactcggaccgtt

SEQ ID NO: 10470 - DNA, 16 bp, Artificial Sequence
  synthetic [barcode part1]
accacctgtctacgac

SEQ ID NO: 10471 - DNA, 16 bp, Artificial Sequence
  synthetic [barcode part1]
acgagtctaatctcct

SEQ ID NO: 10472 - DNA, 16 bp, Artificial Sequence
  synthetic [barcode part1]
aatccgtagtgcctag

SEQ ID NO: 10473 - DNA, 16 bp, Artificial Sequence
  synthetic [barcode part1]
taccaccgtagttatc

SEQ ID NO: 10474 - DNA, 16 bp, Artificial Sequence
  synthetic [barcode part1]
atcggacagatcgtct

SEQ ID NO: 10475 - DNA, 16 bp, Artificial Sequence
  synthetic [barcode part1]
gccaggtcaagagtac

SEQ ID NO: 10476 - DNA, 16 bp, Artificial Sequence
  synthetic [barcode part1]
tagaagagtgtcgatc

SEQ ID NO: 10477 - DNA, 16 bp, Artificial Sequence
  synthetic [barcode part1]
caatccacttgtgttg

SEQ ID NO: 10478 - DNA, 16 bp, Artificial Sequence
  synthetic [barcode part1]
aatcggtattgtggcc

SEQ ID NO: 10479 - DNA, 16 bp, Artificial Sequence
  synthetic [barcode part1]
ccgataactcgcgttc

SEQ ID NO: 10480 - DNA, 16 bp, Artificial Sequence
  synthetic [barcode part1]
ttatcacttgcagacc

SEQ ID NO: 10481 - DNA, 16 bp, Artificial Sequence
  synthetic [barcode part1]
gtcttgcctcaatctc

SEQ ID NO: 10482 - DNA, 16 bp, Artificial Sequence
  synthetic [barcode part1]
gagagatactcggatt

SEQ ID NO: 10483 - DNA, 16 bp, Artificial Sequence
  synthetic [barcode part1]
gcagtaggtgaagtag

SEQ ID NO: 10484 - DNA, 16 bp, Artificial Sequence
  synthetic [barcode part1]
acgaggagattattgc

SEQ ID NO: 10485 - DNA, 16 bp, Artificial Sequence
  synthetic [barcode part1]
cggacaagaataggtg

SEQ ID NO: 10486 - DNA, 16 bp, Artificial Sequence
  synthetic [barcode part1]
tgtcacagtgtacgtg

SEQ ID NO: 10487 - DNA, 16 bp, Artificial Sequence
  synthetic [barcode part1]
ttggttccttgcaagt

SEQ ID NO: 10488 - DNA, 16 bp, Artificial Sequence
  synthetic [barcode part1]
acttggagacactcac

SEQ ID NO: 10489 - DNA, 16 bp, Artificial Sequence
  synthetic [barcode part1]
gtaaggcgtaacagag

SEQ ID NO: 10490 - DNA, 16 bp, Artificial Sequence
  synthetic [barcode part1]
gacttgaccttgtatc

SEQ ID NO: 10491 - DNA, 16 bp, Artificial Sequence
  synthetic [barcode part1]
cacctgttctggaacc

SEQ ID NO: 10492 - DNA, 16 bp, Artificial Sequence
  synthetic [barcode part1]
agactacgtaagaacc

SEQ ID NO: 10493 - DNA, 16 bp, Artificial Sequence
  synthetic [barcode part1]
gagaacaggtgattct

SEQ ID NO: 10494 - DNA, 16 bp, Artificial Sequence
  synthetic [barcode part1]
tgaccagtcctaaggt

SEQ ID NO: 10495 - DNA, 16 bp, Artificial Sequence
  synthetic [barcode part1]
caagtctaagtggtag

SEQ ID NO: 10496 - DNA, 16 bp, Artificial Sequence
  synthetic [barcode part1]
aatagacctcgtccag

SEQ ID NO: 10497 - DNA, 16 bp, Artificial Sequence
  synthetic [barcode part1]
gcgtgaacttgtatcg

SEQ ID NO: 10498 - DNA, 16 bp, Artificial Sequence
  synthetic [barcode part1]
cacggaccgttatctc

SEQ ID NO: 10499 - DNA, 16 bp, Artificial Sequence
  synthetic [barcode part1]
ttagattgtgcggaag

SEQ ID NO: 10500 - DNA, 16 bp, Artificial Sequence
  synthetic [barcode part1]
tgttgacttaactccg

SEQ ID NO: 10501 - DNA, 16 bp, Artificial Sequence
  synthetic [barcode part1]
gagtgaacggaattct

SEQ ID NO: 10502 - DNA, 16 bp, Artificial Sequence
  synthetic [barcode part1]
gacggatcagaatccg

SEQ ID NO: 10503 - DNA, 16 bp, Artificial Sequence
  synthetic [barcode part1]
tgaacctcgttgcctg

SEQ ID NO: 10504 - DNA, 16 bp, Artificial Sequence
  synthetic [barcode part1]
acgtcaactctatcac

SEQ ID NO: 10505 - DNA, 16 bp, Artificial Sequence
  synthetic [barcode part1]
gttctgcggatactcc

SEQ ID NO: 10506 - DNA, 16 bp, Artificial Sequence
  synthetic [barcode part1]
ttctgcgaactgccac

SEQ ID NO: 10507 - DNA, 16 bp, Artificial Sequence
  synthetic [barcode part1]
tcgttacggattcact

SEQ ID NO: 10508 - DNA, 16 bp, Artificial Sequence
  synthetic [barcode part1]
ttgaggtagactctgc

SEQ ID NO: 10509 - DNA, 16 bp, Artificial Sequence
  synthetic [barcode part1]
ccttgtgttctcgtac

SEQ ID NO: 10510 - DNA, 16 bp, Artificial Sequence
  synthetic [barcode part1]
gatcgtactgattctc

SEQ ID NO: 10511 - DNA, 16 bp, Artificial Sequence
  synthetic [barcode part1]
tctggaatagtgtcgc

SEQ ID NO: 10512 - DNA, 16 bp, Artificial Sequence
  synthetic [barcode part1]
tgtggtgcgagtaggt

SEQ ID NO: 10513 - DNA, 16 bp, Artificial Sequence
  synthetic [barcode part1]
tcttagtgtgcaactc

SEQ ID NO: 10514 - DNA, 16 bp, Artificial Sequence
  synthetic [barcode part1]
cgtacagtgagagatt

SEQ ID NO: 10515 - DNA, 16 bp, Artificial Sequence
  synthetic [barcode part1]
tgcgattaggatagtg

SEQ ID NO: 10516 - DNA, 16 bp, Artificial Sequence
  synthetic [barcode part1]
atacgtcgccttccag

SEQ ID NO: 10517 - DNA, 16 bp, Artificial Sequence
  synthetic [barcode part1]
tccagtcctgattctc

SEQ ID NO: 10518 - DNA, 16 bp, Artificial Sequence
  synthetic [barcode part1]
tacgtccacagagatc

SEQ ID NO: 10519 - DNA, 16 bp, Artificial Sequence
  synthetic [barcode part1]
tctgtgaggatagtag

SEQ ID NO: 10520 - DNA, 16 bp, Artificial Sequence
  synthetic [barcode part1]
agtggcacgagataag

SEQ ID NO: 10521 - DNA, 16 bp, Artificial Sequence
  synthetic [barcode part1]
ttcgagtctgcacaag

SEQ ID NO: 10522 - DNA, 16 bp, Artificial Sequence
  synthetic [barcode part1]
gattccagaatagacg

SEQ ID NO: 10523 - DNA, 16 bp, Artificial Sequence
  synthetic [barcode part1]
gacgcgttaactacac

SEQ ID NO: 10524 - DNA, 16 bp, Artificial Sequence
  synthetic [barcode part1]
cgttacttcgccactt

SEQ ID NO: 10525 - DNA, 16 bp, Artificial Sequence
  synthetic [barcode part1]
atcttacctgcacggc

SEQ ID NO: 10526 - DNA, 16 bp, Artificial Sequence
  synthetic [barcode part1]
ttcgtgcgtcgttgac

SEQ ID NO: 10527 - DNA, 16 bp, Artificial Sequence
  synthetic [barcode part1]
atcagtgaataacggc

SEQ ID NO: 10528 - DNA, 16 bp, Artificial Sequence
  synthetic [barcode part1]
taaccgatcctccttc

SEQ ID NO: 10529 - DNA, 16 bp, Artificial Sequence
  synthetic [barcode part1]
tgtgtcaggaggactg

SEQ ID NO: 10530 - DNA, 16 bp, Artificial Sequence
  synthetic [barcode part1]
gttctcggcctagtac

SEQ ID NO: 10531 - DNA, 16 bp, Artificial Sequence
  synthetic [barcode part1]
cacaatctgtaggtcg

SEQ ID NO: 10532 - DNA, 16 bp, Artificial Sequence
  synthetic [barcode part1]
tagactcgtcttgccg

SEQ ID NO: 10533 - DNA, 16 bp, Artificial Sequence
  synthetic [barcode part1]
cggtaagaacaagacg

SEQ ID NO: 10534 - DNA, 16 bp, Artificial Sequence
  synthetic [barcode part1]
aatagagtggcctctc

SEQ ID NO: 10535 - DNA, 16 bp, Artificial Sequence
  synthetic [barcode part1]
taggaggtgtgaccac

SEQ ID NO: 10536 - DNA, 16 bp, Artificial Sequence
  synthetic [barcode part1]
gacaacgaggtagtag

SEQ ID NO: 10537 - DNA, 16 bp, Artificial Sequence
  synthetic [barcode part1]
aggtctatactctgtc

SEQ ID NO: 10538 - DNA, 16 bp, Artificial Sequence
  synthetic [barcode part1]
cgaggaacttcagttc

SEQ ID NO: 10539 - DNA, 16 bp, Artificial Sequence
  synthetic [barcode part1]
cgaccacttcagtctg

SEQ ID NO: 10540 - DNA, 16 bp, Artificial Sequence
  synthetic [barcode part1]
gcaacactgtggtact

SEQ ID NO: 10541 - DNA, 16 bp, Artificial Sequence
  synthetic [barcode part1]
tggcagaatctgcgag

SEQ ID NO: 10542 - DNA, 16 bp, Artificial Sequence
  synthetic [barcode part1]
actggtaacgagacgc

SEQ ID NO: 10543 - DNA, 16 bp, Artificial Sequence
  synthetic [barcode part1]
cggaacttagtaccgt

SEQ ID NO: 10544 - DNA, 16 bp, Artificial Sequence
  synthetic [barcode part1]
cagtccgtctaacaag

SEQ ID NO: 10545 - DNA, 16 bp, Artificial Sequence
  synthetic [barcode part1]
cgtaaggttagtaacg

SEQ ID NO: 10546 - DNA, 16 bp, Artificial Sequence
  synthetic [barcode part1]
cgttcgcggatcttgt

SEQ ID NO: 10547 - DNA, 16 bp, Artificial Sequence
  synthetic [barcode part1]
tctatacgaccgccac

SEQ ID NO: 10548 - DNA, 16 bp, Artificial Sequence
  synthetic [barcode part1]
cgttgataggaagttg

SEQ ID NO: 10549 - DNA, 16 bp, Artificial Sequence
  synthetic [barcode part1]
ttggtacggttcctcg

SEQ ID NO: 10550 - DNA, 16 bp, Artificial Sequence
  synthetic [barcode part1]
gtagagacttccacgt

SEQ ID NO: 10551 - DNA, 16 bp, Artificial Sequence
  synthetic [barcode part1]
agtgtcttctgcagag

SEQ ID NO: 10552 - DNA, 16 bp, Artificial Sequence
  synthetic [barcode part1]
acggcacactatagtc

SEQ ID NO: 10553 - DNA, 16 bp, Artificial Sequence
  synthetic [barcode part1]
tgttcttacgtcctcg

SEQ ID NO: 10554 - DNA, 16 bp, Artificial Sequence
  synthetic [barcode part1]
agaagtaactcggcgc

SEQ ID NO: 10555 - DNA, 16 bp, Artificial Sequence
  synthetic [barcode part1]
cgttattgtctagacc

SEQ ID NO: 10556 - DNA, 16 bp, Artificial Sequence
  synthetic [barcode part1]
tcctagtgtgcgacct

SEQ ID NO: 10557 - DNA, 16 bp, Artificial Sequence
  synthetic [barcode part1]
aggatccaagtagact

SEQ ID NO: 10558 - DNA, 16 bp, Artificial Sequence
  synthetic [barcode part1]
tcgcgtgtctctcaag

SEQ ID NO: 10559 - DNA, 16 bp, Artificial Sequence
  synthetic [barcode part1]
gtaggtctaacaaggt

SEQ ID NO: 10560 - DNA, 16 bp, Artificial Sequence
  synthetic [barcode part1]
actccaccttaacctc

SEQ ID NO: 10561 - DNA, 16 bp, Artificial Sequence
  synthetic [barcode part1]
cgtataaccacgcagt

SEQ ID NO: 10562 - DNA, 16 bp, Artificial Sequence
  synthetic [barcode part1]
aggttgcgtctagtgt

SEQ ID NO: 10563 - DNA, 16 bp, Artificial Sequence
  synthetic [barcode part1]
aacaggcaagttctag

SEQ ID NO: 10564 - DNA, 16 bp, Artificial Sequence
  synthetic [barcode part1]
cgttccgcagatacct

SEQ ID NO: 10565 - DNA, 16 bp, Artificial Sequence
  synthetic [barcode part1]
ttacaggaggcacttc

SEQ ID NO: 10566 - DNA, 16 bp, Artificial Sequence
  synthetic [barcode part1]
cacgtctagtacgaac

SEQ ID NO: 10567 - DNA, 16 bp, Artificial Sequence
  synthetic [barcode part1]
gtatcctaatccggtt

SEQ ID NO: 10568 - DNA, 16 bp, Artificial Sequence
  synthetic [barcode part1]
aggacgaaggtctacc

SEQ ID NO: 10569 - DNA, 16 bp, Artificial Sequence
  synthetic [barcode part1]
cgagaccaactctaac

SEQ ID NO: 10570 - DNA, 16 bp, Artificial Sequence
  synthetic [barcode part1]
ccggagtctatctacc

SEQ ID NO: 10571 - DNA, 16 bp, Artificial Sequence
  synthetic [barcode part1]
agttccttcggcacgt

SEQ ID NO: 10572 - DNA, 16 bp, Artificial Sequence
  synthetic [barcode part1]
gtattggccaacacac

SEQ ID NO: 10573 - DNA, 16 bp, Artificial Sequence
  synthetic [barcode part1]
gtcaaggaccgtacag

SEQ ID NO: 10574 - DNA, 16 bp, Artificial Sequence
  synthetic [barcode part1]
tgaggtcgagactctt

SEQ ID NO: 10575 - DNA, 16 bp, Artificial Sequence
  synthetic [barcode part1]
tcgtgtcgaattgttc

SEQ ID NO: 10576 - DNA, 16 bp, Artificial Sequence
  synthetic [barcode part1]
aggactctattcacct

SEQ ID NO: 10577 - DNA, 16 bp, Artificial Sequence
  synthetic [barcode part1]
aatcgtagactggagt

SEQ ID NO: 10578 - DNA, 16 bp, Artificial Sequence
  synthetic [barcode part1]
tccgtcacgtactgac

SEQ ID NO: 10579 - DNA, 16 bp, Artificial Sequence
  synthetic [barcode part1]
gcggatatctggaacg

SEQ ID NO: 10580 - DNA, 16 bp, Artificial Sequence
  synthetic [barcode part1]
tcgatctgtccttcgt

SEQ ID NO: 10581 - DNA, 16 bp, Artificial Sequence
  synthetic [barcode part1]
atctggtaagagtgtg

SEQ ID NO: 10582 - DNA, 16 bp, Artificial Sequence
  synthetic [barcode part1]
cgagattcttctcctc

SEQ ID NO: 10583 - DNA, 16 bp, Artificial Sequence
  synthetic [barcode part1]
accgcctgaactcact

SEQ ID NO: 10584 - DNA, 16 bp, Artificial Sequence
  synthetic [barcode part1]
aagattcgtaggtggt

SEQ ID NO: 10585 - DNA, 16 bp, Artificial Sequence
  synthetic [barcode part1]
attgtccgtcctacct

SEQ ID NO: 10586 - DNA, 16 bp, Artificial Sequence
  synthetic [barcode part1]
accgagtgtaggaatt

SEQ ID NO: 10587 - DNA, 16 bp, Artificial Sequence
  synthetic [barcode part1]
gtgagagtcggtaacc

SEQ ID NO: 10588 - DNA, 16 bp, Artificial Sequence
  synthetic [barcode part1]
tgcgtcgccttaactg

SEQ ID NO: 10589 - DNA, 16 bp, Artificial Sequence
  synthetic [barcode part1]
cctaacctgtggtcac

SEQ ID NO: 10590 - DNA, 16 bp, Artificial Sequence
  synthetic [barcode part1]
cgatctccaatcacgc

SEQ ID NO: 10591 - DNA, 16 bp, Artificial Sequence
  synthetic [barcode part1]
tcacctacaggatctt

SEQ ID NO: 10592 - DNA, 16 bp, Artificial Sequence
  synthetic [barcode part1]
tgtcacagaggtcttg

SEQ ID NO: 10593 - DNA, 16 bp, Artificial Sequence
  synthetic [barcode part1]
tactgcctggagaatc

SEQ ID NO: 10594 - DNA, 16 bp, Artificial Sequence
  synthetic [barcode part1]
tctgtgagaacctgtg

SEQ ID NO: 10595 - DNA, 16 bp, Artificial Sequence
  synthetic [barcode part1]
agagtctaacaccacc

SEQ ID NO: 10596 - DNA, 16 bp, Artificial Sequence
  synthetic [barcode part1]
tcacaccttgtcaggc

SEQ ID NO: 10597 - DNA, 16 bp, Artificial Sequence
  synthetic [barcode part1]
cagtatacggcgaggt

SEQ ID NO: 10598 - DNA, 16 bp, Artificial Sequence
  synthetic [barcode part1]
tacagacttaccttgc

SEQ ID NO: 10599 - DNA, 16 bp, Artificial Sequence
  synthetic [barcode part1]
gtactccaagagtgtc

SEQ ID NO: 10600 - DNA, 16 bp, Artificial Sequence
  synthetic [barcode part1]
tacgttcagatcgtct

SEQ ID NO: 10601 - DNA, 16 bp, Artificial Sequence
  synthetic [barcode part1]
cagagtcaccagttgt

SEQ ID NO: 10602 - DNA, 16 bp, Artificial Sequence
  synthetic [barcode part1]
ttgagaaggagtggtg

SEQ ID NO: 10603 - DNA, 16 bp, Artificial Sequence
  synthetic [barcode part1]
gcaagaacggcgatct

SEQ ID NO: 10604 - DNA, 16 bp, Artificial Sequence
  synthetic [barcode part1]
agttacaccagtctct

SEQ ID NO: 10605 - DNA, 16 bp, Artificial Sequence
  synthetic [barcode part1]
tacctattcgcggtgc

SEQ ID NO: 10606 - DNA, 16 bp, Artificial Sequence
  synthetic [barcode part1]
aacactgaccacagtc

SEQ ID NO: 10607 - DNA, 16 bp, Artificial Sequence
  synthetic [barcode part1]
attactctcgtagacc

SEQ ID NO: 10608 - DNA, 16 bp, Artificial Sequence
  synthetic [barcode part1]
aactgcacacaaccac

SEQ ID NO: 10609 - DNA, 16 bp, Artificial Sequence
  synthetic [barcode part1]
accaggtggtaatcct

SEQ ID NO: 10610 - DNA, 16 bp, Artificial Sequence
  synthetic [barcode part1]
tagaattgccgtggtc

SEQ ID NO: 10611 - DNA, 16 bp, Artificial Sequence
  synthetic [barcode part1]
gtgagagtgtaaggac

SEQ ID NO: 10612 - DNA, 16 bp, Artificial Sequence
  synthetic [barcode part1]
attggaagtcgtgtag

SEQ ID NO: 10613 - DNA, 16 bp, Artificial Sequence
  synthetic [barcode part1]
tctgttatcaacgcac

SEQ ID NO: 10614 - DNA, 16 bp, Artificial Sequence
  synthetic [barcode part1]
tgtcggatattctcgt

SEQ ID NO: 10615 - DNA, 16 bp, Artificial Sequence
  synthetic [barcode part1]
tgtcctggtaggtctc

SEQ ID NO: 10616 - DNA, 16 bp, Artificial Sequence
  synthetic [barcode part1]
ccagtgccaatatacg

SEQ ID NO: 10617 - DNA, 16 bp, Artificial Sequence
  synthetic [barcode part1]
cacctactgtcgtgac

SEQ ID NO: 10618 - DNA, 16 bp, Artificial Sequence
  synthetic [barcode part1]
gcgcaacagaagatcc

SEQ ID NO: 10619 - DNA, 16 bp, Artificial Sequence
  synthetic [barcode part1]
agtgcagtgtcttcag

SEQ ID NO: 10620 - DNA, 16 bp, Artificial Sequence
  synthetic [barcode part1]
tgcaaggaacttagtg

SEQ ID NO: 10621 - DNA, 16 bp, Artificial Sequence
  synthetic [barcode part1]
gtacagtatcgacacc

SEQ ID NO: 10622 - DNA, 16 bp, Artificial Sequence
  synthetic [barcode part1]
cctgagagaccaactt

SEQ ID NO: 10623 - DNA, 16 bp, Artificial Sequence
  synthetic [barcode part1]
gtgacttccgtacctg

SEQ ID NO: 10624 - DNA, 16 bp, Artificial Sequence
  synthetic [barcode part1]
accagtggagtgttct

SEQ ID NO: 10625 - DNA, 16 bp, Artificial Sequence
  synthetic [barcode part1]
gaacctacgttctgcc

SEQ ID NO: 10626 - DNA, 16 bp, Artificial Sequence
  synthetic [barcode part1]
gcgaactaggaaccgt

SEQ ID NO: 10627 - DNA, 16 bp, Artificial Sequence
  synthetic [barcode part1]
cgtataaccgttacct

SEQ ID NO: 10628 - DNA, 16 bp, Artificial Sequence
  synthetic [barcode part1]
taggactgacttcgac

SEQ ID NO: 10629 - DNA, 16 bp, Artificial Sequence
  synthetic [barcode part1]
cgaccagaatcaactc

SEQ ID NO: 10630 - DNA, 16 bp, Artificial Sequence
  synthetic [barcode part1]
gttcttgacggagact

SEQ ID NO: 10631 - DNA, 16 bp, Artificial Sequence
  synthetic [barcode part1]
acttgacctgagtcag

SEQ ID NO: 10632 - DNA, 16 bp, Artificial Sequence
  synthetic [barcode part1]
tacacctcgttcctgt

SEQ ID NO: 10633 - DNA, 16 bp, Artificial Sequence
  synthetic [barcode part1]
aggtctagtccagatc

SEQ ID NO: 10634 - DNA, 16 bp, Artificial Sequence
  synthetic [barcode part1]
agaggtagtgatctgt

SEQ ID NO: 10635 - DNA, 16 bp, Artificial Sequence
  synthetic [barcode part1]
gtctaagtattgcctc

SEQ ID NO: 10636 - DNA, 16 bp, Artificial Sequence
  synthetic [barcode part1]
caacaacttggatcgc

SEQ ID NO: 10637 - DNA, 16 bp, Artificial Sequence
  synthetic [barcode part1]
tattgcgcaattggcg

SEQ ID NO: 10638 - DNA, 16 bp, Artificial Sequence
  synthetic [barcode part1]
atcaagacagtacgtg

SEQ ID NO: 10639 - DNA, 16 bp, Artificial Sequence
  synthetic [barcode part1]
tgcaagtgtctcgtcc

SEQ ID NO: 10640 - DNA, 16 bp, Artificial Sequence
  synthetic [barcode part1]
gtaattggtcgcgtgt

SEQ ID NO: 10641 - DNA, 16 bp, Artificial Sequence
  synthetic [barcode part1]
tgtgtagttgtacggc

SEQ ID NO: 10642 - DNA, 16 bp, Artificial Sequence
  synthetic [barcode part1]
cagaactagagaaggc

SEQ ID NO: 10643 - DNA, 16 bp, Artificial Sequence
  synthetic [barcode part1]
atcgaataggcgtagt

SEQ ID NO: 10644 - DNA, 16 bp, Artificial Sequence
  synthetic [barcode part1]
gatccggtatatcttc

SEQ ID NO: 10645 - DNA, 16 bp, Artificial Sequence
  synthetic [barcode part1]
acttccacctacgtct

SEQ ID NO: 10646 - DNA, 16 bp, Artificial Sequence
  synthetic [barcode part1]
gtggccgactgatatt

SEQ ID NO: 10647 - DNA, 16 bp, Artificial Sequence
  synthetic [barcode part1]
gtcctgtctacgtgac

SEQ ID NO: 10648 - DNA, 16 bp, Artificial Sequence
  synthetic [barcode part1]
gatagtcgacttggtc

SEQ ID NO: 10649 - DNA, 16 bp, Artificial Sequence
  synthetic [barcode part1]
cactcgtgcagataac

SEQ ID NO: 10650 - DNA, 16 bp, Artificial Sequence
  synthetic [barcode part1]
cactcaccacttgttc

SEQ ID NO: 10651 - DNA, 16 bp, Artificial Sequence
  synthetic [barcode part1]
atcctatacgattgcc

SEQ ID NO: 10652 - DNA, 16 bp, Artificial Sequence
  synthetic [barcode part1]
agaacgactgcggact

SEQ ID NO: 10653 - DNA, 16 bp, Artificial Sequence
  synthetic [barcode part1]
atcttcaacttggtgc

SEQ ID NO: 10654 - DNA, 16 bp, Artificial Sequence
  synthetic [barcode part1]
acacgttctgtgcaag

SEQ ID NO: 10655 - DNA, 16 bp, Artificial Sequence
  synthetic [barcode part1]
ttaggcaggcaggatc

SEQ ID NO: 10656 - DNA, 16 bp, Artificial Sequence
  synthetic [barcode part1]
ttgttgttggaacggc

SEQ ID NO: 10657 - DNA, 16 bp, Artificial Sequence
  synthetic [barcode part1]
acctcactgaagagtc

SEQ ID NO: 10658 - DNA, 16 bp, Artificial Sequence
  synthetic [barcode part1]
ttccaacggcctgtgt

SEQ ID NO: 10659 - DNA, 16 bp, Artificial Sequence
  synthetic [barcode part1]
aacttctccggtacgc

SEQ ID NO: 10660 - DNA, 16 bp, Artificial Sequence
  synthetic [barcode part1]
gttgaacttcaacggc

SEQ ID NO: 10661 - DNA, 16 bp, Artificial Sequence
  synthetic [barcode part1]
aggcagtaaccgtgtg

SEQ ID NO: 10662 - DNA, 16 bp, Artificial Sequence
  synthetic [barcode part1]
gacttagtcaacgacc

SEQ ID NO: 10663 - DNA, 16 bp, Artificial Sequence
  synthetic [barcode part1]
ttgtgtgagtctcttg

SEQ ID NO: 10664 - DNA, 16 bp, Artificial Sequence
  synthetic [barcode part1]
agtgtggaacagtccg

SEQ ID NO: 10665 - DNA, 16 bp, Artificial Sequence
  synthetic [barcode part1]
tgatcgagatcgactc

SEQ ID NO: 10666 - DNA, 16 bp, Artificial Sequence
  synthetic [barcode part1]
gttctactcgtcgtct

SEQ ID NO: 10667 - DNA, 16 bp, Artificial Sequence
  synthetic [barcode part1]
tagtgacgactaccac

SEQ ID NO: 10668 - DNA, 16 bp, Artificial Sequence
  synthetic [barcode part1]
taacgcggtcacctct

SEQ ID NO: 10669 - DNA, 16 bp, Artificial Sequence
  synthetic [barcode part1]
caacacttagacagag

SEQ ID NO: 10670 - DNA, 16 bp, Artificial Sequence
  synthetic [barcode part1]
gaagaacggtacactt

SEQ ID NO: 10671 - DNA, 16 bp, Artificial Sequence
  synthetic [barcode part1]
tcgaacgacgagttct

SEQ ID NO: 10672 - DNA, 16 bp, Artificial Sequence
  synthetic [barcode part1]
tcgagttccttgcacg

SEQ ID NO: 10673 - DNA, 16 bp, Artificial Sequence
  synthetic [barcode part1]
cggacctgtctataag

SEQ ID NO: 10674 - DNA, 16 bp, Artificial Sequence
  synthetic [barcode part1]
aatacagtactaggcg

SEQ ID NO: 10675 - DNA, 16 bp, Artificial Sequence
  synthetic [barcode part1]
atcggcgtacttcgtc

SEQ ID NO: 10676 - DNA, 16 bp, Artificial Sequence
  synthetic [barcode part1]
atactaatcggcgcac

SEQ ID NO: 10677 - DNA, 16 bp, Artificial Sequence
  synthetic [barcode part1]
gactacgatcgacact

SEQ ID NO: 10678 - DNA, 16 bp, Artificial Sequence
  synthetic [barcode part1]
gatcggtccttgaagt

SEQ ID NO: 10679 - DNA, 16 bp, Artificial Sequence
  synthetic [barcode part1]
gccgaacttgtactcc

SEQ ID NO: 10680 - DNA, 16 bp, Artificial Sequence
  synthetic [barcode part1]
tccgaatacaactgcg

SEQ ID NO: 10681 - DNA, 16 bp, Artificial Sequence
  synthetic [barcode part1]
tcactcggagtcctac

SEQ ID NO: 10682 - DNA, 16 bp, Artificial Sequence
  synthetic [barcode part1]
atcacgtccggtatag

SEQ ID NO: 10683 - DNA, 16 bp, Artificial Sequence
  synthetic [barcode part1]
gcacctggagtaacag

SEQ ID NO: 10684 - DNA, 16 bp, Artificial Sequence
  synthetic [barcode part1]
ccttagtgattgcact

SEQ ID NO: 10685 - DNA, 16 bp, Artificial Sequence
  synthetic [barcode part1]
attatacgaagtggcg

SEQ ID NO: 10686 - DNA, 16 bp, Artificial Sequence
  synthetic [barcode part1]
ttagtcgtaaccgacg

SEQ ID NO: 10687 - DNA, 16 bp, Artificial Sequence
  synthetic [barcode part1]
aacgcgaagattgttg

SEQ ID NO: 10688 - DNA, 16 bp, Artificial Sequence
  synthetic [barcode part1]
atatctctctccgtgc

SEQ ID NO: 10689 - DNA, 16 bp, Artificial Sequence
  synthetic [barcode part1]
aacgtactggtgtgtc

SEQ ID NO: 10690 - DNA, 16 bp, Artificial Sequence
  synthetic [barcode part1]
caattgcgttcttcag

SEQ ID NO: 10691 - DNA, 16 bp, Artificial Sequence
  synthetic [barcode part1]
tgtgagtcctgtcgtc

SEQ ID NO: 10692 - DNA, 16 bp, Artificial Sequence
  synthetic [barcode part1]
tccagaatcgaccaac

SEQ ID NO: 10693 - DNA, 16 bp, Artificial Sequence
  synthetic [barcode part1]
agagtgacgtccaggt

SEQ ID NO: 10694 - DNA, 16 bp, Artificial Sequence
  synthetic [barcode part1]
agacgttagtaaggtc

SEQ ID NO: 10695 - DNA, 16 bp, Artificial Sequence
  synthetic [barcode part1]
ttcggtagacaactcg

SEQ ID NO: 10696 - DNA, 16 bp, Artificial Sequence
  synthetic [barcode part1]
cagttactctaatccg

SEQ ID NO: 10697 - DNA, 16 bp, Artificial Sequence
  synthetic [barcode part1]
ttggatctcagtgacg

SEQ ID NO: 10698 - DNA, 16 bp, Artificial Sequence
  synthetic [barcode part1]
agagacagacaacctt

SEQ ID NO: 10699 - DNA, 16 bp, Artificial Sequence
  synthetic [barcode part1]
tcctcgattggagaac

SEQ ID NO: 10700 - DNA, 16 bp, Artificial Sequence
  synthetic [barcode part1]
cgaatactctctaacc

SEQ ID NO: 10701 - DNA, 16 bp, Artificial Sequence
  synthetic [barcode part1]
ttccaacttaacgcgt

SEQ ID NO: 10702 - DNA, 16 bp, Artificial Sequence
  synthetic [barcode part1]
gcgatattcttgaggc

SEQ ID NO: 10703 - DNA, 16 bp, Artificial Sequence
  synthetic [barcode part1]
gaacgacactactctg

SEQ ID NO: 10704 - DNA, 16 bp, Artificial Sequence
  synthetic [barcode part1]
gaagagtagtggcagt

SEQ ID NO: 10705 - DNA, 16 bp, Artificial Sequence
  synthetic [barcode part1]
tgagttgtggtagtcc

SEQ ID NO: 10706 - DNA, 16 bp, Artificial Sequence
  synthetic [barcode part1]
gcactggtgattcctc

SEQ ID NO: 10707 - DNA, 16 bp, Artificial Sequence
  synthetic [barcode part1]
tccaagtcttgattcg

SEQ ID NO: 10708 - DNA, 16 bp, Artificial Sequence
  synthetic [barcode part1]
tgagacgatccttcag

SEQ ID NO: 10709 - DNA, 16 bp, Artificial Sequence
  synthetic [barcode part1]
ccgttcacaagtagac

SEQ ID NO: 10710 - DNA, 16 bp, Artificial Sequence
  synthetic [barcode part1]
tcctaccagatccacg

SEQ ID NO: 10711 - DNA, 16 bp, Artificial Sequence
  synthetic [barcode part1]
tagaggatctctcggt

SEQ ID NO: 10712 - DNA, 16 bp, Artificial Sequence
  synthetic [barcode part1]
caagttcggacaatag

SEQ ID NO: 10713 - DNA, 16 bp, Artificial Sequence
  synthetic [barcode part1]
gcagagtgaacctgtg

SEQ ID NO: 10714 - DNA, 16 bp, Artificial Sequence
  synthetic [barcode part1]
ccaagtaactctactc

SEQ ID NO: 10715 - DNA, 16 bp, Artificial Sequence
  synthetic [barcode part1]
acctacctaagacttc

SEQ ID NO: 10716 - DNA, 16 bp, Artificial Sequence
  synthetic [barcode part1]
gcgaatcaactcgtgt

SEQ ID NO: 10717 - DNA, 16 bp, Artificial Sequence
  synthetic [barcode part1]
gtagttatcggttcct

SEQ ID NO: 10718 - DNA, 16 bp, Artificial Sequence
  synthetic [barcode part1]
tactcaggtcacctcg

SEQ ID NO: 10719 - DNA, 16 bp, Artificial Sequence
  synthetic [barcode part1]
cctaagaaccacagtc

SEQ ID NO: 10720 - DNA, 16 bp, Artificial Sequence
  synthetic [barcode part1]
gcacgcgtataacact

SEQ ID NO: 10721 - DNA, 16 bp, Artificial Sequence
  synthetic [barcode part1]
ccgaattgtcactgag

SEQ ID NO: 10722 - DNA, 16 bp, Artificial Sequence
  synthetic [barcode part1]
cctgatcttctccaac

SEQ ID NO: 10723 - DNA, 16 bp, Artificial Sequence
  synthetic [barcode part1]
cgtatcaataccggtg

SEQ ID NO: 10724 - DNA, 16 bp, Artificial Sequence
  synthetic [barcode part1]
cgtaggttgccgttct

SEQ ID NO: 10725 - DNA, 16 bp, Artificial Sequence
  synthetic [barcode part1]
tagagtcctgattggc

SEQ ID NO: 10726 - DNA, 16 bp, Artificial Sequence
  synthetic [barcode part1]
tacgtgaattctccac

SEQ ID NO: 10727 - DNA, 16 bp, Artificial Sequence
  synthetic [barcode part1]
tccaacttgcggtcgt

SEQ ID NO: 10728 - DNA, 16 bp, Artificial Sequence
  synthetic [barcode part1]
tcgaacaagatccacc

SEQ ID NO: 10729 - DNA, 16 bp, Artificial Sequence
  synthetic [barcode part1]
ttgattcgcctgaatc

SEQ ID NO: 10730 - DNA, 16 bp, Artificial Sequence
  synthetic [barcode part1]
ttggaataggcgaact

SEQ ID NO: 10731 - DNA, 16 bp, Artificial Sequence
  synthetic [barcode part1]
tccagaacacagtgtc

SEQ ID NO: 10732 - DNA, 16 bp, Artificial Sequence
  synthetic [barcode part1]
tatcaagagtgcgagt

SEQ ID NO: 10733 - DNA, 16 bp, Artificial Sequence
  synthetic [barcode part1]
acgaacggaacaagtg

SEQ ID NO: 10734 - DNA, 16 bp, Artificial Sequence
  synthetic [barcode part1]
cgtctggaaggactag

SEQ ID NO: 10735 - DNA, 16 bp, Artificial Sequence
  synthetic [barcode part1]
aggactcctcactcgt

SEQ ID NO: 10736 - DNA, 16 bp, Artificial Sequence
  synthetic [barcode part1]
acactggtcaacacgt

SEQ ID NO: 10737 - DNA, 16 bp, Artificial Sequence
  synthetic [barcode part1]
gttggtgtcgttactt

SEQ ID NO: 10738 - DNA, 16 bp, Artificial Sequence
  synthetic [barcode part1]
ccactaagtattctcg

SEQ ID NO: 10739 - DNA, 16 bp, Artificial Sequence
  synthetic [barcode part1]
gtcggtggtctcttac

SEQ ID NO: 10740 - DNA, 16 bp, Artificial Sequence
  synthetic [barcode part1]
tacagacggcgagatc

SEQ ID NO: 10741 - DNA, 16 bp, Artificial Sequence
  synthetic [barcode part1]
attccgttctacgagt

SEQ ID NO: 10742 - DNA, 16 bp, Artificial Sequence
  synthetic [barcode part1]
gcggatcaagaattac

SEQ ID NO: 10743 - DNA, 16 bp, Artificial Sequence
  synthetic [barcode part1]
tgacactaccttggag

SEQ ID NO: 10744 - DNA, 16 bp, Artificial Sequence
  synthetic [barcode part1]
aagaacgaggtcgcct

SEQ ID NO: 10745 - DNA, 16 bp, Artificial Sequence
  synthetic [barcode part1]
attgtatccaggcgtg

SEQ ID NO: 10746 - DNA, 16 bp, Artificial Sequence
  synthetic [barcode part1]
gcgtagtgattgaagt

SEQ ID NO: 10747 - DNA, 16 bp, Artificial Sequence
  synthetic [barcode part1]
atccttgtcacgtcct

SEQ ID NO: 10748 - DNA, 16 bp, Artificial Sequence
  synthetic [barcode part1]
gtaccggtaattcttc

SEQ ID NO: 10749 - DNA, 16 bp, Artificial Sequence
  synthetic [barcode part1]
gagagtacttgcacct

SEQ ID NO: 10750 - DNA, 16 bp, Artificial Sequence
  synthetic [barcode part1]
gcaagtctcgagtgtt

SEQ ID NO: 10751 - DNA, 16 bp, Artificial Sequence
  synthetic [barcode part1]
gaccaccttcaacaag

SEQ ID NO: 10752 - DNA, 16 bp, Artificial Sequence
  synthetic [barcode part1]
agtgcaccgcaattgt

SEQ ID NO: 10753 - DNA, 16 bp, Artificial Sequence
  synthetic [barcode part1]
aggcaaggaacaagtc

SEQ ID NO: 10754 - DNA, 16 bp, Artificial Sequence
  synthetic [barcode part1]
caccgtctgttctgtt

SEQ ID NO: 10755 - DNA, 16 bp, Artificial Sequence
  synthetic [barcode part1]
tcctgacactgagaac

SEQ ID NO: 10756 - DNA, 16 bp, Artificial Sequence
  synthetic [barcode part1]
agtcctctataccggc

SEQ ID NO: 10757 - DNA, 16 bp, Artificial Sequence
  synthetic [barcode part1]
tgtggactcacaggtt

SEQ ID NO: 10758 - DNA, 16 bp, Artificial Sequence
  synthetic [barcode part1]
tggcgtagtcagaggt

SEQ ID NO: 10759 - DNA, 16 bp, Artificial Sequence
  synthetic [barcode part1]
cgtcctgacttgtggt

SEQ ID NO: 10760 - DNA, 16 bp, Artificial Sequence
  synthetic [barcode part1]
tgtgaacgtaggttcc

SEQ ID NO: 10761 - DNA, 16 bp, Artificial Sequence
  synthetic [barcode part1]
aactagtgccacgact

SEQ ID NO: 10762 - DNA, 16 bp, Artificial Sequence
  synthetic [barcode part1]
cactatctccgcaggt

SEQ ID NO: 10763 - DNA, 16 bp, Artificial Sequence
  synthetic [barcode part1]
gttgtctcttgccgtt

SEQ ID NO: 10764 - DNA, 16 bp, Artificial Sequence
  synthetic [barcode part1]
acgattggtcgtacac

SEQ ID NO: 10765 - DNA, 16 bp, Artificial Sequence
  synthetic [barcode part1]
acgaacctggtggagt

SEQ ID NO: 10766 - DNA, 16 bp, Artificial Sequence
  synthetic [barcode part1]
accgacacgaacttgt

SEQ ID NO: 10767 - DNA, 16 bp, Artificial Sequence
  synthetic [barcode part1]
aacctgaggagtatac

SEQ ID NO: 10768 - DNA, 16 bp, Artificial Sequence
  synthetic [barcode part1]
agtgacggttctactg

SEQ ID NO: 10769 - DNA, 16 bp, Artificial Sequence
  synthetic [barcode part1]
tgtgcaacgaagaatc

SEQ ID NO: 10770 - DNA, 16 bp, Artificial Sequence
  synthetic [barcode part1]
tcgatacgaccaggag

SEQ ID NO: 10771 - DNA, 16 bp, Artificial Sequence
  synthetic [barcode part1]
tcctggtatattcgac

SEQ ID NO: 10772 - DNA, 16 bp, Artificial Sequence
  synthetic [barcode part1]
ccacaggatagagtgc

SEQ ID NO: 10773 - DNA, 16 bp, Artificial Sequence
  synthetic [barcode part1]
caggtgcgtatctaac

SEQ ID NO: 10774 - DNA, 16 bp, Artificial Sequence
  synthetic [barcode part1]
agtgaggccaacgtac

SEQ ID NO: 10775 - DNA, 16 bp, Artificial Sequence
  synthetic [barcode part1]
acactccacacttctc

SEQ ID NO: 10776 - DNA, 16 bp, Artificial Sequence
  synthetic [barcode part1]
agagtgcgtatctctg

SEQ ID NO: 10777 - DNA, 16 bp, Artificial Sequence
  synthetic [barcode part1]
caactcactgttggag

SEQ ID NO: 10778 - DNA, 16 bp, Artificial Sequence
  synthetic [barcode part1]
cggattatcgacgatc

SEQ ID NO: 10779 - DNA, 16 bp, Artificial Sequence
  synthetic [barcode part1]
tctcgaaggtactgtg

SEQ ID NO: 10780 - DNA, 16 bp, Artificial Sequence
  synthetic [barcode part1]
tggaaccactgcagtt

SEQ ID NO: 10781 - DNA, 16 bp, Artificial Sequence
  synthetic [barcode part1]
cgtctgtgaatcttac

SEQ ID NO: 10782 - DNA, 16 bp, Artificial Sequence
  synthetic [barcode part1]
gatcgtgatacaccgt

SEQ ID NO: 10783 - DNA, 16 bp, Artificial Sequence
  synthetic [barcode part1]
ttcgtattggcgattc

SEQ ID NO: 10784 - DNA, 16 bp, Artificial Sequence
  synthetic [barcode part1]
acgttccaactcaatc

SEQ ID NO: 10785 - DNA, 16 bp, Artificial Sequence
  synthetic [barcode part1]
gtctccgcgtcaagtt

SEQ ID NO: 10786 - DNA, 16 bp, Artificial Sequence
  synthetic [barcode part1]
gtcacctagtacctgc

SEQ ID NO: 10787 - DNA, 16 bp, Artificial Sequence
  synthetic [barcode part1]
ttcgtatcgacctaac

SEQ ID NO: 10788 - DNA, 16 bp, Artificial Sequence
  synthetic [barcode part1]
tgtaagtgcgataggt

SEQ ID NO: 10789 - DNA, 16 bp, Artificial Sequence
  synthetic [barcode part1]
tagatcgaaccgttgc

SEQ ID NO: 10790 - DNA, 16 bp, Artificial Sequence
  synthetic [barcode part1]
tccgataggtgacttg

SEQ ID NO: 10791 - DNA, 16 bp, Artificial Sequence
  synthetic [barcode part1]
cgttagatccacgtcc

SEQ ID NO: 10792 - DNA, 16 bp, Artificial Sequence
  synthetic [barcode part1]
aaggaataccttccgc

SEQ ID NO: 10793 - DNA, 16 bp, Artificial Sequence
  synthetic [barcode part1]
caactctccgaagagt

SEQ ID NO: 10794 - DNA, 16 bp, Artificial Sequence
  synthetic [barcode part1]
gcagtgttgacgttgt

SEQ ID NO: 10795 - DNA, 16 bp, Artificial Sequence
  synthetic [barcode part1]
tgcgtaattcgacttc

SEQ ID NO: 10796 - DNA, 16 bp, Artificial Sequence
  synthetic [barcode part1]
ataggttatcgcctct

SEQ ID NO: 10797 - DNA, 16 bp, Artificial Sequence
  synthetic [barcode part1]
gacctaatcggcaatc

SEQ ID NO: 10798 - DNA, 16 bp, Artificial Sequence
  synthetic [barcode part1]
gcgcaactcttaattc

SEQ ID NO: 10799 - DNA, 16 bp, Artificial Sequence
  synthetic [barcode part1]
cgcgcaacaaggaatc

SEQ ID NO: 10800 - DNA, 16 bp, Artificial Sequence
  synthetic [barcode part1]
aatcgtctggagatag

SEQ ID NO: 10801 - DNA, 16 bp, Artificial Sequence
  synthetic [barcode part1]
tgtcctcaattcaacg

SEQ ID NO: 10802 - DNA, 16 bp, Artificial Sequence
  synthetic [barcode part1]
actcgaacttactacc

SEQ ID NO: 10803 - DNA, 16 bp, Artificial Sequence
  synthetic [barcode part1]
ccagtatctctctaag

SEQ ID NO: 10804 - DNA, 16 bp, Artificial Sequence
  synthetic [barcode part1]
cacagttcgactctcg

SEQ ID NO: 10805 - DNA, 16 bp, Artificial Sequence
  synthetic [barcode part1]
ccggacaagacagtac

SEQ ID NO: 10806 - DNA, 16 bp, Artificial Sequence
  synthetic [barcode part1]
taacaccggcggatag

SEQ ID NO: 10807 - DNA, 16 bp, Artificial Sequence
  synthetic [barcode part1]
cgtgaatcgagtgttc

SEQ ID NO: 10808 - DNA, 16 bp, Artificial Sequence
  synthetic [barcode part1]
aaggcgaactctactc

SEQ ID NO: 10809 - DNA, 16 bp, Artificial Sequence
  synthetic [barcode part1]
caagttatcctgcgtt

SEQ ID NO: 10810 - DNA, 16 bp, Artificial Sequence
  synthetic [barcode part1]
cactgcctatcctgtt

SEQ ID NO: 10811 - DNA, 16 bp, Artificial Sequence
  synthetic [barcode part1]
acctctgtcactaggc

SEQ ID NO: 10812 - DNA, 16 bp, Artificial Sequence
  synthetic [barcode part1]
gtgtcttgttgccggt

SEQ ID NO: 10813 - DNA, 16 bp, Artificial Sequence
  synthetic [barcode part1]
gtcgatactcacgaac

SEQ ID NO: 10814 - DNA, 16 bp, Artificial Sequence
  synthetic [barcode part1]
tatctctgtcggattg

SEQ ID NO: 10815 - DNA, 16 bp, Artificial Sequence
  synthetic [barcode part1]
tagtcctaggactggt

SEQ ID NO: 10816 - DNA, 16 bp, Artificial Sequence
  synthetic [barcode part1]
gttgtcaggagtatag

SEQ ID NO: 10817 - DNA, 16 bp, Artificial Sequence
  synthetic [barcode part1]
gttacgaccgtagtac

SEQ ID NO: 10818 - DNA, 16 bp, Artificial Sequence
  synthetic [barcode part1]
atcttcaagaccgttc

SEQ ID NO: 10819 - DNA, 16 bp, Artificial Sequence
  synthetic [barcode part1]
aacgtcacagttggtc

SEQ ID NO: 10820 - DNA, 16 bp, Artificial Sequence
  synthetic [barcode part1]
tcactacggcagagtt

SEQ ID NO: 10821 - DNA, 16 bp, Artificial Sequence
  synthetic [barcode part1]
acggagaaggatacac

SEQ ID NO: 10822 - DNA, 16 bp, Artificial Sequence
  synthetic [barcode part1]
agtcgtgaggaggtct

SEQ ID NO: 10823 - DNA, 16 bp, Artificial Sequence
  synthetic [barcode part1]
tactagaggtggcctt

SEQ ID NO: 10824 - DNA, 16 bp, Artificial Sequence
  synthetic [barcode part1]
attcactgtggtgttc

SEQ ID NO: 10825 - DNA, 16 bp, Artificial Sequence
  synthetic [barcode part1]
agtagttcggtggtct

SEQ ID NO: 10826 - DNA, 16 bp, Artificial Sequence
  synthetic [barcode part1]
ttagacgcctactatc

SEQ ID NO: 10827 - DNA, 16 bp, Artificial Sequence
  synthetic [barcode part1]
cagttgtccgtgtaag

SEQ ID NO: 10828 - DNA, 16 bp, Artificial Sequence
  synthetic [barcode part1]
ttgcagttcaggatcg

SEQ ID NO: 10829 - DNA, 16 bp, Artificial Sequence
  synthetic [barcode part1]
cgaaggttgttcctag

SEQ ID NO: 10830 - DNA, 16 bp, Artificial Sequence
  synthetic [barcode part1]
gtcacctcctagacac

SEQ ID NO: 10831 - DNA, 16 bp, Artificial Sequence
  synthetic [barcode part1]
gaataaccacgaactg

SEQ ID NO: 10832 - DNA, 16 bp, Artificial Sequence
  synthetic [barcode part1]
cgtgttcagtacgaac

SEQ ID NO: 10833 - DNA, 16 bp, Artificial Sequence
  synthetic [barcode part1]
ttcaaccgtcagtact

SEQ ID NO: 10834 - DNA, 16 bp, Artificial Sequence
  synthetic [barcode part1]
actgcggtctacttgc

SEQ ID NO: 10835 - DNA, 16 bp, Artificial Sequence
  synthetic [barcode part1]
aagtggcaatcacgcg

SEQ ID NO: 10836 - DNA, 16 bp, Artificial Sequence
  synthetic [barcode part1]
cgagacacttatagag

SEQ ID NO: 10837 - DNA, 16 bp, Artificial Sequence
  synthetic [barcode part1]
gcaccttatacctctc

SEQ ID NO: 10838 - DNA, 16 bp, Artificial Sequence
  synthetic [barcode part1]
gcacaaccacacaact

SEQ ID NO: 10839 - DNA, 16 bp, Artificial Sequence
  synthetic [barcode part1]
tctagaggtcgtgatc

SEQ ID NO: 10840 - DNA, 16 bp, Artificial Sequence
  synthetic [barcode part1]
tcgactctcactactc

SEQ ID NO: 10841 - DNA, 16 bp, Artificial Sequence
  synthetic [barcode part1]
tcacactggacacagt

SEQ ID NO: 10842 - DNA, 16 bp, Artificial Sequence
  synthetic [barcode part1]
aataccagtaccgcgt

SEQ ID NO: 10843 - DNA, 16 bp, Artificial Sequence
  synthetic [barcode part1]
acagttgtcttagtcc

SEQ ID NO: 10844 - DNA, 16 bp, Artificial Sequence
  synthetic [barcode part1]
gcctatcgtaggtaac

SEQ ID NO: 10845 - DNA, 16 bp, Artificial Sequence
  synthetic [barcode part1]
gcgcacttattggtag

SEQ ID NO: 10846 - DNA, 16 bp, Artificial Sequence
  synthetic [barcode part1]
caagtaagacgttgtg

SEQ ID NO: 10847 - DNA, 16 bp, Artificial Sequence
  synthetic [barcode part1]
acttggacgaacgttc

SEQ ID NO: 10848 - DNA, 16 bp, Artificial Sequence
  synthetic [barcode part1]
cagacgataggtgaag

SEQ ID NO: 10849 - DNA, 16 bp, Artificial Sequence
  synthetic [barcode part1]
agaagtactgtcagac

SEQ ID NO: 10850 - DNA, 16 bp, Artificial Sequence
  synthetic [barcode part1]
tctgaccacgcgttac

SEQ ID NO: 10851 - DNA, 16 bp, Artificial Sequence
  synthetic [barcode part1]
ttgttacacgagtctc

SEQ ID NO: 10852 - DNA, 16 bp, Artificial Sequence
  synthetic [barcode part1]
acagtgttcttgaggc

SEQ ID NO: 10853 - DNA, 16 bp, Artificial Sequence
  synthetic [barcode part1]
cacgagttactatcct

SEQ ID NO: 10854 - DNA, 16 bp, Artificial Sequence
  synthetic [barcode part1]
tcaaggttctaaggcc

SEQ ID NO: 10855 - DNA, 16 bp, Artificial Sequence
  synthetic [barcode part1]
gcggttgtggtatatc

SEQ ID NO: 10856 - DNA, 16 bp, Artificial Sequence
  synthetic [barcode part1]
agatcaagtcgtgtag

SEQ ID NO: 10857 - DNA, 16 bp, Artificial Sequence
  synthetic [barcode part1]
ttcaggacaataccgc

SEQ ID NO: 10858 - DNA, 16 bp, Artificial Sequence
  synthetic [barcode part1]
aacttaaccggatcgc

SEQ ID NO: 10859 - DNA, 16 bp, Artificial Sequence
  synthetic [barcode part1]
actcaggactctatct

SEQ ID NO: 10860 - DNA, 16 bp, Artificial Sequence
  synthetic [barcode part1]
tgttcgaagtctgcag

SEQ ID NO: 10861 - DNA, 16 bp, Artificial Sequence
  synthetic [barcode part1]
gactcgacctcgtgtt

SEQ ID NO: 10862 - DNA, 16 bp, Artificial Sequence
  synthetic [barcode part1]
actaggtgtgatccac

SEQ ID NO: 10863 - DNA, 16 bp, Artificial Sequence
  synthetic [barcode part1]
ccgttcggtaagtagt

SEQ ID NO: 10864 - DNA, 16 bp, Artificial Sequence
  synthetic [barcode part1]
cacggtcactatctcg

SEQ ID NO: 10865 - DNA, 16 bp, Artificial Sequence
  synthetic [barcode part1]
atcacagtaggcggac

SEQ ID NO: 10866 - DNA, 16 bp, Artificial Sequence
  synthetic [barcode part1]
atcctgacagtcaacg

SEQ ID NO: 10867 - DNA, 16 bp, Artificial Sequence
  synthetic [barcode part1]
ttgccgttacttagac

SEQ ID NO: 10868 - DNA, 16 bp, Artificial Sequence
  synthetic [barcode part1]
gcgtggttaatacgtc

SEQ ID NO: 10869 - DNA, 16 bp, Artificial Sequence
  synthetic [barcode part1]
acgcgtctactaacag

SEQ ID NO: 10870 - DNA, 16 bp, Artificial Sequence
  synthetic [barcode part1]
actgcctaatatccac

SEQ ID NO: 10871 - DNA, 16 bp, Artificial Sequence
  synthetic [barcode part1]
cggaggaactagtatt

SEQ ID NO: 10872 - DNA, 16 bp, Artificial Sequence
  synthetic [barcode part1]
cgagatcaccacaact

SEQ ID NO: 10873 - DNA, 16 bp, Artificial Sequence
  synthetic [barcode part1]
aatcgtatcgacctct

SEQ ID NO: 10874 - DNA, 16 bp, Artificial Sequence
  synthetic [barcode part1]
ccaacgagtagagatt

SEQ ID NO: 10875 - DNA, 16 bp, Artificial Sequence
  synthetic [barcode part1]
cagactagtcgaactc

SEQ ID NO: 10876 - DNA, 16 bp, Artificial Sequence
  synthetic [barcode part1]
acagatcttaacgcgc

SEQ ID NO: 10877 - DNA, 16 bp, Artificial Sequence
  synthetic [barcode part1]
gacctattggacgttg

SEQ ID NO: 10878 - DNA, 16 bp, Artificial Sequence
  synthetic [barcode part1]
atcctcggtgagaatc

SEQ ID NO: 10879 - DNA, 16 bp, Artificial Sequence
  synthetic [barcode part1]
accgttcgcagattcc

SEQ ID NO: 10880 - DNA, 16 bp, Artificial Sequence
  synthetic [barcode part1]
attgtctctgtaggtc

SEQ ID NO: 10881 - DNA, 16 bp, Artificial Sequence
  synthetic [barcode part1]
gattgaacactccacg

SEQ ID NO: 10882 - DNA, 16 bp, Artificial Sequence
  synthetic [barcode part1]
ttgagtggacaggacc

SEQ ID NO: 10883 - DNA, 16 bp, Artificial Sequence
  synthetic [barcode part1]
tggccacaacggtaag

SEQ ID NO: 10884 - DNA, 16 bp, Artificial Sequence
  synthetic [barcode part1]
cactccacgttattcc

SEQ ID NO: 10885 - DNA, 16 bp, Artificial Sequence
  synthetic [barcode part1]
agtgcgaacctgacag

SEQ ID NO: 10886 - DNA, 16 bp, Artificial Sequence
  synthetic [barcode part1]
agtgaagtggcagagt

SEQ ID NO: 10887 - DNA, 16 bp, Artificial Sequence
  synthetic [barcode part1]
cagtgacttctacgtt

SEQ ID NO: 10888 - DNA, 16 bp, Artificial Sequence
  synthetic [barcode part1]
cgataggacgaacctg

SEQ ID NO: 10889 - DNA, 16 bp, Artificial Sequence
  synthetic [barcode part1]
cacaacttcctgttag

SEQ ID NO: 10890 - DNA, 16 bp, Artificial Sequence
  synthetic [barcode part1]
cagttcctcctaatcc

SEQ ID NO: 10891 - DNA, 16 bp, Artificial Sequence
  synthetic [barcode part1]
tatactctagactgcc

SEQ ID NO: 10892 - DNA, 16 bp, Artificial Sequence
  synthetic [barcode part1]
ccggtaagtctagtgt

SEQ ID NO: 10893 - DNA, 16 bp, Artificial Sequence
  synthetic [barcode part1]
gaataagtcgtccgtc

SEQ ID NO: 10894 - DNA, 16 bp, Artificial Sequence
  synthetic [barcode part1]
cgtaagtcggatactc

SEQ ID NO: 10895 - DNA, 16 bp, Artificial Sequence
  synthetic [barcode part1]
aagttatcggaccacc

SEQ ID NO: 10896 - DNA, 16 bp, Artificial Sequence
  synthetic [barcode part1]
tcgtatcgagttgtct

SEQ ID NO: 10897 - DNA, 16 bp, Artificial Sequence
  synthetic [barcode part1]
acaggaaccttgcact

SEQ ID NO: 10898 - DNA, 16 bp, Artificial Sequence
  synthetic [barcode part1]
acgatctatctctgtg

SEQ ID NO: 10899 - DNA, 16 bp, Artificial Sequence
  synthetic [barcode part1]
cagaccacctcgtgtt

SEQ ID NO: 10900 - DNA, 16 bp, Artificial Sequence
  synthetic [barcode part1]
cgtgattactattccg

SEQ ID NO: 10901 - DNA, 16 bp, Artificial Sequence
  synthetic [barcode part1]
tacggtgtcgtccgtt

SEQ ID NO: 10902 - DNA, 16 bp, Artificial Sequence
  synthetic [barcode part1]
cagtgagacttcgttg

SEQ ID NO: 10903 - DNA, 16 bp, Artificial Sequence
  synthetic [barcode part1]
tgttcgcgtgacgttc

SEQ ID NO: 10904 - DNA, 16 bp, Artificial Sequence
  synthetic [barcode part1]
cacaccgtgtataacg

SEQ ID NO: 10905 - DNA, 16 bp, Artificial Sequence
  synthetic [barcode part1]
agaggtcgattggaag

SEQ ID NO: 10906 - DNA, 16 bp, Artificial Sequence
  synthetic [barcode part1]
ttcacgaagacaacag

SEQ ID NO: 10907 - DNA, 16 bp, Artificial Sequence
  synthetic [barcode part1]
tgttgtgacacgtacg

SEQ ID NO: 10908 - DNA, 16 bp, Artificial Sequence
  synthetic [barcode part1]
tacgcggccactattc

SEQ ID NO: 10909 - DNA, 16 bp, Artificial Sequence
  synthetic [barcode part1]
cgaatacttccgttac

SEQ ID NO: 10910 - DNA, 16 bp, Artificial Sequence
  synthetic [barcode part1]
agtattgccgaggtct

SEQ ID NO: 10911 - DNA, 16 bp, Artificial Sequence
  synthetic [barcode part1]
tctgccacaataaggc

SEQ ID NO: 10912 - DNA, 16 bp, Artificial Sequence
  synthetic [barcode part1]
tcaagaaggagtgacg

SEQ ID NO: 10913 - DNA, 16 bp, Artificial Sequence
  synthetic [barcode part1]
cgcgaaccttatcacc

SEQ ID NO: 10914 - DNA, 16 bp, Artificial Sequence
  synthetic [barcode part1]
acaacactggtgttgc

SEQ ID NO: 10915 - DNA, 16 bp, Artificial Sequence
  synthetic [barcode part1]
ttcgcgccgatctagt

SEQ ID NO: 10916 - DNA, 16 bp, Artificial Sequence
  synthetic [barcode part1]
agaggacgttcgaacc

SEQ ID NO: 10917 - DNA, 16 bp, Artificial Sequence
  synthetic [barcode part1]
tcgttagtccttgtag

SEQ ID NO: 10918 - DNA, 16 bp, Artificial Sequence
  synthetic [barcode part1]
cctctgtgaattactg

SEQ ID NO: 10919 - DNA, 16 bp, Artificial Sequence
  synthetic [barcode part1]
atagtcacgcgcaact

SEQ ID NO: 10920 - DNA, 16 bp, Artificial Sequence
  synthetic [barcode part1]
tcaagtctgcactccg

SEQ ID NO: 10921 - DNA, 16 bp, Artificial Sequence
  synthetic [barcode part1]
aactctccacgaactt

SEQ ID NO: 10922 - DNA, 16 bp, Artificial Sequence
  synthetic [barcode part1]
cgagtgcaaggtgatc

SEQ ID NO: 10923 - DNA, 16 bp, Artificial Sequence
  synthetic [barcode part1]
gtataatctccagtcc

SEQ ID NO: 10924 - DNA, 16 bp, Artificial Sequence
  synthetic [barcode part1]
tagtacgcaacaagac

SEQ ID NO: 10925 - DNA, 16 bp, Artificial Sequence
  synthetic [barcode part1]
ataagacgacacctag

SEQ ID NO: 10926 - DNA, 16 bp, Artificial Sequence
  synthetic [barcode part1]
taacggtaatcaccgc

SEQ ID NO: 10927 - DNA, 16 bp, Artificial Sequence
  synthetic [barcode part1]
agacgtcaggtctact

SEQ ID NO: 10928 - DNA, 16 bp, Artificial Sequence
  synthetic [barcode part1]
ttcttactgcctccag

SEQ ID NO: 10929 - DNA, 16 bp, Artificial Sequence
  synthetic [barcode part1]
gataccgttagtcggt

SEQ ID NO: 10930 - DNA, 16 bp, Artificial Sequence
  synthetic [barcode part1]
atcttactggatccac

SEQ ID NO: 10931 - DNA, 16 bp, Artificial Sequence
  synthetic [barcode part1]
tgtggccttctaccag

SEQ ID NO: 10932 - DNA, 16 bp, Artificial Sequence
  synthetic [barcode part1]
tggtacttaggtgaag

SEQ ID NO: 10933 - DNA, 16 bp, Artificial Sequence
  synthetic [barcode part1]
tgccgaagagttgtct

SEQ ID NO: 10934 - DNA, 16 bp, Artificial Sequence
  synthetic [barcode part1]
ttacaccggtacaggt

SEQ ID NO: 10935 - DNA, 16 bp, Artificial Sequence
  synthetic [barcode part1]
atacgcgcagtgttgt

SEQ ID NO: 10936 - DNA, 16 bp, Artificial Sequence
  synthetic [barcode part1]
actaacaccgccgtct

SEQ ID NO: 10937 - DNA, 16 bp, Artificial Sequence
  synthetic [barcode part1]
cctaaggtgatcggtt

SEQ ID NO: 10938 - DNA, 16 bp, Artificial Sequence
  synthetic [barcode part1]
ttgatctagtgcgttc

SEQ ID NO: 10939 - DNA, 16 bp, Artificial Sequence
  synthetic [barcode part1]
ttaacctcactccacc

SEQ ID NO: 10940 - DNA, 16 bp, Artificial Sequence
  synthetic [barcode part1]
aagacggagtactcgc

SEQ ID NO: 10941 - DNA, 16 bp, Artificial Sequence
  synthetic [barcode part1]
tccaacacggaggtag

SEQ ID NO: 10942 - DNA, 16 bp, Artificial Sequence
  synthetic [barcode part1]
ttgtgacgtaccacag

SEQ ID NO: 10943 - DNA, 16 bp, Artificial Sequence
  synthetic [barcode part1]
tcctataggagacgtc

SEQ ID NO: 10944 - DNA, 16 bp, Artificial Sequence
  synthetic [barcode part1]
aactgacaccacagtc

SEQ ID NO: 10945 - DNA, 16 bp, Artificial Sequence
  synthetic [barcode part1]
cacacttgagtcactt

SEQ ID NO: 10946 - DNA, 16 bp, Artificial Sequence
  synthetic [barcode part1]
tgtcgattgaccgtag

SEQ ID NO: 10947 - DNA, 16 bp, Artificial Sequence
  synthetic [barcode part1]
tcctgcgaacttgatt

SEQ ID NO: 10948 - DNA, 16 bp, Artificial Sequence
  synthetic [barcode part1]
agtctagttggactgc

SEQ ID NO: 10949 - DNA, 16 bp, Artificial Sequence
  synthetic [barcode part1]
gttcactcttgcctgt

SEQ ID NO: 10950 - DNA, 16 bp, Artificial Sequence
  synthetic [barcode part1]
tggtactaacgtcacg

SEQ ID NO: 10951 - DNA, 16 bp, Artificial Sequence
  synthetic [barcode part1]
cacggattccgtcact

SEQ ID NO: 10952 - DNA, 16 bp, Artificial Sequence
  synthetic [barcode part1]
tcgtaacgaaggagag

SEQ ID NO: 10953 - DNA, 16 bp, Artificial Sequence
  synthetic [barcode part1]
ccgtacgtcgattctg

SEQ ID NO: 10954 - DNA, 16 bp, Artificial Sequence
  synthetic [barcode part1]
tgttgccgtccgaatc

SEQ ID NO: 10955 - DNA, 16 bp, Artificial Sequence
  synthetic [barcode part1]
ttctgaccgtagactt

SEQ ID NO: 10956 - DNA, 16 bp, Artificial Sequence
  synthetic [barcode part1]
agttcctcttcgtcgt

SEQ ID NO: 10957 - DNA, 16 bp, Artificial Sequence
  synthetic [barcode part1]
ttgcctccgtagactg

SEQ ID NO: 10958 - DNA, 16 bp, Artificial Sequence
  synthetic [barcode part1]
tagtgcaactggaggc

SEQ ID NO: 10959 - DNA, 16 bp, Artificial Sequence
  synthetic [barcode part1]
cctactacgaccttct

SEQ ID NO: 10960 - DNA, 16 bp, Artificial Sequence
  synthetic [barcode part1]
aataatctcctgcgtc

SEQ ID NO: 10961 - DNA, 16 bp, Artificial Sequence
  synthetic [barcode part1]
taggaggtggtcacac

SEQ ID NO: 10962 - DNA, 16 bp, Artificial Sequence
  synthetic [barcode part1]
gttcgaagtgacaggc

SEQ ID NO: 10963 - DNA, 16 bp, Artificial Sequence
  synthetic [barcode part1]
tgtacacgtgtgtgtg

SEQ ID NO: 10964 - DNA, 16 bp, Artificial Sequence
  synthetic [barcode part1]
tctaacttagttgcgc

SEQ ID NO: 10965 - DNA, 16 bp, Artificial Sequence
  synthetic [barcode part1]
attcgagacggatctc

SEQ ID NO: 10966 - DNA, 16 bp, Artificial Sequence
  synthetic [barcode part1]
tctcgcaagagtacac

SEQ ID NO: 10967 - DNA, 16 bp, Artificial Sequence
  synthetic [barcode part1]
tccaaggtctcagagt

SEQ ID NO: 10968 - DNA, 16 bp, Artificial Sequence
  synthetic [barcode part1]
gagatctacgaacaac

SEQ ID NO: 10969 - DNA, 16 bp, Artificial Sequence
  synthetic [barcode part1]
tggccttaactgagac

SEQ ID NO: 10970 - DNA, 16 bp, Artificial Sequence
  synthetic [barcode part1]
gttacgacctggaatc

SEQ ID NO: 10971 - DNA, 16 bp, Artificial Sequence
  synthetic [barcode part1]
tccaccgattgttcct

SEQ ID NO: 10972 - DNA, 16 bp, Artificial Sequence
  synthetic [barcode part1]
acgtacgttggtcagt

SEQ ID NO: 10973 - DNA, 16 bp, Artificial Sequence
  synthetic [barcode part1]
ccaagtacactatctc

SEQ ID NO: 10974 - DNA, 16 bp, Artificial Sequence
  synthetic [barcode part1]
cgtgttctgaatcgcc

SEQ ID NO: 10975 - DNA, 16 bp, Artificial Sequence
  synthetic [barcode part1]
gtggtagacagttgcg

SEQ ID NO: 10976 - DNA, 16 bp, Artificial Sequence
  synthetic [barcode part1]
cactcctcgacgattg

SEQ ID NO: 10977 - DNA, 16 bp, Artificial Sequence
  synthetic [barcode part1]
acaagttcgtgtcggt

SEQ ID NO: 10978 - DNA, 16 bp, Artificial Sequence
  synthetic [barcode part1]
aacaccttagagagtg

SEQ ID NO: 10979 - DNA, 16 bp, Artificial Sequence
  synthetic [barcode part1]
gaagttacggtggaag

SEQ ID NO: 10980 - DNA, 16 bp, Artificial Sequence
  synthetic [barcode part1]
agttacaccagaaggt

SEQ ID NO: 10981 - DNA, 16 bp, Artificial Sequence
  synthetic [barcode part1]
ttctgttgagttcgtg

SEQ ID NO: 10982 - DNA, 16 bp, Artificial Sequence
  synthetic [barcode part1]
taggtctagatctgcg

SEQ ID NO: 10983 - DNA, 16 bp, Artificial Sequence
  synthetic [barcode part1]
tcctaatctaggtacc

SEQ ID NO: 10984 - DNA, 16 bp, Artificial Sequence
  synthetic [barcode part1]
acgactggttgtacgt

SEQ ID NO: 10985 - DNA, 16 bp, Artificial Sequence
  synthetic [barcode part1]
ccttctccacgatact

SEQ ID NO: 10986 - DNA, 16 bp, Artificial Sequence
  synthetic [barcode part1]
tgtgatcgttgtcttg

SEQ ID NO: 10987 - DNA, 16 bp, Artificial Sequence
  synthetic [barcode part1]
taggaggtgtgtggtc

SEQ ID NO: 10988 - DNA, 16 bp, Artificial Sequence
  synthetic [barcode part1]
agtatagtgtcgaacg

SEQ ID NO: 10989 - DNA, 16 bp, Artificial Sequence
  synthetic [barcode part1]
ccacgagtattctgcc

SEQ ID NO: 10990 - DNA, 16 bp, Artificial Sequence
  synthetic [barcode part1]
gactaactggcactac

SEQ ID NO: 10991 - DNA, 16 bp, Artificial Sequence
  synthetic [barcode part1]
ttgttcaagtgtcgtc

SEQ ID NO: 10992 - DNA, 16 bp, Artificial Sequence
  synthetic [barcode part1]
cgcacttaatagtctc

SEQ ID NO: 10993 - DNA, 16 bp, Artificial Sequence
  synthetic [barcode part1]
gtcacctgttcgcaac

SEQ ID NO: 10994 - DNA, 16 bp, Artificial Sequence
  synthetic [barcode part1]
gcggatatcacttgtg

SEQ ID NO: 10995 - DNA, 16 bp, Artificial Sequence
  synthetic [barcode part1]
atcagaccgaagacgc

SEQ ID NO: 10996 - DNA, 16 bp, Artificial Sequence
  synthetic [barcode part1]
acagtgcaaggtctct

SEQ ID NO: 10997 - DNA, 16 bp, Artificial Sequence
  synthetic [barcode part1]
tgattcgtagagacag

SEQ ID NO: 10998 - DNA, 16 bp, Artificial Sequence
  synthetic [barcode part1]
cgtagagataccttcg

SEQ ID NO: 10999 - DNA, 16 bp, Artificial Sequence
  synthetic [barcode part1]
ataggcgcaagtgaag

SEQ ID NO: 11000 - DNA, 16 bp, Artificial Sequence
  synthetic [barcode part1]
gatcgccttatatctg

SEQ ID NO: 11001 - DNA, 16 bp, Artificial Sequence
  synthetic [barcode part1]
gaagattgcgtatcag

SEQ ID NO: 11002 - DNA, 16 bp, Artificial Sequence
  synthetic [barcode part1]
tcctgtgattatcgac

SEQ ID NO: 11003 - DNA, 16 bp, Artificial Sequence
  synthetic [barcode part1]
cacctattctaggact

SEQ ID NO: 11004 - DNA, 16 bp, Artificial Sequence
  synthetic [barcode part1]
tgcgttctgaattgtc

SEQ ID NO: 11005 - DNA, 16 bp, Artificial Sequence
  synthetic [barcode part1]
cgttacaatacgcgtg

SEQ ID NO: 11006 - DNA, 16 bp, Artificial Sequence
  synthetic [barcode part1]
tgtgttcgtaatccgt

SEQ ID NO: 11007 - DNA, 16 bp, Artificial Sequence
  synthetic [barcode part1]
gagatccggcactatt

SEQ ID NO: 11008 - DNA, 16 bp, Artificial Sequence
  synthetic [barcode part1]
agaagtgccacactct

SEQ ID NO: 11009 - DNA, 16 bp, Artificial Sequence
  synthetic [barcode part1]
taggtacagtcgtacc

SEQ ID NO: 11010 - DNA, 16 bp, Artificial Sequence
  synthetic [barcode part1]
ttattgaccttcgcag

SEQ ID NO: 11011 - DNA, 16 bp, Artificial Sequence
  synthetic [barcode part1]
tcaactcggcacacct

SEQ ID NO: 11012 - DNA, 16 bp, Artificial Sequence
  synthetic [barcode part1]
acaagtccgtagactc

SEQ ID NO: 11013 - DNA, 16 bp, Artificial Sequence
  synthetic [barcode part1]
tgcgaccgagatagtg

SEQ ID NO: 11014 - DNA, 16 bp, Artificial Sequence
  synthetic [barcode part1]
acgagactactgttcg

SEQ ID NO: 11015 - DNA, 16 bp, Artificial Sequence
  synthetic [barcode part1]
aggattccgaagttcc

SEQ ID NO: 11016 - DNA, 16 bp, Artificial Sequence
  synthetic [barcode part1]
gatctaacggtggtct

SEQ ID NO: 11017 - DNA, 16 bp, Artificial Sequence
  synthetic [barcode part1]
gactataggttctcct

SEQ ID NO: 11018 - DNA, 16 bp, Artificial Sequence
  synthetic [barcode part1]
tgcagtactcagagtc

SEQ ID NO: 11019 - DNA, 16 bp, Artificial Sequence
  synthetic [barcode part1]
attacagagtggacgt

SEQ ID NO: 11020 - DNA, 16 bp, Artificial Sequence
  synthetic [barcode part1]
cactcgcagacagatt

SEQ ID NO: 11021 - DNA, 16 bp, Artificial Sequence
  synthetic [barcode part1]
tctctcctgcaacgtt

SEQ ID NO: 11022 - DNA, 16 bp, Artificial Sequence
  synthetic [barcode part1]
ccgattcacttcctac

SEQ ID NO: 11023 - DNA, 16 bp, Artificial Sequence
  synthetic [barcode part1]
aggatcctgtctgcct

SEQ ID NO: 11024 - DNA, 16 bp, Artificial Sequence
  synthetic [barcode part1]
tattacctgtcggtac

SEQ ID NO: 11025 - DNA, 16 bp, Artificial Sequence
  synthetic [barcode part1]
tcttgatcgacaaggc

SEQ ID NO: 11026 - DNA, 16 bp, Artificial Sequence
  synthetic [barcode part1]
tagacacgcgcaattc

SEQ ID NO: 11027 - DNA, 16 bp, Artificial Sequence
  synthetic [barcode part1]
gaacacgcgactcaag

SEQ ID NO: 11028 - DNA, 16 bp, Artificial Sequence
  synthetic [barcode part1]
tccgaatcctaattcg

SEQ ID NO: 11029 - DNA, 16 bp, Artificial Sequence
  synthetic [barcode part1]
ccagttagattgaccg

SEQ ID NO: 11030 - DNA, 16 bp, Artificial Sequence
  synthetic [barcode part1]
tgtagacggtacctac

SEQ ID NO: 11031 - DNA, 16 bp, Artificial Sequence
  synthetic [barcode part1]
aatcaaccacacgcgt

SEQ ID NO: 11032 - DNA, 16 bp, Artificial Sequence
  synthetic [barcode part1]
gtgcacgcaatatcac

SEQ ID NO: 11033 - DNA, 16 bp, Artificial Sequence
  synthetic [barcode part1]
tatctctcgcaggaag

SEQ ID NO: 11034 - DNA, 16 bp, Artificial Sequence
  synthetic [barcode part1]
tccagtccgattatac

SEQ ID NO: 11035 - DNA, 16 bp, Artificial Sequence
  synthetic [barcode part1]
ttcctggatactggcc

SEQ ID NO: 11036 - DNA, 16 bp, Artificial Sequence
  synthetic [barcode part1]
atcaagtgcgaagact

SEQ ID NO: 11037 - DNA, 16 bp, Artificial Sequence
  synthetic [barcode part1]
acttccgcaagttgcc

SEQ ID NO: 11038 - DNA, 16 bp, Artificial Sequence
  synthetic [barcode part1]
tgtgtgtctgaccaag

SEQ ID NO: 11039 - DNA, 16 bp, Artificial Sequence
  synthetic [barcode part1]
atccactcctaagact

SEQ ID NO: 11040 - DNA, 16 bp, Artificial Sequence
  synthetic [barcode part1]
tgcagttcgacttccg

SEQ ID NO: 11041 - DNA, 16 bp, Artificial Sequence
  synthetic [barcode part1]
tggaacgtactggcag

SEQ ID NO: 11042 - DNA, 16 bp, Artificial Sequence
  synthetic [barcode part1]
cagtatattctgccgt

SEQ ID NO: 11043 - DNA, 16 bp, Artificial Sequence
  synthetic [barcode part1]
gtcgtaacactcgtcc

SEQ ID NO: 11044 - DNA, 16 bp, Artificial Sequence
  synthetic [barcode part1]
agtaggagaccgtatt

SEQ ID NO: 11045 - DNA, 16 bp, Artificial Sequence
  synthetic [barcode part1]
ccgaacgtctaagtac

SEQ ID NO: 11046 - DNA, 16 bp, Artificial Sequence
  synthetic [barcode part1]
ccgtgcctatcagatc

SEQ ID NO: 11047 - DNA, 16 bp, Artificial Sequence
  synthetic [barcode part1]
ttcaggtctcgactcg

SEQ ID NO: 11048 - DNA, 16 bp, Artificial Sequence
  synthetic [barcode part1]
caagatccgtaacgtc

SEQ ID NO: 11049 - DNA, 16 bp, Artificial Sequence
  synthetic [barcode part1]
gaaggatctcgatcct

SEQ ID NO: 11050 - DNA, 16 bp, Artificial Sequence
  synthetic [barcode part1]
cagatactgcgagttc

SEQ ID NO: 11051 - DNA, 16 bp, Artificial Sequence
  synthetic [barcode part1]
tcagtagtacttccac

SEQ ID NO: 11052 - DNA, 16 bp, Artificial Sequence
  synthetic [barcode part1]
ttgcctggtgaacaac

SEQ ID NO: 11053 - DNA, 16 bp, Artificial Sequence
  synthetic [barcode part1]
ccagatagtggtaggc

SEQ ID NO: 11054 - DNA, 16 bp, Artificial Sequence
  synthetic [barcode part1]
gtgtacaggtcagttc

SEQ ID NO: 11055 - DNA, 16 bp, Artificial Sequence
  synthetic [barcode part1]
cgtgcggacttcttgt

SEQ ID NO: 11056 - DNA, 16 bp, Artificial Sequence
  synthetic [barcode part1]
acgtacaggaacttcc

SEQ ID NO: 11057 - DNA, 16 bp, Artificial Sequence
  synthetic [barcode part1]
attccgtaacgcgcct

SEQ ID NO: 11058 - DNA, 16 bp, Artificial Sequence
  synthetic [barcode part1]
tgatcgaggttctgac

SEQ ID NO: 11059 - DNA, 16 bp, Artificial Sequence
  synthetic [barcode part1]
gacacgaacttgatag

SEQ ID NO: 11060 - DNA, 16 bp, Artificial Sequence
  synthetic [barcode part1]
taacctgtcgcacctg

SEQ ID NO: 11061 - DNA, 16 bp, Artificial Sequence
  synthetic [barcode part1]
tccgtgtaattcggcc

SEQ ID NO: 11062 - DNA, 16 bp, Artificial Sequence
  synthetic [barcode part1]
aaggcgtctaatagtg

SEQ ID NO: 11063 - DNA, 16 bp, Artificial Sequence
  synthetic [barcode part1]
taacgtgcaattctcc

SEQ ID NO: 11064 - DNA, 16 bp, Artificial Sequence
  synthetic [barcode part1]
tagaattcgcgtgtgc

SEQ ID NO: 11065 - DNA, 16 bp, Artificial Sequence
  synthetic [barcode part1]
tgttatctaggaggcc

SEQ ID NO: 11066 - DNA, 16 bp, Artificial Sequence
  synthetic [barcode part1]
taacctgttaccggag

SEQ ID NO: 11067 - DNA, 16 bp, Artificial Sequence
  synthetic [barcode part1]
tgtgtgaaggtgtctc

SEQ ID NO: 11068 - DNA, 16 bp, Artificial Sequence
  synthetic [barcode part1]
accaggagagaagttg

SEQ ID NO: 11069 - DNA, 16 bp, Artificial Sequence
  synthetic [barcode part1]
aagacttgacagacgt

SEQ ID NO: 11070 - DNA, 16 bp, Artificial Sequence
  synthetic [barcode part1]
aagttaccagagacgt

SEQ ID NO: 11071 - DNA, 16 bp, Artificial Sequence
  synthetic [barcode part1]
gagttctcctctcttg

SEQ ID NO: 11072 - DNA, 16 bp, Artificial Sequence
  synthetic [barcode part1]
gtgtataccggttggt

SEQ ID NO: 11073 - DNA, 16 bp, Artificial Sequence
  synthetic [barcode part1]
aagaggtctatcgcct

SEQ ID NO: 11074 - DNA, 16 bp, Artificial Sequence
  synthetic [barcode part1]
aatccttgtcgtcctc

SEQ ID NO: 11075 - DNA, 16 bp, Artificial Sequence
  synthetic [barcode part1]
taccagagacagttcc

SEQ ID NO: 11076 - DNA, 16 bp, Artificial Sequence
  synthetic [barcode part1]
gtgtagttagtgcacc

SEQ ID NO: 11077 - DNA, 16 bp, Artificial Sequence
  synthetic [barcode part1]
gaattgcaagtcgtcc

SEQ ID NO: 11078 - DNA, 16 bp, Artificial Sequence
  synthetic [barcode part1]
ccgtatacctcaattg

SEQ ID NO: 11079 - DNA, 16 bp, Artificial Sequence
  synthetic [barcode part1]
gcacaaccaacgtact

SEQ ID NO: 11080 - DNA, 16 bp, Artificial Sequence
  synthetic [barcode part1]
ccagagtcaaggtctt

SEQ ID NO: 11081 - DNA, 16 bp, Artificial Sequence
  synthetic [barcode part1]
acaacctctcacaccg

SEQ ID NO: 11082 - DNA, 16 bp, Artificial Sequence
  synthetic [barcode part1]
taactcctgtggttgt

SEQ ID NO: 11083 - DNA, 16 bp, Artificial Sequence
  synthetic [barcode part1]
tctggaatcggaatcc

SEQ ID NO: 11084 - DNA, 16 bp, Artificial Sequence
  synthetic [barcode part1]
tcgcaccacttctgtt

SEQ ID NO: 11085 - DNA, 16 bp, Artificial Sequence
  synthetic [barcode part1]
agtcgtgtgtaaccgt

SEQ ID NO: 11086 - DNA, 16 bp, Artificial Sequence
  synthetic [barcode part1]
tcgcgtgagagttgag

SEQ ID NO: 11087 - DNA, 16 bp, Artificial Sequence
  synthetic [barcode part1]
cgttctacttaggtgt

SEQ ID NO: 11088 - DNA, 16 bp, Artificial Sequence
  synthetic [barcode part1]
atccaggtaagtgcct

SEQ ID NO: 11089 - DNA, 16 bp, Artificial Sequence
  synthetic [barcode part1]
tgtcttgtaaggcggt

SEQ ID NO: 11090 - DNA, 16 bp, Artificial Sequence
  synthetic [barcode part1]
tgtcacacacagtgtg

SEQ ID NO: 11091 - DNA, 16 bp, Artificial Sequence
  synthetic [barcode part1]
ccgatagtaccgagtt

SEQ ID NO: 11092 - DNA, 16 bp, Artificial Sequence
  synthetic [barcode part1]
acttgttggcggatac

SEQ ID NO: 11093 - DNA, 16 bp, Artificial Sequence
  synthetic [barcode part1]
atcgagtaacgcaggc

SEQ ID NO: 11094 - DNA, 16 bp, Artificial Sequence
  synthetic [barcode part1]
aaggcctcagacaggt

SEQ ID NO: 11095 - DNA, 16 bp, Artificial Sequence
  synthetic [barcode part1]
cgaggagatcggtgtt

SEQ ID NO: 11096 - DNA, 16 bp, Artificial Sequence
  synthetic [barcode part1]
acctcaatcaagaccg

SEQ ID NO: 11097 - DNA, 16 bp, Artificial Sequence
  synthetic [barcode part1]
tatcactgtctaggtc

SEQ ID NO: 11098 - DNA, 16 bp, Artificial Sequence
  synthetic [barcode part1]
aattgcgtctcgattc

SEQ ID NO: 11099 - DNA, 16 bp, Artificial Sequence
  synthetic [barcode part1]
gagtagaagatcctgt

SEQ ID NO: 11100 - DNA, 16 bp, Artificial Sequence
  synthetic [barcode part1]
gacacgatatcggacg

SEQ ID NO: 11101 - DNA, 16 bp, Artificial Sequence
  synthetic [barcode part1]
taatcggtaacgtcgc

SEQ ID NO: 11102 - DNA, 16 bp, Artificial Sequence
  synthetic [barcode part1]
agtgttctcgtcaccg

SEQ ID NO: 11103 - DNA, 16 bp, Artificial Sequence
  synthetic [barcode part1]
taacgtcaggtcctag

SEQ ID NO: 11104 - DNA, 16 bp, Artificial Sequence
  synthetic [barcode part1]
tcaacggcgttgaact

SEQ ID NO: 11105 - DNA, 16 bp, Artificial Sequence
  synthetic [barcode part1]
gagacctataggcggt

SEQ ID NO: 11106 - DNA, 16 bp, Artificial Sequence
  synthetic [barcode part1]
cacaactactaggaag

SEQ ID NO: 11107 - DNA, 16 bp, Artificial Sequence
  synthetic [barcode part1]
taccttgagtactcgt

SEQ ID NO: 11108 - DNA, 16 bp, Artificial Sequence
  synthetic [barcode part1]
tgtcacagatctcgag

SEQ ID NO: 11109 - DNA, 16 bp, Artificial Sequence
  synthetic [barcode part1]
tatcactacggttacc

SEQ ID NO: 11110 - DNA, 16 bp, Artificial Sequence
  synthetic [barcode part1]
taggagatacaaccgt

SEQ ID NO: 11111 - DNA, 16 bp, Artificial Sequence
  synthetic [barcode part1]
taccgtcacgatcgtc

SEQ ID NO: 11112 - DNA, 16 bp, Artificial Sequence
  synthetic [barcode part1]
taccaactcttagtcg

SEQ ID NO: 11113 - DNA, 16 bp, Artificial Sequence
  synthetic [barcode part1]
ataacttgagtgcgag

SEQ ID NO: 11114 - DNA, 16 bp, Artificial Sequence
  synthetic [barcode part1]
cagacgataggactcg

SEQ ID NO: 11115 - DNA, 16 bp, Artificial Sequence
  synthetic [barcode part1]
gcctggtacacagaag

SEQ ID NO: 11116 - DNA, 16 bp, Artificial Sequence
  synthetic [barcode part1]
caacgattgtgagaac

SEQ ID NO: 11117 - DNA, 16 bp, Artificial Sequence
  synthetic [barcode part1]
ccggccgtaatattag

SEQ ID NO: 11118 - DNA, 16 bp, Artificial Sequence
  synthetic [barcode part1]
tacaccaagtctcttg

SEQ ID NO: 11119 - DNA, 16 bp, Artificial Sequence
  synthetic [barcode part1]
acacaactggttgcac

SEQ ID NO: 11120 - DNA, 16 bp, Artificial Sequence
  synthetic [barcode part1]
caattatacggccacg

SEQ ID NO: 11121 - DNA, 16 bp, Artificial Sequence
  synthetic [barcode part1]
taccagtgtgtcagtg

SEQ ID NO: 11122 - DNA, 16 bp, Artificial Sequence
  synthetic [barcode part1]
gagaacaggcaatctt

SEQ ID NO: 11123 - DNA, 16 bp, Artificial Sequence
  synthetic [barcode part1]
tgttctggcgataggt

SEQ ID NO: 11124 - DNA, 16 bp, Artificial Sequence
  synthetic [barcode part1]
cgccactgcgactatt

SEQ ID NO: 11125 - DNA, 16 bp, Artificial Sequence
  synthetic [barcode part1]
tgcgtggtagacttac

SEQ ID NO: 11126 - DNA, 16 bp, Artificial Sequence
  synthetic [barcode part1]
taagtccagacctgtg

SEQ ID NO: 11127 - DNA, 16 bp, Artificial Sequence
  synthetic [barcode part1]
tagtgcaatcgaagac

SEQ ID NO: 11128 - DNA, 16 bp, Artificial Sequence
  synthetic [barcode part1]
cgagtgatctactcag

SEQ ID NO: 11129 - DNA, 16 bp, Artificial Sequence
  synthetic [barcode part1]
gaccagtaagacctct

SEQ ID NO: 11130 - DNA, 16 bp, Artificial Sequence
  synthetic [barcode part1]
gtgtatattggccggt

SEQ ID NO: 11131 - DNA, 16 bp, Artificial Sequence
  synthetic [barcode part1]
gagttgtcagaagtac

SEQ ID NO: 11132 - DNA, 16 bp, Artificial Sequence
  synthetic [barcode part1]
actctccactgtgcag

SEQ ID NO: 11133 - DNA, 16 bp, Artificial Sequence
  synthetic [barcode part1]
gaccgtgttgactctc

SEQ ID NO: 11134 - DNA, 16 bp, Artificial Sequence
  synthetic [barcode part1]
cctcagtatatccggc

SEQ ID NO: 11135 - DNA, 16 bp, Artificial Sequence
  synthetic [barcode part1]
ttcaccgccttactac

SEQ ID NO: 11136 - DNA, 16 bp, Artificial Sequence
  synthetic [barcode part1]
taatagttcggaccgc

SEQ ID NO: 11137 - DNA, 16 bp, Artificial Sequence
  synthetic [barcode part1]
gcaagacacaggttcg

SEQ ID NO: 11138 - DNA, 16 bp, Artificial Sequence
  synthetic [barcode part1]
gcgttctgtcagactc

SEQ ID NO: 11139 - DNA, 16 bp, Artificial Sequence
  synthetic [barcode part1]
taggaagaggaccagt

SEQ ID NO: 11140 - DNA, 16 bp, Artificial Sequence
  synthetic [barcode part1]
taccactacctctcgt

SEQ ID NO: 11141 - DNA, 16 bp, Artificial Sequence
  synthetic [barcode part1]
accacgcgaagatcag

SEQ ID NO: 11142 - DNA, 16 bp, Artificial Sequence
  synthetic [barcode part1]
tcgtgattcaaccgag

SEQ ID NO: 11143 - DNA, 16 bp, Artificial Sequence
  synthetic [barcode part1]
gtcggcggtgattatt

SEQ ID NO: 11144 - DNA, 16 bp, Artificial Sequence
  synthetic [barcode part1]
tggtgtacggttcctc

SEQ ID NO: 11145 - DNA, 16 bp, Artificial Sequence
  synthetic [barcode part1]
gtgcacgttgagattc

SEQ ID NO: 11146 - DNA, 16 bp, Artificial Sequence
  synthetic [barcode part1]
tctagtccggcacgtt

SEQ ID NO: 11147 - DNA, 16 bp, Artificial Sequence
  synthetic [barcode part1]
cgtaacgagacgaatt

SEQ ID NO: 11148 - DNA, 16 bp, Artificial Sequence
  synthetic [barcode part1]
cgcacaactcaatctt

SEQ ID NO: 11149 - DNA, 16 bp, Artificial Sequence
  synthetic [barcode part1]
taatctaggcgtagag

SEQ ID NO: 11150 - DNA, 16 bp, Artificial Sequence
  synthetic [barcode part1]
ataccttcgcaaggac

SEQ ID NO: 11151 - DNA, 16 bp, Artificial Sequence
  synthetic [barcode part1]
tccgtgtagaacacac

SEQ ID NO: 11152 - DNA, 16 bp, Artificial Sequence
  synthetic [barcode part1]
acagtgtggagttctc

SEQ ID NO: 11153 - DNA, 16 bp, Artificial Sequence
  synthetic [barcode part1]
acttccgtactctcac

SEQ ID NO: 11154 - DNA, 16 bp, Artificial Sequence
  synthetic [barcode part1]
agattaggaccaggag

SEQ ID NO: 11155 - DNA, 16 bp, Artificial Sequence
  synthetic [barcode part1]
gtagtaagtggccacg

SEQ ID NO: 11156 - DNA, 16 bp, Artificial Sequence
  synthetic [barcode part1]
tagtcaggatcgactc

SEQ ID NO: 11157 - DNA, 16 bp, Artificial Sequence
  synthetic [barcode part1]
acgagacgagtgatag

SEQ ID NO: 11158 - DNA, 16 bp, Artificial Sequence
  synthetic [barcode part1]
tcgtcggaatctagtg

SEQ ID NO: 11159 - DNA, 16 bp, Artificial Sequence
  synthetic [barcode part1]
tcagatagacgagact

SEQ ID NO: 11160 - DNA, 16 bp, Artificial Sequence
  synthetic [barcode part1]
tgattcgatccttacg

SEQ ID NO: 11161 - DNA, 16 bp, Artificial Sequence
  synthetic [barcode part1]
agtgtcgagttccagt

SEQ ID NO: 11162 - DNA, 16 bp, Artificial Sequence
  synthetic [barcode part1]
aacctccttctgttgc

SEQ ID NO: 11163 - DNA, 16 bp, Artificial Sequence
  synthetic [barcode part1]
tgcgtgcgtattgtag

SEQ ID NO: 11164 - DNA, 16 bp, Artificial Sequence
  synthetic [barcode part1]
agaacctcggataggc

SEQ ID NO: 11165 - DNA, 16 bp, Artificial Sequence
  synthetic [barcode part1]
agaggtgacaacctgc

SEQ ID NO: 11166 - DNA, 16 bp, Artificial Sequence
  synthetic [barcode part1]
tcaggcgtctatcgtc

SEQ ID NO: 11167 - DNA, 16 bp, Artificial Sequence
  synthetic [barcode part1]
acacgatcaaccgtac

SEQ ID NO: 11168 - DNA, 16 bp, Artificial Sequence
  synthetic [barcode part1]
atcctcgtgttcctac

SEQ ID NO: 11169 - DNA, 16 bp, Artificial Sequence
  synthetic [barcode part1]
gcgcaattgcgtgatt

SEQ ID NO: 11170 - DNA, 16 bp, Artificial Sequence
  synthetic [barcode part1]
cggttagaccgtgatt

SEQ ID NO: 11171 - DNA, 16 bp, Artificial Sequence
  synthetic [barcode part1]
tattcctcgacaactg

SEQ ID NO: 11172 - DNA, 16 bp, Artificial Sequence
  synthetic [barcode part1]
tctacgcagttgttac

SEQ ID NO: 11173 - DNA, 16 bp, Artificial Sequence
  synthetic [barcode part1]
taacggcgttggatct

SEQ ID NO: 11174 - DNA, 16 bp, Artificial Sequence
  synthetic [barcode part1]
attgaacggatcgcct

SEQ ID NO: 11175 - DNA, 16 bp, Artificial Sequence
  synthetic [barcode part1]
tatcagacctgcgcct

SEQ ID NO: 11176 - DNA, 16 bp, Artificial Sequence
  synthetic [barcode part1]
caggactctgaagtct

SEQ ID NO: 11177 - DNA, 16 bp, Artificial Sequence
  synthetic [barcode part1]
aatctattctaccgcg

SEQ ID NO: 11178 - DNA, 16 bp, Artificial Sequence
  synthetic [barcode part1]
ttacacgtctcgaccg

SEQ ID NO: 11179 - DNA, 16 bp, Artificial Sequence
  synthetic [barcode part1]
aggacttcttaaggcc

SEQ ID NO: 11180 - DNA, 16 bp, Artificial Sequence
  synthetic [barcode part1]
tgcgagttccgtcact

SEQ ID NO: 11181 - DNA, 16 bp, Artificial Sequence
  synthetic [barcode part1]
tccgcgcaattgtcac

SEQ ID NO: 11182 - DNA, 16 bp, Artificial Sequence
  synthetic [barcode part1]
tgaaggcggcaacttg

SEQ ID NO: 11183 - DNA, 16 bp, Artificial Sequence
  synthetic [barcode part1]
gacgtatattgacgcc

SEQ ID NO: 11184 - DNA, 16 bp, Artificial Sequence
  synthetic [barcode part1]
acttactcgaagttcc

SEQ ID NO: 11185 - DNA, 16 bp, Artificial Sequence
  synthetic [barcode part1]
tgccaggagtaacttc

SEQ ID NO: 11186 - DNA, 16 bp, Artificial Sequence
  synthetic [barcode part1]
ttctgagtggagtctg

SEQ ID NO: 11187 - DNA, 16 bp, Artificial Sequence
  synthetic [barcode part1]
agagttctacctactc

SEQ ID NO: 11188 - DNA, 16 bp, Artificial Sequence
  synthetic [barcode part1]
gcaagtcctcctgact

SEQ ID NO: 11189 - DNA, 16 bp, Artificial Sequence
  synthetic [barcode part1]
aatctggagaggtgcc

SEQ ID NO: 11190 - DNA, 16 bp, Artificial Sequence
  synthetic [barcode part1]
cgcaggttactgtctc

SEQ ID NO: 11191 - DNA, 16 bp, Artificial Sequence
  synthetic [barcode part1]
gtaactcggtgattcg

SEQ ID NO: 11192 - DNA, 16 bp, Artificial Sequence
  synthetic [barcode part1]
tggacgcaaggtagtc

SEQ ID NO: 11193 - DNA, 16 bp, Artificial Sequence
  synthetic [barcode part1]
gacaacctgacttggt

SEQ ID NO: 11194 - DNA, 16 bp, Artificial Sequence
  synthetic [barcode part1]
ccaagtaacctgcaac

SEQ ID NO: 11195 - DNA, 16 bp, Artificial Sequence
  synthetic [barcode part1]
aagttcgacggaacgc

SEQ ID NO: 11196 - DNA, 16 bp, Artificial Sequence
  synthetic [barcode part1]
acaacgttatacgcgc

SEQ ID NO: 11197 - DNA, 16 bp, Artificial Sequence
  synthetic [barcode part1]
gtgcggtatcaatacc

SEQ ID NO: 11198 - DNA, 16 bp, Artificial Sequence
  synthetic [barcode part1]
aacaccttattccgtg

SEQ ID NO: 11199 - DNA, 16 bp, Artificial Sequence
  synthetic [barcode part1]
atcaccttgtcgcctt

SEQ ID NO: 11200 - DNA, 16 bp, Artificial Sequence
  synthetic [barcode part1]
gtgtctcagttattgc

SEQ ID NO: 11201 - DNA, 16 bp, Artificial Sequence
  synthetic [barcode part1]
tacgtagtactctacc

SEQ ID NO: 11202 - DNA, 16 bp, Artificial Sequence
  synthetic [barcode part1]
aaccttgtgaagtccg

SEQ ID NO: 11203 - DNA, 16 bp, Artificial Sequence
  synthetic [barcode part1]
gtgactggtgtcagtt

SEQ ID NO: 11204 - DNA, 16 bp, Artificial Sequence
  synthetic [barcode part1]
taaggaggatcggagt

SEQ ID NO: 11205 - DNA, 16 bp, Artificial Sequence
  synthetic [barcode part1]
aatcgaataggtccag

SEQ ID NO: 11206 - DNA, 16 bp, Artificial Sequence
  synthetic [barcode part1]
tggatacaactgtgcc

SEQ ID NO: 11207 - DNA, 16 bp, Artificial Sequence
  synthetic [barcode part1]
cacgttctcgttggac

SEQ ID NO: 11208 - DNA, 16 bp, Artificial Sequence
  synthetic [barcode part1]
attggtagtgaggtgt

SEQ ID NO: 11209 - DNA, 16 bp, Artificial Sequence
  synthetic [barcode part1]
acctattctcaggatc

SEQ ID NO: 11210 - DNA, 16 bp, Artificial Sequence
  synthetic [barcode part1]
gcaagttgattacgcc

SEQ ID NO: 11211 - DNA, 16 bp, Artificial Sequence
  synthetic [barcode part1]
gtagaatctgtaggtg

SEQ ID NO: 11212 - DNA, 16 bp, Artificial Sequence
  synthetic [barcode part1]
gtgcggcacactaatt

SEQ ID NO: 11213 - DNA, 16 bp, Artificial Sequence
  synthetic [barcode part1]
acagtcaaccacacac

SEQ ID NO: 11214 - DNA, 16 bp, Artificial Sequence
  synthetic [barcode part1]
aacctacctgtgaacg

SEQ ID NO: 11215 - DNA, 16 bp, Artificial Sequence
  synthetic [barcode part1]
cgaactattccgcacc

SEQ ID NO: 11216 - DNA, 16 bp, Artificial Sequence
  synthetic [barcode part1]
gtactagtcgacacac

SEQ ID NO: 11217 - DNA, 16 bp, Artificial Sequence
  synthetic [barcode part1]
gtgcacgactaattgc

SEQ ID NO: 11218 - DNA, 16 bp, Artificial Sequence
  synthetic [barcode part1]
tggtcttcacacagtt

SEQ ID NO: 11219 - DNA, 16 bp, Artificial Sequence
  synthetic [barcode part1]
gtatacgcacagtacc

SEQ ID NO: 11220 - DNA, 16 bp, Artificial Sequence
  synthetic [barcode part1]
aggtcagatcgcgtag

SEQ ID NO: 11221 - DNA, 16 bp, Artificial Sequence
  synthetic [barcode part1]
aactaccagatcaccg

SEQ ID NO: 11222 - DNA, 16 bp, Artificial Sequence
  synthetic [barcode part1]
gcgtaccacggaatag

SEQ ID NO: 11223 - DNA, 16 bp, Artificial Sequence
  synthetic [barcode part1]
tagatagtaccacgag

SEQ ID NO: 11224 - DNA, 16 bp, Artificial Sequence
  synthetic [barcode part1]
actgtgtctaggtgtg

SEQ ID NO: 11225 - DNA, 16 bp, Artificial Sequence
  synthetic [barcode part1]
atacgacgagaccgac

SEQ ID NO: 11226 - DNA, 16 bp, Artificial Sequence
  synthetic [barcode part1]
agtgtaaggactgccg

SEQ ID NO: 11227 - DNA, 16 bp, Artificial Sequence
  synthetic [barcode part1]
cgcacttattcagtac

SEQ ID NO: 11228 - DNA, 16 bp, Artificial Sequence
  synthetic [barcode part1]
cgtgtaactgtgtgac

SEQ ID NO: 11229 - DNA, 16 bp, Artificial Sequence
  synthetic [barcode part1]
taatcaagtgcgcgtc

SEQ ID NO: 11230 - DNA, 16 bp, Artificial Sequence
  synthetic [barcode part1]
ttctacggacttgact

SEQ ID NO: 11231 - DNA, 16 bp, Artificial Sequence
  synthetic [barcode part1]
gtagtcgcgtgtaact

SEQ ID NO: 11232 - DNA, 16 bp, Artificial Sequence
  synthetic [barcode part1]
cgttaagatccggtac

SEQ ID NO: 11233 - DNA, 16 bp, Artificial Sequence
  synthetic [barcode part1]
agtaaggtgcgtcggt

SEQ ID NO: 11234 - DNA, 16 bp, Artificial Sequence
  synthetic [barcode part1]
agtcctatcacggtag

SEQ ID NO: 11235 - DNA, 16 bp, Artificial Sequence
  synthetic [barcode part1]
cgtgagtcctgtcact

SEQ ID NO: 11236 - DNA, 16 bp, Artificial Sequence
  synthetic [barcode part1]
ttcacgtatcggactt

SEQ ID NO: 11237 - DNA, 16 bp, Artificial Sequence
  synthetic [barcode part1]
agagtagacttcgcct

SEQ ID NO: 11238 - DNA, 16 bp, Artificial Sequence
  synthetic [barcode part1]
gtgaccgatcagtatc

SEQ ID NO: 11239 - DNA, 16 bp, Artificial Sequence
  synthetic [barcode part1]
gtcgtgattgtctact

SEQ ID NO: 11240 - DNA, 16 bp, Artificial Sequence
  synthetic [barcode part1]
attccgagttacggtg

SEQ ID NO: 11241 - DNA, 16 bp, Artificial Sequence
  synthetic [barcode part1]
cacgaacaggttcgtt

SEQ ID NO: 11242 - DNA, 16 bp, Artificial Sequence
  synthetic [barcode part1]
atcgactgatcagtcg

SEQ ID NO: 11243 - DNA, 16 bp, Artificial Sequence
  synthetic [barcode part1]
ttatcctgcacggtcg

SEQ ID NO: 11244 - DNA, 16 bp, Artificial Sequence
  synthetic [barcode part1]
agacacgaggatacag

SEQ ID NO: 11245 - DNA, 16 bp, Artificial Sequence
  synthetic [barcode part1]
gcagaccgagaactac

SEQ ID NO: 11246 - DNA, 16 bp, Artificial Sequence
  synthetic [barcode part1]
ttgaacctgtgcctcg

SEQ ID NO: 11247 - DNA, 16 bp, Artificial Sequence
  synthetic [barcode part1]
taacgaccgcaccttc

SEQ ID NO: 11248 - DNA, 16 bp, Artificial Sequence
  synthetic [barcode part1]
tcgtgtaactagtgcg

SEQ ID NO: 11249 - DNA, 16 bp, Artificial Sequence
  synthetic [barcode part1]
gtcagacttcacgcct

SEQ ID NO: 11250 - DNA, 16 bp, Artificial Sequence
  synthetic [barcode part1]
ccttcacaagtgtgag

SEQ ID NO: 11251 - DNA, 16 bp, Artificial Sequence
  synthetic [barcode part1]
caaccggttaagatcc

SEQ ID NO: 11252 - DNA, 16 bp, Artificial Sequence
  synthetic [barcode part1]
cagaacggagtatccg

SEQ ID NO: 11253 - DNA, 16 bp, Artificial Sequence
  synthetic [barcode part1]
tgtaggtcttaccgcc

SEQ ID NO: 11254 - DNA, 16 bp, Artificial Sequence
  synthetic [barcode part1]
tccagagtcggaatct

SEQ ID NO: 11255 - DNA, 16 bp, Artificial Sequence
  synthetic [barcode part1]
ttactgcgtaggttct

SEQ ID NO: 11256 - DNA, 16 bp, Artificial Sequence
  synthetic [barcode part1]
acgattatcgagaggt

SEQ ID NO: 11257 - DNA, 16 bp, Artificial Sequence
  synthetic [barcode part1]
ttccgcaagttcggtc

SEQ ID NO: 11258 - DNA, 16 bp, Artificial Sequence
  synthetic [barcode part1]
tcacagaagtgacaac

SEQ ID NO: 11259 - DNA, 16 bp, Artificial Sequence
  synthetic [barcode part1]
tacgtgacagaagatc

SEQ ID NO: 11260 - DNA, 16 bp, Artificial Sequence
  synthetic [barcode part1]
tcgcaatcgactaacg

SEQ ID NO: 11261 - DNA, 16 bp, Artificial Sequence
  synthetic [barcode part1]
actgcaattacttgcc

SEQ ID NO: 11262 - DNA, 16 bp, Artificial Sequence
  synthetic [barcode part1]
aggccaatacgcagtg

SEQ ID NO: 11263 - DNA, 16 bp, Artificial Sequence
  synthetic [barcode part1]
tacagtctacggactg

SEQ ID NO: 11264 - DNA, 16 bp, Artificial Sequence
  synthetic [barcode part1]
atccaggtacctgagt

SEQ ID NO: 11265 - DNA, 16 bp, Artificial Sequence
  synthetic [barcode part1]
gacgaccaacttaacc

SEQ ID NO: 11266 - DNA, 16 bp, Artificial Sequence
  synthetic [barcode part1]
aacaagacgtaggttc

SEQ ID NO: 11267 - DNA, 16 bp, Artificial Sequence
  synthetic [barcode part1]
gttggttacgtcgtag

SEQ ID NO: 11268 - DNA, 16 bp, Artificial Sequence
  synthetic [barcode part1]
tgacgacttgaaccgt

SEQ ID NO: 11269 - DNA, 16 bp, Artificial Sequence
  synthetic [barcode part1]
ttcctaactcttcggc

SEQ ID NO: 11270 - DNA, 16 bp, Artificial Sequence
  synthetic [barcode part1]
acgcgaattacacctg

SEQ ID NO: 11271 - DNA, 16 bp, Artificial Sequence
  synthetic [barcode part1]
tcttgtgtcgacaact

SEQ ID NO: 11272 - DNA, 16 bp, Artificial Sequence
  synthetic [barcode part1]
gcggttctcgtattcg

SEQ ID NO: 11273 - DNA, 16 bp, Artificial Sequence
  synthetic [barcode part1]
tactgtcgcgattact

SEQ ID NO: 11274 - DNA, 16 bp, Artificial Sequence
  synthetic [barcode part1]
atactcctcgaactgt

SEQ ID NO: 11275 - DNA, 16 bp, Artificial Sequence
  synthetic [barcode part1]
gtagatatcgtccacg

SEQ ID NO: 11276 - DNA, 16 bp, Artificial Sequence
  synthetic [barcode part1]
cactggcaacttcctg

SEQ ID NO: 11277 - DNA, 16 bp, Artificial Sequence
  synthetic [barcode part1]
tgttgttagacgtctc

SEQ ID NO: 11278 - DNA, 16 bp, Artificial Sequence
  synthetic [barcode part1]
gcacttattacaggcg

SEQ ID NO: 11279 - DNA, 16 bp, Artificial Sequence
  synthetic [barcode part1]
tgaacacgaggaccac

SEQ ID NO: 11280 - DNA, 16 bp, Artificial Sequence
  synthetic [barcode part1]
aacttcttacggactc

SEQ ID NO: 11281 - DNA, 16 bp, Artificial Sequence
  synthetic [barcode part1]
gatcgcgtcttagtcc

SEQ ID NO: 11282 - DNA, 16 bp, Artificial Sequence
  synthetic [barcode part1]
ttacttccgtgaatcg

SEQ ID NO: 11283 - DNA, 16 bp, Artificial Sequence
  synthetic [barcode part1]
atagtcggtgccaatc

SEQ ID NO: 11284 - DNA, 16 bp, Artificial Sequence
  synthetic [barcode part1]
tattcaaccagacgcg

SEQ ID NO: 11285 - DNA, 16 bp, Artificial Sequence
  synthetic [barcode part1]
gacgagatctctagtc

SEQ ID NO: 11286 - DNA, 16 bp, Artificial Sequence
  synthetic [barcode part1]
tcaaggtcttattcgc

SEQ ID NO: 11287 - DNA, 16 bp, Artificial Sequence
  synthetic [barcode part1]
aaggaacaacgcgcct

SEQ ID NO: 11288 - DNA, 16 bp, Artificial Sequence
  synthetic [barcode part1]
gtgactatagtgtgcc

SEQ ID NO: 11289 - DNA, 16 bp, Artificial Sequence
  synthetic [barcode part1]
gcggtaagttcaggtg

SEQ ID NO: 11290 - DNA, 16 bp, Artificial Sequence
  synthetic [barcode part1]
cggaattcgatcgatc

SEQ ID NO: 11291 - DNA, 16 bp, Artificial Sequence
  synthetic [barcode part1]
gttcaactggtccaag

SEQ ID NO: 11292 - DNA, 16 bp, Artificial Sequence
  synthetic [barcode part1]
gcaagacggtacctag

SEQ ID NO: 11293 - DNA, 16 bp, Artificial Sequence
  synthetic [barcode part1]
aattgtaaggactggc

SEQ ID NO: 11294 - DNA, 16 bp, Artificial Sequence
  synthetic [barcode part1]
actagtggcaattgcc

SEQ ID NO: 11295 - DNA, 16 bp, Artificial Sequence
  synthetic [barcode part1]
atagagacgtggagac

SEQ ID NO: 11296 - DNA, 16 bp, Artificial Sequence
  synthetic [barcode part1]
aactggtaagacctcc

SEQ ID NO: 11297 - DNA, 16 bp, Artificial Sequence
  synthetic [barcode part1]
cgtaacttgcgtcaag

SEQ ID NO: 11298 - DNA, 16 bp, Artificial Sequence
  synthetic [barcode part1]
gcgcctcttaacagtc

SEQ ID NO: 11299 - DNA, 16 bp, Artificial Sequence
  synthetic [barcode part1]
taagaggcagtcgcgt

SEQ ID NO: 11300 - DNA, 16 bp, Artificial Sequence
  synthetic [barcode part1]
gagtggttgcagatcg

SEQ ID NO: 11301 - DNA, 16 bp, Artificial Sequence
  synthetic [barcode part1]
tctgattgcgttagtc

SEQ ID NO: 11302 - DNA, 16 bp, Artificial Sequence
  synthetic [barcode part1]
gcgccaattctcaacc

SEQ ID NO: 11303 - DNA, 16 bp, Artificial Sequence
  synthetic [barcode part1]
caggtactgcaagtct

SEQ ID NO: 11304 - DNA, 16 bp, Artificial Sequence
  synthetic [barcode part1]
tgacgcggatctatac

SEQ ID NO: 11305 - DNA, 16 bp, Artificial Sequence
  synthetic [barcode part1]
taggcgaacggtactg

SEQ ID NO: 11306 - DNA, 16 bp, Artificial Sequence
  synthetic [barcode part1]
aactataccaagaggc

SEQ ID NO: 11307 - DNA, 16 bp, Artificial Sequence
  synthetic [barcode part1]
caataataccaccggc

SEQ ID NO: 11308 - DNA, 16 bp, Artificial Sequence
  synthetic [barcode part1]
tctgcgtgattcgacc

SEQ ID NO: 11309 - DNA, 16 bp, Artificial Sequence
  synthetic [barcode part1]
gcgtaaggataatctg

SEQ ID NO: 11310 - DNA, 16 bp, Artificial Sequence
  synthetic [barcode part1]
caagacggtaattgtg

SEQ ID NO: 11311 - DNA, 16 bp, Artificial Sequence
  synthetic [barcode part1]
aagacctaagtcctgc

SEQ ID NO: 11312 - DNA, 16 bp, Artificial Sequence
  synthetic [barcode part1]
cggatcagttatcggt

SEQ ID NO: 11313 - DNA, 16 bp, Artificial Sequence
  synthetic [barcode part1]
accgtctggacttgtc

SEQ ID NO: 11314 - DNA, 16 bp, Artificial Sequence
  synthetic [barcode part1]
gacggaacacgtcaac

SEQ ID NO: 11315 - DNA, 16 bp, Artificial Sequence
  synthetic [barcode part1]
tcagacaggcgagatc

SEQ ID NO: 11316 - DNA, 16 bp, Artificial Sequence
  synthetic [barcode part1]
tagtgtagtgcctggt

SEQ ID NO: 11317 - DNA, 16 bp, Artificial Sequence
  synthetic [barcode part1]
taggcgactcacttag

SEQ ID NO: 11318 - DNA, 16 bp, Artificial Sequence
  synthetic [barcode part1]
ttatcctcggttcctg

SEQ ID NO: 11319 - DNA, 16 bp, Artificial Sequence
  synthetic [barcode part1]
ttaccgtcaaggcagt

SEQ ID NO: 11320 - DNA, 16 bp, Artificial Sequence
  synthetic [barcode part1]
gatctcctcttcagtc

SEQ ID NO: 11321 - DNA, 16 bp, Artificial Sequence
  synthetic [barcode part1]
acctatcagtgtcact

SEQ ID NO: 11322 - DNA, 16 bp, Artificial Sequence
  synthetic [barcode part1]
cacctcacactcagac

SEQ ID NO: 11323 - DNA, 16 bp, Artificial Sequence
  synthetic [barcode part1]
gtactaacacggacct

SEQ ID NO: 11324 - DNA, 16 bp, Artificial Sequence
  synthetic [barcode part1]
cagatcactctcgtgc

SEQ ID NO: 11325 - DNA, 16 bp, Artificial Sequence
  synthetic [barcode part1]
ccaagtgattccgcct

SEQ ID NO: 11326 - DNA, 16 bp, Artificial Sequence
  synthetic [barcode part1]
tcgtagttacagtgcg

SEQ ID NO: 11327 - DNA, 16 bp, Artificial Sequence
  synthetic [barcode part1]
tcggtgcctaaccttg

SEQ ID NO: 11328 - DNA, 16 bp, Artificial Sequence
  synthetic [barcode part1]
gcgaagacagtggttc

SEQ ID NO: 11329 - DNA, 16 bp, Artificial Sequence
  synthetic [barcode part1]
cgataacgaagtgcgc

SEQ ID NO: 11330 - DNA, 16 bp, Artificial Sequence
  synthetic [barcode part1]
agtagaacgtaccaac

SEQ ID NO: 11331 - DNA, 16 bp, Artificial Sequence
  synthetic [barcode part1]
tgcgtctcttgtatcc

SEQ ID NO: 11332 - DNA, 16 bp, Artificial Sequence
  synthetic [barcode part1]
tctagtgcgaagatag

SEQ ID NO: 11333 - DNA, 16 bp, Artificial Sequence
  synthetic [barcode part1]
actagtatcgtgcggt

SEQ ID NO: 11334 - DNA, 16 bp, Artificial Sequence
  synthetic [barcode part1]
gcaagacaggtctgtg

SEQ ID NO: 11335 - DNA, 16 bp, Artificial Sequence
  synthetic [barcode part1]
agttgcaactgcacac

SEQ ID NO: 11336 - DNA, 16 bp, Artificial Sequence
  synthetic [barcode part1]
ttccagaacttgttcg

SEQ ID NO: 11337 - DNA, 16 bp, Artificial Sequence
  synthetic [barcode part1]
agtactccactctgcg

SEQ ID NO: 11338 - DNA, 16 bp, Artificial Sequence
  synthetic [barcode part1]
tgagaaggcactgatt

SEQ ID NO: 11339 - DNA, 16 bp, Artificial Sequence
  synthetic [barcode part1]
accggattcgcacctt

SEQ ID NO: 11340 - DNA, 16 bp, Artificial Sequence
  synthetic [barcode part1]
cgaatctcagaacaag

SEQ ID NO: 11341 - DNA, 16 bp, Artificial Sequence
  synthetic [barcode part1]
tattccgtgttcaggt

SEQ ID NO: 11342 - DNA, 16 bp, Artificial Sequence
  synthetic [barcode part1]
tcacaagacaggatac

SEQ ID NO: 11343 - DNA, 16 bp, Artificial Sequence
  synthetic [barcode part1]
cacggtcttgaatacg

SEQ ID NO: 11344 - DNA, 16 bp, Artificial Sequence
  synthetic [barcode part1]
agttcggccgaattgt

SEQ ID NO: 11345 - DNA, 16 bp, Artificial Sequence
  synthetic [barcode part1]
agtactaccgaccagt

SEQ ID NO: 11346 - DNA, 16 bp, Artificial Sequence
  synthetic [barcode part1]
tacgcgaacctagact

SEQ ID NO: 11347 - DNA, 16 bp, Artificial Sequence
  synthetic [barcode part1]
tgaactggatcaccac

SEQ ID NO: 11348 - DNA, 16 bp, Artificial Sequence
  synthetic [barcode part1]
gagatctggtattgcc

SEQ ID NO: 11349 - DNA, 16 bp, Artificial Sequence
  synthetic [barcode part1]
cactccagatatctac

SEQ ID NO: 11350 - DNA, 16 bp, Artificial Sequence
  synthetic [barcode part1]
ttcggaagaccagttc

SEQ ID NO: 11351 - DNA, 16 bp, Artificial Sequence
  synthetic [barcode part1]
gagataggaatccgtt

SEQ ID NO: 11352 - DNA, 16 bp, Artificial Sequence
  synthetic [barcode part1]
tgcctgtgttccgaac

SEQ ID NO: 11353 - DNA, 16 bp, Artificial Sequence
  synthetic [barcode part1]
taacgcgttggacgtt

SEQ ID NO: 11354 - DNA, 16 bp, Artificial Sequence
  synthetic [barcode part1]
attattgaccgccgag

SEQ ID NO: 11355 - DNA, 16 bp, Artificial Sequence
  synthetic [barcode part1]
aggtcgaacgtaccag

SEQ ID NO: 11356 - DNA, 16 bp, Artificial Sequence
  synthetic [barcode part1]
cggtggttggtaattc

SEQ ID NO: 11357 - DNA, 16 bp, Artificial Sequence
  synthetic [barcode part1]
ccgaacctcttacgtg

SEQ ID NO: 11358 - DNA, 16 bp, Artificial Sequence
  synthetic [barcode part1]
gattatagaggtcgac

SEQ ID NO: 11359 - DNA, 16 bp, Artificial Sequence
  synthetic [barcode part1]
aggcctgttactattc

SEQ ID NO: 11360 - DNA, 16 bp, Artificial Sequence
  synthetic [barcode part1]
aacctagtcttgcgcc

SEQ ID NO: 11361 - DNA, 16 bp, Artificial Sequence
  synthetic [barcode part1]
tctgcgcgacttggtt

SEQ ID NO: 11362 - DNA, 16 bp, Artificial Sequence
  synthetic [barcode part1]
acttcttggccagaag

SEQ ID NO: 11363 - DNA, 16 bp, Artificial Sequence
  synthetic [barcode part1]
gtcaacgcaccttatt

SEQ ID NO: 11364 - DNA, 16 bp, Artificial Sequence
  synthetic [barcode part1]
cagatcaatcaggtcc

SEQ ID NO: 11365 - DNA, 16 bp, Artificial Sequence
  synthetic [barcode part1]
atcctcctgcacaacg

SEQ ID NO: 11366 - DNA, 16 bp, Artificial Sequence
  synthetic [barcode part1]
acgcacgtacaatacc

SEQ ID NO: 11367 - DNA, 16 bp, Artificial Sequence
  synthetic [barcode part1]
gtcacttagacctgtt

SEQ ID NO: 11368 - DNA, 16 bp, Artificial Sequence
  synthetic [barcode part1]
gcgatcaagaggacct

SEQ ID NO: 11369 - DNA, 16 bp, Artificial Sequence
  synthetic [barcode part1]
cgatcctgaagaatcc

SEQ ID NO: 11370 - DNA, 16 bp, Artificial Sequence
  synthetic [barcode part1]
accttacaggtgtctt

SEQ ID NO: 11371 - DNA, 16 bp, Artificial Sequence
  synthetic [barcode part1]
tcctaacctaacgtgt

SEQ ID NO: 11372 - DNA, 16 bp, Artificial Sequence
  synthetic [barcode part1]
agattgttccgcgcct

SEQ ID NO: 11373 - DNA, 16 bp, Artificial Sequence
  synthetic [barcode part1]
tgcggacctactctac

SEQ ID NO: 11374 - DNA, 16 bp, Artificial Sequence
  synthetic [barcode part1]
ttggcaactgcactcc

SEQ ID NO: 11375 - DNA, 16 bp, Artificial Sequence
  synthetic [barcode part1]
gtcggtatactctact

SEQ ID NO: 11376 - DNA, 16 bp, Artificial Sequence
  synthetic [barcode part1]
ttaattctgccgacgt

SEQ ID NO: 11377 - DNA, 16 bp, Artificial Sequence
  synthetic [barcode part1]
gccttatctgtgtagt

SEQ ID NO: 11378 - DNA, 16 bp, Artificial Sequence
  synthetic [barcode part1]
gagtaggagactctgc

SEQ ID NO: 11379 - DNA, 16 bp, Artificial Sequence
  synthetic [barcode part1]
tgtcaccgtgaagtac

SEQ ID NO: 11380 - DNA, 16 bp, Artificial Sequence
  synthetic [barcode part1]
ttacggagacgtatcc

SEQ ID NO: 11381 - DNA, 16 bp, Artificial Sequence
  synthetic [barcode part1]
tcagagttctattcgc

SEQ ID NO: 11382 - DNA, 16 bp, Artificial Sequence
  synthetic [barcode part1]
tcacacagatcctccg

SEQ ID NO: 11383 - DNA, 16 bp, Artificial Sequence
  synthetic [barcode part1]
acttcacgttctccgt

SEQ ID NO: 11384 - DNA, 16 bp, Artificial Sequence
  synthetic [barcode part1]
ccttcggtaactgcgt

SEQ ID NO: 11385 - DNA, 16 bp, Artificial Sequence
  synthetic [barcode part1]
tcggtctgtctgagtc

SEQ ID NO: 11386 - DNA, 16 bp, Artificial Sequence
  synthetic [barcode part1]
gttacaccgataagag

SEQ ID NO: 11387 - DNA, 16 bp, Artificial Sequence
  synthetic [barcode part1]
cgagatcgacttcagt

SEQ ID NO: 11388 - DNA, 16 bp, Artificial Sequence
  synthetic [barcode part1]
gtcggcgcagaagatt

SEQ ID NO: 11389 - DNA, 16 bp, Artificial Sequence
  synthetic [barcode part1]
tgttactcgtcgatac

SEQ ID NO: 11390 - DNA, 16 bp, Artificial Sequence
  synthetic [barcode part1]
gcacgactcctgattc

SEQ ID NO: 11391 - DNA, 16 bp, Artificial Sequence
  synthetic [barcode part1]
gaagacctgcgactag

SEQ ID NO: 11392 - DNA, 16 bp, Artificial Sequence
  synthetic [barcode part1]
attggatctcgtgtct

SEQ ID NO: 11393 - DNA, 16 bp, Artificial Sequence
  synthetic [barcode part1]
ttggccgaattggttg

SEQ ID NO: 11394 - DNA, 16 bp, Artificial Sequence
  synthetic [barcode part1]
cacgaatatccgtgac

SEQ ID NO: 11395 - DNA, 16 bp, Artificial Sequence
  synthetic [barcode part1]
cacacagaatacgcct

SEQ ID NO: 11396 - DNA, 16 bp, Artificial Sequence
  synthetic [barcode part1]
gagagaagactctgag

SEQ ID NO: 11397 - DNA, 16 bp, Artificial Sequence
  synthetic [barcode part1]
ttcctaacttcctggc

SEQ ID NO: 11398 - DNA, 16 bp, Artificial Sequence
  synthetic [barcode part1]
gtatcggtaactctct

SEQ ID NO: 11399 - DNA, 16 bp, Artificial Sequence
  synthetic [barcode part1]
gtcaggcagtacagac

SEQ ID NO: 11400 - DNA, 16 bp, Artificial Sequence
  synthetic [barcode part1]
acaacctgtctggtag

SEQ ID NO: 11401 - DNA, 16 bp, Artificial Sequence
  synthetic [barcode part1]
aacctagtcgacgatc

SEQ ID NO: 11402 - DNA, 16 bp, Artificial Sequence
  synthetic [barcode part1]
aaccagttgacgttgc

SEQ ID NO: 11403 - DNA, 16 bp, Artificial Sequence
  synthetic [barcode part1]
gatagatacaacaccg

SEQ ID NO: 11404 - DNA, 16 bp, Artificial Sequence
  synthetic [barcode part1]
tcgttattgtctggac

SEQ ID NO: 11405 - DNA, 16 bp, Artificial Sequence
  synthetic [barcode part1]
tgacgcaatcacttct

SEQ ID NO: 11406 - DNA, 16 bp, Artificial Sequence
  synthetic [barcode part1]
tcttacaattgccgac

SEQ ID NO: 11407 - DNA, 16 bp, Artificial Sequence
  synthetic [barcode part1]
caacagtgtacaagac

SEQ ID NO: 11408 - DNA, 16 bp, Artificial Sequence
  synthetic [barcode part1]
gttggtaataagacgc

SEQ ID NO: 11409 - DNA, 16 bp, Artificial Sequence
  synthetic [barcode part1]
tcgttgtggattcgtt

SEQ ID NO: 11410 - DNA, 16 bp, Artificial Sequence
  synthetic [barcode part1]
tcgtggaacgatcgtt

SEQ ID NO: 11411 - DNA, 16 bp, Artificial Sequence
  synthetic [barcode part1]
taacgtgagttcgtgc

SEQ ID NO: 11412 - DNA, 16 bp, Artificial Sequence
  synthetic [barcode part1]
ttagtccaggtatcct

SEQ ID NO: 11413 - DNA, 16 bp, Artificial Sequence
  synthetic [barcode part1]
atactcgcaccactcg

SEQ ID NO: 11414 - DNA, 16 bp, Artificial Sequence
  synthetic [barcode part1]
gttacgattcaaggcc

SEQ ID NO: 11415 - DNA, 16 bp, Artificial Sequence
  synthetic [barcode part1]
gacactattccgagac

SEQ ID NO: 11416 - DNA, 16 bp, Artificial Sequence
  synthetic [barcode part1]
tcaacactgtgtgacg

SEQ ID NO: 11417 - DNA, 16 bp, Artificial Sequence
  synthetic [barcode part1]
acttggacctgaacac

SEQ ID NO: 11418 - DNA, 16 bp, Artificial Sequence
  synthetic [barcode part1]
tgtatcttggaggcac

SEQ ID NO: 11419 - DNA, 16 bp, Artificial Sequence
  synthetic [barcode part1]
gtaccaacctctgacc

SEQ ID NO: 11420 - DNA, 16 bp, Artificial Sequence
  synthetic [barcode part1]
taccaagtgaggacgc

SEQ ID NO: 11421 - DNA, 16 bp, Artificial Sequence
  synthetic [barcode part1]
tcaatagttgcgtcct

SEQ ID NO: 11422 - DNA, 16 bp, Artificial Sequence
  synthetic [barcode part1]
cgaatcaagttaccgc

SEQ ID NO: 11423 - DNA, 16 bp, Artificial Sequence
  synthetic [barcode part1]
cctgtgttcgagttgc

SEQ ID NO: 11424 - DNA, 16 bp, Artificial Sequence
  synthetic [barcode part1]
gcgactaggtcagagt

SEQ ID NO: 11425 - DNA, 16 bp, Artificial Sequence
  synthetic [barcode part1]
ttcctggaatcctctc

SEQ ID NO: 11426 - DNA, 16 bp, Artificial Sequence
  synthetic [barcode part1]
gttaattggttggccg

SEQ ID NO: 11427 - DNA, 16 bp, Artificial Sequence
  synthetic [barcode part1]
agacggagtaatactc

SEQ ID NO: 11428 - DNA, 16 bp, Artificial Sequence
  synthetic [barcode part1]
aattgccgtgaggacg

SEQ ID NO: 11429 - DNA, 16 bp, Artificial Sequence
  synthetic [barcode part1]
ccttcgaggttagaac

SEQ ID NO: 11430 - DNA, 16 bp, Artificial Sequence
  synthetic [barcode part1]
ccgactcttgcacagt

SEQ ID NO: 11431 - DNA, 16 bp, Artificial Sequence
  synthetic [barcode part1]
ttgacgtacaccaacg

SEQ ID NO: 11432 - DNA, 16 bp, Artificial Sequence
  synthetic [barcode part1]
cgattacctatcgttg

SEQ ID NO: 11433 - DNA, 16 bp, Artificial Sequence
  synthetic [barcode part1]
aatcgcgttctggcct

SEQ ID NO: 11434 - DNA, 16 bp, Artificial Sequence
  synthetic [barcode part1]
taagtacgtgtggcct

SEQ ID NO: 11435 - DNA, 16 bp, Artificial Sequence
  synthetic [barcode part1]
gtgatctgacacggag

SEQ ID NO: 11436 - DNA, 16 bp, Artificial Sequence
  synthetic [barcode part1]
ccgagaattggtgcag

SEQ ID NO: 11437 - DNA, 16 bp, Artificial Sequence
  synthetic [barcode part1]
gtgtctaacagatccg

SEQ ID NO: 11438 - DNA, 16 bp, Artificial Sequence
  synthetic [barcode part1]
acctgaggcctcactt

SEQ ID NO: 11439 - DNA, 16 bp, Artificial Sequence
  synthetic [barcode part1]
attagaggagaccgag

SEQ ID NO: 11440 - DNA, 16 bp, Artificial Sequence
  synthetic [barcode part1]
acacgttgacgtgttg

SEQ ID NO: 11441 - DNA, 16 bp, Artificial Sequence
  synthetic [barcode part1]
tgtgtgtcacagtacg

SEQ ID NO: 11442 - DNA, 16 bp, Artificial Sequence
  synthetic [barcode part1]
cacgacaccacctact

SEQ ID NO: 11443 - DNA, 16 bp, Artificial Sequence
  synthetic [barcode part1]
gatacaccgatcacac

SEQ ID NO: 11444 - DNA, 16 bp, Artificial Sequence
  synthetic [barcode part1]
tggcgtggaagtaacc

SEQ ID NO: 11445 - DNA, 16 bp, Artificial Sequence
  synthetic [barcode part1]
aggtcgtgaatcgtct

SEQ ID NO: 11446 - DNA, 16 bp, Artificial Sequence
  synthetic [barcode part1]
aggtctaagaccaggc

SEQ ID NO: 11447 - DNA, 16 bp, Artificial Sequence
  synthetic [barcode part1]
gtacgagataggaacg

SEQ ID NO: 11448 - DNA, 16 bp, Artificial Sequence
  synthetic [barcode part1]
ttgaagtcgaggcctt

SEQ ID NO: 11449 - DNA, 16 bp, Artificial Sequence
  synthetic [barcode part1]
tcaggagtgcagactg

SEQ ID NO: 11450 - DNA, 16 bp, Artificial Sequence
  synthetic [barcode part1]
cactgttgcctcttgt

SEQ ID NO: 11451 - DNA, 16 bp, Artificial Sequence
  synthetic [barcode part1]
accgataggcaacgac

SEQ ID NO: 11452 - DNA, 16 bp, Artificial Sequence
  synthetic [barcode part1]
ccttgtctgaacgtcg

SEQ ID NO: 11453 - DNA, 16 bp, Artificial Sequence
  synthetic [barcode part1]
aaccgtattaagaggc

SEQ ID NO: 11454 - DNA, 16 bp, Artificial Sequence
  synthetic [barcode part1]
agtgattcttcgcact

SEQ ID NO: 11455 - DNA, 16 bp, Artificial Sequence
  synthetic [barcode part1]
cagtcctgcactagtc

SEQ ID NO: 11456 - DNA, 16 bp, Artificial Sequence
  synthetic [barcode part1]
cgattggttctggagt

SEQ ID NO: 11457 - DNA, 16 bp, Artificial Sequence
  synthetic [barcode part1]
tcggtggtcgtatctc

SEQ ID NO: 11458 - DNA, 16 bp, Artificial Sequence
  synthetic [barcode part1]
gttacggacctgtcct

SEQ ID NO: 11459 - DNA, 16 bp, Artificial Sequence
  synthetic [barcode part1]
tacctcgaataggacc

SEQ ID NO: 11460 - DNA, 16 bp, Artificial Sequence
  synthetic [barcode part1]
gtgaatcgattcgtgc

SEQ ID NO: 11461 - DNA, 16 bp, Artificial Sequence
  synthetic [barcode part1]
tcagtggtccaacagt

SEQ ID NO: 11462 - DNA, 16 bp, Artificial Sequence
  synthetic [barcode part1]
cggtgtcctcacttag

SEQ ID NO: 11463 - DNA, 16 bp, Artificial Sequence
  synthetic [barcode part1]
atcgtacacactcgag

SEQ ID NO: 11464 - DNA, 16 bp, Artificial Sequence
  synthetic [barcode part1]
ttgtggacgaaggacc

SEQ ID NO: 11465 - DNA, 16 bp, Artificial Sequence
  synthetic [barcode part1]
aaggccaatactcaag

SEQ ID NO: 11466 - DNA, 16 bp, Artificial Sequence
  synthetic [barcode part1]
tctgcggaataggacg

SEQ ID NO: 11467 - DNA, 16 bp, Artificial Sequence
  synthetic [barcode part1]
agaaccgacgcctaag

SEQ ID NO: 11468 - DNA, 16 bp, Artificial Sequence
  synthetic [barcode part1]
cgcgaactatcacctc

SEQ ID NO: 11469 - DNA, 16 bp, Artificial Sequence
  synthetic [barcode part1]
cactgtctcgtgtgac

SEQ ID NO: 11470 - DNA, 16 bp, Artificial Sequence
  synthetic [barcode part1]
tgttcttgccgaattg

SEQ ID NO: 11471 - DNA, 16 bp, Artificial Sequence
  synthetic [barcode part1]
acgactactggccttc

SEQ ID NO: 11472 - DNA, 16 bp, Artificial Sequence
  synthetic [barcode part1]
acagaccgcgtaactt

SEQ ID NO: 11473 - DNA, 16 bp, Artificial Sequence
  synthetic [barcode part1]
tggcacgtcaatacac

SEQ ID NO: 11474 - DNA, 16 bp, Artificial Sequence
  synthetic [barcode part1]
atcaaccgaggaagag

SEQ ID NO: 11475 - DNA, 16 bp, Artificial Sequence
  synthetic [barcode part1]
acctctagtgatctgt

SEQ ID NO: 11476 - DNA, 16 bp, Artificial Sequence
  synthetic [barcode part1]
tcaagtcgtgttcttg

SEQ ID NO: 11477 - DNA, 16 bp, Artificial Sequence
  synthetic [barcode part1]
tcgcgtgcaattacag

SEQ ID NO: 11478 - DNA, 16 bp, Artificial Sequence
  synthetic [barcode part1]
gaatacctctgttgtc

SEQ ID NO: 11479 - DNA, 16 bp, Artificial Sequence
  synthetic [barcode part1]
actggttcgtacgtag

SEQ ID NO: 11480 - DNA, 16 bp, Artificial Sequence
  synthetic [barcode part1]
gcagtgaccgtgtaag

SEQ ID NO: 11481 - DNA, 16 bp, Artificial Sequence
  synthetic [barcode part1]
gagttgtgaacacaac

SEQ ID NO: 11482 - DNA, 16 bp, Artificial Sequence
  synthetic [barcode part1]
ttaaggacgacttccg

SEQ ID NO: 11483 - DNA, 16 bp, Artificial Sequence
  synthetic [barcode part1]
tggcggcaattatcgt

SEQ ID NO: 11484 - DNA, 16 bp, Artificial Sequence
  synthetic [barcode part1]
gtcctcagtctaatac

SEQ ID NO: 11485 - DNA, 16 bp, Artificial Sequence
  synthetic [barcode part1]
gtacttgcaggtactg

SEQ ID NO: 11486 - DNA, 16 bp, Artificial Sequence
  synthetic [barcode part1]
agaggtgtcactaggc

SEQ ID NO: 11487 - DNA, 16 bp, Artificial Sequence
  synthetic [barcode part1]
caaccaggttagtcgt

SEQ ID NO: 11488 - DNA, 16 bp, Artificial Sequence
  synthetic [barcode part1]
aggtctaaggtgttcc

SEQ ID NO: 11489 - DNA, 16 bp, Artificial Sequence
  synthetic [barcode part1]
ccacacttattgaacc

SEQ ID NO: 11490 - DNA, 16 bp, Artificial Sequence
  synthetic [barcode part1]
ccagacgcgttacttc

SEQ ID NO: 11491 - DNA, 16 bp, Artificial Sequence
  synthetic [barcode part1]
tctctggatacactac

SEQ ID NO: 11492 - DNA, 16 bp, Artificial Sequence
  synthetic [barcode part1]
ccttgtgttggattac

SEQ ID NO: 11493 - DNA, 16 bp, Artificial Sequence
  synthetic [barcode part1]
gaattcagtccggact

SEQ ID NO: 11494 - DNA, 16 bp, Artificial Sequence
  synthetic [barcode part1]
tgcaggttccgtcgtt

SEQ ID NO: 11495 - DNA, 16 bp, Artificial Sequence
  synthetic [barcode part1]
tactcttgactcaacg

SEQ ID NO: 11496 - DNA, 16 bp, Artificial Sequence
  synthetic [barcode part1]
cagtcctcacggttac

SEQ ID NO: 11497 - DNA, 16 bp, Artificial Sequence
  synthetic [barcode part1]
taccaacacgtgtcag

SEQ ID NO: 11498 - DNA, 16 bp, Artificial Sequence
  synthetic [barcode part1]
tggcgtgaatctgtac

SEQ ID NO: 11499 - DNA, 16 bp, Artificial Sequence
  synthetic [barcode part1]
tggttagatacgcacc

SEQ ID NO: 11500 - DNA, 16 bp, Artificial Sequence
  synthetic [barcode part1]
tcaggactattcgtct

SEQ ID NO: 11501 - DNA, 16 bp, Artificial Sequence
  synthetic [barcode part1]
gagtagagacgttgtt

SEQ ID NO: 11502 - DNA, 16 bp, Artificial Sequence
  synthetic [barcode part1]
tctctctccttgagac

SEQ ID NO: 11503 - DNA, 16 bp, Artificial Sequence
  synthetic [barcode part1]
gttctgaggagtcttg

SEQ ID NO: 11504 - DNA, 16 bp, Artificial Sequence
  synthetic [barcode part1]
accaacagtctaggtc

SEQ ID NO: 11505 - DNA, 16 bp, Artificial Sequence
  synthetic [barcode part1]
aacacctcctaatctg

SEQ ID NO: 11506 - DNA, 16 bp, Artificial Sequence
  synthetic [barcode part1]
atcctgaacactgcag

SEQ ID NO: 11507 - DNA, 16 bp, Artificial Sequence
  synthetic [barcode part1]
atctcttgaggtcgag

SEQ ID NO: 11508 - DNA, 16 bp, Artificial Sequence
  synthetic [barcode part1]
gatcgtggagaccagt

SEQ ID NO: 11509 - DNA, 16 bp, Artificial Sequence
  synthetic [barcode part1]
tctgagtcgtcttgcg

SEQ ID NO: 11510 - DNA, 16 bp, Artificial Sequence
  synthetic [barcode part1]
actacactcgagtgtg

SEQ ID NO: 11511 - DNA, 16 bp, Artificial Sequence
  synthetic [barcode part1]
cgtccgttccgagatt

SEQ ID NO: 11512 - DNA, 16 bp, Artificial Sequence
  synthetic [barcode part1]
cacagatacctgcaac

SEQ ID NO: 11513 - DNA, 16 bp, Artificial Sequence
  synthetic [barcode part1]
cggttgagaccaatct

SEQ ID NO: 11514 - DNA, 16 bp, Artificial Sequence
  synthetic [barcode part1]
cctcggtgagatagtt

SEQ ID NO: 11515 - DNA, 16 bp, Artificial Sequence
  synthetic [barcode part1]
attggtcttgaggtcg

SEQ ID NO: 11516 - DNA, 16 bp, Artificial Sequence
  synthetic [barcode part1]
cctatagtctgccgtg

SEQ ID NO: 11517 - DNA, 16 bp, Artificial Sequence
  synthetic [barcode part1]
ttatcacctcaggcgc

SEQ ID NO: 11518 - DNA, 16 bp, Artificial Sequence
  synthetic [barcode part1]
tcttagtgaccgcacc

SEQ ID NO: 11519 - DNA, 16 bp, Artificial Sequence
  synthetic [barcode part1]
aactctcaatctgcgt

SEQ ID NO: 11520 - DNA, 16 bp, Artificial Sequence
  synthetic [barcode part1]
gtgtggtcagtgtact

SEQ ID NO: 11521 - DNA, 16 bp, Artificial Sequence
  synthetic [barcode part1]
tgaagtacttgtggag

SEQ ID NO: 11522 - DNA, 16 bp, Artificial Sequence
  synthetic [barcode part1]
gcaggtaggataagtg

SEQ ID NO: 11523 - DNA, 16 bp, Artificial Sequence
  synthetic [barcode part1]
tcacgagttgccacct

SEQ ID NO: 11524 - DNA, 16 bp, Artificial Sequence
  synthetic [barcode part1]
gaatcggaatcggaag

SEQ ID NO: 11525 - DNA, 16 bp, Artificial Sequence
  synthetic [barcode part1]
aacctaacttctgcgt

SEQ ID NO: 11526 - DNA, 16 bp, Artificial Sequence
  synthetic [barcode part1]
tgttctaacttgcgac

SEQ ID NO: 11527 - DNA, 16 bp, Artificial Sequence
  synthetic [barcode part1]
cctgacttacgcagtc

SEQ ID NO: 11528 - DNA, 16 bp, Artificial Sequence
  synthetic [barcode part1]
aaggagatagttggcg

SEQ ID NO: 11529 - DNA, 16 bp, Artificial Sequence
  synthetic [barcode part1]
agactcagataacgac

SEQ ID NO: 11530 - DNA, 16 bp, Artificial Sequence
  synthetic [barcode part1]
ttgtggtgttgtggtg

SEQ ID NO: 11531 - DNA, 16 bp, Artificial Sequence
  synthetic [barcode part1]
aagtgttgcctgtggt

SEQ ID NO: 11532 - DNA, 16 bp, Artificial Sequence
  synthetic [barcode part1]
ccgcctctaattcttg

SEQ ID NO: 11533 - DNA, 16 bp, Artificial Sequence
  synthetic [barcode part1]
gactgtggttggtact

SEQ ID NO: 11534 - DNA, 16 bp, Artificial Sequence
  synthetic [barcode part1]
aaccgtgcgcaattgt

SEQ ID NO: 11535 - DNA, 16 bp, Artificial Sequence
  synthetic [barcode part1]
agttacgccaattctc

SEQ ID NO: 11536 - DNA, 16 bp, Artificial Sequence
  synthetic [barcode part1]
ttggaggtggtaagag

SEQ ID NO: 11537 - DNA, 16 bp, Artificial Sequence
  synthetic [barcode part1]
cgcacgtatatcacag

SEQ ID NO: 11538 - DNA, 16 bp, Artificial Sequence
  synthetic [barcode part1]
aaccgtgtctcgacct

SEQ ID NO: 11539 - DNA, 16 bp, Artificial Sequence
  synthetic [barcode part1]
tctgagaataccgcac

SEQ ID NO: 11540 - DNA, 16 bp, Artificial Sequence
  synthetic [barcode part1]
aatcgacctaatcggc

SEQ ID NO: 11541 - DNA, 16 bp, Artificial Sequence
  synthetic [barcode part1]
ccgttgttatcactcc

SEQ ID NO: 11542 - DNA, 16 bp, Artificial Sequence
  synthetic [barcode part1]
tggttctcctcgactt

SEQ ID NO: 11543 - DNA, 16 bp, Artificial Sequence
  synthetic [barcode part1]
tgcggaactggtaacg

SEQ ID NO: 11544 - DNA, 16 bp, Artificial Sequence
  synthetic [barcode part1]
aattaggaacgtaccg

SEQ ID NO: 11545 - DNA, 16 bp, Artificial Sequence
  synthetic [barcode part1]
atcgcggttcacctac

SEQ ID NO: 11546 - DNA, 16 bp, Artificial Sequence
  synthetic [barcode part1]
tctgccggacttgtgt

SEQ ID NO: 11547 - DNA, 16 bp, Artificial Sequence
  synthetic [barcode part1]
aagatctgtagacggt

SEQ ID NO: 11548 - DNA, 16 bp, Artificial Sequence
  synthetic [barcode part1]
ccactacagataacgc

SEQ ID NO: 11549 - DNA, 16 bp, Artificial Sequence
  synthetic [barcode part1]
aacgccgtggtattac

SEQ ID NO: 11550 - DNA, 16 bp, Artificial Sequence
  synthetic [barcode part1]
gttgcctaacgagatc

SEQ ID NO: 11551 - DNA, 16 bp, Artificial Sequence
  synthetic [barcode part1]
gcactaacttccaatc

SEQ ID NO: 11552 - DNA, 16 bp, Artificial Sequence
  synthetic [barcode part1]
gactcctagagattgc

SEQ ID NO: 11553 - DNA, 16 bp, Artificial Sequence
  synthetic [barcode part1]
tcactgacacaagaag

SEQ ID NO: 11554 - DNA, 16 bp, Artificial Sequence
  synthetic [barcode part1]
tcaccgtgacacttgc

SEQ ID NO: 11555 - DNA, 16 bp, Artificial Sequence
  synthetic [barcode part1]
cgaccgtattcaagtg

SEQ ID NO: 11556 - DNA, 16 bp, Artificial Sequence
  synthetic [barcode part1]
acgaatcgattacgcc

SEQ ID NO: 11557 - DNA, 16 bp, Artificial Sequence
  synthetic [barcode part1]
aattgaccgcggtgtt

SEQ ID NO: 11558 - DNA, 16 bp, Artificial Sequence
  synthetic [barcode part1]
gattcctgccactctt

SEQ ID NO: 11559 - DNA, 16 bp, Artificial Sequence
  synthetic [barcode part1]
gtgcgaagagttattg

SEQ ID NO: 11560 - DNA, 16 bp, Artificial Sequence
  synthetic [barcode part1]
gcgaggaccagtagtt

SEQ ID NO: 11561 - DNA, 16 bp, Artificial Sequence
  synthetic [barcode part1]
ttagttcggaccgaac

SEQ ID NO: 11562 - DNA, 16 bp, Artificial Sequence
  synthetic [barcode part1]
ttactctcggttctcg

SEQ ID NO: 11563 - DNA, 16 bp, Artificial Sequence
  synthetic [barcode part1]
actcgtccttaggacc

SEQ ID NO: 11564 - DNA, 16 bp, Artificial Sequence
  synthetic [barcode part1]
acctctccgcaatcag

SEQ ID NO: 11565 - DNA, 16 bp, Artificial Sequence
  synthetic [barcode part1]
cggtggtacgttcttc

SEQ ID NO: 11566 - DNA, 16 bp, Artificial Sequence
  synthetic [barcode part1]
aattgcacgcgtgact

SEQ ID NO: 11567 - DNA, 16 bp, Artificial Sequence
  synthetic [barcode part1]
agactcaggaccgaac

SEQ ID NO: 11568 - DNA, 16 bp, Artificial Sequence
  synthetic [barcode part1]
agaccgacttcctaag

SEQ ID NO: 11569 - DNA, 16 bp, Artificial Sequence
  synthetic [barcode part1]
gccagtgtatcctacc

SEQ ID NO: 11570 - DNA, 16 bp, Artificial Sequence
  synthetic [barcode part1]
tgacgcgtcttaccac

SEQ ID NO: 11571 - DNA, 16 bp, Artificial Sequence
  synthetic [barcode part1]
gtcacgacagaacctt

SEQ ID NO: 11572 - DNA, 16 bp, Artificial Sequence
  synthetic [barcode part1]
aggtcacggacgtagt

SEQ ID NO: 11573 - DNA, 16 bp, Artificial Sequence
  synthetic [barcode part1]
gcaagtgtatccgttg

SEQ ID NO: 11574 - DNA, 16 bp, Artificial Sequence
  synthetic [barcode part1]
ccaagacagtgtcgtt

SEQ ID NO: 11575 - DNA, 16 bp, Artificial Sequence
  synthetic [barcode part1]
taacaaggtcctgtcg

SEQ ID NO: 11576 - DNA, 16 bp, Artificial Sequence
  synthetic [barcode part1]
tccgagagagattcct

SEQ ID NO: 11577 - DNA, 16 bp, Artificial Sequence
  synthetic [barcode part1]
actacacggttacacg

SEQ ID NO: 11578 - DNA, 16 bp, Artificial Sequence
  synthetic [barcode part1]
caacacagaggcgatc

SEQ ID NO: 11579 - DNA, 16 bp, Artificial Sequence
  synthetic [barcode part1]
ttcgcgttacaccttc

SEQ ID NO: 11580 - DNA, 16 bp, Artificial Sequence
  synthetic [barcode part1]
cgtgtgatactctgtt

SEQ ID NO: 11581 - DNA, 16 bp, Artificial Sequence
  synthetic [barcode part1]
tcctacctattcagag

SEQ ID NO: 11582 - DNA, 16 bp, Artificial Sequence
  synthetic [barcode part1]
tctcgcagtattctcc

SEQ ID NO: 11583 - DNA, 16 bp, Artificial Sequence
  synthetic [barcode part1]
ccgcgcctaagttact

SEQ ID NO: 11584 - DNA, 16 bp, Artificial Sequence
  synthetic [barcode part1]
gccttaacaactggtg

SEQ ID NO: 11585 - DNA, 16 bp, Artificial Sequence
  synthetic [barcode part1]
tctaccgttgagtgcc

SEQ ID NO: 11586 - DNA, 16 bp, Artificial Sequence
  synthetic [barcode part1]
tcctcgagtgtatcgc

SEQ ID NO: 11587 - DNA, 16 bp, Artificial Sequence
  synthetic [barcode part1]
ccttcgaagtcaagac

SEQ ID NO: 11588 - DNA, 16 bp, Artificial Sequence
  synthetic [barcode part1]
tcgcgtggagagattg

SEQ ID NO: 11589 - DNA, 16 bp, Artificial Sequence
  synthetic [barcode part1]
acttccaggtgtgagt

SEQ ID NO: 11590 - DNA, 16 bp, Artificial Sequence
  synthetic [barcode part1]
gtggatcaagacagtt

SEQ ID NO: 11591 - DNA, 16 bp, Artificial Sequence
  synthetic [barcode part1]
gttctgatcgactgag

SEQ ID NO: 11592 - DNA, 16 bp, Artificial Sequence
  synthetic [barcode part1]
gtcggtaagacacctt

SEQ ID NO: 11593 - DNA, 16 bp, Artificial Sequence
  synthetic [barcode part1]
agtccttgtcgagagt

SEQ ID NO: 11594 - DNA, 16 bp, Artificial Sequence
  synthetic [barcode part1]
ccttggtcagtaagac

SEQ ID NO: 11595 - DNA, 16 bp, Artificial Sequence
  synthetic [barcode part1]
gacaacgagacttgcg

SEQ ID NO: 11596 - DNA, 16 bp, Artificial Sequence
  synthetic [barcode part1]
gtgtaatcggcacact

SEQ ID NO: 11597 - DNA, 16 bp, Artificial Sequence
  synthetic [barcode part1]
ccttgtcgacgttcag

SEQ ID NO: 11598 - DNA, 16 bp, Artificial Sequence
  synthetic [barcode part1]
cacgtagaggtgttct

SEQ ID NO: 11599 - DNA, 16 bp, Artificial Sequence
  synthetic [barcode part1]
cggtaccaagtaggtg

SEQ ID NO: 11600 - DNA, 16 bp, Artificial Sequence
  synthetic [barcode part1]
tcggtagtggatcgtt

SEQ ID NO: 11601 - DNA, 16 bp, Artificial Sequence
  synthetic [barcode part1]
ttgcacagtactgacg

SEQ ID NO: 11602 - DNA, 16 bp, Artificial Sequence
  synthetic [barcode part1]
cgtctcgagtggaatt

SEQ ID NO: 11603 - DNA, 16 bp, Artificial Sequence
  synthetic [barcode part1]
aagagtgcagagacgt

SEQ ID NO: 11604 - DNA, 16 bp, Artificial Sequence
  synthetic [barcode part1]
ccagtctacctggatc

SEQ ID NO: 11605 - DNA, 16 bp, Artificial Sequence
  synthetic [barcode part1]
taactccacactgact

SEQ ID NO: 11606 - DNA, 16 bp, Artificial Sequence
  synthetic [barcode part1]
tcgatccgaatattcc

SEQ ID NO: 11607 - DNA, 16 bp, Artificial Sequence
  synthetic [barcode part1]
gatcaggtcactactg

SEQ ID NO: 11608 - DNA, 16 bp, Artificial Sequence
  synthetic [barcode part1]
taggtcggaagatact

SEQ ID NO: 11609 - DNA, 16 bp, Artificial Sequence
  synthetic [barcode part1]
tacctgagacttgcag

SEQ ID NO: 11610 - DNA, 16 bp, Artificial Sequence
  synthetic [barcode part1]
tggcaagttgtggacg

SEQ ID NO: 11611 - DNA, 16 bp, Artificial Sequence
  synthetic [barcode part1]
gcgtacgttcttcttc

SEQ ID NO: 11612 - DNA, 16 bp, Artificial Sequence
  synthetic [barcode part1]
aactgaatcgtacgag

SEQ ID NO: 11613 - DNA, 16 bp, Artificial Sequence
  synthetic [barcode part1]
tggacgaggtagatag

SEQ ID NO: 11614 - DNA, 16 bp, Artificial Sequence
  synthetic [barcode part1]
acaccgagagacaatt

SEQ ID NO: 11615 - DNA, 16 bp, Artificial Sequence
  synthetic [barcode part1]
gatcgcagaccagagt

SEQ ID NO: 11616 - DNA, 16 bp, Artificial Sequence
  synthetic [barcode part1]
tgccggtggaatcaag

SEQ ID NO: 11617 - DNA, 16 bp, Artificial Sequence
  synthetic [barcode part1]
aggcaactacgttaag

SEQ ID NO: 11618 - DNA, 16 bp, Artificial Sequence
  synthetic [barcode part1]
tgatcctggtcgaagt

SEQ ID NO: 11619 - DNA, 16 bp, Artificial Sequence
  synthetic [barcode part1]
cagtaggttacaagtg

SEQ ID NO: 11620 - DNA, 16 bp, Artificial Sequence
  synthetic [barcode part1]
ttcaggaagttctggc

SEQ ID NO: 11621 - DNA, 16 bp, Artificial Sequence
  synthetic [barcode part1]
cagttgtagacgttcg

SEQ ID NO: 11622 - DNA, 16 bp, Artificial Sequence
  synthetic [barcode part1]
acactctccttgcact

SEQ ID NO: 11623 - DNA, 16 bp, Artificial Sequence
  synthetic [barcode part1]
ccaattggaagtcctg

SEQ ID NO: 11624 - DNA, 16 bp, Artificial Sequence
  synthetic [barcode part1]
gtactagaaccacgtc

SEQ ID NO: 11625 - DNA, 16 bp, Artificial Sequence
  synthetic [barcode part1]
tacctccttaacaacg

SEQ ID NO: 11626 - DNA, 16 bp, Artificial Sequence
  synthetic [barcode part1]
ccttcctaccgattgt

SEQ ID NO: 11627 - DNA, 16 bp, Artificial Sequence
  synthetic [barcode part1]
agaacttacgacgcct

SEQ ID NO: 11628 - DNA, 16 bp, Artificial Sequence
  synthetic [barcode part1]
gcgagttcttccaatt

SEQ ID NO: 11629 - DNA, 16 bp, Artificial Sequence
  synthetic [barcode part1]
ccaagactacttacct

SEQ ID NO: 11630 - DNA, 16 bp, Artificial Sequence
  synthetic [barcode part1]
cacgtcctgccgaatt

SEQ ID NO: 11631 - DNA, 16 bp, Artificial Sequence
  synthetic [barcode part1]
atcctacctactgcct

SEQ ID NO: 11632 - DNA, 16 bp, Artificial Sequence
  synthetic [barcode part1]
cgaccgtagtggtaag

SEQ ID NO: 11633 - DNA, 16 bp, Artificial Sequence
  synthetic [barcode part1]
tccggagttggttaac

SEQ ID NO: 11634 - DNA, 16 bp, Artificial Sequence
  synthetic [barcode part1]
cgtggcaataggcaac

SEQ ID NO: 11635 - DNA, 16 bp, Artificial Sequence
  synthetic [barcode part1]
ccacctgtggaactct

SEQ ID NO: 11636 - DNA, 16 bp, Artificial Sequence
  synthetic [barcode part1]
ttggtcctactaacac

SEQ ID NO: 11637 - DNA, 16 bp, Artificial Sequence
  synthetic [barcode part1]
acttaggcaaggcgac

SEQ ID NO: 11638 - DNA, 16 bp, Artificial Sequence
  synthetic [barcode part1]
cggaattggttgatcc

SEQ ID NO: 11639 - DNA, 16 bp, Artificial Sequence
  synthetic [barcode part1]
ccgagactctatccac

SEQ ID NO: 11640 - DNA, 16 bp, Artificial Sequence
  synthetic [barcode part1]
gacttctgtgtctagt

SEQ ID NO: 11641 - DNA, 16 bp, Artificial Sequence
  synthetic [barcode part1]
tctcctgcctgtagag

SEQ ID NO: 11642 - DNA, 16 bp, Artificial Sequence
  synthetic [barcode part1]
gtgttaggcgtctaac

SEQ ID NO: 11643 - DNA, 16 bp, Artificial Sequence
  synthetic [barcode part1]
cacgttaaggaccgag

SEQ ID NO: 11644 - DNA, 16 bp, Artificial Sequence
  synthetic [barcode part1]
tggttgtccgttaccg

SEQ ID NO: 11645 - DNA, 16 bp, Artificial Sequence
  synthetic [barcode part1]
actacacctcctgacg

SEQ ID NO: 11646 - DNA, 16 bp, Artificial Sequence
  synthetic [barcode part1]
gttaccttgtctgagt

SEQ ID NO: 11647 - DNA, 16 bp, Artificial Sequence
  synthetic [barcode part1]
ttggtggttcgtatct

SEQ ID NO: 11648 - DNA, 16 bp, Artificial Sequence
  synthetic [barcode part1]
gaggcgcagaatatag

SEQ ID NO: 11649 - DNA, 16 bp, Artificial Sequence
  synthetic [barcode part1]
tgcggactcgttctac

SEQ ID NO: 11650 - DNA, 16 bp, Artificial Sequence
  synthetic [barcode part1]
tcaccaatcagaccag

SEQ ID NO: 11651 - DNA, 16 bp, Artificial Sequence
  synthetic [barcode part1]
gtgaagaaccaagtct

SEQ ID NO: 11652 - DNA, 16 bp, Artificial Sequence
  synthetic [barcode part1]
cggacctactctactg

SEQ ID NO: 11653 - DNA, 16 bp, Artificial Sequence
  synthetic [barcode part1]
tggattgttccgcacc

SEQ ID NO: 11654 - DNA, 16 bp, Artificial Sequence
  synthetic [barcode part1]
agttgaaggtgtgccg

SEQ ID NO: 11655 - DNA, 16 bp, Artificial Sequence
  synthetic [barcode part1]
gtcgacagtgatcact

SEQ ID NO: 11656 - DNA, 16 bp, Artificial Sequence
  synthetic [barcode part1]
gttgacgtaccagtgt

SEQ ID NO: 11657 - DNA, 16 bp, Artificial Sequence
  synthetic [barcode part1]
aggttgtgagtcgttc

SEQ ID NO: 11658 - DNA, 16 bp, Artificial Sequence
  synthetic [barcode part1]
agatagaactctaggc

SEQ ID NO: 11659 - DNA, 16 bp, Artificial Sequence
  synthetic [barcode part1]
ttcgtactacggaggt

SEQ ID NO: 11660 - DNA, 16 bp, Artificial Sequence
  synthetic [barcode part1]
gttcaggagtatccgt

SEQ ID NO: 11661 - DNA, 16 bp, Artificial Sequence
  synthetic [barcode part1]
gtctcacttcgtaggc

SEQ ID NO: 11662 - DNA, 16 bp, Artificial Sequence
  synthetic [barcode part1]
acggaggtatactcct

SEQ ID NO: 11663 - DNA, 16 bp, Artificial Sequence
  synthetic [barcode part1]
aagtagagataccacc

SEQ ID NO: 11664 - DNA, 16 bp, Artificial Sequence
  synthetic [barcode part1]
agtgcgagttcgacag

SEQ ID NO: 11665 - DNA, 16 bp, Artificial Sequence
  synthetic [barcode part1]
tcacagacaccttgcc

SEQ ID NO: 11666 - DNA, 16 bp, Artificial Sequence
  synthetic [barcode part1]
cgagtcacaacgactt

SEQ ID NO: 11667 - DNA, 16 bp, Artificial Sequence
  synthetic [barcode part1]
agtccgatcctcgtgt

SEQ ID NO: 11668 - DNA, 16 bp, Artificial Sequence
  synthetic [barcode part1]
tcttcggaacttcctc

SEQ ID NO: 11669 - DNA, 16 bp, Artificial Sequence
  synthetic [barcode part1]
tgtccacgtgaacaac

SEQ ID NO: 11670 - DNA, 16 bp, Artificial Sequence
  synthetic [barcode part1]
ttgtgcagatcaagag

SEQ ID NO: 11671 - DNA, 16 bp, Artificial Sequence
  synthetic [barcode part1]
aattcaagaccaccgc

SEQ ID NO: 11672 - DNA, 16 bp, Artificial Sequence
  synthetic [barcode part1]
cagacacgactacgtt

SEQ ID NO: 11673 - DNA, 16 bp, Artificial Sequence
  synthetic [barcode part1]
tcgttccttgaatacg

SEQ ID NO: 11674 - DNA, 16 bp, Artificial Sequence
  synthetic [barcode part1]
actagaccagatcacc

SEQ ID NO: 11675 - DNA, 16 bp, Artificial Sequence
  synthetic [barcode part1]
tgtatctcagaggtgc

SEQ ID NO: 11676 - DNA, 16 bp, Artificial Sequence
  synthetic [barcode part1]
tacttgttggaacctc

SEQ ID NO: 11677 - DNA, 16 bp, Artificial Sequence
  synthetic [barcode part1]
cgccgaacttacgttc

SEQ ID NO: 11678 - DNA, 16 bp, Artificial Sequence
  synthetic [barcode part1]
aggacttggcgagtac

SEQ ID NO: 11679 - DNA, 16 bp, Artificial Sequence
  synthetic [barcode part1]
gtcacaggtgacactt

SEQ ID NO: 11680 - DNA, 16 bp, Artificial Sequence
  synthetic [barcode part1]
gtgcacacagtgttgt

SEQ ID NO: 11681 - DNA, 16 bp, Artificial Sequence
  synthetic [barcode part1]
taggtataccgaaggt

SEQ ID NO: 11682 - DNA, 16 bp, Artificial Sequence
  synthetic [barcode part1]
actcagacttagacgc

SEQ ID NO: 11683 - DNA, 16 bp, Artificial Sequence
  synthetic [barcode part1]
cgttaggttcacgcct

SEQ ID NO: 11684 - DNA, 16 bp, Artificial Sequence
  synthetic [barcode part1]
tacaggtaataaggcc

SEQ ID NO: 11685 - DNA, 16 bp, Artificial Sequence
  synthetic [barcode part1]
gacttcctaactcctc

SEQ ID NO: 11686 - DNA, 16 bp, Artificial Sequence
  synthetic [barcode part1]
acgatcgagaatcagt

SEQ ID NO: 11687 - DNA, 16 bp, Artificial Sequence
  synthetic [barcode part1]
aacacacaccagtacc

SEQ ID NO: 11688 - DNA, 16 bp, Artificial Sequence
  synthetic [barcode part1]
tcctgacgacttgcac

SEQ ID NO: 11689 - DNA, 16 bp, Artificial Sequence
  synthetic [barcode part1]
atcttcactatcaggc

SEQ ID NO: 11690 - DNA, 16 bp, Artificial Sequence
  synthetic [barcode part1]
gtcagtacactccgtc

SEQ ID NO: 11691 - DNA, 16 bp, Artificial Sequence
  synthetic [barcode part1]
cgagatccagtactgt

SEQ ID NO: 11692 - DNA, 16 bp, Artificial Sequence
  synthetic [barcode part1]
gtcagtggagttaagt

SEQ ID NO: 11693 - DNA, 16 bp, Artificial Sequence
  synthetic [barcode part1]
aaccgtacgtagtcac

SEQ ID NO: 11694 - DNA, 16 bp, Artificial Sequence
  synthetic [barcode part1]
aaggacggtaatctac

SEQ ID NO: 11695 - DNA, 16 bp, Artificial Sequence
  synthetic [barcode part1]
aacacacacaccagtc

SEQ ID NO: 11696 - DNA, 16 bp, Artificial Sequence
  synthetic [barcode part1]
cacggtacctgttcgt

SEQ ID NO: 11697 - DNA, 16 bp, Artificial Sequence
  synthetic [barcode part1]
tgcgaagaactgttag

SEQ ID NO: 11698 - DNA, 16 bp, Artificial Sequence
  synthetic [barcode part1]
ccgaagtgttctaggt

SEQ ID NO: 11699 - DNA, 16 bp, Artificial Sequence
  synthetic [barcode part1]
tgcgcgtcaattaacg

SEQ ID NO: 11700 - DNA, 16 bp, Artificial Sequence
  synthetic [barcode part1]
gaacaatagagtggcg

SEQ ID NO: 11701 - DNA, 16 bp, Artificial Sequence
  synthetic [barcode part1]
gaattgaccgactctg

SEQ ID NO: 11702 - DNA, 16 bp, Artificial Sequence
  synthetic [barcode part1]
tgtcagagagtgtaac

SEQ ID NO: 11703 - DNA, 16 bp, Artificial Sequence
  synthetic [barcode part1]
gtctgatcaatccgag

SEQ ID NO: 11704 - DNA, 16 bp, Artificial Sequence
  synthetic [barcode part1]
gacagagtgatccttc

SEQ ID NO: 11705 - DNA, 16 bp, Artificial Sequence
  synthetic [barcode part1]
cacagtgcaaggttct

SEQ ID NO: 11706 - DNA, 16 bp, Artificial Sequence
  synthetic [barcode part1]
atcgtggtcgtctatt

SEQ ID NO: 11707 - DNA, 16 bp, Artificial Sequence
  synthetic [barcode part1]
cgcacgattgttattc

SEQ ID NO: 11708 - DNA, 16 bp, Artificial Sequence
  synthetic [barcode part1]
gtgtgtactggtcaac

SEQ ID NO: 11709 - DNA, 16 bp, Artificial Sequence
  synthetic [barcode part1]
tgactggattgcgact

SEQ ID NO: 11710 - DNA, 16 bp, Artificial Sequence
  synthetic [barcode part1]
gagagacttacgtggc

SEQ ID NO: 11711 - DNA, 16 bp, Artificial Sequence
  synthetic [barcode part1]
tgcgtatccgatcaag

SEQ ID NO: 11712 - DNA, 16 bp, Artificial Sequence
  synthetic [barcode part1]
tgaggagatcggtacc

SEQ ID NO: 11713 - DNA, 16 bp, Artificial Sequence
  synthetic [barcode part1]
tagtctgcactaggtg

SEQ ID NO: 11714 - DNA, 16 bp, Artificial Sequence
  synthetic [barcode part1]
acagaccgcacaatct

SEQ ID NO: 11715 - DNA, 16 bp, Artificial Sequence
  synthetic [barcode part1]
gatacggttattggag

SEQ ID NO: 11716 - DNA, 16 bp, Artificial Sequence
  synthetic [barcode part1]
tccttctaccacaacc

SEQ ID NO: 11717 - DNA, 16 bp, Artificial Sequence
  synthetic [barcode part1]
gtcaacgtacttcgtt

SEQ ID NO: 11718 - DNA, 16 bp, Artificial Sequence
  synthetic [barcode part1]
gcgcgataagaagtcc

SEQ ID NO: 11719 - DNA, 16 bp, Artificial Sequence
  synthetic [barcode part1]
gactgtagtatcggtc

SEQ ID NO: 11720 - DNA, 16 bp, Artificial Sequence
  synthetic [barcode part1]
tgcaagttcgtggatc

SEQ ID NO: 11721 - DNA, 16 bp, Artificial Sequence
  synthetic [barcode part1]
ttataccgacgtaggc

SEQ ID NO: 11722 - DNA, 16 bp, Artificial Sequence
  synthetic [barcode part1]
agtgatcaaccgtcac

SEQ ID NO: 11723 - DNA, 16 bp, Artificial Sequence
  synthetic [barcode part1]
cgttaggtatcttcgt

SEQ ID NO: 11724 - DNA, 16 bp, Artificial Sequence
  synthetic [barcode part1]
ccggaattccaaggtt

SEQ ID NO: 11725 - DNA, 16 bp, Artificial Sequence
  synthetic [barcode part1]
aattcctagttgtgcc

SEQ ID NO: 11726 - DNA, 16 bp, Artificial Sequence
  synthetic [barcode part1]
acactgtggacgagtg

SEQ ID NO: 11727 - DNA, 16 bp, Artificial Sequence
  synthetic [barcode part1]
aaggtcgatacgaccg

SEQ ID NO: 11728 - DNA, 16 bp, Artificial Sequence
  synthetic [barcode part1]
tctctcgttgttgtcg

SEQ ID NO: 11729 - DNA, 16 bp, Artificial Sequence
  synthetic [barcode part1]
cgcacacggttaattg

SEQ ID NO: 11730 - DNA, 16 bp, Artificial Sequence
  synthetic [barcode part1]
gtccacgtctctaacg

SEQ ID NO: 11731 - DNA, 16 bp, Artificial Sequence
  synthetic [barcode part1]
cggtcgaatcgtaatc

SEQ ID NO: 11732 - DNA, 16 bp, Artificial Sequence
  synthetic [barcode part1]
gatcctagttctggag

SEQ ID NO: 11733 - DNA, 16 bp, Artificial Sequence
  synthetic [barcode part1]
atactagtgacctcct

SEQ ID NO: 11734 - DNA, 16 bp, Artificial Sequence
  synthetic [barcode part1]
gcagttagagagattc

SEQ ID NO: 11735 - DNA, 16 bp, Artificial Sequence
  synthetic [barcode part1]
agaggtgtctggcaac

SEQ ID NO: 11736 - DNA, 16 bp, Artificial Sequence
  synthetic [barcode part1]
ttaactcgtggttgtc

SEQ ID NO: 11737 - DNA, 16 bp, Artificial Sequence
  synthetic [barcode part1]
tatcgttcttgcagac

SEQ ID NO: 11738 - DNA, 16 bp, Artificial Sequence
  synthetic [barcode part1]
gcgccaggttactctt

SEQ ID NO: 11739 - DNA, 16 bp, Artificial Sequence
  synthetic [barcode part1]
aatcaatcggtcggtc

SEQ ID NO: 11740 - DNA, 16 bp, Artificial Sequence
  synthetic [barcode part1]
acttcacggactgagt

SEQ ID NO: 11741 - DNA, 16 bp, Artificial Sequence
  synthetic [barcode part1]
tgcaacagatagacac

SEQ ID NO: 11742 - DNA, 16 bp, Artificial Sequence
  synthetic [barcode part1]
caccagaatcttcgtt

SEQ ID NO: 11743 - DNA, 16 bp, Artificial Sequence
  synthetic [barcode part1]
atccaactgacctgag

SEQ ID NO: 11744 - DNA, 16 bp, Artificial Sequence
  synthetic [barcode part1]
cgttagacggaggtac

SEQ ID NO: 11745 - DNA, 16 bp, Artificial Sequence
  synthetic [barcode part1]
tcacacaacgtaccag

SEQ ID NO: 11746 - DNA, 16 bp, Artificial Sequence
  synthetic [barcode part1]
gcctgtgatcgaagag

SEQ ID NO: 11747 - DNA, 16 bp, Artificial Sequence
  synthetic [barcode part1]
ttgttaactccacgtg

SEQ ID NO: 11748 - DNA, 16 bp, Artificial Sequence
  synthetic [barcode part1]
caagatcttggccaac

SEQ ID NO: 11749 - DNA, 16 bp, Artificial Sequence
  synthetic [barcode part1]
acagacctcggatact

SEQ ID NO: 11750 - DNA, 16 bp, Artificial Sequence
  synthetic [barcode part1]
tcgtgaactacgcaac

SEQ ID NO: 11751 - DNA, 16 bp, Artificial Sequence
  synthetic [barcode part1]
tctctgagtcaacgtt

SEQ ID NO: 11752 - DNA, 16 bp, Artificial Sequence
  synthetic [barcode part1]
agttcagttggaccac

SEQ ID NO: 11753 - DNA, 16 bp, Artificial Sequence
  synthetic [barcode part1]
atctcgttcgttgcct

SEQ ID NO: 11754 - DNA, 16 bp, Artificial Sequence
  synthetic [barcode part1]
tggccggtggttaatt

SEQ ID NO: 11755 - DNA, 16 bp, Artificial Sequence
  synthetic [barcode part1]
tgaacgccacgaatct

SEQ ID NO: 11756 - DNA, 16 bp, Artificial Sequence
  synthetic [barcode part1]
actatctcaaggcgac

SEQ ID NO: 11757 - DNA, 16 bp, Artificial Sequence
  synthetic [barcode part1]
taccagaggtacggac

SEQ ID NO: 11758 - DNA, 16 bp, Artificial Sequence
  synthetic [barcode part1]
agtacactggtgtgtc

SEQ ID NO: 11759 - DNA, 16 bp, Artificial Sequence
  synthetic [barcode part1]
taaggaatagtgtgcc

SEQ ID NO: 11760 - DNA, 16 bp, Artificial Sequence
  synthetic [barcode part1]
gactcaactcttgtac

SEQ ID NO: 11761 - DNA, 16 bp, Artificial Sequence
  synthetic [barcode part1]
tcgataaccgtacctt

SEQ ID NO: 11762 - DNA, 16 bp, Artificial Sequence
  synthetic [barcode part1]
ttccagaccgttcgtg

SEQ ID NO: 11763 - DNA, 16 bp, Artificial Sequence
  synthetic [barcode part1]
actcaggttcgttgtt

SEQ ID NO: 11764 - DNA, 16 bp, Artificial Sequence
  synthetic [barcode part1]
aatagttcgtgccttc

SEQ ID NO: 11765 - DNA, 16 bp, Artificial Sequence
  synthetic [barcode part1]
taagtgccggtcttcc

SEQ ID NO: 11766 - DNA, 16 bp, Artificial Sequence
  synthetic [barcode part1]
gattgcgccttggtct

SEQ ID NO: 11767 - DNA, 16 bp, Artificial Sequence
  synthetic [barcode part1]
cgaacaccagtgaggt

SEQ ID NO: 11768 - DNA, 16 bp, Artificial Sequence
  synthetic [barcode part1]
agtacgtgttgtgtgc

SEQ ID NO: 11769 - DNA, 16 bp, Artificial Sequence
  synthetic [barcode part1]
tggaaggaatctcctc

SEQ ID NO: 11770 - DNA, 16 bp, Artificial Sequence
  synthetic [barcode part1]
aagttgccttgtgttc

SEQ ID NO: 11771 - DNA, 16 bp, Artificial Sequence
  synthetic [barcode part1]
tgtcgatctagtcttg

SEQ ID NO: 11772 - DNA, 16 bp, Artificial Sequence
  synthetic [barcode part1]
tcgattcgcaactgtt

SEQ ID NO: 11773 - DNA, 16 bp, Artificial Sequence
  synthetic [barcode part1]
gaagatacactagacc

SEQ ID NO: 11774 - DNA, 16 bp, Artificial Sequence
  synthetic [barcode part1]
gcaactatctcctaac

SEQ ID NO: 11775 - DNA, 16 bp, Artificial Sequence
  synthetic [barcode part1]
cctaacttggcgcact

SEQ ID NO: 11776 - DNA, 16 bp, Artificial Sequence
  synthetic [barcode part1]
gttgaacagacgtaac

SEQ ID NO: 11777 - DNA, 16 bp, Artificial Sequence
  synthetic [barcode part1]
tctggtcttccgattc

SEQ ID NO: 11778 - DNA, 16 bp, Artificial Sequence
  synthetic [barcode part1]
cgttggacgaatcgtt

SEQ ID NO: 11779 - DNA, 16 bp, Artificial Sequence
  synthetic [barcode part1]
gcgattgccagagagt

SEQ ID NO: 11780 - DNA, 16 bp, Artificial Sequence
  synthetic [barcode part1]
tgttagatcacgcctt

SEQ ID NO: 11781 - DNA, 16 bp, Artificial Sequence
  synthetic [barcode part1]
cacaacacgttgcaac

SEQ ID NO: 11782 - DNA, 16 bp, Artificial Sequence
  synthetic [barcode part1]
gttggcagtctagact

SEQ ID NO: 11783 - DNA, 16 bp, Artificial Sequence
  synthetic [barcode part1]
actcgttactccaagt

SEQ ID NO: 11784 - DNA, 16 bp, Artificial Sequence
  synthetic [barcode part1]
aacctctcgcaccagt

SEQ ID NO: 11785 - DNA, 16 bp, Artificial Sequence
  synthetic [barcode part1]
tgttatctactgacgc

SEQ ID NO: 11786 - DNA, 16 bp, Artificial Sequence
  synthetic [barcode part1]
acggcggttacgtaag

SEQ ID NO: 11787 - DNA, 16 bp, Artificial Sequence
  synthetic [barcode part1]
gtcctcagttcctatc

SEQ ID NO: 11788 - DNA, 16 bp, Artificial Sequence
  synthetic [barcode part1]
aggtatcggattcgtc

SEQ ID NO: 11789 - DNA, 16 bp, Artificial Sequence
  synthetic [barcode part1]
tgttaagacctccgtt

SEQ ID NO: 11790 - DNA, 16 bp, Artificial Sequence
  synthetic [barcode part1]
cgcaggtctattctgc

SEQ ID NO: 11791 - DNA, 16 bp, Artificial Sequence
  synthetic [barcode part1]
gtatcttaaccaccac

SEQ ID NO: 11792 - DNA, 16 bp, Artificial Sequence
  synthetic [barcode part1]
accgtggaagtagacc

SEQ ID NO: 11793 - DNA, 16 bp, Artificial Sequence
  synthetic [barcode part1]
ttggagttaggcggac

SEQ ID NO: 11794 - DNA, 16 bp, Artificial Sequence
  synthetic [barcode part1]
aatcttcttagtgcgc

SEQ ID NO: 11795 - DNA, 16 bp, Artificial Sequence
  synthetic [barcode part1]
cgacacaagaacaact

SEQ ID NO: 11796 - DNA, 16 bp, Artificial Sequence
  synthetic [barcode part1]
tgtacggttgccgtct

SEQ ID NO: 11797 - DNA, 16 bp, Artificial Sequence
  synthetic [barcode part1]
aggcactactctatct

SEQ ID NO: 11798 - DNA, 16 bp, Artificial Sequence
  synthetic [barcode part1]
cggcaataaggcgtgt

SEQ ID NO: 11799 - DNA, 16 bp, Artificial Sequence
  synthetic [barcode part1]
taagtatccttaccgc

SEQ ID NO: 11800 - DNA, 16 bp, Artificial Sequence
  synthetic [barcode part1]
accaatactgccactt

SEQ ID NO: 11801 - DNA, 16 bp, Artificial Sequence
  synthetic [barcode part1]
atatcgaggccgtact

SEQ ID NO: 11802 - DNA, 16 bp, Artificial Sequence
  synthetic [barcode part1]
tccggtcttgactctt

SEQ ID NO: 11803 - DNA, 16 bp, Artificial Sequence
  synthetic [barcode part1]
ccgtacgtcgaagaag

SEQ ID NO: 11804 - DNA, 16 bp, Artificial Sequence
  synthetic [barcode part1]
cgcgactgtacttaag

SEQ ID NO: 11805 - DNA, 16 bp, Artificial Sequence
  synthetic [barcode part1]
cgtaacagaatctcgc

SEQ ID NO: 11806 - DNA, 16 bp, Artificial Sequence
  synthetic [barcode part1]
atcgtaacgaggtcct

SEQ ID NO: 11807 - DNA, 16 bp, Artificial Sequence
  synthetic [barcode part1]
tcgcgtcaatacgagt

SEQ ID NO: 11808 - DNA, 16 bp, Artificial Sequence
  synthetic [barcode part1]
gtcgcggagtgttatt

SEQ ID NO: 11809 - DNA, 16 bp, Artificial Sequence
  synthetic [barcode part1]
acgttccgattatcac

SEQ ID NO: 11810 - DNA, 16 bp, Artificial Sequence
  synthetic [barcode part1]
attgcggtggaacctt

SEQ ID NO: 11811 - DNA, 16 bp, Artificial Sequence
  synthetic [barcode part1]
tatagaggtcgaatcg

SEQ ID NO: 11812 - DNA, 16 bp, Artificial Sequence
  synthetic [barcode part1]
gacttgaccgaactac

SEQ ID NO: 11813 - DNA, 16 bp, Artificial Sequence
  synthetic [barcode part1]
cgaccttgaagagttc

SEQ ID NO: 11814 - DNA, 16 bp, Artificial Sequence
  synthetic [barcode part1]
tccacaaggtggagtg

SEQ ID NO: 11815 - DNA, 16 bp, Artificial Sequence
  synthetic [barcode part1]
ccaatcacggttagtg

SEQ ID NO: 11816 - DNA, 16 bp, Artificial Sequence
  synthetic [barcode part1]
gtaacacgaggagaac

SEQ ID NO: 11817 - DNA, 16 bp, Artificial Sequence
  synthetic [barcode part1]
ttctggtacgtggcct

SEQ ID NO: 11818 - DNA, 16 bp, Artificial Sequence
  synthetic [barcode part1]
gcagttggttgtgtgt

SEQ ID NO: 11819 - DNA, 16 bp, Artificial Sequence
  synthetic [barcode part1]
cagtagtgagagtatc

SEQ ID NO: 11820 - DNA, 16 bp, Artificial Sequence
  synthetic [barcode part1]
aggtagacactacagt

SEQ ID NO: 11821 - DNA, 16 bp, Artificial Sequence
  synthetic [barcode part1]
gccacctaacagaact

SEQ ID NO: 11822 - DNA, 16 bp, Artificial Sequence
  synthetic [barcode part1]
tccgtctctacttgtg

SEQ ID NO: 11823 - DNA, 16 bp, Artificial Sequence
  synthetic [barcode part1]
cgtaacttgcgaatcg

SEQ ID NO: 11824 - DNA, 16 bp, Artificial Sequence
  synthetic [barcode part1]
ttccgtattggcaact

SEQ ID NO: 11825 - DNA, 16 bp, Artificial Sequence
  synthetic [barcode part1]
accttgaccgagattg

SEQ ID NO: 11826 - DNA, 16 bp, Artificial Sequence
  synthetic [barcode part1]
tctacgtcggcgactt

SEQ ID NO: 11827 - DNA, 16 bp, Artificial Sequence
  synthetic [barcode part1]
aagtggcgttacttcg

SEQ ID NO: 11828 - DNA, 16 bp, Artificial Sequence
  synthetic [barcode part1]
tgaggagatatactgc

SEQ ID NO: 11829 - DNA, 16 bp, Artificial Sequence
  synthetic [barcode part1]
tgattatcactctgcg

SEQ ID NO: 11830 - DNA, 16 bp, Artificial Sequence
  synthetic [barcode part1]
atacaagtcgcacctg

SEQ ID NO: 11831 - DNA, 16 bp, Artificial Sequence
  synthetic [barcode part1]
aggtggtcaacaagag

SEQ ID NO: 11832 - DNA, 16 bp, Artificial Sequence
  synthetic [barcode part1]
atacttccttcgcgtc

SEQ ID NO: 11833 - DNA, 16 bp, Artificial Sequence
  synthetic [barcode part1]
gttgcctaggttcacc

SEQ ID NO: 11834 - DNA, 16 bp, Artificial Sequence
  synthetic [barcode part1]
ttaactcacggccgtc

SEQ ID NO: 11835 - DNA, 16 bp, Artificial Sequence
  synthetic [barcode part1]
gtcaggaagttggaag

SEQ ID NO: 11836 - DNA, 16 bp, Artificial Sequence
  synthetic [barcode part1]
ttcgacctgcgcaatc

SEQ ID NO: 11837 - DNA, 16 bp, Artificial Sequence
  synthetic [barcode part1]
tggattctactacctg

SEQ ID NO: 11838 - DNA, 16 bp, Artificial Sequence
  synthetic [barcode part1]
gccgttctcacagact

SEQ ID NO: 11839 - DNA, 16 bp, Artificial Sequence
  synthetic [barcode part1]
ccggacttcagattag

SEQ ID NO: 11840 - DNA, 16 bp, Artificial Sequence
  synthetic [barcode part1]
attgtcggccagattg

SEQ ID NO: 11841 - DNA, 16 bp, Artificial Sequence
  synthetic [barcode part1]
ccttgaccacaggttc

SEQ ID NO: 11842 - DNA, 16 bp, Artificial Sequence
  synthetic [barcode part1]
cgtcgcactaattgag

SEQ ID NO: 11843 - DNA, 16 bp, Artificial Sequence
  synthetic [barcode part1]
gtgtgactggtgtact

SEQ ID NO: 11844 - DNA, 16 bp, Artificial Sequence
  synthetic [barcode part1]
accttcctacagttag

SEQ ID NO: 11845 - DNA, 16 bp, Artificial Sequence
  synthetic [barcode part1]
aggttgtgcaagaatc

SEQ ID NO: 11846 - DNA, 16 bp, Artificial Sequence
  synthetic [barcode part1]
taacgtcagtgagtag

SEQ ID NO: 11847 - DNA, 16 bp, Artificial Sequence
  synthetic [barcode part1]
tactgtgagtcaaccg

SEQ ID NO: 11848 - DNA, 16 bp, Artificial Sequence
  synthetic [barcode part1]
gacctaggacttggtt

SEQ ID NO: 11849 - DNA, 16 bp, Artificial Sequence
  synthetic [barcode part1]
tactcagaattgcgcg

SEQ ID NO: 11850 - DNA, 16 bp, Artificial Sequence
  synthetic [barcode part1]
gcgtggtactgtatac

SEQ ID NO: 11851 - DNA, 16 bp, Artificial Sequence
  synthetic [barcode part1]
gcctgacttaagtcag

SEQ ID NO: 11852 - DNA, 16 bp, Artificial Sequence
  synthetic [barcode part1]
tgtcgtcttgtgcgac

SEQ ID NO: 11853 - DNA, 16 bp, Artificial Sequence
  synthetic [barcode part1]
cctagaggagacttct

SEQ ID NO: 11854 - DNA, 16 bp, Artificial Sequence
  synthetic [barcode part1]
aagttgttctacgcct

SEQ ID NO: 11855 - DNA, 16 bp, Artificial Sequence
  synthetic [barcode part1]
cactctgatcctactc

SEQ ID NO: 11856 - DNA, 16 bp, Artificial Sequence
  synthetic [barcode part1]
agacctgttgtacggt

SEQ ID NO: 11857 - DNA, 16 bp, Artificial Sequence
  synthetic [barcode part1]
gacagtgaggttcgtg

SEQ ID NO: 11858 - DNA, 16 bp, Artificial Sequence
  synthetic [barcode part1]
gacgacttgcaggagt

SEQ ID NO: 11859 - DNA, 16 bp, Artificial Sequence
  synthetic [barcode part1]
gaccacgtaacgtatc

SEQ ID NO: 11860 - DNA, 16 bp, Artificial Sequence
  synthetic [barcode part1]
tatcttagtccacggt

SEQ ID NO: 11861 - DNA, 16 bp, Artificial Sequence
  synthetic [barcode part1]
gataggaccaggcact

SEQ ID NO: 11862 - DNA, 16 bp, Artificial Sequence
  synthetic [barcode part1]
ttcaggtatctcctag

SEQ ID NO: 11863 - DNA, 16 bp, Artificial Sequence
  synthetic [barcode part1]
tcgacttcagatctgt

SEQ ID NO: 11864 - DNA, 16 bp, Artificial Sequence
  synthetic [barcode part1]
cacgtaagtaaggcgc

SEQ ID NO: 11865 - DNA, 16 bp, Artificial Sequence
  synthetic [barcode part1]
gttctagacgtcgtag

SEQ ID NO: 11866 - DNA, 16 bp, Artificial Sequence
  synthetic [barcode part1]
atcgaggttctagtcg

SEQ ID NO: 11867 - DNA, 16 bp, Artificial Sequence
  synthetic [barcode part1]
gactcggcaatctaac

SEQ ID NO: 11868 - DNA, 16 bp, Artificial Sequence
  synthetic [barcode part1]
actacctggacaacgt

SEQ ID NO: 11869 - DNA, 16 bp, Artificial Sequence
  synthetic [barcode part1]
actgtctcgagacagt

SEQ ID NO: 11870 - DNA, 16 bp, Artificial Sequence
  synthetic [barcode part1]
tggaccgtcctatacc

SEQ ID NO: 11871 - DNA, 16 bp, Artificial Sequence
  synthetic [barcode part1]
tctaaggccagagttc

SEQ ID NO: 11872 - DNA, 16 bp, Artificial Sequence
  synthetic [barcode part1]
aacgatccgcgagaac

SEQ ID NO: 11873 - DNA, 16 bp, Artificial Sequence
  synthetic [barcode part1]
cgattacagacgttcg

SEQ ID NO: 11874 - DNA, 16 bp, Artificial Sequence
  synthetic [barcode part1]
ccgacttattcagatc

SEQ ID NO: 11875 - DNA, 16 bp, Artificial Sequence
  synthetic [barcode part1]
atctaagacctcacct

SEQ ID NO: 11876 - DNA, 16 bp, Artificial Sequence
  synthetic [barcode part1]
aatagtgccgtcctag

SEQ ID NO: 11877 - DNA, 16 bp, Artificial Sequence
  synthetic [barcode part1]
cgtattggagaggtcg

SEQ ID NO: 11878 - DNA, 16 bp, Artificial Sequence
  synthetic [barcode part1]
gtaaccacgatcacac

SEQ ID NO: 11879 - DNA, 16 bp, Artificial Sequence
  synthetic [barcode part1]
ttcaacttagtcacgc

SEQ ID NO: 11880 - DNA, 16 bp, Artificial Sequence
  synthetic [barcode part1]
cactccgtatcactct

SEQ ID NO: 11881 - DNA, 16 bp, Artificial Sequence
  synthetic [barcode part1]
tctgtcaacacaacct

SEQ ID NO: 11882 - DNA, 16 bp, Artificial Sequence
  synthetic [barcode part1]
actgttgtgacggttg

SEQ ID NO: 11883 - DNA, 16 bp, Artificial Sequence
  synthetic [barcode part1]
ttgtgtcgacgatctt

SEQ ID NO: 11884 - DNA, 16 bp, Artificial Sequence
  synthetic [barcode part1]
tgcctctatcactaag

SEQ ID NO: 11885 - DNA, 16 bp, Artificial Sequence
  synthetic [barcode part1]
ccaagttcacgttccg

SEQ ID NO: 11886 - DNA, 16 bp, Artificial Sequence
  synthetic [barcode part1]
tgcagactactactct

SEQ ID NO: 11887 - DNA, 16 bp, Artificial Sequence
  synthetic [barcode part1]
aactaaggttcaggtg

SEQ ID NO: 11888 - DNA, 16 bp, Artificial Sequence
  synthetic [barcode part1]
gaacgcactcttgtag

SEQ ID NO: 11889 - DNA, 16 bp, Artificial Sequence
  synthetic [barcode part1]
ccgaatacttagacgc

SEQ ID NO: 11890 - DNA, 16 bp, Artificial Sequence
  synthetic [barcode part1]
ttcctctcaatcgacc

SEQ ID NO: 11891 - DNA, 16 bp, Artificial Sequence
  synthetic [barcode part1]
caagacgtcgttatcg

SEQ ID NO: 11892 - DNA, 16 bp, Artificial Sequence
  synthetic [barcode part1]
gatacgcgaagaactt

SEQ ID NO: 11893 - DNA, 16 bp, Artificial Sequence
  synthetic [barcode part1]
gttcctggtaggaatc

SEQ ID NO: 11894 - DNA, 16 bp, Artificial Sequence
  synthetic [barcode part1]
tacctacgttcgtcct

SEQ ID NO: 11895 - DNA, 16 bp, Artificial Sequence
  synthetic [barcode part1]
tgtcctccaacctgag

SEQ ID NO: 11896 - DNA, 16 bp, Artificial Sequence
  synthetic [barcode part1]
tgacggagttctactg

SEQ ID NO: 11897 - DNA, 16 bp, Artificial Sequence
  synthetic [barcode part1]
tgatatacgtaccggc

SEQ ID NO: 11898 - DNA, 16 bp, Artificial Sequence
  synthetic [barcode part1]
tgatcgacagtatcgc

SEQ ID NO: 11899 - DNA, 16 bp, Artificial Sequence
  synthetic [barcode part1]
aacttaaggagtgtgc

SEQ ID NO: 11900 - DNA, 16 bp, Artificial Sequence
  synthetic [barcode part1]
cacaacttctcactag

SEQ ID NO: 11901 - DNA, 16 bp, Artificial Sequence
  synthetic [barcode part1]
gtacctagtctgtgag

SEQ ID NO: 11902 - DNA, 16 bp, Artificial Sequence
  synthetic [barcode part1]
gcaattctgagtcacg

SEQ ID NO: 11903 - DNA, 16 bp, Artificial Sequence
  synthetic [barcode part1]
accgattggaatctcg

SEQ ID NO: 11904 - DNA, 16 bp, Artificial Sequence
  synthetic [barcode part1]
tgtagactgccacctc

SEQ ID NO: 11905 - DNA, 16 bp, Artificial Sequence
  synthetic [barcode part1]
gtgattaggagaacct

SEQ ID NO: 11906 - DNA, 16 bp, Artificial Sequence
  synthetic [barcode part1]
tcagtacagaaggccg

SEQ ID NO: 11907 - DNA, 16 bp, Artificial Sequence
  synthetic [barcode part1]
accggactgaattgtc

SEQ ID NO: 11908 - DNA, 16 bp, Artificial Sequence
  synthetic [barcode part1]
caattcctagtgcgtt

SEQ ID NO: 11909 - DNA, 16 bp, Artificial Sequence
  synthetic [barcode part1]
atcacgagaaccttgc

SEQ ID NO: 11910 - DNA, 16 bp, Artificial Sequence
  synthetic [barcode part1]
actgccttctactacc

SEQ ID NO: 11911 - DNA, 16 bp, Artificial Sequence
  synthetic [barcode part1]
gtcggcacctaatctc

SEQ ID NO: 11912 - DNA, 16 bp, Artificial Sequence
  synthetic [barcode part1]
acggccgttctctagt

SEQ ID NO: 11913 - DNA, 16 bp, Artificial Sequence
  synthetic [barcode part1]
agtgccagaagaaggt

SEQ ID NO: 11914 - DNA, 16 bp, Artificial Sequence
  synthetic [barcode part1]
taactaacacgcgtgc

SEQ ID NO: 11915 - DNA, 16 bp, Artificial Sequence
  synthetic [barcode part1]
gtagttcactcttacg

SEQ ID NO: 11916 - DNA, 16 bp, Artificial Sequence
  synthetic [barcode part1]
tccagtctaattacgc

SEQ ID NO: 11917 - DNA, 16 bp, Artificial Sequence
  synthetic [barcode part1]
gttgtggcggaattct

SEQ ID NO: 11918 - DNA, 16 bp, Artificial Sequence
  synthetic [barcode part1]
gtgcaaggacaactcg

SEQ ID NO: 11919 - DNA, 16 bp, Artificial Sequence
  synthetic [barcode part1]
agtgtacggagttggc

SEQ ID NO: 11920 - DNA, 16 bp, Artificial Sequence
  synthetic [barcode part1]
cctctgttagaccacg

SEQ ID NO: 11921 - DNA, 16 bp, Artificial Sequence
  synthetic [barcode part1]
tcgagattctgagacc

SEQ ID NO: 11922 - DNA, 16 bp, Artificial Sequence
  synthetic [barcode part1]
cagagtgataaggcag

SEQ ID NO: 11923 - DNA, 16 bp, Artificial Sequence
  synthetic [barcode part1]
gtggtgagagttgaag

SEQ ID NO: 11924 - DNA, 16 bp, Artificial Sequence
  synthetic [barcode part1]
cactccttaacagttg

SEQ ID NO: 11925 - DNA, 16 bp, Artificial Sequence
  synthetic [barcode part1]
gtgaccaggttcctct

SEQ ID NO: 11926 - DNA, 16 bp, Artificial Sequence
  synthetic [barcode part1]
caccttaggcgaagtt

SEQ ID NO: 11927 - DNA, 16 bp, Artificial Sequence
  synthetic [barcode part1]
tcgttgttgttcgagt

SEQ ID NO: 11928 - DNA, 16 bp, Artificial Sequence
  synthetic [barcode part1]
ttccaccagacaacag

SEQ ID NO: 11929 - DNA, 16 bp, Artificial Sequence
  synthetic [barcode part1]
tgaatcacggtctggt

SEQ ID NO: 11930 - DNA, 16 bp, Artificial Sequence
  synthetic [barcode part1]
tattctgaggcagtgc

SEQ ID NO: 11931 - DNA, 16 bp, Artificial Sequence
  synthetic [barcode part1]
cacgcggttcaatcct

SEQ ID NO: 11932 - DNA, 16 bp, Artificial Sequence
  synthetic [barcode part1]
acgtggttcgactcct

SEQ ID NO: 11933 - DNA, 16 bp, Artificial Sequence
  synthetic [barcode part1]
accactcgaattcgcc

SEQ ID NO: 11934 - DNA, 16 bp, Artificial Sequence
  synthetic [barcode part1]
tatctcgcaagacggt

SEQ ID NO: 11935 - DNA, 16 bp, Artificial Sequence
  synthetic [barcode part1]
ttaggtctcaacggtg

SEQ ID NO: 11936 - DNA, 16 bp, Artificial Sequence
  synthetic [barcode part1]
actctccgtaccaacg

SEQ ID NO: 11937 - DNA, 16 bp, Artificial Sequence
  synthetic [barcode part1]
gaatcgtcggattacc

SEQ ID NO: 11938 - DNA, 16 bp, Artificial Sequence
  synthetic [barcode part1]
tggagacaacgtgaag

SEQ ID NO: 11939 - DNA, 16 bp, Artificial Sequence
  synthetic [barcode part1]
tcctgacacgtgatcc

SEQ ID NO: 11940 - DNA, 16 bp, Artificial Sequence
  synthetic [barcode part1]
tgactggtctcgaagt

SEQ ID NO: 11941 - DNA, 16 bp, Artificial Sequence
  synthetic [barcode part1]
agattgcactcaacgc

SEQ ID NO: 11942 - DNA, 16 bp, Artificial Sequence
  synthetic [barcode part1]
gacgaacttactcgtg

SEQ ID NO: 11943 - DNA, 16 bp, Artificial Sequence
  synthetic [barcode part1]
tagttctcaacgtacc

SEQ ID NO: 11944 - DNA, 16 bp, Artificial Sequence
  synthetic [barcode part1]
ccacgcctccaataac

SEQ ID NO: 11945 - DNA, 16 bp, Artificial Sequence
  synthetic [barcode part1]
ttgtctgttgcggcgt

SEQ ID NO: 11946 - DNA, 16 bp, Artificial Sequence
  synthetic [barcode part1]
gcctattaccttaggt

SEQ ID NO: 11947 - DNA, 16 bp, Artificial Sequence
  synthetic [barcode part1]
gcaccacctatagtag

SEQ ID NO: 11948 - DNA, 16 bp, Artificial Sequence
  synthetic [barcode part1]
gagtaggtggagttcc

SEQ ID NO: 11949 - DNA, 16 bp, Artificial Sequence
  synthetic [barcode part1]
atcctacgcgattgtt

SEQ ID NO: 11950 - DNA, 16 bp, Artificial Sequence
  synthetic [barcode part1]
agaggaatcaagaccg

SEQ ID NO: 11951 - DNA, 16 bp, Artificial Sequence
  synthetic [barcode part1]
ttagtcgcacgtgtag

SEQ ID NO: 11952 - DNA, 16 bp, Artificial Sequence
  synthetic [barcode part1]
acgttaacctcgttgt

SEQ ID NO: 11953 - DNA, 16 bp, Artificial Sequence
  synthetic [barcode part1]
cgatctctcaaccttc

SEQ ID NO: 11954 - DNA, 16 bp, Artificial Sequence
  synthetic [barcode part1]
tgtacggaccttccgt

SEQ ID NO: 11955 - DNA, 16 bp, Artificial Sequence
  synthetic [barcode part1]
gactctccttcgttac

SEQ ID NO: 11956 - DNA, 16 bp, Artificial Sequence
  synthetic [barcode part1]
cctgagacttcagagt

SEQ ID NO: 11957 - DNA, 16 bp, Artificial Sequence
  synthetic [barcode part1]
attggataggtcgcct

SEQ ID NO: 11958 - DNA, 16 bp, Artificial Sequence
  synthetic [barcode part1]
gaagtcgagttgtgcg

SEQ ID NO: 11959 - DNA, 16 bp, Artificial Sequence
  synthetic [barcode part1]
ttggtcacaaccagtg

SEQ ID NO: 11960 - DNA, 16 bp, Artificial Sequence
  synthetic [barcode part1]
accaggagtattagtg

SEQ ID NO: 11961 - DNA, 16 bp, Artificial Sequence
  synthetic [barcode part1]
tggacagagactccag

SEQ ID NO: 11962 - DNA, 16 bp, Artificial Sequence
  synthetic [barcode part1]
gcggttggatcagaac

SEQ ID NO: 11963 - DNA, 16 bp, Artificial Sequence
  synthetic [barcode part1]
ccaccttcacgagttg

SEQ ID NO: 11964 - DNA, 16 bp, Artificial Sequence
  synthetic [barcode part1]
cgcgaattgtctgagt

SEQ ID NO: 11965 - DNA, 16 bp, Artificial Sequence
  synthetic [barcode part1]
cagagttgaccgattc

SEQ ID NO: 11966 - DNA, 16 bp, Artificial Sequence
  synthetic [barcode part1]
tcaacagattcggcac

SEQ ID NO: 11967 - DNA, 16 bp, Artificial Sequence
  synthetic [barcode part1]
attctcactactaggc

SEQ ID NO: 11968 - DNA, 16 bp, Artificial Sequence
  synthetic [barcode part1]
cctctagattacgcgc

SEQ ID NO: 11969 - DNA, 16 bp, Artificial Sequence
  synthetic [barcode part1]
cagtacaaggacaatc

SEQ ID NO: 11970 - DNA, 16 bp, Artificial Sequence
  synthetic [barcode part1]
cctggtccacgtagtt

SEQ ID NO: 11971 - DNA, 16 bp, Artificial Sequence
  synthetic [barcode part1]
tcctacctccaggtag

SEQ ID NO: 11972 - DNA, 16 bp, Artificial Sequence
  synthetic [barcode part1]
acaccaatacgttggc

SEQ ID NO: 11973 - DNA, 16 bp, Artificial Sequence
  synthetic [barcode part1]
cgatctcaactaggac

SEQ ID NO: 11974 - DNA, 16 bp, Artificial Sequence
  synthetic [barcode part1]
tctactgtcgaacact

SEQ ID NO: 11975 - DNA, 16 bp, Artificial Sequence
  synthetic [barcode part1]
ttagtctcactccgtc

SEQ ID NO: 11976 - DNA, 16 bp, Artificial Sequence
  synthetic [barcode part1]
acttctagtgacctac

SEQ ID NO: 11977 - DNA, 16 bp, Artificial Sequence
  synthetic [barcode part1]
caacgttctgtccgtg

SEQ ID NO: 11978 - DNA, 16 bp, Artificial Sequence
  synthetic [barcode part1]
cgagaggaattgaggt

SEQ ID NO: 11979 - DNA, 16 bp, Artificial Sequence
  synthetic [barcode part1]
acctctagaactacct

SEQ ID NO: 11980 - DNA, 16 bp, Artificial Sequence
  synthetic [barcode part1]
tcgagagatcagagag

SEQ ID NO: 11981 - DNA, 16 bp, Artificial Sequence
  synthetic [barcode part1]
gcaatcgtcttctagt

SEQ ID NO: 11982 - DNA, 16 bp, Artificial Sequence
  synthetic [barcode part1]
gcgtcacagtagacag

SEQ ID NO: 11983 - DNA, 16 bp, Artificial Sequence
  synthetic [barcode part1]
aacgcgtgagaggtct

SEQ ID NO: 11984 - DNA, 16 bp, Artificial Sequence
  synthetic [barcode part1]
ttagacgacggacttc

SEQ ID NO: 11985 - DNA, 16 bp, Artificial Sequence
  synthetic [barcode part1]
cgagtattgcgaatcc

SEQ ID NO: 11986 - DNA, 16 bp, Artificial Sequence
  synthetic [barcode part1]
ccgttactaggtgtcc

SEQ ID NO: 11987 - DNA, 16 bp, Artificial Sequence
  synthetic [barcode part1]
taaccgtccgtcgttg

SEQ ID NO: 11988 - DNA, 16 bp, Artificial Sequence
  synthetic [barcode part1]
gaacgactgcgaactg

SEQ ID NO: 11989 - DNA, 16 bp, Artificial Sequence
  synthetic [barcode part1]
tattctcgttaccgag

SEQ ID NO: 11990 - DNA, 16 bp, Artificial Sequence
  synthetic [barcode part1]
tatacaggcaagacgt

SEQ ID NO: 11991 - DNA, 16 bp, Artificial Sequence
  synthetic [barcode part1]
gacgtatcggttgtac

SEQ ID NO: 11992 - DNA, 16 bp, Artificial Sequence
  synthetic [barcode part1]
aacgtctgtctcttag

SEQ ID NO: 11993 - DNA, 16 bp, Artificial Sequence
  synthetic [barcode part1]
tgcaaggttgagttag

SEQ ID NO: 11994 - DNA, 16 bp, Artificial Sequence
  synthetic [barcode part1]
tctgactgccggtact

SEQ ID NO: 11995 - DNA, 16 bp, Artificial Sequence
  synthetic [barcode part1]
tgagtaactcaagacg

SEQ ID NO: 11996 - DNA, 16 bp, Artificial Sequence
  synthetic [barcode part1]
accaacactgtgcaac

SEQ ID NO: 11997 - DNA, 16 bp, Artificial Sequence
  synthetic [barcode part1]
caacgtagaggactgc

SEQ ID NO: 11998 - DNA, 16 bp, Artificial Sequence
  synthetic [barcode part1]
tagaagagtcacgcgc

SEQ ID NO: 11999 - DNA, 16 bp, Artificial Sequence
  synthetic [barcode part1]
gcacaagattcctacg

SEQ ID NO: 12000 - DNA, 16 bp, Artificial Sequence
  synthetic [barcode part1]
gtcgatagttcgaacc

SEQ ID NO: 12001 - DNA, 16 bp, Artificial Sequence
  synthetic [barcode part1]
ataagaggattgccac

SEQ ID NO: 12002 - DNA, 16 bp, Artificial Sequence
  synthetic [barcode part1]
attgtctctcagacac

SEQ ID NO: 12003 - DNA, 16 bp, Artificial Sequence
  synthetic [barcode part1]
gattctcgacctgcgt

SEQ ID NO: 12004 - DNA, 16 bp, Artificial Sequence
  synthetic [barcode part1]
gtgattcagtgtagag

SEQ ID NO: 12005 - DNA, 16 bp, Artificial Sequence
  synthetic [barcode part1]
ttgacttgccttctgc

SEQ ID NO: 12006 - DNA, 16 bp, Artificial Sequence
  synthetic [barcode part1]
cgacacctacttgtcg

SEQ ID NO: 12007 - DNA, 16 bp, Artificial Sequence
  synthetic [barcode part1]
gtgcaacaccaacact

SEQ ID NO: 12008 - DNA, 16 bp, Artificial Sequence
  synthetic [barcode part1]
ataattgtctcctggc

SEQ ID NO: 12009 - DNA, 16 bp, Artificial Sequence
  synthetic [barcode part1]
caacgtagtgtagtcc

SEQ ID NO: 12010 - DNA, 16 bp, Artificial Sequence
  synthetic [barcode part1]
aagttgcctcagtgac

SEQ ID NO: 12011 - DNA, 16 bp, Artificial Sequence
  synthetic [barcode part1]
taagtcaggccactgt

SEQ ID NO: 12012 - DNA, 16 bp, Artificial Sequence
  synthetic [barcode part1]
caattgcgacgacgag

SEQ ID NO: 12013 - DNA, 16 bp, Artificial Sequence
  synthetic [barcode part1]
aacgaggttaatacgc

SEQ ID NO: 12014 - DNA, 16 bp, Artificial Sequence
  synthetic [barcode part1]
gagacgttaataaccg

SEQ ID NO: 12015 - DNA, 16 bp, Artificial Sequence
  synthetic [barcode part1]
tgcgttccactaggtc

SEQ ID NO: 12016 - DNA, 16 bp, Artificial Sequence
  synthetic [barcode part1]
cgagagaatactggcc

SEQ ID NO: 12017 - DNA, 16 bp, Artificial Sequence
  synthetic [barcode part1]
taccaggaagttgcct

SEQ ID NO: 12018 - DNA, 16 bp, Artificial Sequence
  synthetic [barcode part1]
taggcaggtggataag

SEQ ID NO: 12019 - DNA, 16 bp, Artificial Sequence
  synthetic [barcode part1]
aggatctccacttatc

SEQ ID NO: 12020 - DNA, 16 bp, Artificial Sequence
  synthetic [barcode part1]
ccgatcctaccagtgt

SEQ ID NO: 12021 - DNA, 16 bp, Artificial Sequence
  synthetic [barcode part1]
tattcaagtcgttccg

SEQ ID NO: 12022 - DNA, 16 bp, Artificial Sequence
  synthetic [barcode part1]
agacttcgtatacgcg

SEQ ID NO: 12023 - DNA, 16 bp, Artificial Sequence
  synthetic [barcode part1]
aggtccacactctatt

SEQ ID NO: 12024 - DNA, 16 bp, Artificial Sequence
  synthetic [barcode part1]
caggaggcaacgtgtt

SEQ ID NO: 12025 - DNA, 16 bp, Artificial Sequence
  synthetic [barcode part1]
acgttctatcgtcagt

SEQ ID NO: 12026 - DNA, 16 bp, Artificial Sequence
  synthetic [barcode part1]
gtggactcgtagactt

SEQ ID NO: 12027 - DNA, 16 bp, Artificial Sequence
  synthetic [barcode part1]
cactgtctctgcagac

SEQ ID NO: 12028 - DNA, 16 bp, Artificial Sequence
  synthetic [barcode part1]
tgacgattacgttctc

SEQ ID NO: 12029 - DNA, 16 bp, Artificial Sequence
  synthetic [barcode part1]
ccgttaacgattcgag

SEQ ID NO: 12030 - DNA, 16 bp, Artificial Sequence
  synthetic [barcode part1]
agaccactatccttgt

SEQ ID NO: 12031 - DNA, 16 bp, Artificial Sequence
  synthetic [barcode part1]
tgtggtatatctgtcc

SEQ ID NO: 12032 - DNA, 16 bp, Artificial Sequence
  synthetic [barcode part1]
caagtgttcgaacgtc

SEQ ID NO: 12033 - DNA, 16 bp, Artificial Sequence
  synthetic [barcode part1]
gaagagtcctgatcct

SEQ ID NO: 12034 - DNA, 16 bp, Artificial Sequence
  synthetic [barcode part1]
tggtggattcaggcag

SEQ ID NO: 12035 - DNA, 16 bp, Artificial Sequence
  synthetic [barcode part1]
cagattactccacact

SEQ ID NO: 12036 - DNA, 16 bp, Artificial Sequence
  synthetic [barcode part1]
caccggaactcttgtc

SEQ ID NO: 12037 - DNA, 16 bp, Artificial Sequence
  synthetic [barcode part1]
ccaccttatacaactg

SEQ ID NO: 12038 - DNA, 16 bp, Artificial Sequence
  synthetic [barcode part1]
aggtaggaggtgaatc

SEQ ID NO: 12039 - DNA, 16 bp, Artificial Sequence
  synthetic [barcode part1]
cgattgactctctctc

SEQ ID NO: 12040 - DNA, 16 bp, Artificial Sequence
  synthetic [barcode part1]
tctcagacaagacctg

SEQ ID NO: 12041 - DNA, 16 bp, Artificial Sequence
  synthetic [barcode part1]
taagtatccgacacgc

SEQ ID NO: 12042 - DNA, 16 bp, Artificial Sequence
  synthetic [barcode part1]
tgtgaggagaacgtag

SEQ ID NO: 12043 - DNA, 16 bp, Artificial Sequence
  synthetic [barcode part1]
actcgccaagtagact

SEQ ID NO: 12044 - DNA, 16 bp, Artificial Sequence
  synthetic [barcode part1]
tacttcaccgtcttgc

SEQ ID NO: 12045 - DNA, 16 bp, Artificial Sequence
  synthetic [barcode part1]
ccggaggatattcgag

SEQ ID NO: 12046 - DNA, 16 bp, Artificial Sequence
  synthetic [barcode part1]
gttatcgaaccaccag

SEQ ID NO: 12047 - DNA, 16 bp, Artificial Sequence
  synthetic [barcode part1]
caactgagacttcgac

SEQ ID NO: 12048 - DNA, 16 bp, Artificial Sequence
  synthetic [barcode part1]
gtccgagtgaagtgac

SEQ ID NO: 12049 - DNA, 16 bp, Artificial Sequence
  synthetic [barcode part1]
gtgcgtaggttctagt

SEQ ID NO: 12050 - DNA, 16 bp, Artificial Sequence
  synthetic [barcode part1]
tagtgtcttattcgcg

SEQ ID NO: 12051 - DNA, 16 bp, Artificial Sequence
  synthetic [barcode part1]
ccaatccttgcgtgac

SEQ ID NO: 12052 - DNA, 16 bp, Artificial Sequence
  synthetic [barcode part1]
gcaactgcctcaacct

SEQ ID NO: 12053 - DNA, 16 bp, Artificial Sequence
  synthetic [barcode part1]
gccaatacgtcagtac

SEQ ID NO: 12054 - DNA, 16 bp, Artificial Sequence
  synthetic [barcode part1]
cctctaataactgcgt

SEQ ID NO: 12055 - DNA, 16 bp, Artificial Sequence
  synthetic [barcode part1]
tgcagttcttctggcg

SEQ ID NO: 12056 - DNA, 16 bp, Artificial Sequence
  synthetic [barcode part1]
agtctgtcttgttgtg

SEQ ID NO: 12057 - DNA, 16 bp, Artificial Sequence
  synthetic [barcode part1]
tgaactccttgccacg

SEQ ID NO: 12058 - DNA, 16 bp, Artificial Sequence
  synthetic [barcode part1]
ttcttgataaccgtgc

SEQ ID NO: 12059 - DNA, 16 bp, Artificial Sequence
  synthetic [barcode part1]
acacctcgaggtatac

SEQ ID NO: 12060 - DNA, 16 bp, Artificial Sequence
  synthetic [barcode part1]
ttcttgtcagactgtg

SEQ ID NO: 12061 - DNA, 16 bp, Artificial Sequence
  synthetic [barcode part1]
ccgaggtataagtggc

SEQ ID NO: 12062 - DNA, 16 bp, Artificial Sequence
  synthetic [barcode part1]
taacagtcgcgcctct

SEQ ID NO: 12063 - DNA, 16 bp, Artificial Sequence
  synthetic [barcode part1]
tgtctgtcggaatctt

SEQ ID NO: 12064 - DNA, 16 bp, Artificial Sequence
  synthetic [barcode part1]
tgtccacctcggaatc

SEQ ID NO: 12065 - DNA, 16 bp, Artificial Sequence
  synthetic [barcode part1]
gtagtctgacgtggag

SEQ ID NO: 12066 - DNA, 16 bp, Artificial Sequence
  synthetic [barcode part1]
atctgcactaggtacg

SEQ ID NO: 12067 - DNA, 16 bp, Artificial Sequence
  synthetic [barcode part1]
aggtctaagtgacaac

SEQ ID NO: 12068 - DNA, 16 bp, Artificial Sequence
  synthetic [barcode part1]
tataggtgagtgacgt

SEQ ID NO: 12069 - DNA, 16 bp, Artificial Sequence
  synthetic [barcode part1]
cgaatactgtaccgac

SEQ ID NO: 12070 - DNA, 16 bp, Artificial Sequence
  synthetic [barcode part1]
taggtacggagattac

SEQ ID NO: 12071 - DNA, 16 bp, Artificial Sequence
  synthetic [barcode part1]
ttacggacactctgcc

SEQ ID NO: 12072 - DNA, 16 bp, Artificial Sequence
  synthetic [barcode part1]
tcgataaggcgcgagt

SEQ ID NO: 12073 - DNA, 16 bp, Artificial Sequence
  synthetic [barcode part1]
tcggaacgaacttcgt

SEQ ID NO: 12074 - DNA, 16 bp, Artificial Sequence
  synthetic [barcode part1]
ccgagtgttacttcgc

SEQ ID NO: 12075 - DNA, 16 bp, Artificial Sequence
  synthetic [barcode part1]
acgttgaactatctcc

SEQ ID NO: 12076 - DNA, 16 bp, Artificial Sequence
  synthetic [barcode part1]
gattcacttcgttacg

SEQ ID NO: 12077 - DNA, 16 bp, Artificial Sequence
  synthetic [barcode part1]
gtaactgatcgtgcac

SEQ ID NO: 12078 - DNA, 16 bp, Artificial Sequence
  synthetic [barcode part1]
tgtgagtgtaggtctc

SEQ ID NO: 12079 - DNA, 16 bp, Artificial Sequence
  synthetic [barcode part1]
ttcaacttctcggtcc

SEQ ID NO: 12080 - DNA, 16 bp, Artificial Sequence
  synthetic [barcode part1]
ccacttcttcctagtg

SEQ ID NO: 12081 - DNA, 16 bp, Artificial Sequence
  synthetic [barcode part1]
acgtagtaatcaaggc

SEQ ID NO: 12082 - DNA, 16 bp, Artificial Sequence
  synthetic [barcode part1]
tctggttctgacctct

SEQ ID NO: 12083 - DNA, 16 bp, Artificial Sequence
  synthetic [barcode part1]
ccttagtggtcgtatt

SEQ ID NO: 12084 - DNA, 16 bp, Artificial Sequence
  synthetic [barcode part1]
cagtggtgtgtgaggt

SEQ ID NO: 12085 - DNA, 16 bp, Artificial Sequence
  synthetic [barcode part1]
gacaattcctctgtgt

SEQ ID NO: 12086 - DNA, 16 bp, Artificial Sequence
  synthetic [barcode part1]
agactctaccggttag

SEQ ID NO: 12087 - DNA, 16 bp, Artificial Sequence
  synthetic [barcode part1]
tcggcacgattaggag

SEQ ID NO: 12088 - DNA, 16 bp, Artificial Sequence
  synthetic [barcode part1]
tagtctggttcttacg

SEQ ID NO: 12089 - DNA, 16 bp, Artificial Sequence
  synthetic [barcode part1]
acgagagactatcaac

SEQ ID NO: 12090 - DNA, 16 bp, Artificial Sequence
  synthetic [barcode part1]
aacgactaacctgacc

SEQ ID NO: 12091 - DNA, 16 bp, Artificial Sequence
  synthetic [barcode part1]
caattgccttgatctg

SEQ ID NO: 12092 - DNA, 16 bp, Artificial Sequence
  synthetic [barcode part1]
tgcgaaccgtcgttct

SEQ ID NO: 12093 - DNA, 16 bp, Artificial Sequence
  synthetic [barcode part1]
cacaacgcgaagtctt

SEQ ID NO: 12094 - DNA, 16 bp, Artificial Sequence
  synthetic [barcode part1]
tgaatcacgcacttct

SEQ ID NO: 12095 - DNA, 16 bp, Artificial Sequence
  synthetic [barcode part1]
attggtccgactagtg

SEQ ID NO: 12096 - DNA, 16 bp, Artificial Sequence
  synthetic [barcode part1]
aggttgtagtgtagac

SEQ ID NO: 12097 - DNA, 16 bp, Artificial Sequence
  synthetic [barcode part1]
cctatatcctccacac

SEQ ID NO: 12098 - DNA, 16 bp, Artificial Sequence
  synthetic [barcode part1]
tcctggccaattctct

SEQ ID NO: 12099 - DNA, 16 bp, Artificial Sequence
  synthetic [barcode part1]
aactgtgcgcgtaatc

SEQ ID NO: 12100 - DNA, 16 bp, Artificial Sequence
  synthetic [barcode part1]
tcactgtgtggcaagt

SEQ ID NO: 12101 - DNA, 16 bp, Artificial Sequence
  synthetic [barcode part1]
tcggtggactcttacc

SEQ ID NO: 12102 - DNA, 16 bp, Artificial Sequence
  synthetic [barcode part1]
ccttcaatctcctggt

SEQ ID NO: 12103 - DNA, 16 bp, Artificial Sequence
  synthetic [barcode part1]
ttgagtgcacctgaac

SEQ ID NO: 12104 - DNA, 16 bp, Artificial Sequence
  synthetic [barcode part1]
atcacactacggactg

SEQ ID NO: 12105 - DNA, 16 bp, Artificial Sequence
  synthetic [barcode part1]
tcctgcagactcagtc

SEQ ID NO: 12106 - DNA, 16 bp, Artificial Sequence
  synthetic [barcode part1]
ttcgtccgccttagag

SEQ ID NO: 12107 - DNA, 16 bp, Artificial Sequence
  synthetic [barcode part1]
acaggaaccgacggtt

SEQ ID NO: 12108 - DNA, 16 bp, Artificial Sequence
  synthetic [barcode part1]
gatatcgcagtcagtc

SEQ ID NO: 12109 - DNA, 16 bp, Artificial Sequence
  synthetic [barcode part1]
cgtgaacacttacggt

SEQ ID NO: 12110 - DNA, 16 bp, Artificial Sequence
  synthetic [barcode part1]
gttgacttgtgacgtg

SEQ ID NO: 12111 - DNA, 16 bp, Artificial Sequence
  synthetic [barcode part1]
gacgaggtcagacgtt

SEQ ID NO: 12112 - DNA, 16 bp, Artificial Sequence
  synthetic [barcode part1]
gtaactgcaactacgc

SEQ ID NO: 12113 - DNA, 16 bp, Artificial Sequence
  synthetic [barcode part1]
tggagtgttgttaccg

SEQ ID NO: 12114 - DNA, 16 bp, Artificial Sequence
  synthetic [barcode part1]
gaccgtcctatacctg

SEQ ID NO: 12115 - DNA, 16 bp, Artificial Sequence
  synthetic [barcode part1]
tagaagaatcgacacc

SEQ ID NO: 12116 - DNA, 16 bp, Artificial Sequence
  synthetic [barcode part1]
gtctgaactaccttac

SEQ ID NO: 12117 - DNA, 16 bp, Artificial Sequence
  synthetic [barcode part1]
gcgactgatatcagtc

SEQ ID NO: 12118 - DNA, 16 bp, Artificial Sequence
  synthetic [barcode part1]
ccgagtctacgaagag

SEQ ID NO: 12119 - DNA, 16 bp, Artificial Sequence
  synthetic [barcode part1]
ttgcgttcaggttact

SEQ ID NO: 12120 - DNA, 16 bp, Artificial Sequence
  synthetic [barcode part1]
agtccggaagaacacc

SEQ ID NO: 12121 - DNA, 16 bp, Artificial Sequence
  synthetic [barcode part1]
taggcgtaaggcggtt

SEQ ID NO: 12122 - DNA, 16 bp, Artificial Sequence
  synthetic [barcode part1]
cgattactacttcgtg

SEQ ID NO: 12123 - DNA, 16 bp, Artificial Sequence
  synthetic [barcode part1]
cacagagagttactag

SEQ ID NO: 12124 - DNA, 16 bp, Artificial Sequence
  synthetic [barcode part1]
tgcgtggtgaagaacc

SEQ ID NO: 12125 - DNA, 16 bp, Artificial Sequence
  synthetic [barcode part1]
actaatacgtctcacc

SEQ ID NO: 12126 - DNA, 16 bp, Artificial Sequence
  synthetic [barcode part1]
tattaggcctggtggt

SEQ ID NO: 12127 - DNA, 16 bp, Artificial Sequence
  synthetic [barcode part1]
agagttcgcgaataac

SEQ ID NO: 12128 - DNA, 16 bp, Artificial Sequence
  synthetic [barcode part1]
cctggttaaccttctc

SEQ ID NO: 12129 - DNA, 16 bp, Artificial Sequence
  synthetic [barcode part1]
cgtgtctgaattactc

SEQ ID NO: 12130 - DNA, 16 bp, Artificial Sequence
  synthetic [barcode part1]
ataataatccgcggag

SEQ ID NO: 12131 - DNA, 16 bp, Artificial Sequence
  synthetic [barcode part1]
cagaccaagaagtgtt

SEQ ID NO: 12132 - DNA, 16 bp, Artificial Sequence
  synthetic [barcode part1]
gttccgcgatatatct

SEQ ID NO: 12133 - DNA, 16 bp, Artificial Sequence
  synthetic [barcode part1]
cctggactaaggagtg

SEQ ID NO: 12134 - DNA, 16 bp, Artificial Sequence
  synthetic [barcode part1]
ccgtcgtgtaataggt

SEQ ID NO: 12135 - DNA, 16 bp, Artificial Sequence
  synthetic [barcode part1]
cacaatcgattcgcag

SEQ ID NO: 12136 - DNA, 16 bp, Artificial Sequence
  synthetic [barcode part1]
aggtctacgaaggacc

SEQ ID NO: 12137 - DNA, 16 bp, Artificial Sequence
  synthetic [barcode part1]
acggatctgtggatct

SEQ ID NO: 12138 - DNA, 16 bp, Artificial Sequence
  synthetic [barcode part1]
cctactgtcgacacac

SEQ ID NO: 12139 - DNA, 16 bp, Artificial Sequence
  synthetic [barcode part1]
gagaacggtagtccac

SEQ ID NO: 12140 - DNA, 16 bp, Artificial Sequence
  synthetic [barcode part1]
cgactaacacgtgtac

SEQ ID NO: 12141 - DNA, 16 bp, Artificial Sequence
  synthetic [barcode part1]
agtagtagacggaacg

SEQ ID NO: 12142 - DNA, 16 bp, Artificial Sequence
  synthetic [barcode part1]
ttgaataaggtccgcc

SEQ ID NO: 12143 - DNA, 16 bp, Artificial Sequence
  synthetic [barcode part1]
cacgtaggagtcaggt

SEQ ID NO: 12144 - DNA, 16 bp, Artificial Sequence
  synthetic [barcode part1]
tgccaggagattgttc

SEQ ID NO: 12145 - DNA, 16 bp, Artificial Sequence
  synthetic [barcode part1]
tacctatagacaggcc

SEQ ID NO: 12146 - DNA, 16 bp, Artificial Sequence
  synthetic [barcode part1]
tacggcactgtccgtt

SEQ ID NO: 12147 - DNA, 16 bp, Artificial Sequence
  synthetic [barcode part1]
cagtcaggttgcgatt

SEQ ID NO: 12148 - DNA, 16 bp, Artificial Sequence
  synthetic [barcode part1]
cctcggaagattctag

SEQ ID NO: 12149 - DNA, 16 bp, Artificial Sequence
  synthetic [barcode part1]
tgattccgaccttcct

SEQ ID NO: 12150 - DNA, 16 bp, Artificial Sequence
  synthetic [barcode part1]
gtgttagtaacctctc

SEQ ID NO: 12151 - DNA, 16 bp, Artificial Sequence
  synthetic [barcode part1]
cggaacttcctaaggt

SEQ ID NO: 12152 - DNA, 16 bp, Artificial Sequence
  synthetic [barcode part1]
caaggttctgaagtcc

SEQ ID NO: 12153 - DNA, 16 bp, Artificial Sequence
  synthetic [barcode part1]
gacgtaggcctaacag

SEQ ID NO: 12154 - DNA, 16 bp, Artificial Sequence
  synthetic [barcode part1]
tcgtacctaagttacc

SEQ ID NO: 12155 - DNA, 16 bp, Artificial Sequence
  synthetic [barcode part1]
tcaactgactgtgacg

SEQ ID NO: 12156 - DNA, 16 bp, Artificial Sequence
  synthetic [barcode part1]
atatcggaatcgcgtc

SEQ ID NO: 12157 - DNA, 16 bp, Artificial Sequence
  synthetic [barcode part1]
attctcacgttggatc

SEQ ID NO: 12158 - DNA, 16 bp, Artificial Sequence
  synthetic [barcode part1]
atcggttgaggaagag

SEQ ID NO: 12159 - DNA, 16 bp, Artificial Sequence
  synthetic [barcode part1]
gaatctacctggtctt

SEQ ID NO: 12160 - DNA, 16 bp, Artificial Sequence
  synthetic [barcode part1]
gagagtactgtgtcct

SEQ ID NO: 12161 - DNA, 16 bp, Artificial Sequence
  synthetic [barcode part1]
agacggactacaacgc

SEQ ID NO: 12162 - DNA, 16 bp, Artificial Sequence
  synthetic [barcode part1]
accgttctgtcacttc

SEQ ID NO: 12163 - DNA, 16 bp, Artificial Sequence
  synthetic [barcode part1]
caaggtggtaactgcg

SEQ ID NO: 12164 - DNA, 16 bp, Artificial Sequence
  synthetic [barcode part1]
cggagaatacgcaacc

SEQ ID NO: 12165 - DNA, 16 bp, Artificial Sequence
  synthetic [barcode part1]
acctagatcactctac

SEQ ID NO: 12166 - DNA, 16 bp, Artificial Sequence
  synthetic [barcode part1]
aacagagaactcgtgt

SEQ ID NO: 12167 - DNA, 16 bp, Artificial Sequence
  synthetic [barcode part1]
taaccaggttaaccgc

SEQ ID NO: 12168 - DNA, 16 bp, Artificial Sequence
  synthetic [barcode part1]
agtgttccggaagacg

SEQ ID NO: 12169 - DNA, 16 bp, Artificial Sequence
  synthetic [barcode part1]
atcgaacctgcactcc

SEQ ID NO: 12170 - DNA, 16 bp, Artificial Sequence
  synthetic [barcode part1]
gtgaataacaggcgag

SEQ ID NO: 12171 - DNA, 16 bp, Artificial Sequence
  synthetic [barcode part1]
tctggattaggaagtg

SEQ ID NO: 12172 - DNA, 16 bp, Artificial Sequence
  synthetic [barcode part1]
tcgaacaactctatcc

SEQ ID NO: 12173 - DNA, 16 bp, Artificial Sequence
  synthetic [barcode part1]
tacaatactgcctacc

SEQ ID NO: 12174 - DNA, 16 bp, Artificial Sequence
  synthetic [barcode part1]
tgactctgcgttagtt

SEQ ID NO: 12175 - DNA, 16 bp, Artificial Sequence
  synthetic [barcode part1]
tgcctgtgaatcctgc

SEQ ID NO: 12176 - DNA, 16 bp, Artificial Sequence
  synthetic [barcode part1]
cgtcttgtgtcacttc

SEQ ID NO: 12177 - DNA, 16 bp, Artificial Sequence
  synthetic [barcode part1]
tgaagaatcgacctcc

SEQ ID NO: 12178 - DNA, 16 bp, Artificial Sequence
  synthetic [barcode part1]
gaggcaagagtctacc

SEQ ID NO: 12179 - DNA, 16 bp, Artificial Sequence
  synthetic [barcode part1]
gcgtgacaagaggttc

SEQ ID NO: 12180 - DNA, 16 bp, Artificial Sequence
  synthetic [barcode part1]
tgtagtcctgagtacg

SEQ ID NO: 12181 - DNA, 16 bp, Artificial Sequence
  synthetic [barcode part1]
ttcagtgagtgtagag

SEQ ID NO: 12182 - DNA, 16 bp, Artificial Sequence
  synthetic [barcode part1]
acacaacggttcctcc

SEQ ID NO: 12183 - DNA, 16 bp, Artificial Sequence
  synthetic [barcode part1]
aaccaacgttgaccac

SEQ ID NO: 12184 - DNA, 16 bp, Artificial Sequence
  synthetic [barcode part1]
tcgaacgatctcgcct

SEQ ID NO: 12185 - DNA, 16 bp, Artificial Sequence
  synthetic [barcode part1]
gagacttcagatagac

SEQ ID NO: 12186 - DNA, 16 bp, Artificial Sequence
  synthetic [barcode part1]
taatccgccgttgaag

SEQ ID NO: 12187 - DNA, 16 bp, Artificial Sequence
  synthetic [barcode part1]
aggaggcgtggttgtt

SEQ ID NO: 12188 - DNA, 16 bp, Artificial Sequence
  synthetic [barcode part1]
taacttccaatcgcac

SEQ ID NO: 12189 - DNA, 16 bp, Artificial Sequence
  synthetic [barcode part1]
cgccaacctagtcttg

SEQ ID NO: 12190 - DNA, 16 bp, Artificial Sequence
  synthetic [barcode part1]
gtaactcggactatcg

SEQ ID NO: 12191 - DNA, 16 bp, Artificial Sequence
  synthetic [barcode part1]
acacagtctccgatcc

SEQ ID NO: 12192 - DNA, 16 bp, Artificial Sequence
  synthetic [barcode part1]
atcgtactcttcagtg

SEQ ID NO: 12193 - DNA, 16 bp, Artificial Sequence
  synthetic [barcode part1]
cggcactcttgtctag

SEQ ID NO: 12194 - DNA, 16 bp, Artificial Sequence
  synthetic [barcode part1]
gacaattgaggtgtgt

SEQ ID NO: 12195 - DNA, 16 bp, Artificial Sequence
  synthetic [barcode part1]
acgtcaggtgtaacct

SEQ ID NO: 12196 - DNA, 16 bp, Artificial Sequence
  synthetic [barcode part1]
cacgtagtgccttatt

SEQ ID NO: 12197 - DNA, 16 bp, Artificial Sequence
  synthetic [barcode part1]
ccttcctcgactgatt

SEQ ID NO: 12198 - DNA, 16 bp, Artificial Sequence
  synthetic [barcode part1]
atatcggaaggcgacc

SEQ ID NO: 12199 - DNA, 16 bp, Artificial Sequence
  synthetic [barcode part1]
taactctggtccttcc

SEQ ID NO: 12200 - DNA, 16 bp, Artificial Sequence
  synthetic [barcode part1]
gttcaccttcaaggcc

SEQ ID NO: 12201 - DNA, 16 bp, Artificial Sequence
  synthetic [barcode part1]
aggttgcgatacaagt

SEQ ID NO: 12202 - DNA, 16 bp, Artificial Sequence
  synthetic [barcode part1]
tcggaactaggacctt

SEQ ID NO: 12203 - DNA, 16 bp, Artificial Sequence
  synthetic [barcode part1]
ccgattagaggtcttg

SEQ ID NO: 12204 - DNA, 16 bp, Artificial Sequence
  synthetic [barcode part1]
ttctcaggaggtcagt

SEQ ID NO: 12205 - DNA, 16 bp, Artificial Sequence
  synthetic [barcode part1]
cgcagataacagaact

SEQ ID NO: 12206 - DNA, 16 bp, Artificial Sequence
  synthetic [barcode part1]
acactccagtcaccac

SEQ ID NO: 12207 - DNA, 16 bp, Artificial Sequence
  synthetic [barcode part1]
tcaacgtaccaacgtg

SEQ ID NO: 12208 - DNA, 16 bp, Artificial Sequence
  synthetic [barcode part1]
attgcgacctaagacc

SEQ ID NO: 12209 - DNA, 16 bp, Artificial Sequence
  synthetic [barcode part1]
aaccgccttattggag

SEQ ID NO: 12210 - DNA, 16 bp, Artificial Sequence
  synthetic [barcode part1]
gaccagaagacgtctg

SEQ ID NO: 12211 - DNA, 16 bp, Artificial Sequence
  synthetic [barcode part1]
tgtcctcggttgtcag

SEQ ID NO: 12212 - DNA, 16 bp, Artificial Sequence
  synthetic [barcode part1]
tatagtgtcgcggtgt

SEQ ID NO: 12213 - DNA, 16 bp, Artificial Sequence
  synthetic [barcode part1]
atacgaagagttgtcg

SEQ ID NO: 12214 - DNA, 16 bp, Artificial Sequence
  synthetic [barcode part1]
ataccgtcagatagag

SEQ ID NO: 12215 - DNA, 16 bp, Artificial Sequence
  synthetic [barcode part1]
tatagagtcggtggcg

SEQ ID NO: 12216 - DNA, 16 bp, Artificial Sequence
  synthetic [barcode part1]
ttggtctggtgcacct

SEQ ID NO: 12217 - DNA, 16 bp, Artificial Sequence
  synthetic [barcode part1]
tgaccaggaagttcct

SEQ ID NO: 12218 - DNA, 16 bp, Artificial Sequence
  synthetic [barcode part1]
tgtccgtacttcaggc

SEQ ID NO: 12219 - DNA, 16 bp, Artificial Sequence
  synthetic [barcode part1]
agagtggcctaggtac

SEQ ID NO: 12220 - DNA, 16 bp, Artificial Sequence
  synthetic [barcode part1]
gtggaactctaagtag

SEQ ID NO: 12221 - DNA, 16 bp, Artificial Sequence
  synthetic [barcode part1]
gcggattggaacaatt

SEQ ID NO: 12222 - DNA, 16 bp, Artificial Sequence
  synthetic [barcode part1]
cagtgtaattgaggac

SEQ ID NO: 12223 - DNA, 16 bp, Artificial Sequence
  synthetic [barcode part1]
tgacttcggtcgaagt

SEQ ID NO: 12224 - DNA, 16 bp, Artificial Sequence
  synthetic [barcode part1]
agaggtgtccaataac

SEQ ID NO: 12225 - DNA, 16 bp, Artificial Sequence
  synthetic [barcode part1]
tcctatactgaaccac

SEQ ID NO: 12226 - DNA, 16 bp, Artificial Sequence
  synthetic [barcode part1]
attctctgcacgccag

SEQ ID NO: 12227 - DNA, 16 bp, Artificial Sequence
  synthetic [barcode part1]
tagaagacggcgtacc

SEQ ID NO: 12228 - DNA, 16 bp, Artificial Sequence
  synthetic [barcode part1]
tatacgcgtcggttag

SEQ ID NO: 12229 - DNA, 16 bp, Artificial Sequence
  synthetic [barcode part1]
cgtggtcaggatagtg

SEQ ID NO: 12230 - DNA, 16 bp, Artificial Sequence
  synthetic [barcode part1]
tatcctacgttgcctc

SEQ ID NO: 12231 - DNA, 16 bp, Artificial Sequence
  synthetic [barcode part1]
acgagtcctcctaatt

SEQ ID NO: 12232 - DNA, 16 bp, Artificial Sequence
  synthetic [barcode part1]
cagaattccggagtct

SEQ ID NO: 12233 - DNA, 16 bp, Artificial Sequence
  synthetic [barcode part1]
gcgagaagtacttctc

SEQ ID NO: 12234 - DNA, 16 bp, Artificial Sequence
  synthetic [barcode part1]
cactcaacttcactag

SEQ ID NO: 12235 - DNA, 16 bp, Artificial Sequence
  synthetic [barcode part1]
aaggataggtgtggac

SEQ ID NO: 12236 - DNA, 16 bp, Artificial Sequence
  synthetic [barcode part1]
tgacgacgacctgatt

SEQ ID NO: 12237 - DNA, 16 bp, Artificial Sequence
  synthetic [barcode part1]
gttacttgcaagtctc

SEQ ID NO: 12238 - DNA, 16 bp, Artificial Sequence
  synthetic [barcode part1]
tcttggagtaggtaag

SEQ ID NO: 12239 - DNA, 16 bp, Artificial Sequence
  synthetic [barcode part1]
gtaaggatccttgcgt

SEQ ID NO: 12240 - DNA, 16 bp, Artificial Sequence
  synthetic [barcode part1]
gcgactaccgactctt

SEQ ID NO: 12241 - DNA, 16 bp, Artificial Sequence
  synthetic [barcode part1]
tcacgaggtctcctgt

SEQ ID NO: 12242 - DNA, 16 bp, Artificial Sequence
  synthetic [barcode part1]
ttatctccacgccgag

SEQ ID NO: 12243 - DNA, 16 bp, Artificial Sequence
  synthetic [barcode part1]
tctgtattcggcggtc

SEQ ID NO: 12244 - DNA, 16 bp, Artificial Sequence
  synthetic [barcode part1]
tgcctgtagtattacc

SEQ ID NO: 12245 - DNA, 16 bp, Artificial Sequence
  synthetic [barcode part1]
gtctaggacttgcagt

SEQ ID NO: 12246 - DNA, 16 bp, Artificial Sequence
  synthetic [barcode part1]
tgtaggtcaccgttcc

SEQ ID NO: 12247 - DNA, 16 bp, Artificial Sequence
  synthetic [barcode part1]
cacctcaggtgttcac

SEQ ID NO: 12248 - DNA, 16 bp, Artificial Sequence
  synthetic [barcode part1]
ttgcctcggttgtacg

SEQ ID NO: 12249 - DNA, 16 bp, Artificial Sequence
  synthetic [barcode part1]
tgcgttccggactatc

SEQ ID NO: 12250 - DNA, 16 bp, Artificial Sequence
  synthetic [barcode part1]
tcacctatacctgcct

SEQ ID NO: 12251 - DNA, 16 bp, Artificial Sequence
  synthetic [barcode part1]
tcgttcctagtccttg

SEQ ID NO: 12252 - DNA, 16 bp, Artificial Sequence
  synthetic [barcode part1]
tctccggttggttctt

SEQ ID NO: 12253 - DNA, 16 bp, Artificial Sequence
  synthetic [barcode part1]
aacagaatacggactc

SEQ ID NO: 12254 - DNA, 16 bp, Artificial Sequence
  synthetic [barcode part1]
gactatctaggagtag

SEQ ID NO: 12255 - DNA, 16 bp, Artificial Sequence
  synthetic [barcode part1]
tgacgcgtatagatcc

SEQ ID NO: 12256 - DNA, 16 bp, Artificial Sequence
  synthetic [barcode part1]
ttcaatatctacgccg

SEQ ID NO: 12257 - DNA, 16 bp, Artificial Sequence
  synthetic [barcode part1]
taggattggtcctggt

SEQ ID NO: 12258 - DNA, 16 bp, Artificial Sequence
  synthetic [barcode part1]
ttgacaggaacgtaac

SEQ ID NO: 12259 - DNA, 16 bp, Artificial Sequence
  synthetic [barcode part1]
gccgtccagacttatc

SEQ ID NO: 12260 - DNA, 16 bp, Artificial Sequence
  synthetic [barcode part1]
tctctcgacgagatag

SEQ ID NO: 12261 - DNA, 16 bp, Artificial Sequence
  synthetic [barcode part1]
actctacggtggtagt

SEQ ID NO: 12262 - DNA, 16 bp, Artificial Sequence
  synthetic [barcode part1]
gcaatcaggaaccgac

SEQ ID NO: 12263 - DNA, 16 bp, Artificial Sequence
  synthetic [barcode part1]
tgaagatctaccagag

SEQ ID NO: 12264 - DNA, 16 bp, Artificial Sequence
  synthetic [barcode part1]
acctcaattccggaag

SEQ ID NO: 12265 - DNA, 16 bp, Artificial Sequence
  synthetic [barcode part1]
ttggcctaataacggc

SEQ ID NO: 12266 - DNA, 16 bp, Artificial Sequence
  synthetic [barcode part1]
gcgtaatacgtcaacc

SEQ ID NO: 12267 - DNA, 16 bp, Artificial Sequence
  synthetic [barcode part1]
gccgtctatagtaggt

SEQ ID NO: 12268 - DNA, 16 bp, Artificial Sequence
  synthetic [barcode part1]
agtcactataggaacg

SEQ ID NO: 12269 - DNA, 16 bp, Artificial Sequence
  synthetic [barcode part1]
gattccaacggtactg

SEQ ID NO: 12270 - DNA, 16 bp, Artificial Sequence
  synthetic [barcode part1]
tgtacgacagacctac

SEQ ID NO: 12271 - DNA, 16 bp, Artificial Sequence
  synthetic [barcode part1]
agagtggacggacttc

SEQ ID NO: 12272 - DNA, 16 bp, Artificial Sequence
  synthetic [barcode part1]
cgattcacgaaggcag

SEQ ID NO: 12273 - DNA, 16 bp, Artificial Sequence
  synthetic [barcode part1]
gaatcgtgtaatccgc

SEQ ID NO: 12274 - DNA, 16 bp, Artificial Sequence
  synthetic [barcode part1]
tgtataggacgtgcct

SEQ ID NO: 12275 - DNA, 16 bp, Artificial Sequence
  synthetic [barcode part1]
tgagatccacacacac

SEQ ID NO: 12276 - DNA, 16 bp, Artificial Sequence
  synthetic [barcode part1]
gcctgcagttgttctg

SEQ ID NO: 12277 - DNA, 16 bp, Artificial Sequence
  synthetic [barcode part1]
gttcttgagtagtcct

SEQ ID NO: 12278 - DNA, 16 bp, Artificial Sequence
  synthetic [barcode part1]
ttgttcagaacctcac

SEQ ID NO: 12279 - DNA, 16 bp, Artificial Sequence
  synthetic [barcode part1]
tcggcaatctatacct

SEQ ID NO: 12280 - DNA, 16 bp, Artificial Sequence
  synthetic [barcode part1]
cgactctattggcgtc

SEQ ID NO: 12281 - DNA, 16 bp, Artificial Sequence
  synthetic [barcode part1]
tagtctgacaagagtg

SEQ ID NO: 12282 - DNA, 16 bp, Artificial Sequence
  synthetic [barcode part1]
tgcaaggcggtaatcg

SEQ ID NO: 12283 - DNA, 16 bp, Artificial Sequence
  synthetic [barcode part1]
tcgcggtctaactaag

SEQ ID NO: 12284 - DNA, 16 bp, Artificial Sequence
  synthetic [barcode part1]
ttaggcggcaacgagt

SEQ ID NO: 12285 - DNA, 16 bp, Artificial Sequence
  synthetic [barcode part1]
gcgtcaatccttagtt

SEQ ID NO: 12286 - DNA, 16 bp, Artificial Sequence
  synthetic [barcode part1]
agactgtcgagaacgc

SEQ ID NO: 12287 - DNA, 16 bp, Artificial Sequence
  synthetic [barcode part1]
tgaccgaaccgattgt

SEQ ID NO: 12288 - DNA, 16 bp, Artificial Sequence
  synthetic [barcode part1]
attgagacgactgtag

SEQ ID NO: 12289 - DNA, 16 bp, Artificial Sequence
  synthetic [barcode part1]
gtgagttgagagttac

SEQ ID NO: 12290 - DNA, 16 bp, Artificial Sequence
  synthetic [barcode part1]
atacctctgtgcctct

SEQ ID NO: 12291 - DNA, 16 bp, Artificial Sequence
  synthetic [barcode part1]
tgattcggcaggaacg

SEQ ID NO: 12292 - DNA, 16 bp, Artificial Sequence
  synthetic [barcode part1]
taacggtgcacaggac

SEQ ID NO: 12293 - DNA, 16 bp, Artificial Sequence
  synthetic [barcode part1]
gtgactaggtccttcc

SEQ ID NO: 12294 - DNA, 16 bp, Artificial Sequence
  synthetic [barcode part1]
tgccgagtaagttgtc

SEQ ID NO: 12295 - DNA, 16 bp, Artificial Sequence
  synthetic [barcode part1]
caacacaggagactgc

SEQ ID NO: 12296 - DNA, 16 bp, Artificial Sequence
  synthetic [barcode part1]
gtaggacgttctactg

SEQ ID NO: 12297 - DNA, 16 bp, Artificial Sequence
  synthetic [barcode part1]
gaacaggcctaagacc

SEQ ID NO: 12298 - DNA, 16 bp, Artificial Sequence
  synthetic [barcode part1]
ttcgccagattatacc

SEQ ID NO: 12299 - DNA, 16 bp, Artificial Sequence
  synthetic [barcode part1]
cagtcaatagtgccac

SEQ ID NO: 12300 - DNA, 16 bp, Artificial Sequence
  synthetic [barcode part1]
tggtactctattcacg

SEQ ID NO: 12301 - DNA, 16 bp, Artificial Sequence
  synthetic [barcode part1]
gtcttgaatacgcacg

SEQ ID NO: 12302 - DNA, 16 bp, Artificial Sequence
  synthetic [barcode part1]
tattcggtctccggtg

SEQ ID NO: 12303 - DNA, 16 bp, Artificial Sequence
  synthetic [barcode part1]
tccgcacgtcgttagt

SEQ ID NO: 12304 - DNA, 16 bp, Artificial Sequence
  synthetic [barcode part1]
agatcgcgtgatctgt

SEQ ID NO: 12305 - DNA, 16 bp, Artificial Sequence
  synthetic [barcode part1]
acgccgttctatccag

SEQ ID NO: 12306 - DNA, 16 bp, Artificial Sequence
  synthetic [barcode part1]
tacttgtagtgtcacc

SEQ ID NO: 12307 - DNA, 16 bp, Artificial Sequence
  synthetic [barcode part1]
cagtaggcagacactg

SEQ ID NO: 12308 - DNA, 16 bp, Artificial Sequence
  synthetic [barcode part1]
ttatctcagttacgcg

SEQ ID NO: 12309 - DNA, 16 bp, Artificial Sequence
  synthetic [barcode part1]
tacctcggtgatagac

SEQ ID NO: 12310 - DNA, 16 bp, Artificial Sequence
  synthetic [barcode part1]
tacctcgtctactgtc

SEQ ID NO: 12311 - DNA, 16 bp, Artificial Sequence
  synthetic [barcode part1]
tctgttgtcgagtact

SEQ ID NO: 12312 - DNA, 16 bp, Artificial Sequence
  synthetic [barcode part1]
cactctcgtcgaactg

SEQ ID NO: 12313 - DNA, 16 bp, Artificial Sequence
  synthetic [barcode part1]
cgtgcctcagactact

SEQ ID NO: 12314 - DNA, 16 bp, Artificial Sequence
  synthetic [barcode part1]
taggtcgcgcaagagt

SEQ ID NO: 12315 - DNA, 16 bp, Artificial Sequence
  synthetic [barcode part1]
aggtggtgtacaaccg

SEQ ID NO: 12316 - DNA, 16 bp, Artificial Sequence
  synthetic [barcode part1]
cgtcaggtattagacc

SEQ ID NO: 12317 - DNA, 16 bp, Artificial Sequence
  synthetic [barcode part1]
actcggatcgtagact

SEQ ID NO: 12318 - DNA, 16 bp, Artificial Sequence
  synthetic [barcode part1]
ttgcagagtaggacgc

SEQ ID NO: 12319 - DNA, 16 bp, Artificial Sequence
  synthetic [barcode part1]
tggagttggaaccttc

SEQ ID NO: 12320 - DNA, 16 bp, Artificial Sequence
  synthetic [barcode part1]
gtccacgactaaggag

SEQ ID NO: 12321 - DNA, 16 bp, Artificial Sequence
  synthetic [barcode part1]
ttcctcttacacacgc

SEQ ID NO: 12322 - DNA, 16 bp, Artificial Sequence
  synthetic [barcode part1]
gcaagtgtgccgtaag

SEQ ID NO: 12323 - DNA, 16 bp, Artificial Sequence
  synthetic [barcode part1]
atacgtgcggtgttac

SEQ ID NO: 12324 - DNA, 16 bp, Artificial Sequence
  synthetic [barcode part1]
gaagtgagaactcact

SEQ ID NO: 12325 - DNA, 16 bp, Artificial Sequence
  synthetic [barcode part1]
actgcggtctatccac

SEQ ID NO: 12326 - DNA, 16 bp, Artificial Sequence
  synthetic [barcode part1]
gcggattcaataaggt

SEQ ID NO: 12327 - DNA, 16 bp, Artificial Sequence
  synthetic [barcode part1]
agttgacgtcagtcac

SEQ ID NO: 12328 - DNA, 16 bp, Artificial Sequence
  synthetic [barcode part1]
gcagaggaattcaact

SEQ ID NO: 12329 - DNA, 16 bp, Artificial Sequence
  synthetic [barcode part1]
cgcctattctagaatc

SEQ ID NO: 12330 - DNA, 16 bp, Artificial Sequence
  synthetic [barcode part1]
gacgtatatacaccgc

SEQ ID NO: 12331 - DNA, 16 bp, Artificial Sequence
  synthetic [barcode part1]
ttgtgtggttggtgtg

SEQ ID NO: 12332 - DNA, 16 bp, Artificial Sequence
  synthetic [barcode part1]
acaatcgcctcttggc

SEQ ID NO: 12333 - DNA, 16 bp, Artificial Sequence
  synthetic [barcode part1]
cacagagtcggatcag

SEQ ID NO: 12334 - DNA, 16 bp, Artificial Sequence
  synthetic [barcode part1]
tactggattgtacctc

SEQ ID NO: 12335 - DNA, 16 bp, Artificial Sequence
  synthetic [barcode part1]
agacttgtattctgcc

SEQ ID NO: 12336 - DNA, 16 bp, Artificial Sequence
  synthetic [barcode part1]
gacttaagtgtctcct

SEQ ID NO: 12337 - DNA, 16 bp, Artificial Sequence
  synthetic [barcode part1]
accttgcgatatactc

SEQ ID NO: 12338 - DNA, 16 bp, Artificial Sequence
  synthetic [barcode part1]
gcaactagaaggattc

SEQ ID NO: 12339 - DNA, 16 bp, Artificial Sequence
  synthetic [barcode part1]
tacgaattccaggcgt

SEQ ID NO: 12340 - DNA, 16 bp, Artificial Sequence
  synthetic [barcode part1]
cctccaaccaattctc

SEQ ID NO: 12341 - DNA, 16 bp, Artificial Sequence
  synthetic [barcode part1]
tcagagttgagactcc

SEQ ID NO: 12342 - DNA, 16 bp, Artificial Sequence
  synthetic [barcode part1]
cgagaagagttccttc

SEQ ID NO: 12343 - DNA, 16 bp, Artificial Sequence
  synthetic [barcode part1]
atccaggactccgtct

SEQ ID NO: 12344 - DNA, 16 bp, Artificial Sequence
  synthetic [barcode part1]
ttggacacctgaacac

SEQ ID NO: 12345 - DNA, 16 bp, Artificial Sequence
  synthetic [barcode part1]
acgaatctggcaggac

SEQ ID NO: 12346 - DNA, 16 bp, Artificial Sequence
  synthetic [barcode part1]
ttggtccacgaagtac

SEQ ID NO: 12347 - DNA, 16 bp, Artificial Sequence
  synthetic [barcode part1]
aactcagtggtagtcc

SEQ ID NO: 12348 - DNA, 16 bp, Artificial Sequence
  synthetic [barcode part1]
cgagtaccgtactagt

SEQ ID NO: 12349 - DNA, 16 bp, Artificial Sequence
  synthetic [barcode part1]
tacgatcctaggtgtg

SEQ ID NO: 12350 - DNA, 16 bp, Artificial Sequence
  synthetic [barcode part1]
gccagacagacgtaac

SEQ ID NO: 12351 - DNA, 16 bp, Artificial Sequence
  synthetic [barcode part1]
acgatcggtgttgact

SEQ ID NO: 12352 - DNA, 16 bp, Artificial Sequence
  synthetic [barcode part1]
aatcgaacgtcctacg

SEQ ID NO: 12353 - DNA, 16 bp, Artificial Sequence
  synthetic [barcode part1]
tgcgcaacaccttatt

SEQ ID NO: 12354 - DNA, 16 bp, Artificial Sequence
  synthetic [barcode part1]
gactcgattggtgact

SEQ ID NO: 12355 - DNA, 16 bp, Artificial Sequence
  synthetic [barcode part1]
aacgacgcaggataag

SEQ ID NO: 12356 - DNA, 16 bp, Artificial Sequence
  synthetic [barcode part1]
gatatacctggaaggt

SEQ ID NO: 12357 - DNA, 16 bp, Artificial Sequence
  synthetic [barcode part1]
ttagagaggtctgtag

SEQ ID NO: 12358 - DNA, 16 bp, Artificial Sequence
  synthetic [barcode part1]
cgtgacagtagacggt

SEQ ID NO: 12359 - DNA, 16 bp, Artificial Sequence
  synthetic [barcode part1]
tacaaccgccgtcttg

SEQ ID NO: 12360 - DNA, 16 bp, Artificial Sequence
  synthetic [barcode part1]
gactaatctgaggcct

SEQ ID NO: 12361 - DNA, 16 bp, Artificial Sequence
  synthetic [barcode part1]
ccagaacacgagtggt

SEQ ID NO: 12362 - DNA, 16 bp, Artificial Sequence
  synthetic [barcode part1]
aatatcttgttccgcg

SEQ ID NO: 12363 - DNA, 16 bp, Artificial Sequence
  synthetic [barcode part1]
acgaggaaccgtcaac

SEQ ID NO: 12364 - DNA, 16 bp, Artificial Sequence
  synthetic [barcode part1]
tccgtattcggcaatt

SEQ ID NO: 12365 - DNA, 16 bp, Artificial Sequence
  synthetic [barcode part1]
gcacaaggaaccactg

SEQ ID NO: 12366 - DNA, 16 bp, Artificial Sequence
  synthetic [barcode part1]
gccgcaactatagtac

SEQ ID NO: 12367 - DNA, 16 bp, Artificial Sequence
  synthetic [barcode part1]
gtggagacgacaatcc

SEQ ID NO: 12368 - DNA, 16 bp, Artificial Sequence
  synthetic [barcode part1]
ccgaacctcttcacag

SEQ ID NO: 12369 - DNA, 16 bp, Artificial Sequence
  synthetic [barcode part1]
caccagaatctggtgt

SEQ ID NO: 12370 - DNA, 16 bp, Artificial Sequence
  synthetic [barcode part1]
tagtacgtcagtgcac

SEQ ID NO: 12371 - DNA, 16 bp, Artificial Sequence
  synthetic [barcode part1]
caggacagtagttgcg

SEQ ID NO: 12372 - DNA, 16 bp, Artificial Sequence
  synthetic [barcode part1]
aaccgtaggttaagac

SEQ ID NO: 12373 - DNA, 16 bp, Artificial Sequence
  synthetic [barcode part1]
aggaggcgtctaggtt

SEQ ID NO: 12374 - DNA, 16 bp, Artificial Sequence
  synthetic [barcode part1]
accagaggttaatacg

SEQ ID NO: 12375 - DNA, 16 bp, Artificial Sequence
  synthetic [barcode part1]
gtgaaggcggtagttc

SEQ ID NO: 12376 - DNA, 16 bp, Artificial Sequence
  synthetic [barcode part1]
agtaccgcaatcgact

SEQ ID NO: 12377 - DNA, 16 bp, Artificial Sequence
  synthetic [barcode part1]
gttcctggcaatctgc

SEQ ID NO: 12378 - DNA, 16 bp, Artificial Sequence
  synthetic [barcode part1]
cctgcactgatctggt

SEQ ID NO: 12379 - DNA, 16 bp, Artificial Sequence
  synthetic [barcode part1]
tacaggcctacggatt

SEQ ID NO: 12380 - DNA, 16 bp, Artificial Sequence
  synthetic [barcode part1]
gactaacgaagtctcc

SEQ ID NO: 12381 - DNA, 16 bp, Artificial Sequence
  synthetic [barcode part1]
ccaatacgttagtgcg

SEQ ID NO: 12382 - DNA, 16 bp, Artificial Sequence
  synthetic [barcode part1]
tgagtggcgagattcg

SEQ ID NO: 12383 - DNA, 16 bp, Artificial Sequence
  synthetic [barcode part1]
ccaactctcgtacgac

SEQ ID NO: 12384 - DNA, 16 bp, Artificial Sequence
  synthetic [barcode part1]
ttgaagtcctatccgt

SEQ ID NO: 12385 - DNA, 16 bp, Artificial Sequence
  synthetic [barcode part1]
tcaatatcgcgcagtg

SEQ ID NO: 12386 - DNA, 16 bp, Artificial Sequence
  synthetic [barcode part1]
atacgactctcaactc

SEQ ID NO: 12387 - DNA, 16 bp, Artificial Sequence
  synthetic [barcode part1]
aggaccacgtaagtcg

SEQ ID NO: 12388 - DNA, 16 bp, Artificial Sequence
  synthetic [barcode part1]
acgcaataactccttc

SEQ ID NO: 12389 - DNA, 16 bp, Artificial Sequence
  synthetic [barcode part1]
taggtacgttgagaac

SEQ ID NO: 12390 - DNA, 16 bp, Artificial Sequence
  synthetic [barcode part1]
tctgaacagtgtaccg

SEQ ID NO: 12391 - DNA, 16 bp, Artificial Sequence
  synthetic [barcode part1]
gacggttgactgttgt

SEQ ID NO: 12392 - DNA, 16 bp, Artificial Sequence
  synthetic [barcode part1]
aggacggtaaggtagt

SEQ ID NO: 12393 - DNA, 16 bp, Artificial Sequence
  synthetic [barcode part1]
aggaatacgaactacc

SEQ ID NO: 12394 - DNA, 16 bp, Artificial Sequence
  synthetic [barcode part1]
ttggttgtcttcctcg

SEQ ID NO: 12395 - DNA, 16 bp, Artificial Sequence
  synthetic [barcode part1]
gcggccagtatattgt

SEQ ID NO: 12396 - DNA, 16 bp, Artificial Sequence
  synthetic [barcode part1]
tctccttcaataccgc

SEQ ID NO: 12397 - DNA, 16 bp, Artificial Sequence
  synthetic [barcode part1]
gacgttgtgcaacact

SEQ ID NO: 12398 - DNA, 16 bp, Artificial Sequence
  synthetic [barcode part1]
acggttaactaacgcc

SEQ ID NO: 12399 - DNA, 16 bp, Artificial Sequence
  synthetic [barcode part1]
atcagactgttctcac

SEQ ID NO: 12400 - DNA, 16 bp, Artificial Sequence
  synthetic [barcode part1]
aacacgttgacgtacc

SEQ ID NO: 12401 - DNA, 16 bp, Artificial Sequence
  synthetic [barcode part1]
gagtaccggcaggatt

SEQ ID NO: 12402 - DNA, 16 bp, Artificial Sequence
  synthetic [barcode part1]
taacgcgaagaatcgt

SEQ ID NO: 12403 - DNA, 16 bp, Artificial Sequence
  synthetic [barcode part1]
agataaccggtctctg

SEQ ID NO: 12404 - DNA, 16 bp, Artificial Sequence
  synthetic [barcode part1]
gataccaacgtcgtac

SEQ ID NO: 12405 - DNA, 16 bp, Artificial Sequence
  synthetic [barcode part1]
caacacacctccgatc

SEQ ID NO: 12406 - DNA, 16 bp, Artificial Sequence
  synthetic [barcode part1]
tcttggaaggtaagtg

SEQ ID NO: 12407 - DNA, 16 bp, Artificial Sequence
  synthetic [barcode part1]
aactgcacaacacgtc

SEQ ID NO: 12408 - DNA, 16 bp, Artificial Sequence
  synthetic [barcode part1]
tgacaacgaggtgcac

SEQ ID NO: 12409 - DNA, 16 bp, Artificial Sequence
  synthetic [barcode part1]
acctacctcgtctatc

SEQ ID NO: 12410 - DNA, 16 bp, Artificial Sequence
  synthetic [barcode part1]
actgaggccaattctg

SEQ ID NO: 12411 - DNA, 16 bp, Artificial Sequence
  synthetic [barcode part1]
gtgaaccgttgcctct

SEQ ID NO: 12412 - DNA, 16 bp, Artificial Sequence
  synthetic [barcode part1]
taaggttatcggccgt

SEQ ID NO: 12413 - DNA, 16 bp, Artificial Sequence
  synthetic [barcode part1]
cctcacactgacaacc

SEQ ID NO: 12414 - DNA, 16 bp, Artificial Sequence
  synthetic [barcode part1]
taagtatcttccgacc

SEQ ID NO: 12415 - DNA, 16 bp, Artificial Sequence
  synthetic [barcode part1]
tcagtgttggtgtgtg

SEQ ID NO: 12416 - DNA, 16 bp, Artificial Sequence
  synthetic [barcode part1]
tcctaccacggattcg

SEQ ID NO: 12417 - DNA, 16 bp, Artificial Sequence
  synthetic [barcode part1]
aaccttccttcaccgt

SEQ ID NO: 12418 - DNA, 16 bp, Artificial Sequence
  synthetic [barcode part1]
cacgacacgaacgagt

SEQ ID NO: 12419 - DNA, 16 bp, Artificial Sequence
  synthetic [barcode part1]
accttgaatacgtgcg

SEQ ID NO: 12420 - DNA, 16 bp, Artificial Sequence
  synthetic [barcode part1]
aacctgttgaagtgag

SEQ ID NO: 12421 - DNA, 16 bp, Artificial Sequence
  synthetic [barcode part1]
cgccactagtagtagt

SEQ ID NO: 12422 - DNA, 16 bp, Artificial Sequence
  synthetic [barcode part1]
taacaagaggtctgtg

SEQ ID NO: 12423 - DNA, 16 bp, Artificial Sequence
  synthetic [barcode part1]
gtgtgactgacacact

SEQ ID NO: 12424 - DNA, 16 bp, Artificial Sequence
  synthetic [barcode part1]
taatccttctctcggc

SEQ ID NO: 12425 - DNA, 16 bp, Artificial Sequence
  synthetic [barcode part1]
tagagtcacacgtgtc

SEQ ID NO: 12426 - DNA, 16 bp, Artificial Sequence
  synthetic [barcode part1]
gttaattacacgcgcg

SEQ ID NO: 12427 - DNA, 16 bp, Artificial Sequence
  synthetic [barcode part1]
gaccggttagttaacc

SEQ ID NO: 12428 - DNA, 16 bp, Artificial Sequence
  synthetic [barcode part1]
tcaattcagaccggac

SEQ ID NO: 12429 - DNA, 16 bp, Artificial Sequence
  synthetic [barcode part1]
acaacaaggacacttg

SEQ ID NO: 12430 - DNA, 16 bp, Artificial Sequence
  synthetic [barcode part1]
cggtacctgtctgttg

SEQ ID NO: 12431 - DNA, 16 bp, Artificial Sequence
  synthetic [barcode part1]
acaatccgttcgacag

SEQ ID NO: 12432 - DNA, 16 bp, Artificial Sequence
  synthetic [barcode part1]
aactcggattgccagt

SEQ ID NO: 12433 - DNA, 16 bp, Artificial Sequence
  synthetic [barcode part1]
tatcaccaacgcactt

SEQ ID NO: 12434 - DNA, 16 bp, Artificial Sequence
  synthetic [barcode part1]
gactcgatataggagt

SEQ ID NO: 12435 - DNA, 16 bp, Artificial Sequence
  synthetic [barcode part1]
ataggaagtcgagttc

SEQ ID NO: 12436 - DNA, 16 bp, Artificial Sequence
  synthetic [barcode part1]
cgtgtgaagacgtctt

SEQ ID NO: 12437 - DNA, 16 bp, Artificial Sequence
  synthetic [barcode part1]
tggcaccaacggatag

SEQ ID NO: 12438 - DNA, 16 bp, Artificial Sequence
  synthetic [barcode part1]
cctcgcaactactggt

SEQ ID NO: 12439 - DNA, 16 bp, Artificial Sequence
  synthetic [barcode part1]
caggactacacgtact

SEQ ID NO: 12440 - DNA, 16 bp, Artificial Sequence
  synthetic [barcode part1]
aaccgtggtgccaatt

SEQ ID NO: 12441 - DNA, 16 bp, Artificial Sequence
  synthetic [barcode part1]
cgatcttacgtgccgt

SEQ ID NO: 12442 - DNA, 16 bp, Artificial Sequence
  synthetic [barcode part1]
tgtggcgtatcacaac

SEQ ID NO: 12443 - DNA, 16 bp, Artificial Sequence
  synthetic [barcode part1]
gactcagtcgacgatt

SEQ ID NO: 12444 - DNA, 16 bp, Artificial Sequence
  synthetic [barcode part1]
tcacggatcgttactt

SEQ ID NO: 12445 - DNA, 16 bp, Artificial Sequence
  synthetic [barcode part1]
actggcggtgattatc

SEQ ID NO: 12446 - DNA, 16 bp, Artificial Sequence
  synthetic [barcode part1]
tgcgttatcaaccttg

SEQ ID NO: 12447 - DNA, 16 bp, Artificial Sequence
  synthetic [barcode part1]
ttacttggtggtactc

SEQ ID NO: 12448 - DNA, 16 bp, Artificial Sequence
  synthetic [barcode part1]
tggtaggataagtctg

SEQ ID NO: 12449 - DNA, 16 bp, Artificial Sequence
  synthetic [barcode part1]
attacttgcggcaggt

SEQ ID NO: 12450 - DNA, 16 bp, Artificial Sequence
  synthetic [barcode part1]
acacctaacctcgtcg

SEQ ID NO: 12451 - DNA, 16 bp, Artificial Sequence
  synthetic [barcode part1]
actactgatcggatcg

SEQ ID NO: 12452 - DNA, 16 bp, Artificial Sequence
  synthetic [barcode part1]
taaccgagaccaactc

SEQ ID NO: 12453 - DNA, 16 bp, Artificial Sequence
  synthetic [barcode part1]
aagattgaatcgcgtg

SEQ ID NO: 12454 - DNA, 16 bp, Artificial Sequence
  synthetic [barcode part1]
ccttcacgaatcgtcg

SEQ ID NO: 12455 - DNA, 16 bp, Artificial Sequence
  synthetic [barcode part1]
acagtctgcgagaacg

SEQ ID NO: 12456 - DNA, 16 bp, Artificial Sequence
  synthetic [barcode part1]
tgccgaacctgtgtct

SEQ ID NO: 12457 - DNA, 16 bp, Artificial Sequence
  synthetic [barcode part1]
ccgttataccttgcct

SEQ ID NO: 12458 - DNA, 16 bp, Artificial Sequence
  synthetic [barcode part1]
gcacagttgacacgtt

SEQ ID NO: 12459 - DNA, 16 bp, Artificial Sequence
  synthetic [barcode part1]
gttgagtgacagttcc

SEQ ID NO: 12460 - DNA, 16 bp, Artificial Sequence
  synthetic [barcode part1]
tacgtgatatctcgtc

SEQ ID NO: 12461 - DNA, 16 bp, Artificial Sequence
  synthetic [barcode part1]
gagtatcctcgagtac

SEQ ID NO: 12462 - DNA, 16 bp, Artificial Sequence
  synthetic [barcode part1]
ataggaggactatcgt

SEQ ID NO: 12463 - DNA, 16 bp, Artificial Sequence
  synthetic [barcode part1]
gtgcagttgtgcaact

SEQ ID NO: 12464 - DNA, 16 bp, Artificial Sequence
  synthetic [barcode part1]
ttacaggtctggcctc

SEQ ID NO: 12465 - DNA, 16 bp, Artificial Sequence
  synthetic [barcode part1]
aggacaacacttaggt

SEQ ID NO: 12466 - DNA, 16 bp, Artificial Sequence
  synthetic [barcode part1]
gttaggcagtataggt

SEQ ID NO: 12467 - DNA, 16 bp, Artificial Sequence
  synthetic [barcode part1]
cacacaattcggcctc

SEQ ID NO: 12468 - DNA, 16 bp, Artificial Sequence
  synthetic [barcode part1]
tccgaccaatcaaggt

SEQ ID NO: 12469 - DNA, 16 bp, Artificial Sequence
  synthetic [barcode part1]
gttacttctgcggacc

SEQ ID NO: 12470 - DNA, 16 bp, Artificial Sequence
  synthetic [barcode part1]
agtgagattccgtcgt

SEQ ID NO: 12471 - DNA, 16 bp, Artificial Sequence
  synthetic [barcode part1]
caggtgtaacctacgt

SEQ ID NO: 12472 - DNA, 16 bp, Artificial Sequence
  synthetic [barcode part1]
cagagtcgtacgtgtt

SEQ ID NO: 12473 - DNA, 16 bp, Artificial Sequence
  synthetic [barcode part1]
ataacaggacacgttg

SEQ ID NO: 12474 - DNA, 16 bp, Artificial Sequence
  synthetic [barcode part1]
acgataagtccaggcg

SEQ ID NO: 12475 - DNA, 16 bp, Artificial Sequence
  synthetic [barcode part1]
tctaaccagaaggcct

SEQ ID NO: 12476 - DNA, 16 bp, Artificial Sequence
  synthetic [barcode part1]
tacgacaaggtaagtc

SEQ ID NO: 12477 - DNA, 16 bp, Artificial Sequence
  synthetic [barcode part1]
tccgaattaaggagtg

SEQ ID NO: 12478 - DNA, 16 bp, Artificial Sequence
  synthetic [barcode part1]
cggactggaggtatac

SEQ ID NO: 12479 - DNA, 16 bp, Artificial Sequence
  synthetic [barcode part1]
tagaccgcgacttagt

SEQ ID NO: 12480 - DNA, 16 bp, Artificial Sequence
  synthetic [barcode part1]
tgtgtcaaccaacacg

SEQ ID NO: 12481 - DNA, 16 bp, Artificial Sequence
  synthetic [barcode part1]
attcgccaagttccgc

SEQ ID NO: 12482 - DNA, 16 bp, Artificial Sequence
  synthetic [barcode part1]
gtcgcactgtatcaag

SEQ ID NO: 12483 - DNA, 16 bp, Artificial Sequence
  synthetic [barcode part1]
tcttgaggcaacgttg

SEQ ID NO: 12484 - DNA, 16 bp, Artificial Sequence
  synthetic [barcode part1]
gagttattcacgtcct

SEQ ID NO: 12485 - DNA, 16 bp, Artificial Sequence
  synthetic [barcode part1]
gcggcaggaatatctg

SEQ ID NO: 12486 - DNA, 16 bp, Artificial Sequence
  synthetic [barcode part1]
agtattaactgcggcc

SEQ ID NO: 12487 - DNA, 16 bp, Artificial Sequence
  synthetic [barcode part1]
gttggtgtgtcttact

SEQ ID NO: 12488 - DNA, 16 bp, Artificial Sequence
  synthetic [barcode part1]
ttcgaaggaagtcctc

SEQ ID NO: 12489 - DNA, 16 bp, Artificial Sequence
  synthetic [barcode part1]
gacctctgattatacc

SEQ ID NO: 12490 - DNA, 16 bp, Artificial Sequence
  synthetic [barcode part1]
acgcgtaggttgactt

SEQ ID NO: 12491 - DNA, 16 bp, Artificial Sequence
  synthetic [barcode part1]
aggcgtattctgtgtg

SEQ ID NO: 12492 - DNA, 16 bp, Artificial Sequence
  synthetic [barcode part1]
cacacaggtaggacgt

SEQ ID NO: 12493 - DNA, 16 bp, Artificial Sequence
  synthetic [barcode part1]
cactaccacaagacac

SEQ ID NO: 12494 - DNA, 16 bp, Artificial Sequence
  synthetic [barcode part1]
cctatccacaagtgag

SEQ ID NO: 12495 - DNA, 16 bp, Artificial Sequence
  synthetic [barcode part1]
tataacgccactcact

SEQ ID NO: 12496 - DNA, 16 bp, Artificial Sequence
  synthetic [barcode part1]
cgcgaattattgcctt

SEQ ID NO: 12497 - DNA, 16 bp, Artificial Sequence
  synthetic [barcode part1]
tctgatcttctccggt

SEQ ID NO: 12498 - DNA, 16 bp, Artificial Sequence
  synthetic [barcode part1]
gcagaacacagtgaag

SEQ ID NO: 12499 - DNA, 16 bp, Artificial Sequence
  synthetic [barcode part1]
tggtcgagtacgtgtt

SEQ ID NO: 12500 - DNA, 16 bp, Artificial Sequence
  synthetic [barcode part1]
aatataccacgcgacc

SEQ ID NO: 12501 - DNA, 16 bp, Artificial Sequence
  synthetic [barcode part1]
gacagacgaactccag

SEQ ID NO: 12502 - DNA, 16 bp, Artificial Sequence
  synthetic [barcode part1]
atcttcgtcacgcctt

SEQ ID NO: 12503 - DNA, 16 bp, Artificial Sequence
  synthetic [barcode part1]
gcgtgtatcctgaagt

SEQ ID NO: 12504 - DNA, 16 bp, Artificial Sequence
  synthetic [barcode part1]
ttcggaaggtcctaac

SEQ ID NO: 12505 - DNA, 16 bp, Artificial Sequence
  synthetic [barcode part1]
atatcaacgtgtcggc

SEQ ID NO: 12506 - DNA, 16 bp, Artificial Sequence
  synthetic [barcode part1]
cgataactcggatcac

SEQ ID NO: 12507 - DNA, 16 bp, Artificial Sequence
  synthetic [barcode part1]
gcaagtcttggtacgt

SEQ ID NO: 12508 - DNA, 16 bp, Artificial Sequence
  synthetic [barcode part1]
gtgttccttaggttac

SEQ ID NO: 12509 - DNA, 16 bp, Artificial Sequence
  synthetic [barcode part1]
atacgtgcgcagtatc

SEQ ID NO: 12510 - DNA, 16 bp, Artificial Sequence
  synthetic [barcode part1]
gagtctaacgatcacc

SEQ ID NO: 12511 - DNA, 16 bp, Artificial Sequence
  synthetic [barcode part1]
cacgagtgagtctact

SEQ ID NO: 12512 - DNA, 16 bp, Artificial Sequence
  synthetic [barcode part1]
gccggtggaatcaagt

SEQ ID NO: 12513 - DNA, 16 bp, Artificial Sequence
  synthetic [barcode part1]
tcaagtgacttgtggc

SEQ ID NO: 12514 - DNA, 16 bp, Artificial Sequence
  synthetic [barcode part1]
gacttgagtatccttc

SEQ ID NO: 12515 - DNA, 16 bp, Artificial Sequence
  synthetic [barcode part1]
cgttaggtgttcttgt

SEQ ID NO: 12516 - DNA, 16 bp, Artificial Sequence
  synthetic [barcode part1]
gatccaatcgacgatc

SEQ ID NO: 12517 - DNA, 16 bp, Artificial Sequence
  synthetic [barcode part1]
ccacttacgtcgtggt

SEQ ID NO: 12518 - DNA, 16 bp, Artificial Sequence
  synthetic [barcode part1]
ccttaccgtcttgttg

SEQ ID NO: 12519 - DNA, 16 bp, Artificial Sequence
  synthetic [barcode part1]
caagaggcgatacgtc

SEQ ID NO: 12520 - DNA, 16 bp, Artificial Sequence
  synthetic [barcode part1]
agtgtactgtgtggtc

SEQ ID NO: 12521 - DNA, 16 bp, Artificial Sequence
  synthetic [barcode part1]
gaggaggagtcaattg

SEQ ID NO: 12522 - DNA, 16 bp, Artificial Sequence
  synthetic [barcode part1]
tgtacacgacttcgag

SEQ ID NO: 12523 - DNA, 16 bp, Artificial Sequence
  synthetic [barcode part1]
caacgtacctcactgc

SEQ ID NO: 12524 - DNA, 16 bp, Artificial Sequence
  synthetic [barcode part1]
cagtcaatctcaggac

SEQ ID NO: 12525 - DNA, 16 bp, Artificial Sequence
  synthetic [barcode part1]
tcgactcacaattacc

SEQ ID NO: 12526 - DNA, 16 bp, Artificial Sequence
  synthetic [barcode part1]
attccaccaagttcgt

SEQ ID NO: 12527 - DNA, 16 bp, Artificial Sequence
  synthetic [barcode part1]
cctagagtacacgtgt

SEQ ID NO: 12528 - DNA, 16 bp, Artificial Sequence
  synthetic [barcode part1]
gttcgaatcgcgaatc

SEQ ID NO: 12529 - DNA, 16 bp, Artificial Sequence
  synthetic [barcode part1]
gtctgtctcgtaacgc

SEQ ID NO: 12530 - DNA, 16 bp, Artificial Sequence
  synthetic [barcode part1]
tctcgattgacgaggt

SEQ ID NO: 12531 - DNA, 16 bp, Artificial Sequence
  synthetic [barcode part1]
gataaggtgcgttagt

SEQ ID NO: 12532 - DNA, 16 bp, Artificial Sequence
  synthetic [barcode part1]
agttacgcctcttggc

SEQ ID NO: 12533 - DNA, 16 bp, Artificial Sequence
  synthetic [barcode part1]
taggcacgccacttct

SEQ ID NO: 12534 - DNA, 16 bp, Artificial Sequence
  synthetic [barcode part1]
attggtcgaagtcctg

SEQ ID NO: 12535 - DNA, 16 bp, Artificial Sequence
  synthetic [barcode part1]
agaatagtccaggtac

SEQ ID NO: 12536 - DNA, 16 bp, Artificial Sequence
  synthetic [barcode part1]
gacttgtaacgcctag

SEQ ID NO: 12537 - DNA, 16 bp, Artificial Sequence
  synthetic [barcode part1]
gcgtagaagtacgaag

SEQ ID NO: 12538 - DNA, 16 bp, Artificial Sequence
  synthetic [barcode part1]
acgacaggagttagag

SEQ ID NO: 12539 - DNA, 16 bp, Artificial Sequence
  synthetic [barcode part1]
taaggatcagattgcg

SEQ ID NO: 12540 - DNA, 16 bp, Artificial Sequence
  synthetic [barcode part1]
cgtctcgacgataagt

SEQ ID NO: 12541 - DNA, 16 bp, Artificial Sequence
  synthetic [barcode part1]
tgccgtcttacgtggt

SEQ ID NO: 12542 - DNA, 16 bp, Artificial Sequence
  synthetic [barcode part1]
tgcctctctcttacag

SEQ ID NO: 12543 - DNA, 16 bp, Artificial Sequence
  synthetic [barcode part1]
gcgaacagtaatatcg

SEQ ID NO: 12544 - DNA, 16 bp, Artificial Sequence
  synthetic [barcode part1]
caggcggttgtaacag

SEQ ID NO: 12545 - DNA, 16 bp, Artificial Sequence
  synthetic [barcode part1]
accggtctcaattgag

SEQ ID NO: 12546 - DNA, 16 bp, Artificial Sequence
  synthetic [barcode part1]
gttctgttctgtaggt

SEQ ID NO: 12547 - DNA, 16 bp, Artificial Sequence
  synthetic [barcode part1]
acgttagtcggtgtac

SEQ ID NO: 12548 - DNA, 16 bp, Artificial Sequence
  synthetic [barcode part1]
ccacacgaactggaag

SEQ ID NO: 12549 - DNA, 16 bp, Artificial Sequence
  synthetic [barcode part1]
tccttccgagattcct

SEQ ID NO: 12550 - DNA, 16 bp, Artificial Sequence
  synthetic [barcode part1]
cacgattcgaccttcg

SEQ ID NO: 12551 - DNA, 16 bp, Artificial Sequence
  synthetic [barcode part1]
tgtcgaataggagtac

SEQ ID NO: 12552 - DNA, 16 bp, Artificial Sequence
  synthetic [barcode part1]
cactgatccttagttg

SEQ ID NO: 12553 - DNA, 16 bp, Artificial Sequence
  synthetic [barcode part1]
taagaccgtcggttac

SEQ ID NO: 12554 - DNA, 16 bp, Artificial Sequence
  synthetic [barcode part1]
gtcgtaggacaggtgt

SEQ ID NO: 12555 - DNA, 16 bp, Artificial Sequence
  synthetic [barcode part1]
tagaggcacggtctag

SEQ ID NO: 12556 - DNA, 16 bp, Artificial Sequence
  synthetic [barcode part1]
atcttcgcactcctgt

SEQ ID NO: 12557 - DNA, 16 bp, Artificial Sequence
  synthetic [barcode part1]
cactggatactcttgt

SEQ ID NO: 12558 - DNA, 16 bp, Artificial Sequence
  synthetic [barcode part1]
gtacgtagactggttc

SEQ ID NO: 12559 - DNA, 16 bp, Artificial Sequence
  synthetic [barcode part1]
tatcgtgcaatcgacg

SEQ ID NO: 12560 - DNA, 16 bp, Artificial Sequence
  synthetic [barcode part1]
cagatctacttcactg

SEQ ID NO: 12561 - DNA, 16 bp, Artificial Sequence
  synthetic [barcode part1]
acacctaagatccacg

SEQ ID NO: 12562 - DNA, 16 bp, Artificial Sequence
  synthetic [barcode part1]
taaggcctcaggactt

SEQ ID NO: 12563 - DNA, 16 bp, Artificial Sequence
  synthetic [barcode part1]
gcggttattccaatct

SEQ ID NO: 12564 - DNA, 16 bp, Artificial Sequence
  synthetic [barcode part1]
taacggttgattcggc

SEQ ID NO: 12565 - DNA, 16 bp, Artificial Sequence
  synthetic [barcode part1]
gcgtaaccttcaactt

SEQ ID NO: 12566 - DNA, 16 bp, Artificial Sequence
  synthetic [barcode part1]
gtgatcttgccaagtg

SEQ ID NO: 12567 - DNA, 16 bp, Artificial Sequence
  synthetic [barcode part1]
atcaggtgtgactcac

SEQ ID NO: 12568 - DNA, 16 bp, Artificial Sequence
  synthetic [barcode part1]
tcttgatacgcgattc

SEQ ID NO: 12569 - DNA, 16 bp, Artificial Sequence
  synthetic [barcode part1]
accttcctcaactctg

SEQ ID NO: 12570 - DNA, 16 bp, Artificial Sequence
  synthetic [barcode part1]
gagtgaacacttgcct

SEQ ID NO: 12571 - DNA, 16 bp, Artificial Sequence
  synthetic [barcode part1]
tatcttcaccggattg

SEQ ID NO: 12572 - DNA, 16 bp, Artificial Sequence
  synthetic [barcode part1]
cactcaacggtccttg

SEQ ID NO: 12573 - DNA, 16 bp, Artificial Sequence
  synthetic [barcode part1]
tccactagagacgact

SEQ ID NO: 12574 - DNA, 16 bp, Artificial Sequence
  synthetic [barcode part1]
tccgtaactgtgagtg

SEQ ID NO: 12575 - DNA, 16 bp, Artificial Sequence
  synthetic [barcode part1]
gtaactgtacgtggtc

SEQ ID NO: 12576 - DNA, 16 bp, Artificial Sequence
  synthetic [barcode part1]
atatctccgacctaac

SEQ ID NO: 12577 - DNA, 16 bp, Artificial Sequence
  synthetic [barcode part1]
aacgtacctccgactc

SEQ ID NO: 12578 - DNA, 16 bp, Artificial Sequence
  synthetic [barcode part1]
ccaagtactgtcttac

SEQ ID NO: 12579 - DNA, 16 bp, Artificial Sequence
  synthetic [barcode part1]
attggtcctctccttg

SEQ ID NO: 12580 - DNA, 16 bp, Artificial Sequence
  synthetic [barcode part1]
tacaaccgactacgtg

SEQ ID NO: 12581 - DNA, 16 bp, Artificial Sequence
  synthetic [barcode part1]
tacaattcgcgtcgag

SEQ ID NO: 12582 - DNA, 16 bp, Artificial Sequence
  synthetic [barcode part1]
actgtctacctgcggt

SEQ ID NO: 12583 - DNA, 16 bp, Artificial Sequence
  synthetic [barcode part1]
tcggaatcaggtggac

SEQ ID NO: 12584 - DNA, 16 bp, Artificial Sequence
  synthetic [barcode part1]
gaggcaagtccgtaac

SEQ ID NO: 12585 - DNA, 16 bp, Artificial Sequence
  synthetic [barcode part1]
cgacaataaggacgcc

SEQ ID NO: 12586 - DNA, 16 bp, Artificial Sequence
  synthetic [barcode part1]
gcaccgtgtagacaag

SEQ ID NO: 12587 - DNA, 16 bp, Artificial Sequence
  synthetic [barcode part1]
gcaccttgacctgatc

SEQ ID NO: 12588 - DNA, 16 bp, Artificial Sequence
  synthetic [barcode part1]
aagtctgtcactatcc

SEQ ID NO: 12589 - DNA, 16 bp, Artificial Sequence
  synthetic [barcode part1]
ttacggactcacagac

SEQ ID NO: 12590 - DNA, 16 bp, Artificial Sequence
  synthetic [barcode part1]
cgaacgttcttgccgt

SEQ ID NO: 12591 - DNA, 16 bp, Artificial Sequence
  synthetic [barcode part1]
tcgttcggaattccgc

SEQ ID NO: 12592 - DNA, 16 bp, Artificial Sequence
  synthetic [barcode part1]
cctgccgatataattc

SEQ ID NO: 12593 - DNA, 16 bp, Artificial Sequence
  synthetic [barcode part1]
aggtcgttcgtcaagt

SEQ ID NO: 12594 - DNA, 16 bp, Artificial Sequence
  synthetic [barcode part1]
tagtaagttcggacag

SEQ ID NO: 12595 - DNA, 16 bp, Artificial Sequence
  synthetic [barcode part1]
tccactctaagattcg

SEQ ID NO: 12596 - DNA, 16 bp, Artificial Sequence
  synthetic [barcode part1]
gagatctgtgacactc

SEQ ID NO: 12597 - DNA, 16 bp, Artificial Sequence
  synthetic [barcode part1]
cctcggagataggtag

SEQ ID NO: 12598 - DNA, 16 bp, Artificial Sequence
  synthetic [barcode part1]
tattcctcgacggtcg

SEQ ID NO: 12599 - DNA, 16 bp, Artificial Sequence
  synthetic [barcode part1]
taacctgcgaattgcg

SEQ ID NO: 12600 - DNA, 16 bp, Artificial Sequence
  synthetic [barcode part1]
tggtgtgaagacagtt

SEQ ID NO: 12601 - DNA, 16 bp, Artificial Sequence
  synthetic [barcode part1]
aggcgtacaacgactg

SEQ ID NO: 12602 - DNA, 16 bp, Artificial Sequence
  synthetic [barcode part1]
gttggccacgttatag

SEQ ID NO: 12603 - DNA, 16 bp, Artificial Sequence
  synthetic [barcode part1]
gcacgattcttctagt

SEQ ID NO: 12604 - DNA, 16 bp, Artificial Sequence
  synthetic [barcode part1]
tggatcgtcgacgatt

SEQ ID NO: 12605 - DNA, 16 bp, Artificial Sequence
  synthetic [barcode part1]
aacagagtggcagagt

SEQ ID NO: 12606 - DNA, 16 bp, Artificial Sequence
  synthetic [barcode part1]
gagtcgaagaaccaag

SEQ ID NO: 12607 - DNA, 16 bp, Artificial Sequence
  synthetic [barcode part1]
agtaaggccaggcgtt

SEQ ID NO: 12608 - DNA, 16 bp, Artificial Sequence
  synthetic [barcode part1]
tgattcttggtacacc

SEQ ID NO: 12609 - DNA, 16 bp, Artificial Sequence
  synthetic [barcode part1]
cctgatatccacgtcg

SEQ ID NO: 12610 - DNA, 16 bp, Artificial Sequence
  synthetic [barcode part1]
cctggcctaatcgtac

SEQ ID NO: 12611 - DNA, 16 bp, Artificial Sequence
  synthetic [barcode part1]
ccaggaagtatctaag

SEQ ID NO: 12612 - DNA, 16 bp, Artificial Sequence
  synthetic [barcode part1]
tgtaagtacggtgagt

SEQ ID NO: 12613 - DNA, 16 bp, Artificial Sequence
  synthetic [barcode part1]
cgtgtaagtggaatac

SEQ ID NO: 12614 - DNA, 16 bp, Artificial Sequence
  synthetic [barcode part1]
actgtaggtgagtggc

SEQ ID NO: 12615 - DNA, 16 bp, Artificial Sequence
  synthetic [barcode part1]
actattccgaacactc

SEQ ID NO: 12616 - DNA, 16 bp, Artificial Sequence
  synthetic [barcode part1]
cagagaatcgagaggt

SEQ ID NO: 12617 - DNA, 16 bp, Artificial Sequence
  synthetic [barcode part1]
taattccgcactagtc

SEQ ID NO: 12618 - DNA, 16 bp, Artificial Sequence
  synthetic [barcode part1]
ccgttcagaacttcgc

SEQ ID NO: 12619 - DNA, 16 bp, Artificial Sequence
  synthetic [barcode part1]
acagtctaagttgccg

SEQ ID NO: 12620 - DNA, 16 bp, Artificial Sequence
  synthetic [barcode part1]
tagtacacttccgact

SEQ ID NO: 12621 - DNA, 16 bp, Artificial Sequence
  synthetic [barcode part1]
tacaacgtaggacctc

SEQ ID NO: 12622 - DNA, 16 bp, Artificial Sequence
  synthetic [barcode part1]
acaacacgtcaactgc

SEQ ID NO: 12623 - DNA, 16 bp, Artificial Sequence
  synthetic [barcode part1]
taatagtctcttgcgc

SEQ ID NO: 12624 - DNA, 16 bp, Artificial Sequence
  synthetic [barcode part1]
tacgtggttcgtaggt

SEQ ID NO: 12625 - DNA, 16 bp, Artificial Sequence
  synthetic [barcode part1]
tgatacggtacctgac

SEQ ID NO: 12626 - DNA, 16 bp, Artificial Sequence
  synthetic [barcode part1]
gttgttctcgtagact

SEQ ID NO: 12627 - DNA, 16 bp, Artificial Sequence
  synthetic [barcode part1]
caggagagtcgtacac

SEQ ID NO: 12628 - DNA, 16 bp, Artificial Sequence
  synthetic [barcode part1]
gtgtagtattgcgtgc

SEQ ID NO: 12629 - DNA, 16 bp, Artificial Sequence
  synthetic [barcode part1]
cagaccgaggatacac

SEQ ID NO: 12630 - DNA, 16 bp, Artificial Sequence
  synthetic [barcode part1]
gattacgtgacacacc

SEQ ID NO: 12631 - DNA, 16 bp, Artificial Sequence
  synthetic [barcode part1]
tagttgaaccgcggtt

SEQ ID NO: 12632 - DNA, 16 bp, Artificial Sequence
  synthetic [barcode part1]
cgatatacacaggcct

SEQ ID NO: 12633 - DNA, 16 bp, Artificial Sequence
  synthetic [barcode part1]
gtgagtctcagacact

SEQ ID NO: 12634 - DNA, 16 bp, Artificial Sequence
  synthetic [barcode part1]
tcaggaccacttgcct

SEQ ID NO: 12635 - DNA, 16 bp, Artificial Sequence
  synthetic [barcode part1]
ataccaggtattcggc

SEQ ID NO: 12636 - DNA, 16 bp, Artificial Sequence
  synthetic [barcode part1]
atatctccggtaatcc

SEQ ID NO: 12637 - DNA, 16 bp, Artificial Sequence
  synthetic [barcode part1]
caagtcttctgtcgcg

SEQ ID NO: 12638 - DNA, 16 bp, Artificial Sequence
  synthetic [barcode part1]
ttggtcagtcaaccag

SEQ ID NO: 12639 - DNA, 16 bp, Artificial Sequence
  synthetic [barcode part1]
aacgaaggcgtaatct

SEQ ID NO: 12640 - DNA, 16 bp, Artificial Sequence
  synthetic [barcode part1]
cgtagttgttattccg

SEQ ID NO: 12641 - DNA, 16 bp, Artificial Sequence
  synthetic [barcode part1]
ttaggtgcctaccgtc

SEQ ID NO: 12642 - DNA, 16 bp, Artificial Sequence
  synthetic [barcode part1]
actgacgatcctccgt

SEQ ID NO: 12643 - DNA, 16 bp, Artificial Sequence
  synthetic [barcode part1]
tgttacttgagtctgc

SEQ ID NO: 12644 - DNA, 16 bp, Artificial Sequence
  synthetic [barcode part1]
agtaaccacacagaac

SEQ ID NO: 12645 - DNA, 16 bp, Artificial Sequence
  synthetic [barcode part1]
ttggtgttgtgcaacg

SEQ ID NO: 12646 - DNA, 16 bp, Artificial Sequence
  synthetic [barcode part1]
agaaccggttatctcg

SEQ ID NO: 12647 - DNA, 16 bp, Artificial Sequence
  synthetic [barcode part1]
ttgcggagttcaggtt

SEQ ID NO: 12648 - DNA, 16 bp, Artificial Sequence
  synthetic [barcode part1]
acgatctattctcgtg

SEQ ID NO: 12649 - DNA, 16 bp, Artificial Sequence
  synthetic [barcode part1]
gcctgaacgagtactt

SEQ ID NO: 12650 - DNA, 16 bp, Artificial Sequence
  synthetic [barcode part1]
atccgcgtcagtatag

SEQ ID NO: 12651 - DNA, 16 bp, Artificial Sequence
  synthetic [barcode part1]
caagaagaggaggtct

SEQ ID NO: 12652 - DNA, 16 bp, Artificial Sequence
  synthetic [barcode part1]
cgttaggtgcctctgt

SEQ ID NO: 12653 - DNA, 16 bp, Artificial Sequence
  synthetic [barcode part1]
cgagagtattcaacag

SEQ ID NO: 12654 - DNA, 16 bp, Artificial Sequence
  synthetic [barcode part1]
tgtacttccgtcaggc

SEQ ID NO: 12655 - DNA, 16 bp, Artificial Sequence
  synthetic [barcode part1]
agtgtcaatcgcgatc

SEQ ID NO: 12656 - DNA, 16 bp, Artificial Sequence
  synthetic [barcode part1]
gaattgcgtaacctgc

SEQ ID NO: 12657 - DNA, 16 bp, Artificial Sequence
  synthetic [barcode part1]
gtgtgtatcctaaggc

SEQ ID NO: 12658 - DNA, 16 bp, Artificial Sequence
  synthetic [barcode part1]
tcggacgatagattcc

SEQ ID NO: 12659 - DNA, 16 bp, Artificial Sequence
  synthetic [barcode part1]
aggcaggacggtatct

SEQ ID NO: 12660 - DNA, 16 bp, Artificial Sequence
  synthetic [barcode part1]
taccagataggtcacc

SEQ ID NO: 12661 - DNA, 16 bp, Artificial Sequence
  synthetic [barcode part1]
aacctccgacttgtgc

SEQ ID NO: 12662 - DNA, 16 bp, Artificial Sequence
  synthetic [barcode part1]
agtccgcacctataag

SEQ ID NO: 12663 - DNA, 16 bp, Artificial Sequence
  synthetic [barcode part1]
taggatcacacgtacc

SEQ ID NO: 12664 - DNA, 16 bp, Artificial Sequence
  synthetic [barcode part1]
tgtggtgagtaggcgt

SEQ ID NO: 12665 - DNA, 16 bp, Artificial Sequence
  synthetic [barcode part1]
tgatcacttgcgtgag

SEQ ID NO: 12666 - DNA, 16 bp, Artificial Sequence
  synthetic [barcode part1]
cctgaggacactatac

SEQ ID NO: 12667 - DNA, 16 bp, Artificial Sequence
  synthetic [barcode part1]
tcttcttctgaccggt

SEQ ID NO: 12668 - DNA, 16 bp, Artificial Sequence
  synthetic [barcode part1]
cgcgacgtgaacaagt

SEQ ID NO: 12669 - DNA, 16 bp, Artificial Sequence
  synthetic [barcode part1]
atcacagacttacctc

SEQ ID NO: 12670 - DNA, 16 bp, Artificial Sequence
  synthetic [barcode part1]
acttgaacgcctgagt

SEQ ID NO: 12671 - DNA, 16 bp, Artificial Sequence
  synthetic [barcode part1]
acagtaccacaacgtc

SEQ ID NO: 12672 - DNA, 16 bp, Artificial Sequence
  synthetic [barcode part1]
tcaggttcctcgtgtg

SEQ ID NO: 12673 - DNA, 16 bp, Artificial Sequence
  synthetic [barcode part1]
tataataggcggacgt

SEQ ID NO: 12674 - DNA, 16 bp, Artificial Sequence
  synthetic [barcode part1]
tccgtactggtagtcc

SEQ ID NO: 12675 - DNA, 16 bp, Artificial Sequence
  synthetic [barcode part1]
aagaccttctggagtc

SEQ ID NO: 12676 - DNA, 16 bp, Artificial Sequence
  synthetic [barcode part1]
tcggcgtcttcaactg

SEQ ID NO: 12677 - DNA, 16 bp, Artificial Sequence
  synthetic [barcode part1]
tcggataggacgacac

SEQ ID NO: 12678 - DNA, 16 bp, Artificial Sequence
  synthetic [barcode part1]
atacggcggaggatct

SEQ ID NO: 12679 - DNA, 16 bp, Artificial Sequence
  synthetic [barcode part1]
tccactcttgcggtag

SEQ ID NO: 12680 - DNA, 16 bp, Artificial Sequence
  synthetic [barcode part1]
aacacgtgtcagtacc

SEQ ID NO: 12681 - DNA, 16 bp, Artificial Sequence
  synthetic [barcode part1]
ccttcaatcctggtct

SEQ ID NO: 12682 - DNA, 16 bp, Artificial Sequence
  synthetic [barcode part1]
attggacgtctagtgc

SEQ ID NO: 12683 - DNA, 16 bp, Artificial Sequence
  synthetic [barcode part1]
tccaactccgatcctt

SEQ ID NO: 12684 - DNA, 16 bp, Artificial Sequence
  synthetic [barcode part1]
actggacgcaggagtt

SEQ ID NO: 12685 - DNA, 16 bp, Artificial Sequence
  synthetic [barcode part1]
aaccggtaactccagt

SEQ ID NO: 12686 - DNA, 16 bp, Artificial Sequence
  synthetic [barcode part1]
atccgtaagtctgcag

SEQ ID NO: 12687 - DNA, 16 bp, Artificial Sequence
  synthetic [barcode part1]
tccttctcgcgatatc

SEQ ID NO: 12688 - DNA, 16 bp, Artificial Sequence
  synthetic [barcode part1]
tgttgccagacacctc

SEQ ID NO: 12689 - DNA, 16 bp, Artificial Sequence
  synthetic [barcode part1]
gcgatagtcacacgag

SEQ ID NO: 12690 - DNA, 16 bp, Artificial Sequence
  synthetic [barcode part1]
caagaccgtgcgtatt

SEQ ID NO: 12691 - DNA, 16 bp, Artificial Sequence
  synthetic [barcode part1]
acagttgcgcgattac

SEQ ID NO: 12692 - DNA, 16 bp, Artificial Sequence
  synthetic [barcode part1]
tcttactacgacggag

SEQ ID NO: 12693 - DNA, 16 bp, Artificial Sequence
  synthetic [barcode part1]
ccaggtagtgataagt

SEQ ID NO: 12694 - DNA, 16 bp, Artificial Sequence
  synthetic [barcode part1]
taccaggtaagagtgt

SEQ ID NO: 12695 - DNA, 16 bp, Artificial Sequence
  synthetic [barcode part1]
acgtcctatactctcc

SEQ ID NO: 12696 - DNA, 16 bp, Artificial Sequence
  synthetic [barcode part1]
gagtgagaatatcgtc

SEQ ID NO: 12697 - DNA, 16 bp, Artificial Sequence
  synthetic [barcode part1]
tccaactgcaccgact

SEQ ID NO: 12698 - DNA, 16 bp, Artificial Sequence
  synthetic [barcode part1]
acctgatcgtgaggag

SEQ ID NO: 12699 - DNA, 16 bp, Artificial Sequence
  synthetic [barcode part1]
tatcgtgcacgtacag

SEQ ID NO: 12700 - DNA, 16 bp, Artificial Sequence
  synthetic [barcode part1]
aggtaataagacggcg

SEQ ID NO: 12701 - DNA, 16 bp, Artificial Sequence
  synthetic [barcode part1]
agaggcaactcgacac

SEQ ID NO: 12702 - DNA, 16 bp, Artificial Sequence
  synthetic [barcode part1]
agacagaacgacgcct

SEQ ID NO: 12703 - DNA, 16 bp, Artificial Sequence
  synthetic [barcode part1]
tatccttgcacgagag

SEQ ID NO: 12704 - DNA, 16 bp, Artificial Sequence
  synthetic [barcode part1]
aggtcgacacaaccag

SEQ ID NO: 12705 - DNA, 16 bp, Artificial Sequence
  synthetic [barcode part1]
gagaggcgttcggatt

SEQ ID NO: 12706 - DNA, 16 bp, Artificial Sequence
  synthetic [barcode part1]
tgccgttactcggatc

SEQ ID NO: 12707 - DNA, 16 bp, Artificial Sequence
  synthetic [barcode part1]
tgcctcgtctagacgt

SEQ ID NO: 12708 - DNA, 16 bp, Artificial Sequence
  synthetic [barcode part1]
ccacagattcaacctt

SEQ ID NO: 12709 - DNA, 16 bp, Artificial Sequence
  synthetic [barcode part1]
tatagagtggcggtcg

SEQ ID NO: 12710 - DNA, 16 bp, Artificial Sequence
  synthetic [barcode part1]
cctagattccaatctg

SEQ ID NO: 12711 - DNA, 16 bp, Artificial Sequence
  synthetic [barcode part1]
tccaagattctgaggc

SEQ ID NO: 12712 - DNA, 16 bp, Artificial Sequence
  synthetic [barcode part1]
gactgcctctataccg

SEQ ID NO: 12713 - DNA, 16 bp, Artificial Sequence
  synthetic [barcode part1]
ttgaccagtcacagtg

SEQ ID NO: 12714 - DNA, 16 bp, Artificial Sequence
  synthetic [barcode part1]
ttaacggaggcgtgac

SEQ ID NO: 12715 - DNA, 16 bp, Artificial Sequence
  synthetic [barcode part1]
gttaggttgttcctac

SEQ ID NO: 12716 - DNA, 16 bp, Artificial Sequence
  synthetic [barcode part1]
ccacagatacttcgtt

SEQ ID NO: 12717 - DNA, 16 bp, Artificial Sequence
  synthetic [barcode part1]
tgtgttgcacaaccag

SEQ ID NO: 12718 - DNA, 16 bp, Artificial Sequence
  synthetic [barcode part1]
aattggcctctccttc

SEQ ID NO: 12719 - DNA, 16 bp, Artificial Sequence
  synthetic [barcode part1]
gtctccgagtggtctt

SEQ ID NO: 12720 - DNA, 16 bp, Artificial Sequence
  synthetic [barcode part1]
ccaatacttgatcctg

SEQ ID NO: 12721 - DNA, 16 bp, Artificial Sequence
  synthetic [barcode part1]
gataagtcaggatctg

SEQ ID NO: 12722 - DNA, 16 bp, Artificial Sequence
  synthetic [barcode part1]
actcgcgaattcgtag

SEQ ID NO: 12723 - DNA, 16 bp, Artificial Sequence
  synthetic [barcode part1]
gatcagtctgatcgac

SEQ ID NO: 12724 - DNA, 16 bp, Artificial Sequence
  synthetic [barcode part1]
ttggccggttgattag

SEQ ID NO: 12725 - DNA, 16 bp, Artificial Sequence
  synthetic [barcode part1]
cagtgtgcgatctcct

SEQ ID NO: 12726 - DNA, 16 bp, Artificial Sequence
  synthetic [barcode part1]
ttagtcttccacgaac

SEQ ID NO: 12727 - DNA, 16 bp, Artificial Sequence
  synthetic [barcode part1]
tcggcgatattgagtc

SEQ ID NO: 12728 - DNA, 16 bp, Artificial Sequence
  synthetic [barcode part1]
agtctccgtgtgactc

SEQ ID NO: 12729 - DNA, 16 bp, Artificial Sequence
  synthetic [barcode part1]
acacaggcactcttag

SEQ ID NO: 12730 - DNA, 16 bp, Artificial Sequence
  synthetic [barcode part1]
taacgtacctctggtt

SEQ ID NO: 12731 - DNA, 16 bp, Artificial Sequence
  synthetic [barcode part1]
agacgccactctactc

SEQ ID NO: 12732 - DNA, 16 bp, Artificial Sequence
  synthetic [barcode part1]
tacacgtctagagtcg

SEQ ID NO: 12733 - DNA, 16 bp, Artificial Sequence
  synthetic [barcode part1]
cgcctgtgtggtactt

SEQ ID NO: 12734 - DNA, 16 bp, Artificial Sequence
  synthetic [barcode part1]
actgactcgatcaacg

SEQ ID NO: 12735 - DNA, 16 bp, Artificial Sequence
  synthetic [barcode part1]
atacttctcctcgtgc

SEQ ID NO: 12736 - DNA, 16 bp, Artificial Sequence
  synthetic [barcode part1]
aacgcgacctaacgag

SEQ ID NO: 12737 - DNA, 16 bp, Artificial Sequence
  synthetic [barcode part1]
ccggaatacggacagt

SEQ ID NO: 12738 - DNA, 16 bp, Artificial Sequence
  synthetic [barcode part1]
taacacgaaggtaacc

SEQ ID NO: 12739 - DNA, 16 bp, Artificial Sequence
  synthetic [barcode part1]
gtgttgatcctcggtc

SEQ ID NO: 12740 - DNA, 16 bp, Artificial Sequence
  synthetic [barcode part1]
caggtgtgtacgactt

SEQ ID NO: 12741 - DNA, 16 bp, Artificial Sequence
  synthetic [barcode part1]
aactgcaggccagaac

SEQ ID NO: 12742 - DNA, 16 bp, Artificial Sequence
  synthetic [barcode part1]
cacctacaacaccacc

SEQ ID NO: 12743 - DNA, 16 bp, Artificial Sequence
  synthetic [barcode part1]
gttaggcctactgagt

SEQ ID NO: 12744 - DNA, 16 bp, Artificial Sequence
  synthetic [barcode part1]
tcgtgccgtagtctgt

SEQ ID NO: 12745 - DNA, 16 bp, Artificial Sequence
  synthetic [barcode part1]
gactgtaggtccttcc

SEQ ID NO: 12746 - DNA, 16 bp, Artificial Sequence
  synthetic [barcode part1]
aatctctaccgccttc

SEQ ID NO: 12747 - DNA, 16 bp, Artificial Sequence
  synthetic [barcode part1]
caggattgtcgtaacc

SEQ ID NO: 12748 - DNA, 16 bp, Artificial Sequence
  synthetic [barcode part1]
tccacacaccaccaac

SEQ ID NO: 12749 - DNA, 16 bp, Artificial Sequence
  synthetic [barcode part1]
cgttcgcacgaatagt

SEQ ID NO: 12750 - DNA, 16 bp, Artificial Sequence
  synthetic [barcode part1]
gaagtggacctgcaac

SEQ ID NO: 12751 - DNA, 16 bp, Artificial Sequence
  synthetic [barcode part1]
aaccactgcgagagtg

SEQ ID NO: 12752 - DNA, 16 bp, Artificial Sequence
  synthetic [barcode part1]
atcttgtctcggttcc

SEQ ID NO: 12753 - DNA, 16 bp, Artificial Sequence
  synthetic [barcode part1]
tcagtccttgttgtcc

SEQ ID NO: 12754 - DNA, 16 bp, Artificial Sequence
  synthetic [barcode part1]
taacgtaccggtgtgt

SEQ ID NO: 12755 - DNA, 16 bp, Artificial Sequence
  synthetic [barcode part1]
gattatatcgacctcc

SEQ ID NO: 12756 - DNA, 16 bp, Artificial Sequence
  synthetic [barcode part1]
gattattctacgtccg

SEQ ID NO: 12757 - DNA, 16 bp, Artificial Sequence
  synthetic [barcode part1]
caggagatacagtcgc

SEQ ID NO: 12758 - DNA, 16 bp, Artificial Sequence
  synthetic [barcode part1]
acgttagtctcaccgc

SEQ ID NO: 12759 - DNA, 16 bp, Artificial Sequence
  synthetic [barcode part1]
gagatcgaaccgtgtg

SEQ ID NO: 12760 - DNA, 16 bp, Artificial Sequence
  synthetic [barcode part1]
gatactccttgattcg

SEQ ID NO: 12761 - DNA, 16 bp, Artificial Sequence
  synthetic [barcode part1]
atacctcgaggtgtgt

SEQ ID NO: 12762 - DNA, 16 bp, Artificial Sequence
  synthetic [barcode part1]
agtgtcaactgtgacc

SEQ ID NO: 12763 - DNA, 16 bp, Artificial Sequence
  synthetic [barcode part1]
atcctgttaccagtgt

SEQ ID NO: 12764 - DNA, 16 bp, Artificial Sequence
  synthetic [barcode part1]
gcaggtagtgacgttg

SEQ ID NO: 12765 - DNA, 16 bp, Artificial Sequence
  synthetic [barcode part1]
cggaggaagttaaggt

SEQ ID NO: 12766 - DNA, 16 bp, Artificial Sequence
  synthetic [barcode part1]
tatcttcgcactcctg

SEQ ID NO: 12767 - DNA, 16 bp, Artificial Sequence
  synthetic [barcode part1]
ttattcctgtaggtcg

SEQ ID NO: 12768 - DNA, 16 bp, Artificial Sequence
  synthetic [barcode part1]
gccgtcttcgtgagtt

SEQ ID NO: 12769 - DNA, 16 bp, Artificial Sequence
  synthetic [barcode part1]
tgaagtagtggtcgcg

SEQ ID NO: 12770 - DNA, 16 bp, Artificial Sequence
  synthetic [barcode part1]
ttagtgcggaagattg

SEQ ID NO: 12771 - DNA, 16 bp, Artificial Sequence
  synthetic [barcode part1]
gacaggaaggaactac

SEQ ID NO: 12772 - DNA, 16 bp, Artificial Sequence
  synthetic [barcode part1]
cggtgacgtgttcttc

SEQ ID NO: 12773 - DNA, 16 bp, Artificial Sequence
  synthetic [barcode part1]
gtgaggattgaaccgc

SEQ ID NO: 12774 - DNA, 16 bp, Artificial Sequence
  synthetic [barcode part1]
atccaccttgtaacac

SEQ ID NO: 12775 - DNA, 16 bp, Artificial Sequence
  synthetic [barcode part1]
aagtgttctcgtcgtt

SEQ ID NO: 12776 - DNA, 16 bp, Artificial Sequence
  synthetic [barcode part1]
atacgtggttacggtc

SEQ ID NO: 12777 - DNA, 16 bp, Artificial Sequence
  synthetic [barcode part1]
atagactcctctgact

SEQ ID NO: 12778 - DNA, 16 bp, Artificial Sequence
  synthetic [barcode part1]
tcaggttgatcgtcag

SEQ ID NO: 12779 - DNA, 16 bp, Artificial Sequence
  synthetic [barcode part1]
agagtatcgcaccttg

SEQ ID NO: 12780 - DNA, 16 bp, Artificial Sequence
  synthetic [barcode part1]
tactccgtaggcactc

SEQ ID NO: 12781 - DNA, 16 bp, Artificial Sequence
  synthetic [barcode part1]
aaggattaggagaccg

SEQ ID NO: 12782 - DNA, 16 bp, Artificial Sequence
  synthetic [barcode part1]
acctagttcctgcgtg

SEQ ID NO: 12783 - DNA, 16 bp, Artificial Sequence
  synthetic [barcode part1]
gatccggttaagttgc

SEQ ID NO: 12784 - DNA, 16 bp, Artificial Sequence
  synthetic [barcode part1]
gttgaacttgtgttcc

SEQ ID NO: 12785 - DNA, 16 bp, Artificial Sequence
  synthetic [barcode part1]
aagtcgcacttctact

SEQ ID NO: 12786 - DNA, 16 bp, Artificial Sequence
  synthetic [barcode part1]
tgtggacactccacct

SEQ ID NO: 12787 - DNA, 16 bp, Artificial Sequence
  synthetic [barcode part1]
cagtcctcacgcaatc

SEQ ID NO: 12788 - DNA, 16 bp, Artificial Sequence
  synthetic [barcode part1]
acactcacctactgcg

SEQ ID NO: 12789 - DNA, 16 bp, Artificial Sequence
  synthetic [barcode part1]
acggttaaggatcaac

SEQ ID NO: 12790 - DNA, 16 bp, Artificial Sequence
  synthetic [barcode part1]
gacaagaccggacact

SEQ ID NO: 12791 - DNA, 16 bp, Artificial Sequence
  synthetic [barcode part1]
tgatctctagtcgtgt

SEQ ID NO: 12792 - DNA, 16 bp, Artificial Sequence
  synthetic [barcode part1]
taggttactggaccgt

SEQ ID NO: 12793 - DNA, 16 bp, Artificial Sequence
  synthetic [barcode part1]
cgccaagaataacctc

SEQ ID NO: 12794 - DNA, 16 bp, Artificial Sequence
  synthetic [barcode part1]
agaccgagattgagag

SEQ ID NO: 12795 - DNA, 16 bp, Artificial Sequence
  synthetic [barcode part1]
gacgtgaccgttgaag

SEQ ID NO: 12796 - DNA, 16 bp, Artificial Sequence
  synthetic [barcode part1]
tcttcgactgagaggt

SEQ ID NO: 12797 - DNA, 16 bp, Artificial Sequence
  synthetic [barcode part1]
tagacctctacttcag

SEQ ID NO: 12798 - DNA, 16 bp, Artificial Sequence
  synthetic [barcode part1]
aacagtcagaacgtac

SEQ ID NO: 12799 - DNA, 16 bp, Artificial Sequence
  synthetic [barcode part1]
gacttctcagtctcct

SEQ ID NO: 12800 - DNA, 16 bp, Artificial Sequence
  synthetic [barcode part1]
agacttactcggttct

SEQ ID NO: 12801 - DNA, 16 bp, Artificial Sequence
  synthetic [barcode part1]
caatcgattggtcgac

SEQ ID NO: 12802 - DNA, 16 bp, Artificial Sequence
  synthetic [barcode part1]
tgaataccggtcttct

SEQ ID NO: 12803 - DNA, 16 bp, Artificial Sequence
  synthetic [barcode part1]
tgcacagtgcctcact

SEQ ID NO: 12804 - DNA, 16 bp, Artificial Sequence
  synthetic [barcode part1]
gagaggtattcaagtc

SEQ ID NO: 12805 - DNA, 16 bp, Artificial Sequence
  synthetic [barcode part1]
actgcaaccacagtac

SEQ ID NO: 12806 - DNA, 16 bp, Artificial Sequence
  synthetic [barcode part1]
tggactagtgcaggac

SEQ ID NO: 12807 - DNA, 16 bp, Artificial Sequence
  synthetic [barcode part1]
tgtcaacgatcctccg

SEQ ID NO: 12808 - DNA, 16 bp, Artificial Sequence
  synthetic [barcode part1]
aagaaggattgcgacg

SEQ ID NO: 12809 - DNA, 16 bp, Artificial Sequence
  synthetic [barcode part1]
agttgacctgagactc

SEQ ID NO: 12810 - DNA, 16 bp, Artificial Sequence
  synthetic [barcode part1]
aggtaggagtgttgcc

SEQ ID NO: 12811 - DNA, 16 bp, Artificial Sequence
  synthetic [barcode part1]
aacgcgttagtcgtgt

SEQ ID NO: 12812 - DNA, 16 bp, Artificial Sequence
  synthetic [barcode part1]
ccttgtctgaatactg

SEQ ID NO: 12813 - DNA, 16 bp, Artificial Sequence
  synthetic [barcode part1]
tactagatcgtgcctt

SEQ ID NO: 12814 - DNA, 16 bp, Artificial Sequence
  synthetic [barcode part1]
atcaccaggttcaacg

SEQ ID NO: 12815 - DNA, 16 bp, Artificial Sequence
  synthetic [barcode part1]
gtgaacttctcaccgc

SEQ ID NO: 12816 - DNA, 16 bp, Artificial Sequence
  synthetic [barcode part1]
tggtacagaagtaacc

SEQ ID NO: 12817 - DNA, 16 bp, Artificial Sequence
  synthetic [barcode part1]
ccgatcctagagaact

SEQ ID NO: 12818 - DNA, 16 bp, Artificial Sequence
  synthetic [barcode part1]
gagacgacagatattc

SEQ ID NO: 12819 - DNA, 16 bp, Artificial Sequence
  synthetic [barcode part1]
cgatcctactacacgc

SEQ ID NO: 12820 - DNA, 16 bp, Artificial Sequence
  synthetic [barcode part1]
tgacgattcgacagtc

SEQ ID NO: 12821 - DNA, 16 bp, Artificial Sequence
  synthetic [barcode part1]
actggatcaccgaatc

SEQ ID NO: 12822 - DNA, 16 bp, Artificial Sequence
  synthetic [barcode part1]
atagtcgattggcacc

SEQ ID NO: 12823 - DNA, 16 bp, Artificial Sequence
  synthetic [barcode part1]
tcgacggtgaattgtc

SEQ ID NO: 12824 - DNA, 16 bp, Artificial Sequence
  synthetic [barcode part1]
gttccgttgaggaatc

SEQ ID NO: 12825 - DNA, 16 bp, Artificial Sequence
  synthetic [barcode part1]
atagtattgcgcacgc

SEQ ID NO: 12826 - DNA, 16 bp, Artificial Sequence
  synthetic [barcode part1]
tagacgtgccgtcttc

SEQ ID NO: 12827 - DNA, 16 bp, Artificial Sequence
  synthetic [barcode part1]
aacagtcaagagtacc

SEQ ID NO: 12828 - DNA, 16 bp, Artificial Sequence
  synthetic [barcode part1]
aacgcgtcacgtgatt

SEQ ID NO: 12829 - DNA, 16 bp, Artificial Sequence
  synthetic [barcode part1]
tgtcttactgcaagtc

SEQ ID NO: 12830 - DNA, 16 bp, Artificial Sequence
  synthetic [barcode part1]
gtgacgagacacactg

SEQ ID NO: 12831 - DNA, 16 bp, Artificial Sequence
  synthetic [barcode part1]
cgttgtatacaacgcg

SEQ ID NO: 12832 - DNA, 16 bp, Artificial Sequence
  synthetic [barcode part1]
gtacgatacacactgc

SEQ ID NO: 12833 - DNA, 16 bp, Artificial Sequence
  synthetic [barcode part1]
attcttccgtgtaacg

SEQ ID NO: 12834 - DNA, 16 bp, Artificial Sequence
  synthetic [barcode part1]
cgtgtccttacacctt

SEQ ID NO: 12835 - DNA, 16 bp, Artificial Sequence
  synthetic [barcode part1]
gaccgtactcctcagt

SEQ ID NO: 12836 - DNA, 16 bp, Artificial Sequence
  synthetic [barcode part1]
tcacctgttgtaacac

SEQ ID NO: 12837 - DNA, 16 bp, Artificial Sequence
  synthetic [barcode part1]
ttcttgtggtagttcg

SEQ ID NO: 12838 - DNA, 16 bp, Artificial Sequence
  synthetic [barcode part1]
tagtacgattacctcc

SEQ ID NO: 12839 - DNA, 16 bp, Artificial Sequence
  synthetic [barcode part1]
gtggtacactggttgt

SEQ ID NO: 12840 - DNA, 16 bp, Artificial Sequence
  synthetic [barcode part1]
acagtgcgattgacct

SEQ ID NO: 12841 - DNA, 16 bp, Artificial Sequence
  synthetic [barcode part1]
agaatacgaccgttag

SEQ ID NO: 12842 - DNA, 16 bp, Artificial Sequence
  synthetic [barcode part1]
ttccgtatcgaatcgt

SEQ ID NO: 12843 - DNA, 16 bp, Artificial Sequence
  synthetic [barcode part1]
ttctgagttactcgtg

SEQ ID NO: 12844 - DNA, 16 bp, Artificial Sequence
  synthetic [barcode part1]
gcgtctgaccttatcg

SEQ ID NO: 12845 - DNA, 16 bp, Artificial Sequence
  synthetic [barcode part1]
acggagagtcgtcaac

SEQ ID NO: 12846 - DNA, 16 bp, Artificial Sequence
  synthetic [barcode part1]
caactgtcgagaggtg

SEQ ID NO: 12847 - DNA, 16 bp, Artificial Sequence
  synthetic [barcode part1]
cgtagttgttagagag

SEQ ID NO: 12848 - DNA, 16 bp, Artificial Sequence
  synthetic [barcode part1]
accgcgactcacttac

SEQ ID NO: 12849 - DNA, 16 bp, Artificial Sequence
  synthetic [barcode part1]
tctggaagtcgtagtc

SEQ ID NO: 12850 - DNA, 16 bp, Artificial Sequence
  synthetic [barcode part1]
cgtccaccttagaatt

SEQ ID NO: 12851 - DNA, 16 bp, Artificial Sequence
  synthetic [barcode part1]
gcagactacgttcagt

SEQ ID NO: 12852 - DNA, 16 bp, Artificial Sequence
  synthetic [barcode part1]
cagttgtgcctaagtg

SEQ ID NO: 12853 - DNA, 16 bp, Artificial Sequence
  synthetic [barcode part1]
taagtcgccgacaatc

SEQ ID NO: 12854 - DNA, 16 bp, Artificial Sequence
  synthetic [barcode part1]
taggattgccaaccgt

SEQ ID NO: 12855 - DNA, 16 bp, Artificial Sequence
  synthetic [barcode part1]
tagtcttgttgtacgc

SEQ ID NO: 12856 - DNA, 16 bp, Artificial Sequence
  synthetic [barcode part1]
tgttcaggttgcctcg

SEQ ID NO: 12857 - DNA, 16 bp, Artificial Sequence
  synthetic [barcode part1]
cgtatagttcgtggac

SEQ ID NO: 12858 - DNA, 16 bp, Artificial Sequence
  synthetic [barcode part1]
tgttactcagatctgc

SEQ ID NO: 12859 - DNA, 16 bp, Artificial Sequence
  synthetic [barcode part1]
gacgtcaacacacgtt

SEQ ID NO: 12860 - DNA, 16 bp, Artificial Sequence
  synthetic [barcode part1]
tagttatctgttgccg

SEQ ID NO: 12861 - DNA, 16 bp, Artificial Sequence
  synthetic [barcode part1]
gttagtaggcaacagt

SEQ ID NO: 12862 - DNA, 16 bp, Artificial Sequence
  synthetic [barcode part1]
cgatacgtggtctcct

SEQ ID NO: 12863 - DNA, 16 bp, Artificial Sequence
  synthetic [barcode part1]
acaagatcttgtcgcg

SEQ ID NO: 12864 - DNA, 16 bp, Artificial Sequence
  synthetic [barcode part1]
gccaggcagtaattct

SEQ ID NO: 12865 - DNA, 16 bp, Artificial Sequence
  synthetic [barcode part1]
cgttgttcctgacctt

SEQ ID NO: 12866 - DNA, 16 bp, Artificial Sequence
  synthetic [barcode part1]
aagttccgagaaggag

SEQ ID NO: 12867 - DNA, 16 bp, Artificial Sequence
  synthetic [barcode part1]
tcaatctgcggttgcc

SEQ ID NO: 12868 - DNA, 16 bp, Artificial Sequence
  synthetic [barcode part1]
aagacctcgagatctc

SEQ ID NO: 12869 - DNA, 16 bp, Artificial Sequence
  synthetic [barcode part1]
ttcgcgttgtatctcc

SEQ ID NO: 12870 - DNA, 16 bp, Artificial Sequence
  synthetic [barcode part1]
actacgaggcggatac

SEQ ID NO: 12871 - DNA, 16 bp, Artificial Sequence
  synthetic [barcode part1]
agatccagtctgaacc

SEQ ID NO: 12872 - DNA, 16 bp, Artificial Sequence
  synthetic [barcode part1]
tgttatcttcacggac

SEQ ID NO: 12873 - DNA, 16 bp, Artificial Sequence
  synthetic [barcode part1]
tccggcactgtattcg

SEQ ID NO: 12874 - DNA, 16 bp, Artificial Sequence
  synthetic [barcode part1]
gaccaactgcagtgtt

SEQ ID NO: 12875 - DNA, 16 bp, Artificial Sequence
  synthetic [barcode part1]
tacaatagaacaggcc

SEQ ID NO: 12876 - DNA, 16 bp, Artificial Sequence
  synthetic [barcode part1]
ataggaattaggtcgc

SEQ ID NO: 12877 - DNA, 16 bp, Artificial Sequence
  synthetic [barcode part1]
gtgacgatctacggag

SEQ ID NO: 12878 - DNA, 16 bp, Artificial Sequence
  synthetic [barcode part1]
gtgttctccggtaatt

SEQ ID NO: 12879 - DNA, 16 bp, Artificial Sequence
  synthetic [barcode part1]
tatctcggcctatagt

SEQ ID NO: 12880 - DNA, 16 bp, Artificial Sequence
  synthetic [barcode part1]
gcctagaacggatctt

SEQ ID NO: 12881 - DNA, 16 bp, Artificial Sequence
  synthetic [barcode part1]
cacaacacactgtgac

SEQ ID NO: 12882 - DNA, 16 bp, Artificial Sequence
  synthetic [barcode part1]
gttgatctcaggactg

SEQ ID NO: 12883 - DNA, 16 bp, Artificial Sequence
  synthetic [barcode part1]
cggtcaacttctcctt

SEQ ID NO: 12884 - DNA, 16 bp, Artificial Sequence
  synthetic [barcode part1]
gaggacttgacacacg

SEQ ID NO: 12885 - DNA, 16 bp, Artificial Sequence
  synthetic [barcode part1]
taagacctaaccgacc

SEQ ID NO: 12886 - DNA, 16 bp, Artificial Sequence
  synthetic [barcode part1]
cgttgatccgaaggag

SEQ ID NO: 12887 - DNA, 16 bp, Artificial Sequence
  synthetic [barcode part1]
acagtcgaccgatact

SEQ ID NO: 12888 - DNA, 16 bp, Artificial Sequence
  synthetic [barcode part1]
atagaaggaccgccac

SEQ ID NO: 12889 - DNA, 16 bp, Artificial Sequence
  synthetic [barcode part1]
aactggcaggagaagt

SEQ ID NO: 12890 - DNA, 16 bp, Artificial Sequence
  synthetic [barcode part1]
gccacgaatctactcc

SEQ ID NO: 12891 - DNA, 16 bp, Artificial Sequence
  synthetic [barcode part1]
aatcaccagactaccg

SEQ ID NO: 12892 - DNA, 16 bp, Artificial Sequence
  synthetic [barcode part1]
gtatacggtacacgtc

SEQ ID NO: 12893 - DNA, 16 bp, Artificial Sequence
  synthetic [barcode part1]
tatccgatctcgttag

SEQ ID NO: 12894 - DNA, 16 bp, Artificial Sequence
  synthetic [barcode part1]
tagttcctacaaccgt

SEQ ID NO: 12895 - DNA, 16 bp, Artificial Sequence
  synthetic [barcode part1]
cctagtcgactagaac

SEQ ID NO: 12896 - DNA, 16 bp, Artificial Sequence
  synthetic [barcode part1]
tcttacggatccagtt

SEQ ID NO: 12897 - DNA, 16 bp, Artificial Sequence
  synthetic [barcode part1]
acaactaccagttcct

SEQ ID NO: 12898 - DNA, 16 bp, Artificial Sequence
  synthetic [barcode part1]
tacgccttactcctac

SEQ ID NO: 12899 - DNA, 16 bp, Artificial Sequence
  synthetic [barcode part1]
atcctgcaggtgtctc

SEQ ID NO: 12900 - DNA, 16 bp, Artificial Sequence
  synthetic [barcode part1]
taagtgacaaggttcg

SEQ ID NO: 12901 - DNA, 16 bp, Artificial Sequence
  synthetic [barcode part1]
attcgcagtatccgag

SEQ ID NO: 12902 - DNA, 16 bp, Artificial Sequence
  synthetic [barcode part1]
ttcgtactcagtggtt

SEQ ID NO: 12903 - DNA, 16 bp, Artificial Sequence
  synthetic [barcode part1]
tgtgtcctactaagtc

SEQ ID NO: 12904 - DNA, 16 bp, Artificial Sequence
  synthetic [barcode part1]
acttaggagacttgcc

SEQ ID NO: 12905 - DNA, 16 bp, Artificial Sequence
  synthetic [barcode part1]
caagttccgaggtgag

SEQ ID NO: 12906 - DNA, 16 bp, Artificial Sequence
  synthetic [barcode part1]
aacagaatcgaacgtc

SEQ ID NO: 12907 - DNA, 16 bp, Artificial Sequence
  synthetic [barcode part1]
gtcctatagtgacggt

SEQ ID NO: 12908 - DNA, 16 bp, Artificial Sequence
  synthetic [barcode part1]
gagtggtacacgatcg

SEQ ID NO: 12909 - DNA, 16 bp, Artificial Sequence
  synthetic [barcode part1]
ccttacaccagtaact

SEQ ID NO: 12910 - DNA, 16 bp, Artificial Sequence
  synthetic [barcode part1]
atagtgcagttggtcc

SEQ ID NO: 12911 - DNA, 16 bp, Artificial Sequence
  synthetic [barcode part1]
agtggtcgacctaact

SEQ ID NO: 12912 - DNA, 16 bp, Artificial Sequence
  synthetic [barcode part1]
aaggtggcacttggac

SEQ ID NO: 12913 - DNA, 16 bp, Artificial Sequence
  synthetic [barcode part1]
tgcaggattgacgacg

SEQ ID NO: 12914 - DNA, 16 bp, Artificial Sequence
  synthetic [barcode part1]
gtgtgattcaaggaac

SEQ ID NO: 12915 - DNA, 16 bp, Artificial Sequence
  synthetic [barcode part1]
attctcgtcgccaggt

SEQ ID NO: 12916 - DNA, 16 bp, Artificial Sequence
  synthetic [barcode part1]
aactcacgtggacttg

SEQ ID NO: 12917 - DNA, 16 bp, Artificial Sequence
  synthetic [barcode part1]
cgagagattgaccttc

SEQ ID NO: 12918 - DNA, 16 bp, Artificial Sequence
  synthetic [barcode part1]
ttggccttactgatac

SEQ ID NO: 12919 - DNA, 16 bp, Artificial Sequence
  synthetic [barcode part1]
gtggagtacaggtctg

SEQ ID NO: 12920 - DNA, 16 bp, Artificial Sequence
  synthetic [barcode part1]
atcctcacttgtgcct

SEQ ID NO: 12921 - DNA, 16 bp, Artificial Sequence
  synthetic [barcode part1]
caacgagtcacaggtg

SEQ ID NO: 12922 - DNA, 16 bp, Artificial Sequence
  synthetic [barcode part1]
tgaactccactacttg

SEQ ID NO: 12923 - DNA, 16 bp, Artificial Sequence
  synthetic [barcode part1]
tggtgtgtcgagtgtt

SEQ ID NO: 12924 - DNA, 16 bp, Artificial Sequence
  synthetic [barcode part1]
ccgcgtattaactccg

SEQ ID NO: 12925 - DNA, 16 bp, Artificial Sequence
  synthetic [barcode part1]
tggtgtactggtacac

SEQ ID NO: 12926 - DNA, 16 bp, Artificial Sequence
  synthetic [barcode part1]
atacagtaccacgcgt

SEQ ID NO: 12927 - DNA, 16 bp, Artificial Sequence
  synthetic [barcode part1]
cgacttaccgttagag

SEQ ID NO: 12928 - DNA, 16 bp, Artificial Sequence
  synthetic [barcode part1]
tgcgaagaggatacag

SEQ ID NO: 12929 - DNA, 16 bp, Artificial Sequence
  synthetic [barcode part1]
acagtcttcacacttg

SEQ ID NO: 12930 - DNA, 16 bp, Artificial Sequence
  synthetic [barcode part1]
agaacggtattcgaac

SEQ ID NO: 12931 - DNA, 16 bp, Artificial Sequence
  synthetic [barcode part1]
gccggtatactgatac

SEQ ID NO: 12932 - DNA, 16 bp, Artificial Sequence
  synthetic [barcode part1]
gcgagattgtcacttg

SEQ ID NO: 12933 - DNA, 16 bp, Artificial Sequence
  synthetic [barcode part1]
taatacaggtcacgcc

SEQ ID NO: 12934 - DNA, 16 bp, Artificial Sequence
  synthetic [barcode part1]
gaggaggcgtatatag

SEQ ID NO: 12935 - DNA, 16 bp, Artificial Sequence
  synthetic [barcode part1]
attcaggaacaagacc

SEQ ID NO: 12936 - DNA, 16 bp, Artificial Sequence
  synthetic [barcode part1]
accactaaggatacag

SEQ ID NO: 12937 - DNA, 16 bp, Artificial Sequence
  synthetic [barcode part1]
tgtcgagagtagtcct

SEQ ID NO: 12938 - DNA, 16 bp, Artificial Sequence
  synthetic [barcode part1]
gacaaggatcagagac

SEQ ID NO: 12939 - DNA, 16 bp, Artificial Sequence
  synthetic [barcode part1]
ccttcaccaggaatag

SEQ ID NO: 12940 - DNA, 16 bp, Artificial Sequence
  synthetic [barcode part1]
acaattgcggtgcact

SEQ ID NO: 12941 - DNA, 16 bp, Artificial Sequence
  synthetic [barcode part1]
cggtagaaccttgttg

SEQ ID NO: 12942 - DNA, 16 bp, Artificial Sequence
  synthetic [barcode part1]
tctctgaaccaacact

SEQ ID NO: 12943 - DNA, 16 bp, Artificial Sequence
  synthetic [barcode part1]
atactcgtaggcgttg

SEQ ID NO: 12944 - DNA, 16 bp, Artificial Sequence
  synthetic [barcode part1]
tcactgcgacacctac

SEQ ID NO: 12945 - DNA, 16 bp, Artificial Sequence
  synthetic [barcode part1]
ttaaggattaggcacg

SEQ ID NO: 12946 - DNA, 16 bp, Artificial Sequence
  synthetic [barcode part1]
gcgatattggtaccac

SEQ ID NO: 12947 - DNA, 16 bp, Artificial Sequence
  synthetic [barcode part1]
ttcagacagtgcgttg

SEQ ID NO: 12948 - DNA, 16 bp, Artificial Sequence
  synthetic [barcode part1]
cacacttgcggtctgt

SEQ ID NO: 12949 - DNA, 16 bp, Artificial Sequence
  synthetic [barcode part1]
acgtatccgaactcag

SEQ ID NO: 12950 - DNA, 16 bp, Artificial Sequence
  synthetic [barcode part1]
cgacctcacgtgttgt

SEQ ID NO: 12951 - DNA, 16 bp, Artificial Sequence
  synthetic [barcode part1]
aacagtcttcttacgc

SEQ ID NO: 12952 - DNA, 16 bp, Artificial Sequence
  synthetic [barcode part1]
agaccttagaggagag

SEQ ID NO: 12953 - DNA, 16 bp, Artificial Sequence
  synthetic [barcode part1]
cgtcgtctgttctact

SEQ ID NO: 12954 - DNA, 16 bp, Artificial Sequence
  synthetic [barcode part1]
gcgtagtcttcaatct

SEQ ID NO: 12955 - DNA, 16 bp, Artificial Sequence
  synthetic [barcode part1]
cgagtacaccacctct

SEQ ID NO: 12956 - DNA, 16 bp, Artificial Sequence
  synthetic [barcode part1]
atctgaggaacctgtc

SEQ ID NO: 12957 - DNA, 16 bp, Artificial Sequence
  synthetic [barcode part1]
tactcgacgcgaattg

SEQ ID NO: 12958 - DNA, 16 bp, Artificial Sequence
  synthetic [barcode part1]
tcacctcttggcgtag

SEQ ID NO: 12959 - DNA, 16 bp, Artificial Sequence
  synthetic [barcode part1]
gaattgcgtggaggtc

SEQ ID NO: 12960 - DNA, 16 bp, Artificial Sequence
  synthetic [barcode part1]
ataccgagaaggccac

SEQ ID NO: 12961 - DNA, 16 bp, Artificial Sequence
  synthetic [barcode part1]
gtactacgtggtatcg

SEQ ID NO: 12962 - DNA, 16 bp, Artificial Sequence
  synthetic [barcode part1]
acgtgcaagaagaggt

SEQ ID NO: 12963 - DNA, 16 bp, Artificial Sequence
  synthetic [barcode part1]
gcaactgcgattacgt

SEQ ID NO: 12964 - DNA, 16 bp, Artificial Sequence
  synthetic [barcode part1]
tactcttcggcaaccg

SEQ ID NO: 12965 - DNA, 16 bp, Artificial Sequence
  synthetic [barcode part1]
tctccttctggagttc

SEQ ID NO: 12966 - DNA, 16 bp, Artificial Sequence
  synthetic [barcode part1]
tacgagtacagactcc

SEQ ID NO: 12967 - DNA, 16 bp, Artificial Sequence
  synthetic [barcode part1]
tctattgccttcggtc

SEQ ID NO: 12968 - DNA, 16 bp, Artificial Sequence
  synthetic [barcode part1]
aatcgcagaccaggac

SEQ ID NO: 12969 - DNA, 16 bp, Artificial Sequence
  synthetic [barcode part1]
accgtatactacttcg

SEQ ID NO: 12970 - DNA, 16 bp, Artificial Sequence
  synthetic [barcode part1]
agtattgcgtggcgtt

SEQ ID NO: 12971 - DNA, 16 bp, Artificial Sequence
  synthetic [barcode part1]
ccgtcagttcttatag

SEQ ID NO: 12972 - DNA, 16 bp, Artificial Sequence
  synthetic [barcode part1]
gcctactgaaccttgc

SEQ ID NO: 12973 - DNA, 16 bp, Artificial Sequence
  synthetic [barcode part1]
ttcgacctgtagtcgc

SEQ ID NO: 12974 - DNA, 16 bp, Artificial Sequence
  synthetic [barcode part1]
cagaacgacttctcag

SEQ ID NO: 12975 - DNA, 16 bp, Artificial Sequence
  synthetic [barcode part1]
tgccttacgaacgcct

SEQ ID NO: 12976 - DNA, 16 bp, Artificial Sequence
  synthetic [barcode part1]
cctcgcaccagtagtt

SEQ ID NO: 12977 - DNA, 16 bp, Artificial Sequence
  synthetic [barcode part1]
ttgccgtacaggttcc

SEQ ID NO: 12978 - DNA, 16 bp, Artificial Sequence
  synthetic [barcode part1]
tggtatctgcctattg

SEQ ID NO: 12979 - DNA, 16 bp, Artificial Sequence
  synthetic [barcode part1]
tcgaacacgaggtgac

SEQ ID NO: 12980 - DNA, 16 bp, Artificial Sequence
  synthetic [barcode part1]
tcacaaggcaaggcac

SEQ ID NO: 12981 - DNA, 16 bp, Artificial Sequence
  synthetic [barcode part1]
ttatcgcacttacggt

SEQ ID NO: 12982 - DNA, 16 bp, Artificial Sequence
  synthetic [barcode part1]
cgatcctcaattgcgc

SEQ ID NO: 12983 - DNA, 16 bp, Artificial Sequence
  synthetic [barcode part1]
tgcacagagtgtacct

SEQ ID NO: 12984 - DNA, 16 bp, Artificial Sequence
  synthetic [barcode part1]
gtaatacggtcggtct

SEQ ID NO: 12985 - DNA, 16 bp, Artificial Sequence
  synthetic [barcode part1]
gtaacgttgtgtacgc

SEQ ID NO: 12986 - DNA, 16 bp, Artificial Sequence
  synthetic [barcode part1]
ttgtgaacaggtccgt

SEQ ID NO: 12987 - DNA, 16 bp, Artificial Sequence
  synthetic [barcode part1]
taagaccactaaccgc

SEQ ID NO: 12988 - DNA, 16 bp, Artificial Sequence
  synthetic [barcode part1]
cagagacacttagtag

SEQ ID NO: 12989 - DNA, 16 bp, Artificial Sequence
  synthetic [barcode part1]
cactgcgtgtatacag

SEQ ID NO: 12990 - DNA, 16 bp, Artificial Sequence
  synthetic [barcode part1]
gacagttgcacctctc

SEQ ID NO: 12991 - DNA, 16 bp, Artificial Sequence
  synthetic [barcode part1]
ttggtgagtgattcgc

SEQ ID NO: 12992 - DNA, 16 bp, Artificial Sequence
  synthetic [barcode part1]
ttagacgaacacctgc

SEQ ID NO: 12993 - DNA, 16 bp, Artificial Sequence
  synthetic [barcode part1]
gttaataccaccgttc

SEQ ID NO: 12994 - DNA, 16 bp, Artificial Sequence
  synthetic [barcode part1]
gtcctacgttctctac

SEQ ID NO: 12995 - DNA, 16 bp, Artificial Sequence
  synthetic [barcode part1]
cgcacctggactactt

SEQ ID NO: 12996 - DNA, 16 bp, Artificial Sequence
  synthetic [barcode part1]
agtgaggagtctatac

SEQ ID NO: 12997 - DNA, 16 bp, Artificial Sequence
  synthetic [barcode part1]
attgaagtaacacgcg

SEQ ID NO: 12998 - DNA, 16 bp, Artificial Sequence
  synthetic [barcode part1]
tcgtaacgttacgacg

SEQ ID NO: 12999 - DNA, 16 bp, Artificial Sequence
  synthetic [barcode part1]
accagtggaaccaggt

SEQ ID NO: 13000 - DNA, 16 bp, Artificial Sequence
  synthetic [barcode part1]
tgagatccagtaccac

SEQ ID NO: 13001 - DNA, 16 bp, Artificial Sequence
  synthetic [barcode part1]
gtctgagacttgtggt

SEQ ID NO: 13002 - DNA, 16 bp, Artificial Sequence
  synthetic [barcode part1]
tcgaactcgacaatcg

SEQ ID NO: 13003 - DNA, 16 bp, Artificial Sequence
  synthetic [barcode part1]
tctccgtggtagttcg

SEQ ID NO: 13004 - DNA, 16 bp, Artificial Sequence
  synthetic [barcode part1]
ttctgtagtcgccgac

SEQ ID NO: 13005 - DNA, 16 bp, Artificial Sequence
  synthetic [barcode part1]
atcggtgttcgatctt

SEQ ID NO: 13006 - DNA, 16 bp, Artificial Sequence
  synthetic [barcode part1]
tactgccggtatattc

SEQ ID NO: 13007 - DNA, 16 bp, Artificial Sequence
  synthetic [barcode part1]
gttccaccagacctac

SEQ ID NO: 13008 - DNA, 16 bp, Artificial Sequence
  synthetic [barcode part1]
aaggaccttgaaggag

SEQ ID NO: 13009 - DNA, 16 bp, Artificial Sequence
  synthetic [barcode part1]
ccgtgcaatattggtg

SEQ ID NO: 13010 - DNA, 16 bp, Artificial Sequence
  synthetic [barcode part1]
cacagtgttgtctact

SEQ ID NO: 13011 - DNA, 16 bp, Artificial Sequence
  synthetic [barcode part1]
accagattagaccacc

SEQ ID NO: 13012 - DNA, 16 bp, Artificial Sequence
  synthetic [barcode part1]
gaggtgtattaggccg

SEQ ID NO: 13013 - DNA, 16 bp, Artificial Sequence
  synthetic [barcode part1]
ttggtctgcagttgtt

SEQ ID NO: 13014 - DNA, 16 bp, Artificial Sequence
  synthetic [barcode part1]
gaatcaacaatcgcag

SEQ ID NO: 13015 - DNA, 16 bp, Artificial Sequence
  synthetic [barcode part1]
cagtggtagtctggtt

SEQ ID NO: 13016 - DNA, 16 bp, Artificial Sequence
  synthetic [barcode part1]
atctactcgtcgtggc

SEQ ID NO: 13017 - DNA, 16 bp, Artificial Sequence
  synthetic [barcode part1]
gatcttcgtcggaagt

SEQ ID NO: 13018 - DNA, 16 bp, Artificial Sequence
  synthetic [barcode part1]
tggaatctagttggcc

SEQ ID NO: 13019 - DNA, 16 bp, Artificial Sequence
  synthetic [barcode part1]
ttggaactccggaatc

SEQ ID NO: 13020 - DNA, 16 bp, Artificial Sequence
  synthetic [barcode part1]
gcgagatcgagtactg

SEQ ID NO: 13021 - DNA, 16 bp, Artificial Sequence
  synthetic [barcode part1]
caatcttgtgtaccac

SEQ ID NO: 13022 - DNA, 16 bp, Artificial Sequence
  synthetic [barcode part1]
gaatagtagttcgcag

SEQ ID NO: 13023 - DNA, 16 bp, Artificial Sequence
  synthetic [barcode part1]
tgtacagattctctgc

SEQ ID NO: 13024 - DNA, 16 bp, Artificial Sequence
  synthetic [barcode part1]
agacctggcaactact

SEQ ID NO: 13025 - DNA, 16 bp, Artificial Sequence
  synthetic [barcode part1]
ttgtcaccttgccgtt

SEQ ID NO: 13026 - DNA, 16 bp, Artificial Sequence
  synthetic [barcode part1]
aagtgttgagtgacgt

SEQ ID NO: 13027 - DNA, 16 bp, Artificial Sequence
  synthetic [barcode part1]
caggagtggatcgttg

SEQ ID NO: 13028 - DNA, 16 bp, Artificial Sequence
  synthetic [barcode part1]
aagtgaacgagattcc

SEQ ID NO: 13029 - DNA, 16 bp, Artificial Sequence
  synthetic [barcode part1]
tgaacgccggtgaagt

SEQ ID NO: 13030 - DNA, 16 bp, Artificial Sequence
  synthetic [barcode part1]
agtgccactctgaagt

SEQ ID NO: 13031 - DNA, 16 bp, Artificial Sequence
  synthetic [barcode part1]
accacttacttcgcct

SEQ ID NO: 13032 - DNA, 16 bp, Artificial Sequence
  synthetic [barcode part1]
ttacgcctgaactgcc

SEQ ID NO: 13033 - DNA, 16 bp, Artificial Sequence
  synthetic [barcode part1]
acttggtaccactgag

SEQ ID NO: 13034 - DNA, 16 bp, Artificial Sequence
  synthetic [barcode part1]
gtgtctcactactggc

SEQ ID NO: 13035 - DNA, 16 bp, Artificial Sequence
  synthetic [barcode part1]
tcaactgtcgaccaag

SEQ ID NO: 13036 - DNA, 16 bp, Artificial Sequence
  synthetic [barcode part1]
gagacctctacttact

SEQ ID NO: 13037 - DNA, 16 bp, Artificial Sequence
  synthetic [barcode part1]
tcaacaaggaccacct

SEQ ID NO: 13038 - DNA, 16 bp, Artificial Sequence
  synthetic [barcode part1]
tcctgacgtacttggc

SEQ ID NO: 13039 - DNA, 16 bp, Artificial Sequence
  synthetic [barcode part1]
agtcacggagaccagt

SEQ ID NO: 13040 - DNA, 16 bp, Artificial Sequence
  synthetic [barcode part1]
aactggtctagttggc

SEQ ID NO: 13041 - DNA, 16 bp, Artificial Sequence
  synthetic [barcode part1]
cgttacactaaccgag

SEQ ID NO: 13042 - DNA, 16 bp, Artificial Sequence
  synthetic [barcode part1]
acaacctctaccagag

SEQ ID NO: 13043 - DNA, 16 bp, Artificial Sequence
  synthetic [barcode part1]
tcacaggatccgagtt

SEQ ID NO: 13044 - DNA, 16 bp, Artificial Sequence
  synthetic [barcode part1]
acaatcgttggcctcc

SEQ ID NO: 13045 - DNA, 16 bp, Artificial Sequence
  synthetic [barcode part1]
tagtgtgtggtcctcc

SEQ ID NO: 13046 - DNA, 16 bp, Artificial Sequence
  synthetic [barcode part1]
gtaaggattgacggtt

SEQ ID NO: 13047 - DNA, 16 bp, Artificial Sequence
  synthetic [barcode part1]
tgcgagtccgtagatt

SEQ ID NO: 13048 - DNA, 16 bp, Artificial Sequence
  synthetic [barcode part1]
aacgccaattgcggtt

SEQ ID NO: 13049 - DNA, 16 bp, Artificial Sequence
  synthetic [barcode part1]
tcttagttggccttcc

SEQ ID NO: 13050 - DNA, 16 bp, Artificial Sequence
  synthetic [barcode part1]
tcttgttggcgcctag

SEQ ID NO: 13051 - DNA, 16 bp, Artificial Sequence
  synthetic [barcode part1]
gcgcgagagtaatctg

SEQ ID NO: 13052 - DNA, 16 bp, Artificial Sequence
  synthetic [barcode part1]
aaggcgtaatccggtg

SEQ ID NO: 13053 - DNA, 16 bp, Artificial Sequence
  synthetic [barcode part1]
aggcgtcgtcctattc

SEQ ID NO: 13054 - DNA, 16 bp, Artificial Sequence
  synthetic [barcode part1]
caagacgactcgagtg

SEQ ID NO: 13055 - DNA, 16 bp, Artificial Sequence
  synthetic [barcode part1]
atcgatatctggcctt

SEQ ID NO: 13056 - DNA, 16 bp, Artificial Sequence
  synthetic [barcode part1]
aggtaggccacttatc

SEQ ID NO: 13057 - DNA, 16 bp, Artificial Sequence
  synthetic [barcode part1]
tcgtggacaagaagtt

SEQ ID NO: 13058 - DNA, 16 bp, Artificial Sequence
  synthetic [barcode part1]
tcctcctaccgtgatt

SEQ ID NO: 13059 - DNA, 16 bp, Artificial Sequence
  synthetic [barcode part1]
gccgcctaataagatc

SEQ ID NO: 13060 - DNA, 16 bp, Artificial Sequence
  synthetic [barcode part1]
agaatccgtggtactc

SEQ ID NO: 13061 - DNA, 16 bp, Artificial Sequence
  synthetic [barcode part1]
tactcaggacttgcag

SEQ ID NO: 13062 - DNA, 16 bp, Artificial Sequence
  synthetic [barcode part1]
aacaccagtgtgtacc

SEQ ID NO: 13063 - DNA, 16 bp, Artificial Sequence
  synthetic [barcode part1]
cacagttcgcactaag

SEQ ID NO: 13064 - DNA, 16 bp, Artificial Sequence
  synthetic [barcode part1]
tagtctcgcgtcggtt

SEQ ID NO: 13065 - DNA, 16 bp, Artificial Sequence
  synthetic [barcode part1]
gcgaactatcactctt

SEQ ID NO: 13066 - DNA, 16 bp, Artificial Sequence
  synthetic [barcode part1]
aacgtcaacacgtgtc

SEQ ID NO: 13067 - DNA, 16 bp, Artificial Sequence
  synthetic [barcode part1]
ttaataccggtgtgcg

SEQ ID NO: 13068 - DNA, 16 bp, Artificial Sequence
  synthetic [barcode part1]
tatcacgcgtgtacag

SEQ ID NO: 13069 - DNA, 16 bp, Artificial Sequence
  synthetic [barcode part1]
tcggacaacgataagt

SEQ ID NO: 13070 - DNA, 16 bp, Artificial Sequence
  synthetic [barcode part1]
tctcgaactgcctacg

SEQ ID NO: 13071 - DNA, 16 bp, Artificial Sequence
  synthetic [barcode part1]
tagtgactggtagtcc

SEQ ID NO: 13072 - DNA, 16 bp, Artificial Sequence
  synthetic [barcode part1]
taggaggcacagttgc

SEQ ID NO: 13073 - DNA, 16 bp, Artificial Sequence
  synthetic [barcode part1]
gcgaatccaatagagt

SEQ ID NO: 13074 - DNA, 16 bp, Artificial Sequence
  synthetic [barcode part1]
cgtcggtatactagtg

SEQ ID NO: 13075 - DNA, 16 bp, Artificial Sequence
  synthetic [barcode part1]
atcggtgtgaaggatt

SEQ ID NO: 13076 - DNA, 16 bp, Artificial Sequence
  synthetic [barcode part1]
ttaactccactagtgc

SEQ ID NO: 13077 - DNA, 16 bp, Artificial Sequence
  synthetic [barcode part1]
gtgccggtatattggt

SEQ ID NO: 13078 - DNA, 16 bp, Artificial Sequence
  synthetic [barcode part1]
gcacgtcggtaacaag

SEQ ID NO: 13079 - DNA, 16 bp, Artificial Sequence
  synthetic [barcode part1]
ttcgcaagagtgatag

SEQ ID NO: 13080 - DNA, 16 bp, Artificial Sequence
  synthetic [barcode part1]
cgactgcacttaagtg

SEQ ID NO: 13081 - DNA, 16 bp, Artificial Sequence
  synthetic [barcode part1]
tcctgatcgacagagt

SEQ ID NO: 13082 - DNA, 16 bp, Artificial Sequence
  synthetic [barcode part1]
aggtctgaccttccgt

SEQ ID NO: 13083 - DNA, 16 bp, Artificial Sequence
  synthetic [barcode part1]
ccagtaggcggaagtt

SEQ ID NO: 13084 - DNA, 16 bp, Artificial Sequence
  synthetic [barcode part1]
taactggatcagtcgc

SEQ ID NO: 13085 - DNA, 16 bp, Artificial Sequence
  synthetic [barcode part1]
tagtcaggtcaatcgc

SEQ ID NO: 13086 - DNA, 16 bp, Artificial Sequence
  synthetic [barcode part1]
gaactacttcgtatcc

SEQ ID NO: 13087 - DNA, 16 bp, Artificial Sequence
  synthetic [barcode part1]
tgagaccaccgtaact

SEQ ID NO: 13088 - DNA, 16 bp, Artificial Sequence
  synthetic [barcode part1]
aagaggaccgagattg

SEQ ID NO: 13089 - DNA, 16 bp, Artificial Sequence
  synthetic [barcode part1]
tccgatcagaaggttc

SEQ ID NO: 13090 - DNA, 16 bp, Artificial Sequence
  synthetic [barcode part1]
gattgcgagagtcggt

SEQ ID NO: 13091 - DNA, 16 bp, Artificial Sequence
  synthetic [barcode part1]
agacgccagtattcac

SEQ ID NO: 13092 - DNA, 16 bp, Artificial Sequence
  synthetic [barcode part1]
tggcgattgtgttctt

SEQ ID NO: 13093 - DNA, 16 bp, Artificial Sequence
  synthetic [barcode part1]
gccttaactgagactg

SEQ ID NO: 13094 - DNA, 16 bp, Artificial Sequence
  synthetic [barcode part1]
gttaggtagacacggc

SEQ ID NO: 13095 - DNA, 16 bp, Artificial Sequence
  synthetic [barcode part1]
ttcggaacgaccaatc

SEQ ID NO: 13096 - DNA, 16 bp, Artificial Sequence
  synthetic [barcode part1]
aggccgttctaacaac

SEQ ID NO: 13097 - DNA, 16 bp, Artificial Sequence
  synthetic [barcode part1]
acaggttaccagaggc

SEQ ID NO: 13098 - DNA, 16 bp, Artificial Sequence
  synthetic [barcode part1]
tcgttgcagtactcgc

SEQ ID NO: 13099 - DNA, 16 bp, Artificial Sequence
  synthetic [barcode part1]
cggtgaatcgtcttag

SEQ ID NO: 13100 - DNA, 16 bp, Artificial Sequence
  synthetic [barcode part1]
tcttaactcctgtcgc

SEQ ID NO: 13101 - DNA, 16 bp, Artificial Sequence
  synthetic [barcode part1]
aacgatacgagtgccg

SEQ ID NO: 13102 - DNA, 16 bp, Artificial Sequence
  synthetic [barcode part1]
cactagttcggccttg

SEQ ID NO: 13103 - DNA, 16 bp, Artificial Sequence
  synthetic [barcode part1]
gtgaacgccgtagtag

SEQ ID NO: 13104 - DNA, 16 bp, Artificial Sequence
  synthetic [barcode part1]
cctacaagatagagtg

SEQ ID NO: 13105 - DNA, 16 bp, Artificial Sequence
  synthetic [barcode part1]
acacctctcagtgacc

SEQ ID NO: 13106 - DNA, 16 bp, Artificial Sequence
  synthetic [barcode part1]
tgtcggagtctccact

SEQ ID NO: 13107 - DNA, 16 bp, Artificial Sequence
  synthetic [barcode part1]
attgaaccgtccttgt

SEQ ID NO: 13108 - DNA, 16 bp, Artificial Sequence
  synthetic [barcode part1]
gaatccactacacgac

SEQ ID NO: 13109 - DNA, 16 bp, Artificial Sequence
  synthetic [barcode part1]
gtatatactgaccggc

SEQ ID NO: 13110 - DNA, 16 bp, Artificial Sequence
  synthetic [barcode part1]
tgttaggacgatctgc

SEQ ID NO: 13111 - DNA, 16 bp, Artificial Sequence
  synthetic [barcode part1]
caataagtcgtgaacg

SEQ ID NO: 13112 - DNA, 16 bp, Artificial Sequence
  synthetic [barcode part1]
aactattcgcctctag

SEQ ID NO: 13113 - DNA, 16 bp, Artificial Sequence
  synthetic [barcode part1]
gactacttccgtgtcg

SEQ ID NO: 13114 - DNA, 16 bp, Artificial Sequence
  synthetic [barcode part1]
attgcgtagagactag

SEQ ID NO: 13115 - DNA, 16 bp, Artificial Sequence
  synthetic [barcode part1]
tgtagacgtaggtctc

SEQ ID NO: 13116 - DNA, 16 bp, Artificial Sequence
  synthetic [barcode part1]
attctcaactcgacac

SEQ ID NO: 13117 - DNA, 16 bp, Artificial Sequence
  synthetic [barcode part1]
aacgtgcctaacttct

SEQ ID NO: 13118 - DNA, 16 bp, Artificial Sequence
  synthetic [barcode part1]
ccggcagatagaggtt

SEQ ID NO: 13119 - DNA, 16 bp, Artificial Sequence
  synthetic [barcode part1]
cacaggtacgaacctt

SEQ ID NO: 13120 - DNA, 16 bp, Artificial Sequence
  synthetic [barcode part1]
agacgagtgaacgaac

SEQ ID NO: 13121 - DNA, 16 bp, Artificial Sequence
  synthetic [barcode part1]
aacctgagactaccac

SEQ ID NO: 13122 - DNA, 16 bp, Artificial Sequence
  synthetic [barcode part1]
gtcactaggaacgcag

SEQ ID NO: 13123 - DNA, 16 bp, Artificial Sequence
  synthetic [barcode part1]
atacggtggtctcctc

SEQ ID NO: 13124 - DNA, 16 bp, Artificial Sequence
  synthetic [barcode part1]
ttcttgacacggttac

SEQ ID NO: 13125 - DNA, 16 bp, Artificial Sequence
  synthetic [barcode part1]
gtaattgaggaccagt

SEQ ID NO: 13126 - DNA, 16 bp, Artificial Sequence
  synthetic [barcode part1]
ttggacggacggagtt

SEQ ID NO: 13127 - DNA, 16 bp, Artificial Sequence
  synthetic [barcode part1]
cagaacgccgttattg

SEQ ID NO: 13128 - DNA, 16 bp, Artificial Sequence
  synthetic [barcode part1]
ccagttcacaactatc

SEQ ID NO: 13129 - DNA, 16 bp, Artificial Sequence
  synthetic [barcode part1]
ttcttgtgagtcgccg

SEQ ID NO: 13130 - DNA, 16 bp, Artificial Sequence
  synthetic [barcode part1]
atccagacagacactc

SEQ ID NO: 13131 - DNA, 16 bp, Artificial Sequence
  synthetic [barcode part1]
tctccggatatcaact

SEQ ID NO: 13132 - DNA, 16 bp, Artificial Sequence
  synthetic [barcode part1]
tgagttgttggtgacc

SEQ ID NO: 13133 - DNA, 16 bp, Artificial Sequence
  synthetic [barcode part1]
gtggaagtagtggtcc

SEQ ID NO: 13134 - DNA, 16 bp, Artificial Sequence
  synthetic [barcode part1]
gacgtataccgtacac

SEQ ID NO: 13135 - DNA, 16 bp, Artificial Sequence
  synthetic [barcode part1]
tggtcttgtacactgt

SEQ ID NO: 13136 - DNA, 16 bp, Artificial Sequence
  synthetic [barcode part1]
cagttctatcgtacgt

SEQ ID NO: 13137 - DNA, 16 bp, Artificial Sequence
  synthetic [barcode part1]
gtatcgacgtaagtcc

SEQ ID NO: 13138 - DNA, 16 bp, Artificial Sequence
  synthetic [barcode part1]
acacaacgactaagac

SEQ ID NO: 13139 - DNA, 16 bp, Artificial Sequence
  synthetic [barcode part1]
tgttgaggaacgtggc

SEQ ID NO: 13140 - DNA, 16 bp, Artificial Sequence
  synthetic [barcode part1]
tacgcgaactcgaact

SEQ ID NO: 13141 - DNA, 16 bp, Artificial Sequence
  synthetic [barcode part1]
acagtgcgttacggtt

SEQ ID NO: 13142 - DNA, 16 bp, Artificial Sequence
  synthetic [barcode part1]
tacaggcacggtaggt

SEQ ID NO: 13143 - DNA, 16 bp, Artificial Sequence
  synthetic [barcode part1]
cggacctcttgaatag

SEQ ID NO: 13144 - DNA, 16 bp, Artificial Sequence
  synthetic [barcode part1]
cgttaagtctgtactc

SEQ ID NO: 13145 - DNA, 16 bp, Artificial Sequence
  synthetic [barcode part1]
tcagacttcgaaccag

SEQ ID NO: 13146 - DNA, 16 bp, Artificial Sequence
  synthetic [barcode part1]
agtgaggtataagtcc

SEQ ID NO: 13147 - DNA, 16 bp, Artificial Sequence
  synthetic [barcode part1]
taccaccttactgtcc

SEQ ID NO: 13148 - DNA, 16 bp, Artificial Sequence
  synthetic [barcode part1]
agtgtacggccagaac

SEQ ID NO: 13149 - DNA, 16 bp, Artificial Sequence
  synthetic [barcode part1]
atcggaggttgacacg

SEQ ID NO: 13150 - DNA, 16 bp, Artificial Sequence
  synthetic [barcode part1]
caacgaggtaacagag

SEQ ID NO: 13151 - DNA, 16 bp, Artificial Sequence
  synthetic [barcode part1]
tccaccttctggaacg

SEQ ID NO: 13152 - DNA, 16 bp, Artificial Sequence
  synthetic [barcode part1]
atctgagacttcactc

SEQ ID NO: 13153 - DNA, 16 bp, Artificial Sequence
  synthetic [barcode part1]
cgtctgcgtgatacct

SEQ ID NO: 13154 - DNA, 16 bp, Artificial Sequence
  synthetic [barcode part1]
ttcttccgcgttacac

SEQ ID NO: 13155 - DNA, 16 bp, Artificial Sequence
  synthetic [barcode part1]
acgaagattggcgatt

SEQ ID NO: 13156 - DNA, 16 bp, Artificial Sequence
  synthetic [barcode part1]
aggttcgcactccact

SEQ ID NO: 13157 - DNA, 16 bp, Artificial Sequence
  synthetic [barcode part1]
caatagtctggaccgt

SEQ ID NO: 13158 - DNA, 16 bp, Artificial Sequence
  synthetic [barcode part1]
cacacctgacgattcc

SEQ ID NO: 13159 - DNA, 16 bp, Artificial Sequence
  synthetic [barcode part1]
gactcggtccttgtac

SEQ ID NO: 13160 - DNA, 16 bp, Artificial Sequence
  synthetic [barcode part1]
ttgttcgaggcagact

SEQ ID NO: 13161 - DNA, 16 bp, Artificial Sequence
  synthetic [barcode part1]
ttctaatcgcgaacct

SEQ ID NO: 13162 - DNA, 16 bp, Artificial Sequence
  synthetic [barcode part1]
tacagtgtgagacctc

SEQ ID NO: 13163 - DNA, 16 bp, Artificial Sequence
  synthetic [barcode part1]
accaatcggaattccg

SEQ ID NO: 13164 - DNA, 16 bp, Artificial Sequence
  synthetic [barcode part1]
gagatcgactgtcttg

SEQ ID NO: 13165 - DNA, 16 bp, Artificial Sequence
  synthetic [barcode part1]
caacaggttgcaggtg

SEQ ID NO: 13166 - DNA, 16 bp, Artificial Sequence
  synthetic [barcode part1]
aacgacgcgttacttg

SEQ ID NO: 13167 - DNA, 16 bp, Artificial Sequence
  synthetic [barcode part1]
gcaagtgttgtaacag

SEQ ID NO: 13168 - DNA, 16 bp, Artificial Sequence
  synthetic [barcode part1]
taacttccgaccacgc

SEQ ID NO: 13169 - DNA, 16 bp, Artificial Sequence
  synthetic [barcode part1]
actgttggtcaggttg

SEQ ID NO: 13170 - DNA, 16 bp, Artificial Sequence
  synthetic [barcode part1]
tgacagtaccagatcc

SEQ ID NO: 13171 - DNA, 16 bp, Artificial Sequence
  synthetic [barcode part1]
agtcaggtagagagtg

SEQ ID NO: 13172 - DNA, 16 bp, Artificial Sequence
  synthetic [barcode part1]
tcacctggcggtattc

SEQ ID NO: 13173 - DNA, 16 bp, Artificial Sequence
  synthetic [barcode part1]
gacgaacgacactacg

SEQ ID NO: 13174 - DNA, 16 bp, Artificial Sequence
  synthetic [barcode part1]
attcgttgtcttaggc

SEQ ID NO: 13175 - DNA, 16 bp, Artificial Sequence
  synthetic [barcode part1]
taaggtagagtacctg

SEQ ID NO: 13176 - DNA, 16 bp, Artificial Sequence
  synthetic [barcode part1]
ttcgccgtacgtcagt

SEQ ID NO: 13177 - DNA, 16 bp, Artificial Sequence
  synthetic [barcode part1]
gtctctggatacgaac

SEQ ID NO: 13178 - DNA, 16 bp, Artificial Sequence
  synthetic [barcode part1]
tgcagtgattcacctt

SEQ ID NO: 13179 - DNA, 16 bp, Artificial Sequence
  synthetic [barcode part1]
attcgcaactaaggag

SEQ ID NO: 13180 - DNA, 16 bp, Artificial Sequence
  synthetic [barcode part1]
ttacaagttaccgcct

SEQ ID NO: 13181 - DNA, 16 bp, Artificial Sequence
  synthetic [barcode part1]
gtcctcaagattatcc

SEQ ID NO: 13182 - DNA, 16 bp, Artificial Sequence
  synthetic [barcode part1]
taattcaggcggtctg

SEQ ID NO: 13183 - DNA, 16 bp, Artificial Sequence
  synthetic [barcode part1]
tgcagatctcaccgtc

SEQ ID NO: 13184 - DNA, 16 bp, Artificial Sequence
  synthetic [barcode part1]
ttgtctaggatcttgc

SEQ ID NO: 13185 - DNA, 16 bp, Artificial Sequence
  synthetic [barcode part1]
cgtgtctctgtcagac

SEQ ID NO: 13186 - DNA, 16 bp, Artificial Sequence
  synthetic [barcode part1]
ccgatctgagtacctc

SEQ ID NO: 13187 - DNA, 16 bp, Artificial Sequence
  synthetic [barcode part1]
cggagagataccggtt

SEQ ID NO: 13188 - DNA, 16 bp, Artificial Sequence
  synthetic [barcode part1]
gtatcaacggttcctt

SEQ ID NO: 13189 - DNA, 16 bp, Artificial Sequence
  synthetic [barcode part1]
tacttgtagacggacc

SEQ ID NO: 13190 - DNA, 16 bp, Artificial Sequence
  synthetic [barcode part1]
agtcacggaccgaagt

SEQ ID NO: 13191 - DNA, 16 bp, Artificial Sequence
  synthetic [barcode part1]
tactcacagatctcgt

SEQ ID NO: 13192 - DNA, 16 bp, Artificial Sequence
  synthetic [barcode part1]
ttggactaacctgacg

SEQ ID NO: 13193 - DNA, 16 bp, Artificial Sequence
  synthetic [barcode part1]
tggaaggtagtgtatc

SEQ ID NO: 13194 - DNA, 16 bp, Artificial Sequence
  synthetic [barcode part1]
gaggtgtctgaattag

SEQ ID NO: 13195 - DNA, 16 bp, Artificial Sequence
  synthetic [barcode part1]
ttcaggaccagaactc

SEQ ID NO: 13196 - DNA, 16 bp, Artificial Sequence
  synthetic [barcode part1]
tgtgcgatagaggatt

SEQ ID NO: 13197 - DNA, 16 bp, Artificial Sequence
  synthetic [barcode part1]
agtcggaggtgtactg

SEQ ID NO: 13198 - DNA, 16 bp, Artificial Sequence
  synthetic [barcode part1]
tctagtgttgtatccg

SEQ ID NO: 13199 - DNA, 16 bp, Artificial Sequence
  synthetic [barcode part1]
aagaggtcgtctcact

SEQ ID NO: 13200 - DNA, 16 bp, Artificial Sequence
  synthetic [barcode part1]
gatctcaatccgtccg

SEQ ID NO: 13201 - DNA, 16 bp, Artificial Sequence
  synthetic [barcode part1]
cgtccttgttagaccg

SEQ ID NO: 13202 - DNA, 16 bp, Artificial Sequence
  synthetic [barcode part1]
cacgtaatagaagacc

SEQ ID NO: 13203 - DNA, 16 bp, Artificial Sequence
  synthetic [barcode part1]
attacttcgtccaggt

SEQ ID NO: 13204 - DNA, 16 bp, Artificial Sequence
  synthetic [barcode part1]
caggatctgcagtgtt

SEQ ID NO: 13205 - DNA, 16 bp, Artificial Sequence
  synthetic [barcode part1]
atctatctactacggc

SEQ ID NO: 13206 - DNA, 16 bp, Artificial Sequence
  synthetic [barcode part1]
ataattgaggaccgac

SEQ ID NO: 13207 - DNA, 16 bp, Artificial Sequence
  synthetic [barcode part1]
acagtgcctggaactt

SEQ ID NO: 13208 - DNA, 16 bp, Artificial Sequence
  synthetic [barcode part1]
acgaaggtggcagttc

SEQ ID NO: 13209 - DNA, 16 bp, Artificial Sequence
  synthetic [barcode part1]
tgtggtactcgaagtc

SEQ ID NO: 13210 - DNA, 16 bp, Artificial Sequence
  synthetic [barcode part1]
tggtgatcacgccttc

SEQ ID NO: 13211 - DNA, 16 bp, Artificial Sequence
  synthetic [barcode part1]
aggagtgaacgacctc

SEQ ID NO: 13212 - DNA, 16 bp, Artificial Sequence
  synthetic [barcode part1]
cagtagttgcgaggac

SEQ ID NO: 13213 - DNA, 16 bp, Artificial Sequence
  synthetic [barcode part1]
tcctgactataggttc

SEQ ID NO: 13214 - DNA, 16 bp, Artificial Sequence
  synthetic [barcode part1]
cgaggtatctagttcg

SEQ ID NO: 13215 - DNA, 16 bp, Artificial Sequence
  synthetic [barcode part1]
agtcgcctacctctag

SEQ ID NO: 13216 - DNA, 16 bp, Artificial Sequence
  synthetic [barcode part1]
aacggtgtcacgaacg

SEQ ID NO: 13217 - DNA, 16 bp, Artificial Sequence
  synthetic [barcode part1]
cgtgacagtccgttct

SEQ ID NO: 13218 - DNA, 16 bp, Artificial Sequence
  synthetic [barcode part1]
gttatccgttccgtct

SEQ ID NO: 13219 - DNA, 16 bp, Artificial Sequence
  synthetic [barcode part1]
caactgaactgaccac

SEQ ID NO: 13220 - DNA, 16 bp, Artificial Sequence
  synthetic [barcode part1]
cctcacacgatagtcc

SEQ ID NO: 13221 - DNA, 16 bp, Artificial Sequence
  synthetic [barcode part1]
tctctgagtactgact

SEQ ID NO: 13222 - DNA, 16 bp, Artificial Sequence
  synthetic [barcode part1]
cctactcctacggtag

SEQ ID NO: 13223 - DNA, 16 bp, Artificial Sequence
  synthetic [barcode part1]
gtagattccaggcgtt

SEQ ID NO: 13224 - DNA, 16 bp, Artificial Sequence
  synthetic [barcode part1]
ttatcgtctacggatc

SEQ ID NO: 13225 - DNA, 16 bp, Artificial Sequence
  synthetic [barcode part1]
actgttgcagttcgag

SEQ ID NO: 13226 - DNA, 16 bp, Artificial Sequence
  synthetic [barcode part1]
acgtgacgtgtatcgt

SEQ ID NO: 13227 - DNA, 16 bp, Artificial Sequence
  synthetic [barcode part1]
gtcctacgttcggatc

SEQ ID NO: 13228 - DNA, 16 bp, Artificial Sequence
  synthetic [barcode part1]
acctcggaactagttg

SEQ ID NO: 13229 - DNA, 16 bp, Artificial Sequence
  synthetic [barcode part1]
gttagtctgtgcacag

SEQ ID NO: 13230 - DNA, 16 bp, Artificial Sequence
  synthetic [barcode part1]
aaggcgtaaggtacag

SEQ ID NO: 13231 - DNA, 16 bp, Artificial Sequence
  synthetic [barcode part1]
gattacgactgtgcac

SEQ ID NO: 13232 - DNA, 16 bp, Artificial Sequence
  synthetic [barcode part1]
aatacttgtcctccag

SEQ ID NO: 13233 - DNA, 16 bp, Artificial Sequence
  synthetic [barcode part1]
tgtctaggactacacg

SEQ ID NO: 13234 - DNA, 16 bp, Artificial Sequence
  synthetic [barcode part1]
gattaccttcggcaag

SEQ ID NO: 13235 - DNA, 16 bp, Artificial Sequence
  synthetic [barcode part1]
tagtggcaatcaccgt

SEQ ID NO: 13236 - DNA, 16 bp, Artificial Sequence
  synthetic [barcode part1]
taacgtcgtagtaccg

SEQ ID NO: 13237 - DNA, 16 bp, Artificial Sequence
  synthetic [barcode part1]
tccaatcgcaccggtt

SEQ ID NO: 13238 - DNA, 16 bp, Artificial Sequence
  synthetic [barcode part1]
agtcagtctccttctc

SEQ ID NO: 13239 - DNA, 16 bp, Artificial Sequence
  synthetic [barcode part1]
gttctagaaccggttg

SEQ ID NO: 13240 - DNA, 16 bp, Artificial Sequence
  synthetic [barcode part1]
cagaatcagagtcctc

SEQ ID NO: 13241 - DNA, 16 bp, Artificial Sequence
  synthetic [barcode part1]
ataagagtggcctggc

SEQ ID NO: 13242 - DNA, 16 bp, Artificial Sequence
  synthetic [barcode part1]
actggaccacttccgt

SEQ ID NO: 13243 - DNA, 16 bp, Artificial Sequence
  synthetic [barcode part1]
cgataacttccacgcc

SEQ ID NO: 13244 - DNA, 16 bp, Artificial Sequence
  synthetic [barcode part1]
gagttcggcgattgtt

SEQ ID NO: 13245 - DNA, 16 bp, Artificial Sequence
  synthetic [barcode part1]
tctggaagattccgac

SEQ ID NO: 13246 - DNA, 16 bp, Artificial Sequence
  synthetic [barcode part1]
gttacgtgactcacag

SEQ ID NO: 13247 - DNA, 16 bp, Artificial Sequence
  synthetic [barcode part1]
tgcacggtagatctac

SEQ ID NO: 13248 - DNA, 16 bp, Artificial Sequence
  synthetic [barcode part1]
aacacactgactgcac

SEQ ID NO: 13249 - DNA, 16 bp, Artificial Sequence
  synthetic [barcode part1]
gttgacggacgtactt

SEQ ID NO: 13250 - DNA, 16 bp, Artificial Sequence
  synthetic [barcode part1]
tgtgactggttgtgtg

SEQ ID NO: 13251 - DNA, 16 bp, Artificial Sequence
  synthetic [barcode part1]
tgttcgtgttccaagt

SEQ ID NO: 13252 - DNA, 16 bp, Artificial Sequence
  synthetic [barcode part1]
taggttcctacagacg

SEQ ID NO: 13253 - DNA, 16 bp, Artificial Sequence
  synthetic [barcode part1]
tgttcacactccaagt

SEQ ID NO: 13254 - DNA, 16 bp, Artificial Sequence
  synthetic [barcode part1]
taccgagttcgtgcct

SEQ ID NO: 13255 - DNA, 16 bp, Artificial Sequence
  synthetic [barcode part1]
atcgaacgtagtccac

SEQ ID NO: 13256 - DNA, 16 bp, Artificial Sequence
  synthetic [barcode part1]
cggtctcctaacttct

SEQ ID NO: 13257 - DNA, 16 bp, Artificial Sequence
  synthetic [barcode part1]
aactgtgttcttcgac

SEQ ID NO: 13258 - DNA, 16 bp, Artificial Sequence
  synthetic [barcode part1]
ataccagagaggccac

SEQ ID NO: 13259 - DNA, 16 bp, Artificial Sequence
  synthetic [barcode part1]
aatcgtcagacgtaag

SEQ ID NO: 13260 - DNA, 16 bp, Artificial Sequence
  synthetic [barcode part1]
gttacgtacacgatcg

SEQ ID NO: 13261 - DNA, 16 bp, Artificial Sequence
  synthetic [barcode part1]
tatcggtcgactgtag

SEQ ID NO: 13262 - DNA, 16 bp, Artificial Sequence
  synthetic [barcode part1]
acttcttgtgttgacg

SEQ ID NO: 13263 - DNA, 16 bp, Artificial Sequence
  synthetic [barcode part1]
gtcaaggaggaagttg

SEQ ID NO: 13264 - DNA, 16 bp, Artificial Sequence
  synthetic [barcode part1]
gcgtcttatcgagtcc

SEQ ID NO: 13265 - DNA, 16 bp, Artificial Sequence
  synthetic [barcode part1]
acctcacgttcaggtc

SEQ ID NO: 13266 - DNA, 16 bp, Artificial Sequence
  synthetic [barcode part1]
caccggtggaagattg

SEQ ID NO: 13267 - DNA, 16 bp, Artificial Sequence
  synthetic [barcode part1]
acaaccgcgacgtatt

SEQ ID NO: 13268 - DNA, 16 bp, Artificial Sequence
  synthetic [barcode part1]
ccgagaacaacttctg

SEQ ID NO: 13269 - DNA, 16 bp, Artificial Sequence
  synthetic [barcode part1]
ttacacgttagtctcg

SEQ ID NO: 13270 - DNA, 16 bp, Artificial Sequence
  synthetic [barcode part1]
ccaggtaagtgttcgt

SEQ ID NO: 13271 - DNA, 16 bp, Artificial Sequence
  synthetic [barcode part1]
acaatatacaccgcgc

SEQ ID NO: 13272 - DNA, 16 bp, Artificial Sequence
  synthetic [barcode part1]
atcgtgtctgaacacg

SEQ ID NO: 13273 - DNA, 16 bp, Artificial Sequence
  synthetic [barcode part1]
acaattactccggttc

SEQ ID NO: 13274 - DNA, 16 bp, Artificial Sequence
  synthetic [barcode part1]
tcacacttcacgtcct

SEQ ID NO: 13275 - DNA, 16 bp, Artificial Sequence
  synthetic [barcode part1]
tcgcgaacgtcctgtt

SEQ ID NO: 13276 - DNA, 16 bp, Artificial Sequence
  synthetic [barcode part1]
aacaccactagttggc

SEQ ID NO: 13277 - DNA, 16 bp, Artificial Sequence
  synthetic [barcode part1]
gactggataggtccag

SEQ ID NO: 13278 - DNA, 16 bp, Artificial Sequence
  synthetic [barcode part1]
ttcactaaggagtcgc

SEQ ID NO: 13279 - DNA, 16 bp, Artificial Sequence
  synthetic [barcode part1]
gtgcggttgtaactac

SEQ ID NO: 13280 - DNA, 16 bp, Artificial Sequence
  synthetic [barcode part1]
ttattgcgacgtccgc

SEQ ID NO: 13281 - DNA, 16 bp, Artificial Sequence
  synthetic [barcode part1]
tgtcaggtgtcctcgt

SEQ ID NO: 13282 - DNA, 16 bp, Artificial Sequence
  synthetic [barcode part1]
tctctccttctctcct

SEQ ID NO: 13283 - DNA, 16 bp, Artificial Sequence
  synthetic [barcode part1]
gtcgcggaatatcact

SEQ ID NO: 13284 - DNA, 16 bp, Artificial Sequence
  synthetic [barcode part1]
ttccacgaactatcac

SEQ ID NO: 13285 - DNA, 16 bp, Artificial Sequence
  synthetic [barcode part1]
ttcaggatacacgcac

SEQ ID NO: 13286 - DNA, 16 bp, Artificial Sequence
  synthetic [barcode part1]
gagtgtggatctgacg

SEQ ID NO: 13287 - DNA, 16 bp, Artificial Sequence
  synthetic [barcode part1]
tggtccgacttgatag

SEQ ID NO: 13288 - DNA, 16 bp, Artificial Sequence
  synthetic [barcode part1]
atagttggccggtact

SEQ ID NO: 13289 - DNA, 16 bp, Artificial Sequence
  synthetic [barcode part1]
agattccgaagaggag

SEQ ID NO: 13290 - DNA, 16 bp, Artificial Sequence
  synthetic [barcode part1]
acagtgtccggaattc

SEQ ID NO: 13291 - DNA, 16 bp, Artificial Sequence
  synthetic [barcode part1]
ttgttgttccggacgc

SEQ ID NO: 13292 - DNA, 16 bp, Artificial Sequence
  synthetic [barcode part1]
ccgtatatcttgatcg

SEQ ID NO: 13293 - DNA, 16 bp, Artificial Sequence
  synthetic [barcode part1]
gtgtcggtctcgttac

SEQ ID NO: 13294 - DNA, 16 bp, Artificial Sequence
  synthetic [barcode part1]
gtatctgatagtggag

SEQ ID NO: 13295 - DNA, 16 bp, Artificial Sequence
  synthetic [barcode part1]
aggactcaagtctcgt

SEQ ID NO: 13296 - DNA, 16 bp, Artificial Sequence
  synthetic [barcode part1]
gcaaccgtgtaattgc

SEQ ID NO: 13297 - DNA, 16 bp, Artificial Sequence
  synthetic [barcode part1]
attgacgcgagagacc

SEQ ID NO: 13298 - DNA, 16 bp, Artificial Sequence
  synthetic [barcode part1]
ccgtagatctgcaagt

SEQ ID NO: 13299 - DNA, 16 bp, Artificial Sequence
  synthetic [barcode part1]
actggcacttgcaagt

SEQ ID NO: 13300 - DNA, 16 bp, Artificial Sequence
  synthetic [barcode part1]
cggaattcctcaagac

SEQ ID NO: 13301 - DNA, 16 bp, Artificial Sequence
  synthetic [barcode part1]
atccttacgaaggcac

SEQ ID NO: 13302 - DNA, 16 bp, Artificial Sequence
  synthetic [barcode part1]
gttgttctcacaggtt

SEQ ID NO: 13303 - DNA, 16 bp, Artificial Sequence
  synthetic [barcode part1]
acaacctgtcttcgcg

SEQ ID NO: 13304 - DNA, 16 bp, Artificial Sequence
  synthetic [barcode part1]
gttactgtggtagtcg

SEQ ID NO: 13305 - DNA, 16 bp, Artificial Sequence
  synthetic [barcode part1]
tgattcttatacggcc

SEQ ID NO: 13306 - DNA, 16 bp, Artificial Sequence
  synthetic [barcode part1]
tggtccttagtgtgcc

SEQ ID NO: 13307 - DNA, 16 bp, Artificial Sequence
  synthetic [barcode part1]
aggtattgtctcacct

SEQ ID NO: 13308 - DNA, 16 bp, Artificial Sequence
  synthetic [barcode part1]
gttcctcgatcaagag

SEQ ID NO: 13309 - DNA, 16 bp, Artificial Sequence
  synthetic [barcode part1]
ccttctggacgtactg

SEQ ID NO: 13310 - DNA, 16 bp, Artificial Sequence
  synthetic [barcode part1]
cactgagtgaggacgt

SEQ ID NO: 13311 - DNA, 16 bp, Artificial Sequence
  synthetic [barcode part1]
tctaacgcctgacaag

SEQ ID NO: 13312 - DNA, 16 bp, Artificial Sequence
  synthetic [barcode part1]
gacgttaataccacgc

SEQ ID NO: 13313 - DNA, 16 bp, Artificial Sequence
  synthetic [barcode part1]
atctcacctacgtagt

SEQ ID NO: 13314 - DNA, 16 bp, Artificial Sequence
  synthetic [barcode part1]
aattactgtgaaggcg

SEQ ID NO: 13315 - DNA, 16 bp, Artificial Sequence
  synthetic [barcode part1]
ttacgcaactacgcag

SEQ ID NO: 13316 - DNA, 16 bp, Artificial Sequence
  synthetic [barcode part1]
accgagtcttatacct

SEQ ID NO: 13317 - DNA, 16 bp, Artificial Sequence
  synthetic [barcode part1]
tcagacagagtggcac

SEQ ID NO: 13318 - DNA, 16 bp, Artificial Sequence
  synthetic [barcode part1]
aactagagtctaggtg

SEQ ID NO: 13319 - DNA, 16 bp, Artificial Sequence
  synthetic [barcode part1]
atcgatagtggccact

SEQ ID NO: 13320 - DNA, 16 bp, Artificial Sequence
  synthetic [barcode part1]
ttccttctctcaaggc

SEQ ID NO: 13321 - DNA, 16 bp, Artificial Sequence
  synthetic [barcode part1]
acactactacctactg

SEQ ID NO: 13322 - DNA, 16 bp, Artificial Sequence
  synthetic [barcode part1]
tacctgtgaattccgt

SEQ ID NO: 13323 - DNA, 16 bp, Artificial Sequence
  synthetic [barcode part1]
cgcgttcactcttact

SEQ ID NO: 13324 - DNA, 16 bp, Artificial Sequence
  synthetic [barcode part1]
tcttacgcaacagtct

SEQ ID NO: 13325 - DNA, 16 bp, Artificial Sequence
  synthetic [barcode part1]
acagttcgttcctgcg

SEQ ID NO: 13326 - DNA, 16 bp, Artificial Sequence
  synthetic [barcode part1]
agtgacctgatccagt

SEQ ID NO: 13327 - DNA, 16 bp, Artificial Sequence
  synthetic [barcode part1]
gcctgccaatatcacc

SEQ ID NO: 13328 - DNA, 16 bp, Artificial Sequence
  synthetic [barcode part1]
cggactattagaccgt

SEQ ID NO: 13329 - DNA, 16 bp, Artificial Sequence
  synthetic [barcode part1]
ccagagtgaacaagtt

SEQ ID NO: 13330 - DNA, 16 bp, Artificial Sequence
  synthetic [barcode part1]
gaataacaaggtggcg

SEQ ID NO: 13331 - DNA, 16 bp, Artificial Sequence
  synthetic [barcode part1]
gttggcaggtgtatct

SEQ ID NO: 13332 - DNA, 16 bp, Artificial Sequence
  synthetic [barcode part1]
caggaggttctctagt

SEQ ID NO: 13333 - DNA, 16 bp, Artificial Sequence
  synthetic [barcode part1]
caacttccgcagtcgt

SEQ ID NO: 13334 - DNA, 16 bp, Artificial Sequence
  synthetic [barcode part1]
gtatctcagagtgcgt

SEQ ID NO: 13335 - DNA, 16 bp, Artificial Sequence
  synthetic [barcode part1]
cgacaagtactgtctg

SEQ ID NO: 13336 - DNA, 16 bp, Artificial Sequence
  synthetic [barcode part1]
acaagttacgcgacct

SEQ ID NO: 13337 - DNA, 16 bp, Artificial Sequence
  synthetic [barcode part1]
taatcctgcaccaatc

SEQ ID NO: 13338 - DNA, 16 bp, Artificial Sequence
  synthetic [barcode part1]
cagtgtggtcagaggt

SEQ ID NO: 13339 - DNA, 16 bp, Artificial Sequence
  synthetic [barcode part1]
tctattctcgcctacg

SEQ ID NO: 13340 - DNA, 16 bp, Artificial Sequence
  synthetic [barcode part1]
taaggtctcaactggc

SEQ ID NO: 13341 - DNA, 16 bp, Artificial Sequence
  synthetic [barcode part1]
acgtctaacgaacctg

SEQ ID NO: 13342 - DNA, 16 bp, Artificial Sequence
  synthetic [barcode part1]
caggttaaggaatacc

SEQ ID NO: 13343 - DNA, 16 bp, Artificial Sequence
  synthetic [barcode part1]
gtgaacttgcgtcaac

SEQ ID NO: 13344 - DNA, 16 bp, Artificial Sequence
  synthetic [barcode part1]
gaaggtctctctcaag

SEQ ID NO: 13345 - DNA, 16 bp, Artificial Sequence
  synthetic [barcode part1]
tcaccactctagacgc

SEQ ID NO: 13346 - DNA, 16 bp, Artificial Sequence
  synthetic [barcode part1]
aatcggcgacttcagt

SEQ ID NO: 13347 - DNA, 16 bp, Artificial Sequence
  synthetic [barcode part1]
attcggatcgtcttac

SEQ ID NO: 13348 - DNA, 16 bp, Artificial Sequence
  synthetic [barcode part1]
gtcgaacacgatctgt

SEQ ID NO: 13349 - DNA, 16 bp, Artificial Sequence
  synthetic [barcode part1]
tggttctgtaccgatt

SEQ ID NO: 13350 - DNA, 16 bp, Artificial Sequence
  synthetic [barcode part1]
ttcgaccgtgcgttac

SEQ ID NO: 13351 - DNA, 16 bp, Artificial Sequence
  synthetic [barcode part1]
tcaggtgactctgcct

SEQ ID NO: 13352 - DNA, 16 bp, Artificial Sequence
  synthetic [barcode part1]
taggttcggtgttcag

SEQ ID NO: 13353 - DNA, 16 bp, Artificial Sequence
  synthetic [barcode part1]
tcgagtgtgaggcagt

SEQ ID NO: 13354 - DNA, 16 bp, Artificial Sequence
  synthetic [barcode part1]
gtaccaagaggtgacc

SEQ ID NO: 13355 - DNA, 16 bp, Artificial Sequence
  synthetic [barcode part1]
ttaggacgacggacac

SEQ ID NO: 13356 - DNA, 16 bp, Artificial Sequence
  synthetic [barcode part1]
ttcacacagtcgccgt

SEQ ID NO: 13357 - DNA, 16 bp, Artificial Sequence
  synthetic [barcode part1]
tctagacttgtgcgag

SEQ ID NO: 13358 - DNA, 16 bp, Artificial Sequence
  synthetic [barcode part1]
gtcctatcgtcggtgt

SEQ ID NO: 13359 - DNA, 16 bp, Artificial Sequence
  synthetic [barcode part1]
gtgcaatcgcacaatc

SEQ ID NO: 13360 - DNA, 16 bp, Artificial Sequence
  synthetic [barcode part1]
accaagttgaaccacc

SEQ ID NO: 13361 - DNA, 16 bp, Artificial Sequence
  synthetic [barcode part1]
atcgtagtggagttcc

SEQ ID NO: 13362 - DNA, 16 bp, Artificial Sequence
  synthetic [barcode part1]
cgtctacgtcttggac

SEQ ID NO: 13363 - DNA, 16 bp, Artificial Sequence
  synthetic [barcode part1]
ttgacacgtgtgtcag

SEQ ID NO: 13364 - DNA, 16 bp, Artificial Sequence
  synthetic [barcode part1]
tctactagaagtggcc

SEQ ID NO: 13365 - DNA, 16 bp, Artificial Sequence
  synthetic [barcode part1]
ccgtactcaaggatac

SEQ ID NO: 13366 - DNA, 16 bp, Artificial Sequence
  synthetic [barcode part1]
cacacttccgtgtctt

SEQ ID NO: 13367 - DNA, 16 bp, Artificial Sequence
  synthetic [barcode part1]
tacaagtacggcaagt

SEQ ID NO: 13368 - DNA, 16 bp, Artificial Sequence
  synthetic [barcode part1]
gcggaccgattatact

SEQ ID NO: 13369 - DNA, 16 bp, Artificial Sequence
  synthetic [barcode part1]
gtagtgcctggttagt

SEQ ID NO: 13370 - DNA, 16 bp, Artificial Sequence
  synthetic [barcode part1]
agaggcgtatcgaatt

SEQ ID NO: 13371 - DNA, 16 bp, Artificial Sequence
  synthetic [barcode part1]
gtctgattacacttcg

SEQ ID NO: 13372 - DNA, 16 bp, Artificial Sequence
  synthetic [barcode part1]
gcctactcctgaagtc

SEQ ID NO: 13373 - DNA, 16 bp, Artificial Sequence
  synthetic [barcode part1]
cggtgtagtcggaagt

SEQ ID NO: 13374 - DNA, 16 bp, Artificial Sequence
  synthetic [barcode part1]
gaacggtccgatacag

SEQ ID NO: 13375 - DNA, 16 bp, Artificial Sequence
  synthetic [barcode part1]
tacgactgaggattag

SEQ ID NO: 13376 - DNA, 16 bp, Artificial Sequence
  synthetic [barcode part1]
agatcaaccagtcctg

SEQ ID NO: 13377 - DNA, 16 bp, Artificial Sequence
  synthetic [barcode part1]
tgatcgagactccaac

SEQ ID NO: 13378 - DNA, 16 bp, Artificial Sequence
  synthetic [barcode part1]
tcagtgtcagtcacag

SEQ ID NO: 13379 - DNA, 16 bp, Artificial Sequence
  synthetic [barcode part1]
actggataggtgtaac

SEQ ID NO: 13380 - DNA, 16 bp, Artificial Sequence
  synthetic [barcode part1]
tccagatcgagagacg

SEQ ID NO: 13381 - DNA, 16 bp, Artificial Sequence
  synthetic [barcode part1]
agttgtcacctggtag

SEQ ID NO: 13382 - DNA, 16 bp, Artificial Sequence
  synthetic [barcode part1]
cctcggaataggcaag

SEQ ID NO: 13383 - DNA, 16 bp, Artificial Sequence
  synthetic [barcode part1]
tgaggcagaatacttg

SEQ ID NO: 13384 - DNA, 16 bp, Artificial Sequence
  synthetic [barcode part1]
tgtgtgagacagtaac

SEQ ID NO: 13385 - DNA, 16 bp, Artificial Sequence
  synthetic [barcode part1]
gtgacacgtcaactgt

SEQ ID NO: 13386 - DNA, 16 bp, Artificial Sequence
  synthetic [barcode part1]
acagtgcgtcgtagtt

SEQ ID NO: 13387 - DNA, 16 bp, Artificial Sequence
  synthetic [barcode part1]
tatcttcgaccactag

SEQ ID NO: 13388 - DNA, 16 bp, Artificial Sequence
  synthetic [barcode part1]
gatctctgacctgcgt

SEQ ID NO: 13389 - DNA, 16 bp, Artificial Sequence
  synthetic [barcode part1]
agtcttgcactacgag

SEQ ID NO: 13390 - DNA, 16 bp, Artificial Sequence
  synthetic [barcode part1]
agtgcgcagaagatcc

SEQ ID NO: 13391 - DNA, 16 bp, Artificial Sequence
  synthetic [barcode part1]
gatcttcggtccgtgt

SEQ ID NO: 13392 - DNA, 16 bp, Artificial Sequence
  synthetic [barcode part1]
gtgacgttgtgtgtgt

SEQ ID NO: 13393 - DNA, 16 bp, Artificial Sequence
  synthetic [barcode part1]
acgagtcaacctacgt

SEQ ID NO: 13394 - DNA, 16 bp, Artificial Sequence
  synthetic [barcode part1]
tagtcgattggttggc

SEQ ID NO: 13395 - DNA, 16 bp, Artificial Sequence
  synthetic [barcode part1]
acggtacgatcgatct

SEQ ID NO: 13396 - DNA, 16 bp, Artificial Sequence
  synthetic [barcode part1]
tacagtgaggtggacc

SEQ ID NO: 13397 - DNA, 16 bp, Artificial Sequence
  synthetic [barcode part1]
gcagtacaattccggt

SEQ ID NO: 13398 - DNA, 16 bp, Artificial Sequence
  synthetic [barcode part1]
aacacctcggagaacg

SEQ ID NO: 13399 - DNA, 16 bp, Artificial Sequence
  synthetic [barcode part1]
taggtggttatctgcg

SEQ ID NO: 13400 - DNA, 16 bp, Artificial Sequence
  synthetic [barcode part1]
agactctctctccttg

SEQ ID NO: 13401 - DNA, 16 bp, Artificial Sequence
  synthetic [barcode part1]
gacgttaccgaagttc

SEQ ID NO: 13402 - DNA, 16 bp, Artificial Sequence
  synthetic [barcode part1]
ttcagaggtatacgcc

SEQ ID NO: 13403 - DNA, 16 bp, Artificial Sequence
  synthetic [barcode part1]
tagtgcgaggataact

SEQ ID NO: 13404 - DNA, 16 bp, Artificial Sequence
  synthetic [barcode part1]
gattcaggtactcttc

SEQ ID NO: 13405 - DNA, 16 bp, Artificial Sequence
  synthetic [barcode part1]
aagtgtctgtccagac

SEQ ID NO: 13406 - DNA, 16 bp, Artificial Sequence
  synthetic [barcode part1]
gttagtcagtctcgag

SEQ ID NO: 13407 - DNA, 16 bp, Artificial Sequence
  synthetic [barcode part1]
acgaggatagtagttc

SEQ ID NO: 13408 - DNA, 16 bp, Artificial Sequence
  synthetic [barcode part1]
gtgttaacaacggagt

SEQ ID NO: 13409 - DNA, 16 bp, Artificial Sequence
  synthetic [barcode part1]
caacagttcgagtcac

SEQ ID NO: 13410 - DNA, 16 bp, Artificial Sequence
  synthetic [barcode part1]
cgattgactaactggc

SEQ ID NO: 13411 - DNA, 16 bp, Artificial Sequence
  synthetic [barcode part1]
ttctggcaggagttac

SEQ ID NO: 13412 - DNA, 16 bp, Artificial Sequence
  synthetic [barcode part1]
tacggtaccacttgcc

SEQ ID NO: 13413 - DNA, 16 bp, Artificial Sequence
  synthetic [barcode part1]
cggcgttaacagacag

SEQ ID NO: 13414 - DNA, 16 bp, Artificial Sequence
  synthetic [barcode part1]
cgtcttggatatccgc

SEQ ID NO: 13415 - DNA, 16 bp, Artificial Sequence
  synthetic [barcode part1]
tgccggtcaatatacg

SEQ ID NO: 13416 - DNA, 16 bp, Artificial Sequence
  synthetic [barcode part1]
gaattgccgttctcgc

SEQ ID NO: 13417 - DNA, 16 bp, Artificial Sequence
  synthetic [barcode part1]
actgtaacgcctgcct

SEQ ID NO: 13418 - DNA, 16 bp, Artificial Sequence
  synthetic [barcode part1]
acctccttacacgacg

SEQ ID NO: 13419 - DNA, 16 bp, Artificial Sequence
  synthetic [barcode part1]
aacaagtggacaggtg

SEQ ID NO: 13420 - DNA, 16 bp, Artificial Sequence
  synthetic [barcode part1]
cacgacacctgtctgt

SEQ ID NO: 13421 - DNA, 16 bp, Artificial Sequence
  synthetic [barcode part1]
tgcctcacttgaatac

SEQ ID NO: 13422 - DNA, 16 bp, Artificial Sequence
  synthetic [barcode part1]
ccgtgttgagtcgttc

SEQ ID NO: 13423 - DNA, 16 bp, Artificial Sequence
  synthetic [barcode part1]
caggagtagtgactcg

SEQ ID NO: 13424 - DNA, 16 bp, Artificial Sequence
  synthetic [barcode part1]
caggtagttacgatag

SEQ ID NO: 13425 - DNA, 16 bp, Artificial Sequence
  synthetic [barcode part1]
gtgccggttaatacgt

SEQ ID NO: 13426 - DNA, 16 bp, Artificial Sequence
  synthetic [barcode part1]
atcagtggtagtcacc

SEQ ID NO: 13427 - DNA, 16 bp, Artificial Sequence
  synthetic [barcode part1]
tagatcggtgttcttc

SEQ ID NO: 13428 - DNA, 16 bp, Artificial Sequence
  synthetic [barcode part1]
attgtctggtgagacc

SEQ ID NO: 13429 - DNA, 16 bp, Artificial Sequence
  synthetic [barcode part1]
tgaacacaagacggcc

SEQ ID NO: 13430 - DNA, 16 bp, Artificial Sequence
  synthetic [barcode part1]
tggtcctataccaatc

SEQ ID NO: 13431 - DNA, 16 bp, Artificial Sequence
  synthetic [barcode part1]
cgagaaggcacgttac

SEQ ID NO: 13432 - DNA, 16 bp, Artificial Sequence
  synthetic [barcode part1]
cggttaggtcgcaatt

SEQ ID NO: 13433 - DNA, 16 bp, Artificial Sequence
  synthetic [barcode part1]
agtatagtagactgcg

SEQ ID NO: 13434 - DNA, 16 bp, Artificial Sequence
  synthetic [barcode part1]
tgaattggcacctctt

SEQ ID NO: 13435 - DNA, 16 bp, Artificial Sequence
  synthetic [barcode part1]
caagtacgtgttcgac

SEQ ID NO: 13436 - DNA, 16 bp, Artificial Sequence
  synthetic [barcode part1]
gtaacctatccggtag

SEQ ID NO: 13437 - DNA, 16 bp, Artificial Sequence
  synthetic [barcode part1]
agtctggttccgcgtt

SEQ ID NO: 13438 - DNA, 16 bp, Artificial Sequence
  synthetic [barcode part1]
acgaatcactagagac

SEQ ID NO: 13439 - DNA, 16 bp, Artificial Sequence
  synthetic [barcode part1]
gattacacgactgcgt

SEQ ID NO: 13440 - DNA, 16 bp, Artificial Sequence
  synthetic [barcode part1]
tcctcagttaagaggc

SEQ ID NO: 13441 - DNA, 16 bp, Artificial Sequence
  synthetic [barcode part1]
attctgtgcgaggtac

SEQ ID NO: 13442 - DNA, 16 bp, Artificial Sequence
  synthetic [barcode part1]
tgccgaggtctctatc

SEQ ID NO: 13443 - DNA, 16 bp, Artificial Sequence
  synthetic [barcode part1]
tcgcgaatatcggtgt

SEQ ID NO: 13444 - DNA, 16 bp, Artificial Sequence
  synthetic [barcode part1]
aggtctggcgattgtt

SEQ ID NO: 13445 - DNA, 16 bp, Artificial Sequence
  synthetic [barcode part1]
cgtaggtattccgcct

SEQ ID NO: 13446 - DNA, 16 bp, Artificial Sequence
  synthetic [barcode part1]
ataattgacgcgccac

SEQ ID NO: 13447 - DNA, 16 bp, Artificial Sequence
  synthetic [barcode part1]
cgtaacgattcgtctt

SEQ ID NO: 13448 - DNA, 16 bp, Artificial Sequence
  synthetic [barcode part1]
aggtggattacctacc

SEQ ID NO: 13449 - DNA, 16 bp, Artificial Sequence
  synthetic [barcode part1]
taccgaagtgaggacc

SEQ ID NO: 13450 - DNA, 16 bp, Artificial Sequence
  synthetic [barcode part1]
cctctctgtcgattgt

SEQ ID NO: 13451 - DNA, 16 bp, Artificial Sequence
  synthetic [barcode part1]
tgtaggcacctcgtct

SEQ ID NO: 13452 - DNA, 16 bp, Artificial Sequence
  synthetic [barcode part1]
ccgtataacgtcaacg

SEQ ID NO: 13453 - DNA, 16 bp, Artificial Sequence
  synthetic [barcode part1]
accgaagaactctctg

SEQ ID NO: 13454 - DNA, 16 bp, Artificial Sequence
  synthetic [barcode part1]
gcactaggtgtgactt

SEQ ID NO: 13455 - DNA, 16 bp, Artificial Sequence
  synthetic [barcode part1]
agatatccagaacggt

SEQ ID NO: 13456 - DNA, 16 bp, Artificial Sequence
  synthetic [barcode part1]
aacactcactccttag

SEQ ID NO: 13457 - DNA, 16 bp, Artificial Sequence
  synthetic [barcode part1]
acctgtattaggcgtg

SEQ ID NO: 13458 - DNA, 16 bp, Artificial Sequence
  synthetic [barcode part1]
tctggatcaccgatag

SEQ ID NO: 13459 - DNA, 16 bp, Artificial Sequence
  synthetic [barcode part1]
gccagattcaccaagt

SEQ ID NO: 13460 - DNA, 16 bp, Artificial Sequence
  synthetic [barcode part1]
taactcctcaggaggt

SEQ ID NO: 13461 - DNA, 16 bp, Artificial Sequence
  synthetic [barcode part1]
agaacagtaggacggt

SEQ ID NO: 13462 - DNA, 16 bp, Artificial Sequence
  synthetic [barcode part1]
tacgtccgtgacctac

SEQ ID NO: 13463 - DNA, 16 bp, Artificial Sequence
  synthetic [barcode part1]
aacggtggacgtctag

SEQ ID NO: 13464 - DNA, 16 bp, Artificial Sequence
  synthetic [barcode part1]
tacgtcagtcagtgtg

SEQ ID NO: 13465 - DNA, 16 bp, Artificial Sequence
  synthetic [barcode part1]
tatacgaccaccgcct

SEQ ID NO: 13466 - DNA, 16 bp, Artificial Sequence
  synthetic [barcode part1]
caatcggaggagaagt

SEQ ID NO: 13467 - DNA, 16 bp, Artificial Sequence
  synthetic [barcode part1]
tgtgtctatccagtgt

SEQ ID NO: 13468 - DNA, 16 bp, Artificial Sequence
  synthetic [barcode part1]
cacaatcacgcctaag

SEQ ID NO: 13469 - DNA, 16 bp, Artificial Sequence
  synthetic [barcode part1]
gactctacctgcctag

SEQ ID NO: 13470 - DNA, 16 bp, Artificial Sequence
  synthetic [barcode part1]
gttgtggcgagtaggt

SEQ ID NO: 13471 - DNA, 16 bp, Artificial Sequence
  synthetic [barcode part1]
acgtgatcttcagttc

SEQ ID NO: 13472 - DNA, 16 bp, Artificial Sequence
  synthetic [barcode part1]
caggagatccttcaac

SEQ ID NO: 13473 - DNA, 16 bp, Artificial Sequence
  synthetic [barcode part1]
gaggagttgccttatc

SEQ ID NO: 13474 - DNA, 16 bp, Artificial Sequence
  synthetic [barcode part1]
caccaggtgaaggtac

SEQ ID NO: 13475 - DNA, 16 bp, Artificial Sequence
  synthetic [barcode part1]
attgcacacgcagttg

SEQ ID NO: 13476 - DNA, 16 bp, Artificial Sequence
  synthetic [barcode part1]
taggtcacgcgtcttc

SEQ ID NO: 13477 - DNA, 16 bp, Artificial Sequence
  synthetic [barcode part1]
agtatcctgtcttgtg

SEQ ID NO: 13478 - DNA, 16 bp, Artificial Sequence
  synthetic [barcode part1]
ttctcggtgcgtaacc

SEQ ID NO: 13479 - DNA, 16 bp, Artificial Sequence
  synthetic [barcode part1]
accaggaccttagttg

SEQ ID NO: 13480 - DNA, 16 bp, Artificial Sequence
  synthetic [barcode part1]
acacctaggacaatag

SEQ ID NO: 13481 - DNA, 16 bp, Artificial Sequence
  synthetic [barcode part1]
tgcagatagattcgcc

SEQ ID NO: 13482 - DNA, 16 bp, Artificial Sequence
  synthetic [barcode part1]
ttaggtccggtaatcg

SEQ ID NO: 13483 - DNA, 16 bp, Artificial Sequence
  synthetic [barcode part1]
tcttccttacaacgcc

SEQ ID NO: 13484 - DNA, 16 bp, Artificial Sequence
  synthetic [barcode part1]
actcactgcagacagt

SEQ ID NO: 13485 - DNA, 16 bp, Artificial Sequence
  synthetic [barcode part1]
gtaggtcgccactctt

SEQ ID NO: 13486 - DNA, 16 bp, Artificial Sequence
  synthetic [barcode part1]
gtgacacactgactgt

SEQ ID NO: 13487 - DNA, 16 bp, Artificial Sequence
  synthetic [barcode part1]
cggtatagatcgtacc

SEQ ID NO: 13488 - DNA, 16 bp, Artificial Sequence
  synthetic [barcode part1]
aaggttactaagtgcg

SEQ ID NO: 13489 - DNA, 16 bp, Artificial Sequence
  synthetic [barcode part1]
taaccaggaccaatcc

SEQ ID NO: 13490 - DNA, 16 bp, Artificial Sequence
  synthetic [barcode part1]
cacgcgataccaatac

SEQ ID NO: 13491 - DNA, 16 bp, Artificial Sequence
  synthetic [barcode part1]
ccagtctgttcggatc

SEQ ID NO: 13492 - DNA, 16 bp, Artificial Sequence
  synthetic [barcode part1]
tactccgacttgcgac

SEQ ID NO: 13493 - DNA, 16 bp, Artificial Sequence
  synthetic [barcode part1]
ccaaggcctgtctatc

SEQ ID NO: 13494 - DNA, 16 bp, Artificial Sequence
  synthetic [barcode part1]
aactccactgtccgtg

SEQ ID NO: 13495 - DNA, 16 bp, Artificial Sequence
  synthetic [barcode part1]
aactgtccgttagacg

SEQ ID NO: 13496 - DNA, 16 bp, Artificial Sequence
  synthetic [barcode part1]
cagtgtacgacgagac

SEQ ID NO: 13497 - DNA, 16 bp, Artificial Sequence
  synthetic [barcode part1]
ccaacttaggtactct

SEQ ID NO: 13498 - DNA, 16 bp, Artificial Sequence
  synthetic [barcode part1]
gtgtctacgtcgttcg

SEQ ID NO: 13499 - DNA, 16 bp, Artificial Sequence
  synthetic [barcode part1]
actacggtccactcgt

SEQ ID NO: 13500 - DNA, 16 bp, Artificial Sequence
  synthetic [barcode part1]
ttcgcgtgacctagtc

SEQ ID NO: 13501 - DNA, 16 bp, Artificial Sequence
  synthetic [barcode part1]
gaggacttgtgtggtg

SEQ ID NO: 13502 - DNA, 16 bp, Artificial Sequence
  synthetic [barcode part1]
accaactgaagtctcg

SEQ ID NO: 13503 - DNA, 16 bp, Artificial Sequence
  synthetic [barcode part1]
aattcaggccggactt

SEQ ID NO: 13504 - DNA, 16 bp, Artificial Sequence
  synthetic [barcode part1]
ttcttgagttacacgc

SEQ ID NO: 13505 - DNA, 16 bp, Artificial Sequence
  synthetic [barcode part1]
cctctacgacgatctg

SEQ ID NO: 13506 - DNA, 16 bp, Artificial Sequence
  synthetic [barcode part1]
ttcgcaatctatcacg

SEQ ID NO: 13507 - DNA, 16 bp, Artificial Sequence
  synthetic [barcode part1]
acttggaagacggtgc

SEQ ID NO: 13508 - DNA, 16 bp, Artificial Sequence
  synthetic [barcode part1]
gcctgccttgtgatac

SEQ ID NO: 13509 - DNA, 16 bp, Artificial Sequence
  synthetic [barcode part1]
aaggatactactggac

SEQ ID NO: 13510 - DNA, 16 bp, Artificial Sequence
  synthetic [barcode part1]
cactaactcctccgag

SEQ ID NO: 13511 - DNA, 16 bp, Artificial Sequence
  synthetic [barcode part1]
tcttgacgtactcagt

SEQ ID NO: 13512 - DNA, 16 bp, Artificial Sequence
  synthetic [barcode part1]
aatatacgtgccggtc

SEQ ID NO: 13513 - DNA, 16 bp, Artificial Sequence
  synthetic [barcode part1]
ccacaatattgtggcg

SEQ ID NO: 13514 - DNA, 16 bp, Artificial Sequence
  synthetic [barcode part1]
atatcaacggtggaac

SEQ ID NO: 13515 - DNA, 16 bp, Artificial Sequence
  synthetic [barcode part1]
agaatcacgacctctg

SEQ ID NO: 13516 - DNA, 16 bp, Artificial Sequence
  synthetic [barcode part1]
caattctctccggttc

SEQ ID NO: 13517 - DNA, 16 bp, Artificial Sequence
  synthetic [barcode part1]
gtgagtcaacctgtgt

SEQ ID NO: 13518 - DNA, 16 bp, Artificial Sequence
  synthetic [barcode part1]
aagagtagacgcgaac

SEQ ID NO: 13519 - DNA, 16 bp, Artificial Sequence
  synthetic [barcode part1]
tcaagtgtcgcgaatc

SEQ ID NO: 13520 - DNA, 16 bp, Artificial Sequence
  synthetic [barcode part1]
taggtggtgtcgtgag

SEQ ID NO: 13521 - DNA, 16 bp, Artificial Sequence
  synthetic [barcode part1]
aacaagaacgtagtcc

SEQ ID NO: 13522 - DNA, 16 bp, Artificial Sequence
  synthetic [barcode part1]
tcttggcgtatccgac

SEQ ID NO: 13523 - DNA, 16 bp, Artificial Sequence
  synthetic [barcode part1]
ttgtcaggttggactg

SEQ ID NO: 13524 - DNA, 16 bp, Artificial Sequence
  synthetic [barcode part1]
aaccgcgtcttaattc

SEQ ID NO: 13525 - DNA, 16 bp, Artificial Sequence
  synthetic [barcode part1]
tattgagagaccgcct

SEQ ID NO: 13526 - DNA, 16 bp, Artificial Sequence
  synthetic [barcode part1]
gtccaccacttgttct

SEQ ID NO: 13527 - DNA, 16 bp, Artificial Sequence
  synthetic [barcode part1]
tgcctctaaggtacag

SEQ ID NO: 13528 - DNA, 16 bp, Artificial Sequence
  synthetic [barcode part1]
tctaatacgtcggacg

SEQ ID NO: 13529 - DNA, 16 bp, Artificial Sequence
  synthetic [barcode part1]
tggagtggagtatccg

SEQ ID NO: 13530 - DNA, 16 bp, Artificial Sequence
  synthetic [barcode part1]
actcggagtaagtcct

SEQ ID NO: 13531 - DNA, 16 bp, Artificial Sequence
  synthetic [barcode part1]
aatccagtgcgtctcc

SEQ ID NO: 13532 - DNA, 16 bp, Artificial Sequence
  synthetic [barcode part1]
tcttgagtactcgccg

SEQ ID NO: 13533 - DNA, 16 bp, Artificial Sequence
  synthetic [barcode part1]
acgtgtatcggagttc

SEQ ID NO: 13534 - DNA, 16 bp, Artificial Sequence
  synthetic [barcode part1]
caggattgaccagttc

SEQ ID NO: 13535 - DNA, 16 bp, Artificial Sequence
  synthetic [barcode part1]
gtctattcaggacttc

SEQ ID NO: 13536 - DNA, 16 bp, Artificial Sequence
  synthetic [barcode part1]
acgaataccacaacag

SEQ ID NO: 13537 - DNA, 16 bp, Artificial Sequence
  synthetic [barcode part1]
gagagtactgttgagt

SEQ ID NO: 13538 - DNA, 16 bp, Artificial Sequence
  synthetic [barcode part1]
atccggactgtagact

SEQ ID NO: 13539 - DNA, 16 bp, Artificial Sequence
  synthetic [barcode part1]
agttagacgccggtag

SEQ ID NO: 13540 - DNA, 16 bp, Artificial Sequence
  synthetic [barcode part1]
ccacgtctgttaagtt

SEQ ID NO: 13541 - DNA, 16 bp, Artificial Sequence
  synthetic [barcode part1]
acctactgacactact

SEQ ID NO: 13542 - DNA, 16 bp, Artificial Sequence
  synthetic [barcode part1]
gcagagattgaaccgc

SEQ ID NO: 13543 - DNA, 16 bp, Artificial Sequence
  synthetic [barcode part1]
tcctctcttccaaggt

SEQ ID NO: 13544 - DNA, 16 bp, Artificial Sequence
  synthetic [barcode part1]
cacacaatccacagac

SEQ ID NO: 13545 - DNA, 16 bp, Artificial Sequence
  synthetic [barcode part1]
cacgtctactcggtac

SEQ ID NO: 13546 - DNA, 16 bp, Artificial Sequence
  synthetic [barcode part1]
aggaacgtaggtcacc

SEQ ID NO: 13547 - DNA, 16 bp, Artificial Sequence
  synthetic [barcode part1]
tgcgaactactacctt

SEQ ID NO: 13548 - DNA, 16 bp, Artificial Sequence
  synthetic [barcode part1]
tctctaacttctcggc

SEQ ID NO: 13549 - DNA, 16 bp, Artificial Sequence
  synthetic [barcode part1]
ttattcgccgcctatc

SEQ ID NO: 13550 - DNA, 16 bp, Artificial Sequence
  synthetic [barcode part1]
gtctggaacttcactt

SEQ ID NO: 13551 - DNA, 16 bp, Artificial Sequence
  synthetic [barcode part1]
tagttcgtcgttggag

SEQ ID NO: 13552 - DNA, 16 bp, Artificial Sequence
  synthetic [barcode part1]
ttctctccgtggtatc

SEQ ID NO: 13553 - DNA, 16 bp, Artificial Sequence
  synthetic [barcode part1]
aatcgcgccaaggagt

SEQ ID NO: 13554 - DNA, 16 bp, Artificial Sequence
  synthetic [barcode part1]
aattacttgccaggcg

SEQ ID NO: 13555 - DNA, 16 bp, Artificial Sequence
  synthetic [barcode part1]
gatcaacggccaattc

SEQ ID NO: 13556 - DNA, 16 bp, Artificial Sequence
  synthetic [barcode part1]
ttcgtaggacactcag

SEQ ID NO: 13557 - DNA, 16 bp, Artificial Sequence
  synthetic [barcode part1]
tccttctcaacgttgc

SEQ ID NO: 13558 - DNA, 16 bp, Artificial Sequence
  synthetic [barcode part1]
ccagagagttaccttg

SEQ ID NO: 13559 - DNA, 16 bp, Artificial Sequence
  synthetic [barcode part1]
atcctcgattctcacc

SEQ ID NO: 13560 - DNA, 16 bp, Artificial Sequence
  synthetic [barcode part1]
tgtacgtccggaattg

SEQ ID NO: 13561 - DNA, 16 bp, Artificial Sequence
  synthetic [barcode part1]
tgtcaccttgttgtcc

SEQ ID NO: 13562 - DNA, 16 bp, Artificial Sequence
  synthetic [barcode part1]
gccgttgcgataattg

SEQ ID NO: 13563 - DNA, 16 bp, Artificial Sequence
  synthetic [barcode part1]
tgcgtccgagttacct

SEQ ID NO: 13564 - DNA, 16 bp, Artificial Sequence
  synthetic [barcode part1]
cgagagataaccacgc

SEQ ID NO: 13565 - DNA, 16 bp, Artificial Sequence
  synthetic [barcode part1]
cagagttattgaccgc

SEQ ID NO: 13566 - DNA, 16 bp, Artificial Sequence
  synthetic [barcode part1]
ttggtggacctctatt

SEQ ID NO: 13567 - DNA, 16 bp, Artificial Sequence
  synthetic [barcode part1]
tggactgtcaggttgt

SEQ ID NO: 13568 - DNA, 16 bp, Artificial Sequence
  synthetic [barcode part1]
ccaggattgagtaagt

SEQ ID NO: 13569 - DNA, 16 bp, Artificial Sequence
  synthetic [barcode part1]
tggtcaggatctcagt

SEQ ID NO: 13570 - DNA, 16 bp, Artificial Sequence
  synthetic [barcode part1]
attaccgtggcaactg

SEQ ID NO: 13571 - DNA, 16 bp, Artificial Sequence
  synthetic [barcode part1]
ttgttgttccgagtac

SEQ ID NO: 13572 - DNA, 16 bp, Artificial Sequence
  synthetic [barcode part1]
tgcgcaattaccactt

SEQ ID NO: 13573 - DNA, 16 bp, Artificial Sequence
  synthetic [barcode part1]
cgaatcgaagaacact

SEQ ID NO: 13574 - DNA, 16 bp, Artificial Sequence
  synthetic [barcode part1]
tctcagtggttgtgtt

SEQ ID NO: 13575 - DNA, 16 bp, Artificial Sequence
  synthetic [barcode part1]
ccgattagttgaccag

SEQ ID NO: 13576 - DNA, 16 bp, Artificial Sequence
  synthetic [barcode part1]
ccgaattcagtctgag

SEQ ID NO: 13577 - DNA, 16 bp, Artificial Sequence
  synthetic [barcode part1]
gtctactgcctgtctt

SEQ ID NO: 13578 - DNA, 16 bp, Artificial Sequence
  synthetic [barcode part1]
gtgcgtcctattgtcg

SEQ ID NO: 13579 - DNA, 16 bp, Artificial Sequence
  synthetic [barcode part1]
tggcgatcgtaggagt

SEQ ID NO: 13580 - DNA, 16 bp, Artificial Sequence
  synthetic [barcode part1]
gtatcaccgagacttg

SEQ ID NO: 13581 - DNA, 16 bp, Artificial Sequence
  synthetic [barcode part1]
gaacgaggtctcagac

SEQ ID NO: 13582 - DNA, 16 bp, Artificial Sequence
  synthetic [barcode part1]
gcaagtggcaacgttg

SEQ ID NO: 13583 - DNA, 16 bp, Artificial Sequence
  synthetic [barcode part1]
tacttacggataggcc

SEQ ID NO: 13584 - DNA, 16 bp, Artificial Sequence
  synthetic [barcode part1]
aactgcagttgcacac

SEQ ID NO: 13585 - DNA, 16 bp, Artificial Sequence
  synthetic [barcode part1]
atcaagagtaccagtg

SEQ ID NO: 13586 - DNA, 16 bp, Artificial Sequence
  synthetic [barcode part1]
ttggcgagtctagtgt

SEQ ID NO: 13587 - DNA, 16 bp, Artificial Sequence
  synthetic [barcode part1]
ccttagatcgtgacag

SEQ ID NO: 13588 - DNA, 16 bp, Artificial Sequence
  synthetic [barcode part1]
aattggcagagtctcc

SEQ ID NO: 13589 - DNA, 16 bp, Artificial Sequence
  synthetic [barcode part1]
tgttgtctcaccacct

SEQ ID NO: 13590 - DNA, 16 bp, Artificial Sequence
  synthetic [barcode part1]
gtacggattcgataag

SEQ ID NO: 13591 - DNA, 16 bp, Artificial Sequence
  synthetic [barcode part1]
tctattcgacaccgcg

SEQ ID NO: 13592 - DNA, 16 bp, Artificial Sequence
  synthetic [barcode part1]
gccgcgagatattact

SEQ ID NO: 13593 - DNA, 16 bp, Artificial Sequence
  synthetic [barcode part1]
tcgccttgaagtaacg

SEQ ID NO: 13594 - DNA, 16 bp, Artificial Sequence
  synthetic [barcode part1]
tccgactgttgcacac

SEQ ID NO: 13595 - DNA, 16 bp, Artificial Sequence
  synthetic [barcode part1]
gcgtcttcagtggttc

SEQ ID NO: 13596 - DNA, 16 bp, Artificial Sequence
  synthetic [barcode part1]
atctcagtggtcagtg

SEQ ID NO: 13597 - DNA, 16 bp, Artificial Sequence
  synthetic [barcode part1]
tcaaggccactcgtct

SEQ ID NO: 13598 - DNA, 16 bp, Artificial Sequence
  synthetic [barcode part1]
gagattctactgcgac

SEQ ID NO: 13599 - DNA, 16 bp, Artificial Sequence
  synthetic [barcode part1]
tgcacgcaactgattg

SEQ ID NO: 13600 - DNA, 16 bp, Artificial Sequence
  synthetic [barcode part1]
gtctaggtggatacct

SEQ ID NO: 13601 - DNA, 16 bp, Artificial Sequence
  synthetic [barcode part1]
gatctggatcaggtct

SEQ ID NO: 13602 - DNA, 16 bp, Artificial Sequence
  synthetic [barcode part1]
cggtcaataacaccgt

SEQ ID NO: 13603 - DNA, 16 bp, Artificial Sequence
  synthetic [barcode part1]
gacctctctaagtgcc

SEQ ID NO: 13604 - DNA, 16 bp, Artificial Sequence
  synthetic [barcode part1]
gtagtaccgtaacgtc

SEQ ID NO: 13605 - DNA, 16 bp, Artificial Sequence
  synthetic [barcode part1]
cggattgtcggtgatt

SEQ ID NO: 13606 - DNA, 16 bp, Artificial Sequence
  synthetic [barcode part1]
tcagtgagaacgtggc

SEQ ID NO: 13607 - DNA, 16 bp, Artificial Sequence
  synthetic [barcode part1]
tgacgtaagaacgatc

SEQ ID NO: 13608 - DNA, 16 bp, Artificial Sequence
  synthetic [barcode part1]
cctgcagatcctatcg

SEQ ID NO: 13609 - DNA, 16 bp, Artificial Sequence
  synthetic [barcode part1]
agtctggtcggtgatt

SEQ ID NO: 13610 - DNA, 16 bp, Artificial Sequence
  synthetic [barcode part1]
cggcgtacaacagaac

SEQ ID NO: 13611 - DNA, 16 bp, Artificial Sequence
  synthetic [barcode part1]
tcgtgcgtcctgattg

SEQ ID NO: 13612 - DNA, 16 bp, Artificial Sequence
  synthetic [barcode part1]
agactcagtctgagtc

SEQ ID NO: 13613 - DNA, 16 bp, Artificial Sequence
  synthetic [barcode part1]
gcggaataagtccacg

SEQ ID NO: 13614 - DNA, 16 bp, Artificial Sequence
  synthetic [barcode part1]
tatacctggtgatctc

SEQ ID NO: 13615 - DNA, 16 bp, Artificial Sequence
  synthetic [barcode part1]
cacctcgtactcaggt

SEQ ID NO: 13616 - DNA, 16 bp, Artificial Sequence
  synthetic [barcode part1]
tacgcaagtccaagtc

SEQ ID NO: 13617 - DNA, 16 bp, Artificial Sequence
  synthetic [barcode part1]
tgtagtgcaccacaac

SEQ ID NO: 13618 - DNA, 16 bp, Artificial Sequence
  synthetic [barcode part1]
ttgtggtcagtcagtg

SEQ ID NO: 13619 - DNA, 16 bp, Artificial Sequence
  synthetic [barcode part1]
aggcaacggttcacag

SEQ ID NO: 13620 - DNA, 16 bp, Artificial Sequence
  synthetic [barcode part1]
tccagaacgatcgatc

SEQ ID NO: 13621 - DNA, 16 bp, Artificial Sequence
  synthetic [barcode part1]
acggaccaacttgtac

SEQ ID NO: 13622 - DNA, 16 bp, Artificial Sequence
  synthetic [barcode part1]
gattgaaggcacgtcg

SEQ ID NO: 13623 - DNA, 16 bp, Artificial Sequence
  synthetic [barcode part1]
aattgcctactaggcg

SEQ ID NO: 13624 - DNA, 16 bp, Artificial Sequence
  synthetic [barcode part1]
ttcgccaactaggaac

SEQ ID NO: 13625 - DNA, 16 bp, Artificial Sequence
  synthetic [barcode part1]
cgacaagattcacaag

SEQ ID NO: 13626 - DNA, 16 bp, Artificial Sequence
  synthetic [barcode part1]
tactggtgactctccg

SEQ ID NO: 13627 - DNA, 16 bp, Artificial Sequence
  synthetic [barcode part1]
cgcaatacaaggttcc

SEQ ID NO: 13628 - DNA, 16 bp, Artificial Sequence
  synthetic [barcode part1]
gaccgaatcgcacaag

SEQ ID NO: 13629 - DNA, 16 bp, Artificial Sequence
  synthetic [barcode part1]
gatccaagaggcacac

SEQ ID NO: 13630 - DNA, 16 bp, Artificial Sequence
  synthetic [barcode part1]
aacaaccggcctaatc

SEQ ID NO: 13631 - DNA, 16 bp, Artificial Sequence
  synthetic [barcode part1]
gcgtctccgacaactt

SEQ ID NO: 13632 - DNA, 16 bp, Artificial Sequence
  synthetic [barcode part1]
gcactggatcaaggac

SEQ ID NO: 13633 - DNA, 16 bp, Artificial Sequence
  synthetic [barcode part1]
aactccagtggtgttg

SEQ ID NO: 13634 - DNA, 16 bp, Artificial Sequence
  synthetic [barcode part1]
tcgacagaacgactct

SEQ ID NO: 13635 - DNA, 16 bp, Artificial Sequence
  synthetic [barcode part1]
agtggagaacctatac

SEQ ID NO: 13636 - DNA, 16 bp, Artificial Sequence
  synthetic [barcode part1]
acgacacacactacgt

SEQ ID NO: 13637 - DNA, 16 bp, Artificial Sequence
  synthetic [barcode part1]
agagtcgaggataacg

SEQ ID NO: 13638 - DNA, 16 bp, Artificial Sequence
  synthetic [barcode part1]
gaggtacacacagaag

SEQ ID NO: 13639 - DNA, 16 bp, Artificial Sequence
  synthetic [barcode part1]
tgacttcgcgtcggtt

SEQ ID NO: 13640 - DNA, 16 bp, Artificial Sequence
  synthetic [barcode part1]
ccacttcttgaatacg

SEQ ID NO: 13641 - DNA, 16 bp, Artificial Sequence
  synthetic [barcode part1]
gaatccggagtacctt

SEQ ID NO: 13642 - DNA, 16 bp, Artificial Sequence
  synthetic [barcode part1]
tcaggatcacctattc

SEQ ID NO: 13643 - DNA, 16 bp, Artificial Sequence
  synthetic [barcode part1]
tgtgttgaccaacgtg

SEQ ID NO: 13644 - DNA, 16 bp, Artificial Sequence
  synthetic [barcode part1]
tgactacttcgacttg

SEQ ID NO: 13645 - DNA, 16 bp, Artificial Sequence
  synthetic [barcode part1]
tccgcgcagaatatac

SEQ ID NO: 13646 - DNA, 16 bp, Artificial Sequence
  synthetic [barcode part1]
ttcttactgagtcgtg

SEQ ID NO: 13647 - DNA, 16 bp, Artificial Sequence
  synthetic [barcode part1]
cgccttagagttcgtc

SEQ ID NO: 13648 - DNA, 16 bp, Artificial Sequence
  synthetic [barcode part1]
tagtacgtacgagtcc

SEQ ID NO: 13649 - DNA, 16 bp, Artificial Sequence
  synthetic [barcode part1]
ttccggttcaagtatc

SEQ ID NO: 13650 - DNA, 16 bp, Artificial Sequence
  synthetic [barcode part1]
tgaatatcgcgagtcc

SEQ ID NO: 13651 - DNA, 16 bp, Artificial Sequence
  synthetic [barcode part1]
gaagtcgaaggatcag

SEQ ID NO: 13652 - DNA, 16 bp, Artificial Sequence
  synthetic [barcode part1]
cgacacgcaattctcc

SEQ ID NO: 13653 - DNA, 16 bp, Artificial Sequence
  synthetic [barcode part1]
ccgtatccaagttatc

SEQ ID NO: 13654 - DNA, 16 bp, Artificial Sequence
  synthetic [barcode part1]
taacgtcggtatcgtg

SEQ ID NO: 13655 - DNA, 16 bp, Artificial Sequence
  synthetic [barcode part1]
tcagactctccacacg

SEQ ID NO: 13656 - DNA, 16 bp, Artificial Sequence
  synthetic [barcode part1]
acggaggcgattcagt

SEQ ID NO: 13657 - DNA, 16 bp, Artificial Sequence
  synthetic [barcode part1]
atctgccacttgttcc

SEQ ID NO: 13658 - DNA, 16 bp, Artificial Sequence
  synthetic [barcode part1]
tgttctggtggcaagt

SEQ ID NO: 13659 - DNA, 16 bp, Artificial Sequence
  synthetic [barcode part1]
aagttgagtgccgacg

SEQ ID NO: 13660 - DNA, 16 bp, Artificial Sequence
  synthetic [barcode part1]
gatcggtgtcgattgt

SEQ ID NO: 13661 - DNA, 16 bp, Artificial Sequence
  synthetic [barcode part1]
gattataccggaagac

SEQ ID NO: 13662 - DNA, 16 bp, Artificial Sequence
  synthetic [barcode part1]
aggtcagagaaggttg

SEQ ID NO: 13663 - DNA, 16 bp, Artificial Sequence
  synthetic [barcode part1]
acttcgcagacgttcc

SEQ ID NO: 13664 - DNA, 16 bp, Artificial Sequence
  synthetic [barcode part1]
agagtaggccttgtct

SEQ ID NO: 13665 - DNA, 16 bp, Artificial Sequence
  synthetic [barcode part1]
tgtgcagacctgagtt

SEQ ID NO: 13666 - DNA, 16 bp, Artificial Sequence
  synthetic [barcode part1]
aggaagtgcgaccact

SEQ ID NO: 13667 - DNA, 16 bp, Artificial Sequence
  synthetic [barcode part1]
taactcgccacgtctg

SEQ ID NO: 13668 - DNA, 16 bp, Artificial Sequence
  synthetic [barcode part1]
attaactcgtgcgcag

SEQ ID NO: 13669 - DNA, 16 bp, Artificial Sequence
  synthetic [barcode part1]
gcaaccacaacgtact

SEQ ID NO: 13670 - DNA, 16 bp, Artificial Sequence
  synthetic [barcode part1]
gtctggcaatctaacg

SEQ ID NO: 13671 - DNA, 16 bp, Artificial Sequence
  synthetic [barcode part1]
gtcgcggttacttatt

SEQ ID NO: 13672 - DNA, 16 bp, Artificial Sequence
  synthetic [barcode part1]
atcgtaatcgtggcgt

SEQ ID NO: 13673 - DNA, 16 bp, Artificial Sequence
  synthetic [barcode part1]
gagacagtctactacc

SEQ ID NO: 13674 - DNA, 16 bp, Artificial Sequence
  synthetic [barcode part1]
ttagagagattcgcag

SEQ ID NO: 13675 - DNA, 16 bp, Artificial Sequence
  synthetic [barcode part1]
tgcgcactgtaatacg

SEQ ID NO: 13676 - DNA, 16 bp, Artificial Sequence
  synthetic [barcode part1]
ttggatctgcactccg

SEQ ID NO: 13677 - DNA, 16 bp, Artificial Sequence
  synthetic [barcode part1]
aggtcgatcttccaag

SEQ ID NO: 13678 - DNA, 16 bp, Artificial Sequence
  synthetic [barcode part1]
ttcaatcgtcggcacc

SEQ ID NO: 13679 - DNA, 16 bp, Artificial Sequence
  synthetic [barcode part1]
attcacgactaggaag

SEQ ID NO: 13680 - DNA, 16 bp, Artificial Sequence
  synthetic [barcode part1]
taactggaactctggc

SEQ ID NO: 13681 - DNA, 16 bp, Artificial Sequence
  synthetic [barcode part1]
gtagtgtacaccgtac

SEQ ID NO: 13682 - DNA, 16 bp, Artificial Sequence
  synthetic [barcode part1]
tgaggactacctctag

SEQ ID NO: 13683 - DNA, 16 bp, Artificial Sequence
  synthetic [barcode part1]
ccaacgattaccaggt

SEQ ID NO: 13684 - DNA, 16 bp, Artificial Sequence
  synthetic [barcode part1]
taattcctggcgtatc

SEQ ID NO: 13685 - DNA, 16 bp, Artificial Sequence
  synthetic [barcode part1]
tcgagttcggtagttg

SEQ ID NO: 13686 - DNA, 16 bp, Artificial Sequence
  synthetic [barcode part1]
agaggtgcgttcttac

SEQ ID NO: 13687 - DNA, 16 bp, Artificial Sequence
  synthetic [barcode part1]
acacacaacgtgtacc

SEQ ID NO: 13688 - DNA, 16 bp, Artificial Sequence
  synthetic [barcode part1]
tgtcttaattcacggc

SEQ ID NO: 13689 - DNA, 16 bp, Artificial Sequence
  synthetic [barcode part1]
ttccgattgcagatct

SEQ ID NO: 13690 - DNA, 16 bp, Artificial Sequence
  synthetic [barcode part1]
tctagacacagtcgtg

SEQ ID NO: 13691 - DNA, 16 bp, Artificial Sequence
  synthetic [barcode part1]
tggatacgaagtaacc

SEQ ID NO: 13692 - DNA, 16 bp, Artificial Sequence
  synthetic [barcode part1]
agacgactctctagtg

SEQ ID NO: 13693 - DNA, 16 bp, Artificial Sequence
  synthetic [barcode part1]
gaactcgttgtcactt

SEQ ID NO: 13694 - DNA, 16 bp, Artificial Sequence
  synthetic [barcode part1]
aagtaggtccgttcgt

SEQ ID NO: 13695 - DNA, 16 bp, Artificial Sequence
  synthetic [barcode part1]
tccacacttggaccac

SEQ ID NO: 13696 - DNA, 16 bp, Artificial Sequence
  synthetic [barcode part1]
gcaagttgcacaactc

SEQ ID NO: 13697 - DNA, 16 bp, Artificial Sequence
  synthetic [barcode part1]
ccactctcttcactag

SEQ ID NO: 13698 - DNA, 16 bp, Artificial Sequence
  synthetic [barcode part1]
taattccgcaccgacc

SEQ ID NO: 13699 - DNA, 16 bp, Artificial Sequence
  synthetic [barcode part1]
aactcttcctctggtc

SEQ ID NO: 13700 - DNA, 16 bp, Artificial Sequence
  synthetic [barcode part1]
tggaacgtgccagtag

SEQ ID NO: 13701 - DNA, 16 bp, Artificial Sequence
  synthetic [barcode part1]
gataccgaggatctct

SEQ ID NO: 13702 - DNA, 16 bp, Artificial Sequence
  synthetic [barcode part1]
cggattgtggcaatct

SEQ ID NO: 13703 - DNA, 16 bp, Artificial Sequence
  synthetic [barcode part1]
atacttaccacggacg

SEQ ID NO: 13704 - DNA, 16 bp, Artificial Sequence
  synthetic [barcode part1]
ccaataacagaggtgt

SEQ ID NO: 13705 - DNA, 16 bp, Artificial Sequence
  synthetic [barcode part1]
aataccgcgactagtc

SEQ ID NO: 13706 - DNA, 16 bp, Artificial Sequence
  synthetic [barcode part1]
gtctcactaccttgtc

SEQ ID NO: 13707 - DNA, 16 bp, Artificial Sequence
  synthetic [barcode part1]
tggaacgagacgtctg

SEQ ID NO: 13708 - DNA, 16 bp, Artificial Sequence
  synthetic [barcode part1]
agtcgatcgtagtgtc

SEQ ID NO: 13709 - DNA, 16 bp, Artificial Sequence
  synthetic [barcode part1]
tgacagtacgtcctcc

SEQ ID NO: 13710 - DNA, 16 bp, Artificial Sequence
  synthetic [barcode part1]
gcctctggtctagtgt

SEQ ID NO: 13711 - DNA, 16 bp, Artificial Sequence
  synthetic [barcode part1]
tatacgacgtcgacgt

SEQ ID NO: 13712 - DNA, 16 bp, Artificial Sequence
  synthetic [barcode part1]
gactgtggtacgttgt

SEQ ID NO: 13713 - DNA, 16 bp, Artificial Sequence
  synthetic [barcode part1]
gacgccgcagttaatt

SEQ ID NO: 13714 - DNA, 16 bp, Artificial Sequence
  synthetic [barcode part1]
tgacgactgtattcct

SEQ ID NO: 13715 - DNA, 16 bp, Artificial Sequence
  synthetic [barcode part1]
gtattggttggacgtc

SEQ ID NO: 13716 - DNA, 16 bp, Artificial Sequence
  synthetic [barcode part1]
gtcgtgattcaggact

SEQ ID NO: 13717 - DNA, 16 bp, Artificial Sequence
  synthetic [barcode part1]
gcctcgatatacacag

SEQ ID NO: 13718 - DNA, 16 bp, Artificial Sequence
  synthetic [barcode part1]
tactgtcggtggtagt

SEQ ID NO: 13719 - DNA, 16 bp, Artificial Sequence
  synthetic [barcode part1]
gtagaagaaggcacgt

SEQ ID NO: 13720 - DNA, 16 bp, Artificial Sequence
  synthetic [barcode part1]
cgttgaataaggacac

SEQ ID NO: 13721 - DNA, 16 bp, Artificial Sequence
  synthetic [barcode part1]
tctctccagaactcct

SEQ ID NO: 13722 - DNA, 16 bp, Artificial Sequence
  synthetic [barcode part1]
ttcctagaccagtgtt

SEQ ID NO: 13723 - DNA, 16 bp, Artificial Sequence
  synthetic [barcode part1]
ttgcagatctacggac

SEQ ID NO: 13724 - DNA, 16 bp, Artificial Sequence
  synthetic [barcode part1]
cacactctctgacgac

SEQ ID NO: 13725 - DNA, 16 bp, Artificial Sequence
  synthetic [barcode part1]
cgaatctgaactcgtg

SEQ ID NO: 13726 - DNA, 16 bp, Artificial Sequence
  synthetic [barcode part1]
tatctgtgcagacgac

SEQ ID NO: 13727 - DNA, 16 bp, Artificial Sequence
  synthetic [barcode part1]
tctcctgacttggacg

SEQ ID NO: 13728 - DNA, 16 bp, Artificial Sequence
  synthetic [barcode part1]
caactggattggtcgt

SEQ ID NO: 13729 - DNA, 16 bp, Artificial Sequence
  synthetic [barcode part1]
gcaagtctcttactgt

SEQ ID NO: 13730 - DNA, 16 bp, Artificial Sequence
  synthetic [barcode part1]
gttcaagacttcgttc

SEQ ID NO: 13731 - DNA, 16 bp, Artificial Sequence
  synthetic [barcode part1]
cagtagtaatccggtc

SEQ ID NO: 13732 - DNA, 16 bp, Artificial Sequence
  synthetic [barcode part1]
gccttgcctgtacagt

SEQ ID NO: 13733 - DNA, 16 bp, Artificial Sequence
  synthetic [barcode part1]
ttacgttgcgagagtc

SEQ ID NO: 13734 - DNA, 16 bp, Artificial Sequence
  synthetic [barcode part1]
agtgtggacggtctag

SEQ ID NO: 13735 - DNA, 16 bp, Artificial Sequence
  synthetic [barcode part1]
ccgtatctgttaggcc

SEQ ID NO: 13736 - DNA, 16 bp, Artificial Sequence
  synthetic [barcode part1]
cgacgaatccgagtag

SEQ ID NO: 13737 - DNA, 16 bp, Artificial Sequence
  synthetic [barcode part1]
gtattccacgccttct

SEQ ID NO: 13738 - DNA, 16 bp, Artificial Sequence
  synthetic [barcode part1]
tggaatcaactggtcc

SEQ ID NO: 13739 - DNA, 16 bp, Artificial Sequence
  synthetic [barcode part1]
aaccgtaagaaccggc

SEQ ID NO: 13740 - DNA, 16 bp, Artificial Sequence
  synthetic [barcode part1]
gaactgtatccgacac

SEQ ID NO: 13741 - DNA, 16 bp, Artificial Sequence
  synthetic [barcode part1]
aagtcactccacgtcc

SEQ ID NO: 13742 - DNA, 16 bp, Artificial Sequence
  synthetic [barcode part1]
gcgcgtatatacgtac

SEQ ID NO: 13743 - DNA, 16 bp, Artificial Sequence
  synthetic [barcode part1]
cctaattactggtgtc

SEQ ID NO: 13744 - DNA, 16 bp, Artificial Sequence
  synthetic [barcode part1]
ttacgtgtgtacgacg

SEQ ID NO: 13745 - DNA, 16 bp, Artificial Sequence
  synthetic [barcode part1]
taccaaccacagtcag

SEQ ID NO: 13746 - DNA, 16 bp, Artificial Sequence
  synthetic [barcode part1]
agaagttcacggccag

SEQ ID NO: 13747 - DNA, 16 bp, Artificial Sequence
  synthetic [barcode part1]
tgactcacttgtatcg

SEQ ID NO: 13748 - DNA, 16 bp, Artificial Sequence
  synthetic [barcode part1]
aggattaaccacctcg

SEQ ID NO: 13749 - DNA, 16 bp, Artificial Sequence
  synthetic [barcode part1]
ttctgttcctgtcgtg

SEQ ID NO: 13750 - DNA, 16 bp, Artificial Sequence
  synthetic [barcode part1]
gttcgccacaatactt

SEQ ID NO: 13751 - DNA, 16 bp, Artificial Sequence
  synthetic [barcode part1]
ataggattgccacctg

SEQ ID NO: 13752 - DNA, 16 bp, Artificial Sequence
  synthetic [barcode part1]
ttgcacaactggtacg

SEQ ID NO: 13753 - DNA, 16 bp, Artificial Sequence
  synthetic [barcode part1]
tagtcagtgaccgatc

SEQ ID NO: 13754 - DNA, 16 bp, Artificial Sequence
  synthetic [barcode part1]
agaacagatctacggt

SEQ ID NO: 13755 - DNA, 16 bp, Artificial Sequence
  synthetic [barcode part1]
agttcggtacagaagt

SEQ ID NO: 13756 - DNA, 16 bp, Artificial Sequence
  synthetic [barcode part1]
tcctcgaatataccac

SEQ ID NO: 13757 - DNA, 16 bp, Artificial Sequence
  synthetic [barcode part1]
actcgtacgtatcgag

SEQ ID NO: 13758 - DNA, 16 bp, Artificial Sequence
  synthetic [barcode part1]
attggcacgttctatc

SEQ ID NO: 13759 - DNA, 16 bp, Artificial Sequence
  synthetic [barcode part1]
tagaatcgcacgcgtt

SEQ ID NO: 13760 - DNA, 16 bp, Artificial Sequence
  synthetic [barcode part1]
gtggattgccacttcc

SEQ ID NO: 13761 - DNA, 16 bp, Artificial Sequence
  synthetic [barcode part1]
ttctacggttgttggt

SEQ ID NO: 13762 - DNA, 16 bp, Artificial Sequence
  synthetic [barcode part1]
cctacggagtagagtg

SEQ ID NO: 13763 - DNA, 16 bp, Artificial Sequence
  synthetic [barcode part1]
tgtggagtgtgagaag

SEQ ID NO: 13764 - DNA, 16 bp, Artificial Sequence
  synthetic [barcode part1]
acagtctgtctctgcg

SEQ ID NO: 13765 - DNA, 16 bp, Artificial Sequence
  synthetic [barcode part1]
tgaggaggaggttaac

SEQ ID NO: 13766 - DNA, 16 bp, Artificial Sequence
  synthetic [barcode part1]
gacaacgattccactg

SEQ ID NO: 13767 - DNA, 16 bp, Artificial Sequence
  synthetic [barcode part1]
tctagactctagtctg

SEQ ID NO: 13768 - DNA, 16 bp, Artificial Sequence
  synthetic [barcode part1]
cgtaggtcaaggtggt

SEQ ID NO: 13769 - DNA, 16 bp, Artificial Sequence
  synthetic [barcode part1]
acctagttgcgccttg

SEQ ID NO: 13770 - DNA, 16 bp, Artificial Sequence
  synthetic [barcode part1]
aggtagacttggaact

SEQ ID NO: 13771 - DNA, 16 bp, Artificial Sequence
  synthetic [barcode part1]
acaacacgttgaccac

SEQ ID NO: 13772 - DNA, 16 bp, Artificial Sequence
  synthetic [barcode part1]
acggtgtcgatactgt

SEQ ID NO: 13773 - DNA, 16 bp, Artificial Sequence
  synthetic [barcode part1]
acgtactagtgtgtcg

SEQ ID NO: 13774 - DNA, 16 bp, Artificial Sequence
  synthetic [barcode part1]
atcaggccggactatt

SEQ ID NO: 13775 - DNA, 16 bp, Artificial Sequence
  synthetic [barcode part1]
acctagtatactcctg

SEQ ID NO: 13776 - DNA, 16 bp, Artificial Sequence
  synthetic [barcode part1]
agttctgactccagag

SEQ ID NO: 13777 - DNA, 16 bp, Artificial Sequence
  synthetic [barcode part1]
attaggcaccttcgcc

SEQ ID NO: 13778 - DNA, 16 bp, Artificial Sequence
  synthetic [barcode part1]
cagaatctgtaacgcc

SEQ ID NO: 13779 - DNA, 16 bp, Artificial Sequence
  synthetic [barcode part1]
caatccagttcggtag

SEQ ID NO: 13780 - DNA, 16 bp, Artificial Sequence
  synthetic [barcode part1]
tgtatcctaccggatt

SEQ ID NO: 13781 - DNA, 16 bp, Artificial Sequence
  synthetic [barcode part1]
taggcgttggcagagt

SEQ ID NO: 13782 - DNA, 16 bp, Artificial Sequence
  synthetic [barcode part1]
ataccggactggaggt

SEQ ID NO: 13783 - DNA, 16 bp, Artificial Sequence
  synthetic [barcode part1]
ccgtccgaataagtac

SEQ ID NO: 13784 - DNA, 16 bp, Artificial Sequence
  synthetic [barcode part1]
aaggcaaccacggact

SEQ ID NO: 13785 - DNA, 16 bp, Artificial Sequence
  synthetic [barcode part1]
acacgattcagaagac

SEQ ID NO: 13786 - DNA, 16 bp, Artificial Sequence
  synthetic [barcode part1]
cgtcgtgactagttag

SEQ ID NO: 13787 - DNA, 16 bp, Artificial Sequence
  synthetic [barcode part1]
cacttgcgtggtatcc

SEQ ID NO: 13788 - DNA, 16 bp, Artificial Sequence
  synthetic [barcode part1]
ccttacggactactgc

SEQ ID NO: 13789 - DNA, 16 bp, Artificial Sequence
  synthetic [barcode part1]
aggtcaggtactgacg

SEQ ID NO: 13790 - DNA, 16 bp, Artificial Sequence
  synthetic [barcode part1]
agtcttgaagtgaacg

SEQ ID NO: 13791 - DNA, 16 bp, Artificial Sequence
  synthetic [barcode part1]
gacgtagtacttccag

SEQ ID NO: 13792 - DNA, 16 bp, Artificial Sequence
  synthetic [barcode part1]
aaccacgaactaaggt

SEQ ID NO: 13793 - DNA, 16 bp, Artificial Sequence
  synthetic [barcode part1]
tactatcctcgcaggc

SEQ ID NO: 13794 - DNA, 16 bp, Artificial Sequence
  synthetic [barcode part1]
aggcgaattgtagtac

SEQ ID NO: 13795 - DNA, 16 bp, Artificial Sequence
  synthetic [barcode part1]
gcgtctcgacctgatt

SEQ ID NO: 13796 - DNA, 16 bp, Artificial Sequence
  synthetic [barcode part1]
agtcctaatccgtccg

SEQ ID NO: 13797 - DNA, 16 bp, Artificial Sequence
  synthetic [barcode part1]
cagtcaactctaggac

SEQ ID NO: 13798 - DNA, 16 bp, Artificial Sequence
  synthetic [barcode part1]
tattattgcgaccacc

SEQ ID NO: 13799 - DNA, 16 bp, Artificial Sequence
  synthetic [barcode part1]
atcgtcctctagacgc

SEQ ID NO: 13800 - DNA, 16 bp, Artificial Sequence
  synthetic [barcode part1]
caggcggataatattg

SEQ ID NO: 13801 - DNA, 16 bp, Artificial Sequence
  synthetic [barcode part1]
ccagtcgtcaatcaag

SEQ ID NO: 13802 - DNA, 16 bp, Artificial Sequence
  synthetic [barcode part1]
cacagagagagtgtag

SEQ ID NO: 13803 - DNA, 16 bp, Artificial Sequence
  synthetic [barcode part1]
ttgagactactgcgac

SEQ ID NO: 13804 - DNA, 16 bp, Artificial Sequence
  synthetic [barcode part1]
gtaacgtcgtaacgtc

SEQ ID NO: 13805 - DNA, 16 bp, Artificial Sequence
  synthetic [barcode part1]
gtattgccttggaacg

SEQ ID NO: 13806 - DNA, 16 bp, Artificial Sequence
  synthetic [barcode part1]
taccaggtgtctccgt

SEQ ID NO: 13807 - DNA, 16 bp, Artificial Sequence
  synthetic [barcode part1]
cctatcgtatactgac

SEQ ID NO: 13808 - DNA, 16 bp, Artificial Sequence
  synthetic [barcode part1]
gtaaccaacgtcgatc

SEQ ID NO: 13809 - DNA, 16 bp, Artificial Sequence
  synthetic [barcode part1]
gatcttcgcgtaactt

SEQ ID NO: 13810 - DNA, 16 bp, Artificial Sequence
  synthetic [barcode part1]
cagttacgaacacctg

SEQ ID NO: 13811 - DNA, 16 bp, Artificial Sequence
  synthetic [barcode part1]
ccgatatacaccaacg

SEQ ID NO: 13812 - DNA, 16 bp, Artificial Sequence
  synthetic [barcode part1]
gtactcctggtggttc

SEQ ID NO: 13813 - DNA, 16 bp, Artificial Sequence
  synthetic [barcode part1]
actctcgcctgacaac

SEQ ID NO: 13814 - DNA, 16 bp, Artificial Sequence
  synthetic [barcode part1]
taactaagtcgcggtc

SEQ ID NO: 13815 - DNA, 16 bp, Artificial Sequence
  synthetic [barcode part1]
aattgcgttccaatcc

SEQ ID NO: 13816 - DNA, 16 bp, Artificial Sequence
  synthetic [barcode part1]
tcttgcgttagtgatc

SEQ ID NO: 13817 - DNA, 16 bp, Artificial Sequence
  synthetic [barcode part1]
gatctctgcacggtct

SEQ ID NO: 13818 - DNA, 16 bp, Artificial Sequence
  synthetic [barcode part1]
aacggactcacttgtg

SEQ ID NO: 13819 - DNA, 16 bp, Artificial Sequence
  synthetic [barcode part1]
gacacgcagagttgac

SEQ ID NO: 13820 - DNA, 16 bp, Artificial Sequence
  synthetic [barcode part1]
tggcacctatctaccg

SEQ ID NO: 13821 - DNA, 16 bp, Artificial Sequence
  synthetic [barcode part1]
ataccgaactactctc

SEQ ID NO: 13822 - DNA, 16 bp, Artificial Sequence
  synthetic [barcode part1]
taagtaggaacctcag

SEQ ID NO: 13823 - DNA, 16 bp, Artificial Sequence
  synthetic [barcode part1]
aaccaactgtgacacc

SEQ ID NO: 13824 - DNA, 16 bp, Artificial Sequence
  synthetic [barcode part1]
acgtctcgattgtcgc

SEQ ID NO: 13825 - DNA, 16 bp, Artificial Sequence
  synthetic [barcode part1]
accttcctctctcaag

SEQ ID NO: 13826 - DNA, 16 bp, Artificial Sequence
  synthetic [barcode part1]
aggcactaagtggcgt

SEQ ID NO: 13827 - DNA, 16 bp, Artificial Sequence
  synthetic [barcode part1]
tcgcacctatcttcgt

SEQ ID NO: 13828 - DNA, 16 bp, Artificial Sequence
  synthetic [barcode part1]
attcactctcagagtc

SEQ ID NO: 13829 - DNA, 16 bp, Artificial Sequence
  synthetic [barcode part1]
gttgatcttaaggccg

SEQ ID NO: 13830 - DNA, 16 bp, Artificial Sequence
  synthetic [barcode part1]
tggccttgttagtgcc

SEQ ID NO: 13831 - DNA, 16 bp, Artificial Sequence
  synthetic [barcode part1]
tgtcgcgtaatcagtg

SEQ ID NO: 13832 - DNA, 16 bp, Artificial Sequence
  synthetic [barcode part1]
tgtggtagtgacgttc

SEQ ID NO: 13833 - DNA, 16 bp, Artificial Sequence
  synthetic [barcode part1]
gtgtccgaacgaagtg

SEQ ID NO: 13834 - DNA, 16 bp, Artificial Sequence
  synthetic [barcode part1]
tacgtaccacaacgtg

SEQ ID NO: 13835 - DNA, 16 bp, Artificial Sequence
  synthetic [barcode part1]
cctaccaatatccaac

SEQ ID NO: 13836 - DNA, 16 bp, Artificial Sequence
  synthetic [barcode part1]
accgattcttccttcg

SEQ ID NO: 13837 - DNA, 16 bp, Artificial Sequence
  synthetic [barcode part1]
cgtatcacgcaatcag

SEQ ID NO: 13838 - DNA, 16 bp, Artificial Sequence
  synthetic [barcode part1]
agaccgacacgtaacg

SEQ ID NO: 13839 - DNA, 16 bp, Artificial Sequence
  synthetic [barcode part1]
cgttaacctctccgag

SEQ ID NO: 13840 - DNA, 16 bp, Artificial Sequence
  synthetic [barcode part1]
cgcctataggtaagtc

SEQ ID NO: 13841 - DNA, 16 bp, Artificial Sequence
  synthetic [barcode part1]
atcggatattcctgtc

SEQ ID NO: 13842 - DNA, 16 bp, Artificial Sequence
  synthetic [barcode part1]
ccgttaaccaacaacg

SEQ ID NO: 13843 - DNA, 16 bp, Artificial Sequence
  synthetic [barcode part1]
tggacaggtgaacaag

SEQ ID NO: 13844 - DNA, 16 bp, Artificial Sequence
  synthetic [barcode part1]
gtggtgaccacgtaag

SEQ ID NO: 13845 - DNA, 16 bp, Artificial Sequence
  synthetic [barcode part1]
gttaccaccaacaacg

SEQ ID NO: 13846 - DNA, 16 bp, Artificial Sequence
  synthetic [barcode part1]
tagattagatccggcc

SEQ ID NO: 13847 - DNA, 16 bp, Artificial Sequence
  synthetic [barcode part1]
tcaaggtacttgttcc

SEQ ID NO: 13848 - DNA, 16 bp, Artificial Sequence
  synthetic [barcode part1]
tctctattggaccgcg

SEQ ID NO: 13849 - DNA, 16 bp, Artificial Sequence
  synthetic [barcode part1]
aggaccaacacctgag

SEQ ID NO: 13850 - DNA, 16 bp, Artificial Sequence
  synthetic [barcode part1]
acgagttcaataaggc

SEQ ID NO: 13851 - DNA, 16 bp, Artificial Sequence
  synthetic [barcode part1]
taatagttcctcacgc

SEQ ID NO: 13852 - DNA, 16 bp, Artificial Sequence
  synthetic [barcode part1]
gacgtgcactatacac

SEQ ID NO: 13853 - DNA, 16 bp, Artificial Sequence
  synthetic [barcode part1]
accgtctgttcacgac

SEQ ID NO: 13854 - DNA, 16 bp, Artificial Sequence
  synthetic [barcode part1]
cgtgacggatattgtc

SEQ ID NO: 13855 - DNA, 16 bp, Artificial Sequence
  synthetic [barcode part1]
tgcgaaggacctaacg

SEQ ID NO: 13856 - DNA, 16 bp, Artificial Sequence
  synthetic [barcode part1]
tagaagagttggcgcc

SEQ ID NO: 13857 - DNA, 16 bp, Artificial Sequence
  synthetic [barcode part1]
ccactacaagtccgtc

SEQ ID NO: 13858 - DNA, 16 bp, Artificial Sequence
  synthetic [barcode part1]
gtgtgcacgatcgatt

SEQ ID NO: 13859 - DNA, 16 bp, Artificial Sequence
  synthetic [barcode part1]
tattccggacaggact

SEQ ID NO: 13860 - DNA, 16 bp, Artificial Sequence
  synthetic [barcode part1]
tggatcaccttatacc

SEQ ID NO: 13861 - DNA, 16 bp, Artificial Sequence
  synthetic [barcode part1]
cactcggttgatacag

SEQ ID NO: 13862 - DNA, 16 bp, Artificial Sequence
  synthetic [barcode part1]
tctctcgacagagtag

SEQ ID NO: 13863 - DNA, 16 bp, Artificial Sequence
  synthetic [barcode part1]
taaggataacgcggag

SEQ ID NO: 13864 - DNA, 16 bp, Artificial Sequence
  synthetic [barcode part1]
aggttcagtagtcacc

SEQ ID NO: 13865 - DNA, 16 bp, Artificial Sequence
  synthetic [barcode part1]
tgtggatcgtctgaac

SEQ ID NO: 13866 - DNA, 16 bp, Artificial Sequence
  synthetic [barcode part1]
gcgccaggtataactt

SEQ ID NO: 13867 - DNA, 16 bp, Artificial Sequence
  synthetic [barcode part1]
cactacctgaacctgc

SEQ ID NO: 13868 - DNA, 16 bp, Artificial Sequence
  synthetic [barcode part1]
acctccacactgagtc

SEQ ID NO: 13869 - DNA, 16 bp, Artificial Sequence
  synthetic [barcode part1]
tcgagactaggactct

SEQ ID NO: 13870 - DNA, 16 bp, Artificial Sequence
  synthetic [barcode part1]
cgtacgagaacactct

SEQ ID NO: 13871 - DNA, 16 bp, Artificial Sequence
  synthetic [barcode part1]
actgtagaggtaagtc

SEQ ID NO: 13872 - DNA, 16 bp, Artificial Sequence
  synthetic [barcode part1]
tctgtatccgaaccgc

SEQ ID NO: 13873 - DNA, 16 bp, Artificial Sequence
  synthetic [barcode part1]
gttgacaggcgtattc

SEQ ID NO: 13874 - DNA, 16 bp, Artificial Sequence
  synthetic [barcode part1]
acgaataccacctacg

SEQ ID NO: 13875 - DNA, 16 bp, Artificial Sequence
  synthetic [barcode part1]
aacgccgtcttaagac

SEQ ID NO: 13876 - DNA, 16 bp, Artificial Sequence
  synthetic [barcode part1]
gtgtgcgcaatattgc

SEQ ID NO: 13877 - DNA, 16 bp, Artificial Sequence
  synthetic [barcode part1]
aatctggataccttcc

SEQ ID NO: 13878 - DNA, 16 bp, Artificial Sequence
  synthetic [barcode part1]
tcttccgagtgcactg

SEQ ID NO: 13879 - DNA, 16 bp, Artificial Sequence
  synthetic [barcode part1]
taggtaacgccgcaag

SEQ ID NO: 13880 - DNA, 16 bp, Artificial Sequence
  synthetic [barcode part1]
cgagaacgcaatccag

SEQ ID NO: 13881 - DNA, 16 bp, Artificial Sequence
  synthetic [barcode part1]
gcgtcttggttgtcac

SEQ ID NO: 13882 - DNA, 16 bp, Artificial Sequence
  synthetic [barcode part1]
tactcagtgcaagtcg

SEQ ID NO: 13883 - DNA, 16 bp, Artificial Sequence
  synthetic [barcode part1]
aaccttgcactgtgag

SEQ ID NO: 13884 - DNA, 16 bp, Artificial Sequence
  synthetic [barcode part1]
ccggaatcaggtgagt

SEQ ID NO: 13885 - DNA, 16 bp, Artificial Sequence
  synthetic [barcode part1]
gcacagtctccgactt

SEQ ID NO: 13886 - DNA, 16 bp, Artificial Sequence
  synthetic [barcode part1]
cgtggtagaacagatt

SEQ ID NO: 13887 - DNA, 16 bp, Artificial Sequence
  synthetic [barcode part1]
tcgcaagtggaggact

SEQ ID NO: 13888 - DNA, 16 bp, Artificial Sequence
  synthetic [barcode part1]
aactacgatcgtgtgc

SEQ ID NO: 13889 - DNA, 16 bp, Artificial Sequence
  synthetic [barcode part1]
actcggatattgcctt

SEQ ID NO: 13890 - DNA, 16 bp, Artificial Sequence
  synthetic [barcode part1]
gcgagaagacttgacc

SEQ ID NO: 13891 - DNA, 16 bp, Artificial Sequence
  synthetic [barcode part1]
aaggcggaggttcact

SEQ ID NO: 13892 - DNA, 16 bp, Artificial Sequence
  synthetic [barcode part1]
accacctctgtaggtc

SEQ ID NO: 13893 - DNA, 16 bp, Artificial Sequence
  synthetic [barcode part1]
tgtatcgactgcgtag

SEQ ID NO: 13894 - DNA, 16 bp, Artificial Sequence
  synthetic [barcode part1]
gcaataccaataccgc

SEQ ID NO: 13895 - DNA, 16 bp, Artificial Sequence
  synthetic [barcode part1]
atcttaccagatctgc

SEQ ID NO: 13896 - DNA, 16 bp, Artificial Sequence
  synthetic [barcode part1]
gtccgtccttatctgt

SEQ ID NO: 13897 - DNA, 16 bp, Artificial Sequence
  synthetic [barcode part1]
cgagtgaggtatcacg

SEQ ID NO: 13898 - DNA, 16 bp, Artificial Sequence
  synthetic [barcode part1]
tagtcgtgacgtgttg

SEQ ID NO: 13899 - DNA, 16 bp, Artificial Sequence
  synthetic [barcode part1]
ccttctgtgaacttag

SEQ ID NO: 13900 - DNA, 16 bp, Artificial Sequence
  synthetic [barcode part1]
acacaacaaccgaggc

SEQ ID NO: 13901 - DNA, 16 bp, Artificial Sequence
  synthetic [barcode part1]
cgttactccacgcagt

SEQ ID NO: 13902 - DNA, 16 bp, Artificial Sequence
  synthetic [barcode part1]
tattggcaaggagttg

SEQ ID NO: 13903 - DNA, 16 bp, Artificial Sequence
  synthetic [barcode part1]
gtataagtctgcaccg

SEQ ID NO: 13904 - DNA, 16 bp, Artificial Sequence
  synthetic [barcode part1]
cgattggtcaggactt

SEQ ID NO: 13905 - DNA, 16 bp, Artificial Sequence
  synthetic [barcode part1]
gtgaagactgaatcgt

SEQ ID NO: 13906 - DNA, 16 bp, Artificial Sequence
  synthetic [barcode part1]
cgttagactgtcgaac

SEQ ID NO: 13907 - DNA, 16 bp, Artificial Sequence
  synthetic [barcode part1]
tccgtacaattatcgc

SEQ ID NO: 13908 - DNA, 16 bp, Artificial Sequence
  synthetic [barcode part1]
gtaatcgaattcctcc

SEQ ID NO: 13909 - DNA, 16 bp, Artificial Sequence
  synthetic [barcode part1]
actctgttcgtacagt

SEQ ID NO: 13910 - DNA, 16 bp, Artificial Sequence
  synthetic [barcode part1]
ccagaatcctaagacc

SEQ ID NO: 13911 - DNA, 16 bp, Artificial Sequence
  synthetic [barcode part1]
ccaaccttcacacgac

SEQ ID NO: 13912 - DNA, 16 bp, Artificial Sequence
  synthetic [barcode part1]
gaagtatcacgaggag

SEQ ID NO: 13913 - DNA, 16 bp, Artificial Sequence
  synthetic [barcode part1]
ccaggaacacgaactg

SEQ ID NO: 13914 - DNA, 16 bp, Artificial Sequence
  synthetic [barcode part1]
gtggtgattgtcactg

SEQ ID NO: 13915 - DNA, 16 bp, Artificial Sequence
  synthetic [barcode part1]
cacgcaggttcttcac

SEQ ID NO: 13916 - DNA, 16 bp, Artificial Sequence
  synthetic [barcode part1]
cgtgttatagtacgcg

SEQ ID NO: 13917 - DNA, 16 bp, Artificial Sequence
  synthetic [barcode part1]
tagacgttgcagatcc

SEQ ID NO: 13918 - DNA, 16 bp, Artificial Sequence
  synthetic [barcode part1]
tagtcgattggccaac

SEQ ID NO: 13919 - DNA, 16 bp, Artificial Sequence
  synthetic [barcode part1]
gactgacgtgtacgtt

SEQ ID NO: 13920 - DNA, 16 bp, Artificial Sequence
  synthetic [barcode part1]
cgagaacgaacacaag

SEQ ID NO: 13921 - DNA, 16 bp, Artificial Sequence
  synthetic [barcode part1]
gaagtcttagacagac

SEQ ID NO: 13922 - DNA, 16 bp, Artificial Sequence
  synthetic [barcode part1]
accaactcgtgtacag

SEQ ID NO: 13923 - DNA, 16 bp, Artificial Sequence
  synthetic [barcode part1]
tgacagtcaacgatcc

SEQ ID NO: 13924 - DNA, 16 bp, Artificial Sequence
  synthetic [barcode part1]
ttcagtctgtgcgatt

SEQ ID NO: 13925 - DNA, 16 bp, Artificial Sequence
  synthetic [barcode part1]
actggagtgtgtggtg

SEQ ID NO: 13926 - DNA, 16 bp, Artificial Sequence
  synthetic [barcode part1]
cacctacctgtagtgc

SEQ ID NO: 13927 - DNA, 16 bp, Artificial Sequence
  synthetic [barcode part1]
gacaggacaatccttc

SEQ ID NO: 13928 - DNA, 16 bp, Artificial Sequence
  synthetic [barcode part1]
gtgtactggtagtaag

SEQ ID NO: 13929 - DNA, 16 bp, Artificial Sequence
  synthetic [barcode part1]
gccttacaacgtattc

SEQ ID NO: 13930 - DNA, 16 bp, Artificial Sequence
  synthetic [barcode part1]
tattgccagtggcagt

SEQ ID NO: 13931 - DNA, 16 bp, Artificial Sequence
  synthetic [barcode part1]
ttcttacagtgatccg

SEQ ID NO: 13932 - DNA, 16 bp, Artificial Sequence
  synthetic [barcode part1]
cgacctgcagagatag

SEQ ID NO: 13933 - DNA, 16 bp, Artificial Sequence
  synthetic [barcode part1]
gccttgtataactacc

SEQ ID NO: 13934 - DNA, 16 bp, Artificial Sequence
  synthetic [barcode part1]
gatctggtctccgtgt

SEQ ID NO: 13935 - DNA, 16 bp, Artificial Sequence
  synthetic [barcode part1]
gtgcagatacttccag

SEQ ID NO: 13936 - DNA, 16 bp, Artificial Sequence
  synthetic [barcode part1]
gttactcggcaagact

SEQ ID NO: 13937 - DNA, 16 bp, Artificial Sequence
  synthetic [barcode part1]
gcaggccagaacaact

SEQ ID NO: 13938 - DNA, 16 bp, Artificial Sequence
  synthetic [barcode part1]
cagttcttacgatcgt

SEQ ID NO: 13939 - DNA, 16 bp, Artificial Sequence
  synthetic [barcode part1]
cctctaggtgttggtc

SEQ ID NO: 13940 - DNA, 16 bp, Artificial Sequence
  synthetic [barcode part1]
actgacaccgtcgttc

SEQ ID NO: 13941 - DNA, 16 bp, Artificial Sequence
  synthetic [barcode part1]
tcgttcgtgaacagac

SEQ ID NO: 13942 - DNA, 16 bp, Artificial Sequence
  synthetic [barcode part1]
gactcaaggtcactac

SEQ ID NO: 13943 - DNA, 16 bp, Artificial Sequence
  synthetic [barcode part1]
tacgacggtctattct

SEQ ID NO: 13944 - DNA, 16 bp, Artificial Sequence
  synthetic [barcode part1]
tctccaagttgcgcgt

SEQ ID NO: 13945 - DNA, 16 bp, Artificial Sequence
  synthetic [barcode part1]
tcaacctctaccacct

SEQ ID NO: 13946 - DNA, 16 bp, Artificial Sequence
  synthetic [barcode part1]
gaatcgcacagagatt

SEQ ID NO: 13947 - DNA, 16 bp, Artificial Sequence
  synthetic [barcode part1]
ccactgtgaataacgc

SEQ ID NO: 13948 - DNA, 16 bp, Artificial Sequence
  synthetic [barcode part1]
atcaggttgttcttgc

SEQ ID NO: 13949 - DNA, 16 bp, Artificial Sequence
  synthetic [barcode part1]
tcgcctagttctggac

SEQ ID NO: 13950 - DNA, 16 bp, Artificial Sequence
  synthetic [barcode part1]
gtggccggtgttaatt

SEQ ID NO: 13951 - DNA, 16 bp, Artificial Sequence
  synthetic [barcode part1]
cacttgtccgttcgtt

SEQ ID NO: 13952 - DNA, 16 bp, Artificial Sequence
  synthetic [barcode part1]
tcgtcgttaagacgac

SEQ ID NO: 13953 - DNA, 16 bp, Artificial Sequence
  synthetic [barcode part1]
tactgacacgtaccag

SEQ ID NO: 13954 - DNA, 16 bp, Artificial Sequence
  synthetic [barcode part1]
tcaggacacctcaagt

SEQ ID NO: 13955 - DNA, 16 bp, Artificial Sequence
  synthetic [barcode part1]
gatctagtatacctcc

SEQ ID NO: 13956 - DNA, 16 bp, Artificial Sequence
  synthetic [barcode part1]
caccaccttcagtctt

SEQ ID NO: 13957 - DNA, 16 bp, Artificial Sequence
  synthetic [barcode part1]
acgatcacaatcgtgc

SEQ ID NO: 13958 - DNA, 16 bp, Artificial Sequence
  synthetic [barcode part1]
attgcacttccgttag

SEQ ID NO: 13959 - DNA, 16 bp, Artificial Sequence
  synthetic [barcode part1]
tacctgtctcacctgt

SEQ ID NO: 13960 - DNA, 16 bp, Artificial Sequence
  synthetic [barcode part1]
ttaccgagattcggtg

SEQ ID NO: 13961 - DNA, 16 bp, Artificial Sequence
  synthetic [barcode part1]
agtgcagttcgtgttg

SEQ ID NO: 13962 - DNA, 16 bp, Artificial Sequence
  synthetic [barcode part1]
gtgtacacgactaacc

SEQ ID NO: 13963 - DNA, 16 bp, Artificial Sequence
  synthetic [barcode part1]
gcaagtggacactgtg

SEQ ID NO: 13964 - DNA, 16 bp, Artificial Sequence
  synthetic [barcode part1]
atcctaggatcaaccg

SEQ ID NO: 13965 - DNA, 16 bp, Artificial Sequence
  synthetic [barcode part1]
tgaaccaggagtatac

SEQ ID NO: 13966 - DNA, 16 bp, Artificial Sequence
  synthetic [barcode part1]
tgtctcgcacctagac

SEQ ID NO: 13967 - DNA, 16 bp, Artificial Sequence
  synthetic [barcode part1]
accaacttgtaacgcg

SEQ ID NO: 13968 - DNA, 16 bp, Artificial Sequence
  synthetic [barcode part1]
caatacgacacagtcc

SEQ ID NO: 13969 - DNA, 16 bp, Artificial Sequence
  synthetic [barcode part1]
caggactcagtcagtt

SEQ ID NO: 13970 - DNA, 16 bp, Artificial Sequence
  synthetic [barcode part1]
tgcaacgcctgtctgt

SEQ ID NO: 13971 - DNA, 16 bp, Artificial Sequence
  synthetic [barcode part1]
aatccgagattcggtc

SEQ ID NO: 13972 - DNA, 16 bp, Artificial Sequence
  synthetic [barcode part1]
gtcgtgaatctatcct

SEQ ID NO: 13973 - DNA, 16 bp, Artificial Sequence
  synthetic [barcode part1]
taccagatatcctcac

SEQ ID NO: 13974 - DNA, 16 bp, Artificial Sequence
  synthetic [barcode part1]
acgcgatagaatcagt

SEQ ID NO: 13975 - DNA, 16 bp, Artificial Sequence
  synthetic [barcode part1]
gttctaggactgactg

SEQ ID NO: 13976 - DNA, 16 bp, Artificial Sequence
  synthetic [barcode part1]
tgattccggtcaaggt

SEQ ID NO: 13977 - DNA, 16 bp, Artificial Sequence
  synthetic [barcode part1]
ataccgacgcaagttc

SEQ ID NO: 13978 - DNA, 16 bp, Artificial Sequence
  synthetic [barcode part1]
ccttctcgagagaagt

SEQ ID NO: 13979 - DNA, 16 bp, Artificial Sequence
  synthetic [barcode part1]
gcgttatcttggaacg

SEQ ID NO: 13980 - DNA, 16 bp, Artificial Sequence
  synthetic [barcode part1]
acttcgcaggtactcc

SEQ ID NO: 13981 - DNA, 16 bp, Artificial Sequence
  synthetic [barcode part1]
actcagtcgatccaag

SEQ ID NO: 13982 - DNA, 16 bp, Artificial Sequence
  synthetic [barcode part1]
caggtcggtatctctc

SEQ ID NO: 13983 - DNA, 16 bp, Artificial Sequence
  synthetic [barcode part1]
cactacctcgttatcc

SEQ ID NO: 13984 - DNA, 16 bp, Artificial Sequence
  synthetic [barcode part1]
agaaggcagtatactc

SEQ ID NO: 13985 - DNA, 16 bp, Artificial Sequence
  synthetic [barcode part1]
cggtaaggtaagtccg

SEQ ID NO: 13986 - DNA, 16 bp, Artificial Sequence
  synthetic [barcode part1]
cagagaatacgcgatt

SEQ ID NO: 13987 - DNA, 16 bp, Artificial Sequence
  synthetic [barcode part1]
caccgttcaggttcac

SEQ ID NO: 13988 - DNA, 16 bp, Artificial Sequence
  synthetic [barcode part1]
gttagtcgtgtgtgtg

SEQ ID NO: 13989 - DNA, 16 bp, Artificial Sequence
  synthetic [barcode part1]
gtataagttgcgcctg

SEQ ID NO: 13990 - DNA, 16 bp, Artificial Sequence
  synthetic [barcode part1]
actgactaattggccg

SEQ ID NO: 13991 - DNA, 16 bp, Artificial Sequence
  synthetic [barcode part1]
cacaagtcggatatcc

SEQ ID NO: 13992 - DNA, 16 bp, Artificial Sequence
  synthetic [barcode part1]
gccgataacaaggcgt

SEQ ID NO: 13993 - DNA, 16 bp, Artificial Sequence
  synthetic [barcode part1]
cacctacaagtcctgc

SEQ ID NO: 13994 - DNA, 16 bp, Artificial Sequence
  synthetic [barcode part1]
gaagacgcgttcttac

SEQ ID NO: 13995 - DNA, 16 bp, Artificial Sequence
  synthetic [barcode part1]
cggatatagtctgtgc

SEQ ID NO: 13996 - DNA, 16 bp, Artificial Sequence
  synthetic [barcode part1]
gtatcttctccacacc

SEQ ID NO: 13997 - DNA, 16 bp, Artificial Sequence
  synthetic [barcode part1]
gatcgacgcacgtatt

SEQ ID NO: 13998 - DNA, 16 bp, Artificial Sequence
  synthetic [barcode part1]
cgaggttcgtaacgtt

SEQ ID NO: 13999 - DNA, 16 bp, Artificial Sequence
  synthetic [barcode part1]
cgaggttgttgcgatt

SEQ ID NO: 14000 - DNA, 16 bp, Artificial Sequence
  synthetic [barcode part1]
gttaacgacttcttgc

SEQ ID NO: 14001 - DNA, 16 bp, Artificial Sequence
  synthetic [barcode part1]
tagtggccgtgttcct

SEQ ID NO: 14002 - DNA, 16 bp, Artificial Sequence
  synthetic [barcode part1]
gtgaggttggaacaag

SEQ ID NO: 14003 - DNA, 16 bp, Artificial Sequence
  synthetic [barcode part1]
cgatcggatcaattgc

SEQ ID NO: 14004 - DNA, 16 bp, Artificial Sequence
  synthetic [barcode part1]
cctcgagttattcgcg

SEQ ID NO: 14005 - DNA, 16 bp, Artificial Sequence
  synthetic [barcode part1]
gactgtgtgtggttgt

SEQ ID NO: 14006 - DNA, 16 bp, Artificial Sequence
  synthetic [barcode part1]
agtacgttcagagaac

SEQ ID NO: 14007 - DNA, 16 bp, Artificial Sequence
  synthetic [barcode part1]
gtgtcttcggcaacct

SEQ ID NO: 14008 - DNA, 16 bp, Artificial Sequence
  synthetic [barcode part1]
cctaagacagtaccac

SEQ ID NO: 14009 - DNA, 16 bp, Artificial Sequence
  synthetic [barcode part1]
gaccgaacagactcag

SEQ ID NO: 14010 - DNA, 16 bp, Artificial Sequence
  synthetic [barcode part1]
agtgccaataccgtgt

SEQ ID NO: 14011 - DNA, 16 bp, Artificial Sequence
  synthetic [barcode part1]
ttgtccgagtggatac

SEQ ID NO: 14012 - DNA, 16 bp, Artificial Sequence
  synthetic [barcode part1]
ataccaacggcctcct

SEQ ID NO: 14013 - DNA, 16 bp, Artificial Sequence
  synthetic [barcode part1]
acaaccactccgactc

SEQ ID NO: 14014 - DNA, 16 bp, Artificial Sequence
  synthetic [barcode part1]
aacctccgtacgactc

SEQ ID NO: 14015 - DNA, 16 bp, Artificial Sequence
  synthetic [barcode part1]
gatcgacctctaaggt

SEQ ID NO: 14016 - DNA, 16 bp, Artificial Sequence
  synthetic [barcode part1]
gtgacactgaccagtt

SEQ ID NO: 14017 - DNA, 16 bp, Artificial Sequence
  synthetic [barcode part1]
tccgttccactacgag

SEQ ID NO: 14018 - DNA, 16 bp, Artificial Sequence
  synthetic [barcode part1]
gaccaacgatctcagt

SEQ ID NO: 14019 - DNA, 16 bp, Artificial Sequence
  synthetic [barcode part1]
cgcagtatccagagtt

SEQ ID NO: 14020 - DNA, 16 bp, Artificial Sequence
  synthetic [barcode part1]
atataaccggtcacgc

SEQ ID NO: 14021 - DNA, 16 bp, Artificial Sequence
  synthetic [barcode part1]
cgtgattgaagtggcg

SEQ ID NO: 14022 - DNA, 16 bp, Artificial Sequence
  synthetic [barcode part1]
cctacggaccttatcg

SEQ ID NO: 14023 - DNA, 16 bp, Artificial Sequence
  synthetic [barcode part1]
tgtcctaataggtcct

SEQ ID NO: 14024 - DNA, 16 bp, Artificial Sequence
  synthetic [barcode part1]
aggtcaccgagagtgt

SEQ ID NO: 14025 - DNA, 16 bp, Artificial Sequence
  synthetic [barcode part1]
cgtaggtggtaagatt

SEQ ID NO: 14026 - DNA, 16 bp, Artificial Sequence
  synthetic [barcode part1]
tgaacctggcaagacg

SEQ ID NO: 14027 - DNA, 16 bp, Artificial Sequence
  synthetic [barcode part1]
cactattctacgcggc

SEQ ID NO: 14028 - DNA, 16 bp, Artificial Sequence
  synthetic [barcode part1]
actactcgttccgtct

SEQ ID NO: 14029 - DNA, 16 bp, Artificial Sequence
  synthetic [barcode part1]
ttactctgacctgtag

SEQ ID NO: 14030 - DNA, 16 bp, Artificial Sequence
  synthetic [barcode part1]
actcctaggtggcctt

SEQ ID NO: 14031 - DNA, 16 bp, Artificial Sequence
  synthetic [barcode part1]
gacggattatccactg

SEQ ID NO: 14032 - DNA, 16 bp, Artificial Sequence
  synthetic [barcode part1]
gaacctgtgcctcgtt

SEQ ID NO: 14033 - DNA, 16 bp, Artificial Sequence
  synthetic [barcode part1]
agtcagttcttcctcc

SEQ ID NO: 14034 - DNA, 16 bp, Artificial Sequence
  synthetic [barcode part1]
gaagttattcctggcg

SEQ ID NO: 14035 - DNA, 16 bp, Artificial Sequence
  synthetic [barcode part1]
tctagactccggttcg

SEQ ID NO: 14036 - DNA, 16 bp, Artificial Sequence
  synthetic [barcode part1]
cagttgatagttggcc

SEQ ID NO: 14037 - DNA, 16 bp, Artificial Sequence
  synthetic [barcode part1]
aggcgaggtcttgagt

SEQ ID NO: 14038 - DNA, 16 bp, Artificial Sequence
  synthetic [barcode part1]
aggtggatctagaatc

SEQ ID NO: 14039 - DNA, 16 bp, Artificial Sequence
  synthetic [barcode part1]
ttaacggactcagtgc

SEQ ID NO: 14040 - DNA, 16 bp, Artificial Sequence
  synthetic [barcode part1]
caacgtattggacgtc

SEQ ID NO: 14041 - DNA, 16 bp, Artificial Sequence
  synthetic [barcode part1]
tagatcgccaacgatc

SEQ ID NO: 14042 - DNA, 16 bp, Artificial Sequence
  synthetic [barcode part1]
actccgcgttcagact

SEQ ID NO: 14043 - DNA, 16 bp, Artificial Sequence
  synthetic [barcode part1]
ataaccaactgcgcgt

SEQ ID NO: 14044 - DNA, 16 bp, Artificial Sequence
  synthetic [barcode part1]
gtcggtggtggaatac

SEQ ID NO: 14045 - DNA, 16 bp, Artificial Sequence
  synthetic [barcode part1]
gcgaactggaacgact

SEQ ID NO: 14046 - DNA, 16 bp, Artificial Sequence
  synthetic [barcode part1]
gatctctcgcaggtct

SEQ ID NO: 14047 - DNA, 16 bp, Artificial Sequence
  synthetic [barcode part1]
cgtctcttggcctaag

SEQ ID NO: 14048 - DNA, 16 bp, Artificial Sequence
  synthetic [barcode part1]
tatccaggagaatcag

SEQ ID NO: 14049 - DNA, 16 bp, Artificial Sequence
  synthetic [barcode part1]
tataccgttccggtcg

SEQ ID NO: 14050 - DNA, 16 bp, Artificial Sequence
  synthetic [barcode part1]
ccgcaagtaggagatc

SEQ ID NO: 14051 - DNA, 16 bp, Artificial Sequence
  synthetic [barcode part1]
ttgcctctacggactg

SEQ ID NO: 14052 - DNA, 16 bp, Artificial Sequence
  synthetic [barcode part1]
tagaagttgtcgaacg

SEQ ID NO: 14053 - DNA, 16 bp, Artificial Sequence
  synthetic [barcode part1]
ccgcgtaagaatcgag

SEQ ID NO: 14054 - DNA, 16 bp, Artificial Sequence
  synthetic [barcode part1]
ttctcggactacgtgc

SEQ ID NO: 14055 - DNA, 16 bp, Artificial Sequence
  synthetic [barcode part1]
tggcgaaggataacag

SEQ ID NO: 14056 - DNA, 16 bp, Artificial Sequence
  synthetic [barcode part1]
gaataaggataggcgc

SEQ ID NO: 14057 - DNA, 16 bp, Artificial Sequence
  synthetic [barcode part1]
gtccacttaagacttc

SEQ ID NO: 14058 - DNA, 16 bp, Artificial Sequence
  synthetic [barcode part1]
aatactggcgcacgtt

SEQ ID NO: 14059 - DNA, 16 bp, Artificial Sequence
  synthetic [barcode part1]
cagaaggagttctctc

SEQ ID NO: 14060 - DNA, 16 bp, Artificial Sequence
  synthetic [barcode part1]
cgtcactgttcggatc

SEQ ID NO: 14061 - DNA, 16 bp, Artificial Sequence
  synthetic [barcode part1]
cgttctctagtgattg

SEQ ID NO: 14062 - DNA, 16 bp, Artificial Sequence
  synthetic [barcode part1]
aggagaccttaacctc

SEQ ID NO: 14063 - DNA, 16 bp, Artificial Sequence
  synthetic [barcode part1]
tggtacaccttcgacc

SEQ ID NO: 14064 - DNA, 16 bp, Artificial Sequence
  synthetic [barcode part1]
taagtgactcgcctag

SEQ ID NO: 14065 - DNA, 16 bp, Artificial Sequence
  synthetic [barcode part1]
gagtccgtgttctacc

SEQ ID NO: 14066 - DNA, 16 bp, Artificial Sequence
  synthetic [barcode part1]
gcgcgatctccttaac

SEQ ID NO: 14067 - DNA, 16 bp, Artificial Sequence
  synthetic [barcode part1]
agtactgcaactggtc

SEQ ID NO: 14068 - DNA, 16 bp, Artificial Sequence
  synthetic [barcode part1]
aagtgaagttccagac

SEQ ID NO: 14069 - DNA, 16 bp, Artificial Sequence
  synthetic [barcode part1]
tggttgattagtcggc

SEQ ID NO: 14070 - DNA, 16 bp, Artificial Sequence
  synthetic [barcode part1]
ttgcaaggtagttgcc

SEQ ID NO: 14071 - DNA, 16 bp, Artificial Sequence
  synthetic [barcode part1]
acaccttctctgcact

SEQ ID NO: 14072 - DNA, 16 bp, Artificial Sequence
  synthetic [barcode part1]
aggatcgtacgaattg

SEQ ID NO: 14073 - DNA, 16 bp, Artificial Sequence
  synthetic [barcode part1]
tccagaagtcagtcac

SEQ ID NO: 14074 - DNA, 16 bp, Artificial Sequence
  synthetic [barcode part1]
ataggtacaaggttcg

SEQ ID NO: 14075 - DNA, 16 bp, Artificial Sequence
  synthetic [barcode part1]
gccggatataattcgc

SEQ ID NO: 14076 - DNA, 16 bp, Artificial Sequence
  synthetic [barcode part1]
gaaccgattgaggaag

SEQ ID NO: 14077 - DNA, 16 bp, Artificial Sequence
  synthetic [barcode part1]
tgtcctcaccactgag

SEQ ID NO: 14078 - DNA, 16 bp, Artificial Sequence
  synthetic [barcode part1]
gtgtgactcttgatct

SEQ ID NO: 14079 - DNA, 16 bp, Artificial Sequence
  synthetic [barcode part1]
tctaactgtatcggtc

SEQ ID NO: 14080 - DNA, 16 bp, Artificial Sequence
  synthetic [barcode part1]
tcacctgtggagttcc

SEQ ID NO: 14081 - DNA, 16 bp, Artificial Sequence
  synthetic [barcode part1]
aatagtggcaagttcg

SEQ ID NO: 14082 - DNA, 16 bp, Artificial Sequence
  synthetic [barcode part1]
gtaacctctaccgaag

SEQ ID NO: 14083 - DNA, 16 bp, Artificial Sequence
  synthetic [barcode part1]
cgtgtgagtccagatt

SEQ ID NO: 14084 - DNA, 16 bp, Artificial Sequence
  synthetic [barcode part1]
ttcgaagtgcgtgtac

SEQ ID NO: 14085 - DNA, 16 bp, Artificial Sequence
  synthetic [barcode part1]
gtcgagtacttctgtt

SEQ ID NO: 14086 - DNA, 16 bp, Artificial Sequence
  synthetic [barcode part1]
ccgactcactcaggtt

SEQ ID NO: 14087 - DNA, 16 bp, Artificial Sequence
  synthetic [barcode part1]
tcagaggtcttgtcag

SEQ ID NO: 14088 - DNA, 16 bp, Artificial Sequence
  synthetic [barcode part1]
cctgaggtcagaattc

SEQ ID NO: 14089 - DNA, 16 bp, Artificial Sequence
  synthetic [barcode part1]
gtgtctcagttcggtc

SEQ ID NO: 14090 - DNA, 16 bp, Artificial Sequence
  synthetic [barcode part1]
acggacaacgataccg

SEQ ID NO: 14091 - DNA, 16 bp, Artificial Sequence
  synthetic [barcode part1]
cacgtgaggtaatagt

SEQ ID NO: 14092 - DNA, 16 bp, Artificial Sequence
  synthetic [barcode part1]
gattcggtctcgcact

SEQ ID NO: 14093 - DNA, 16 bp, Artificial Sequence
  synthetic [barcode part1]
cgaacttggcgaagtg

SEQ ID NO: 14094 - DNA, 16 bp, Artificial Sequence
  synthetic [barcode part1]
agtggccagaacacac

SEQ ID NO: 14095 - DNA, 16 bp, Artificial Sequence
  synthetic [barcode part1]
cgtcacgaactctaag

SEQ ID NO: 14096 - DNA, 16 bp, Artificial Sequence
  synthetic [barcode part1]
gcgcactgataacgag

SEQ ID NO: 14097 - DNA, 16 bp, Artificial Sequence
  synthetic [barcode part1]
atataacgcgttggcc

SEQ ID NO: 14098 - DNA, 16 bp, Artificial Sequence
  synthetic [barcode part1]
acgactagtgcactac

SEQ ID NO: 14099 - DNA, 16 bp, Artificial Sequence
  synthetic [barcode part1]
gtgaccaactgtgtgt

SEQ ID NO: 14100 - DNA, 16 bp, Artificial Sequence
  synthetic [barcode part1]
atccacctgttgtggc

SEQ ID NO: 14101 - DNA, 16 bp, Artificial Sequence
  synthetic [barcode part1]
acgtacaaggagagac

SEQ ID NO: 14102 - DNA, 16 bp, Artificial Sequence
  synthetic [barcode part1]
tcaggtatcgccttgc

SEQ ID NO: 14103 - DNA, 16 bp, Artificial Sequence
  synthetic [barcode part1]
aatccacagacttgcg

SEQ ID NO: 14104 - DNA, 16 bp, Artificial Sequence
  synthetic [barcode part1]
tctataagacaaggcg

SEQ ID NO: 14105 - DNA, 16 bp, Artificial Sequence
  synthetic [barcode part1]
tccaactcgtgcggtt

SEQ ID NO: 14106 - DNA, 16 bp, Artificial Sequence
  synthetic [barcode part1]
gaacctaagtagtgac

SEQ ID NO: 14107 - DNA, 16 bp, Artificial Sequence
  synthetic [barcode part1]
tcaataatccgacggc

SEQ ID NO: 14108 - DNA, 16 bp, Artificial Sequence
  synthetic [barcode part1]
aactgcagttggtacc

SEQ ID NO: 14109 - DNA, 16 bp, Artificial Sequence
  synthetic [barcode part1]
gaactgttgaatcgcc

SEQ ID NO: 14110 - DNA, 16 bp, Artificial Sequence
  synthetic [barcode part1]
gtggattctggatacc

SEQ ID NO: 14111 - DNA, 16 bp, Artificial Sequence
  synthetic [barcode part1]
tgccgccagtaataac

SEQ ID NO: 14112 - DNA, 16 bp, Artificial Sequence
  synthetic [barcode part1]
caagtaagtggtactg

SEQ ID NO: 14113 - DNA, 16 bp, Artificial Sequence
  synthetic [barcode part1]
cacttatcaggcgaac

SEQ ID NO: 14114 - DNA, 16 bp, Artificial Sequence
  synthetic [barcode part1]
cggcaactacgttctc

SEQ ID NO: 14115 - DNA, 16 bp, Artificial Sequence
  synthetic [barcode part1]
gttcggcaagacacag

SEQ ID NO: 14116 - DNA, 16 bp, Artificial Sequence
  synthetic [barcode part1]
tctgattcgcaattgc

SEQ ID NO: 14117 - DNA, 16 bp, Artificial Sequence
  synthetic [barcode part1]
aactgcgattgcacgt

SEQ ID NO: 14118 - DNA, 16 bp, Artificial Sequence
  synthetic [barcode part1]
taacacaccggtacgt

SEQ ID NO: 14119 - DNA, 16 bp, Artificial Sequence
  synthetic [barcode part1]
aatcggccagttgact

SEQ ID NO: 14120 - DNA, 16 bp, Artificial Sequence
  synthetic [barcode part1]
agacctgcagaagatt

SEQ ID NO: 14121 - DNA, 16 bp, Artificial Sequence
  synthetic [barcode part1]
gcaagttacgcgattc

SEQ ID NO: 14122 - DNA, 16 bp, Artificial Sequence
  synthetic [barcode part1]
gtatacgtgtggtacc

SEQ ID NO: 14123 - DNA, 16 bp, Artificial Sequence
  synthetic [barcode part1]
gtgtgacaattcctct

SEQ ID NO: 14124 - DNA, 16 bp, Artificial Sequence
  synthetic [barcode part1]
cgtcggaactcttacc

SEQ ID NO: 14125 - DNA, 16 bp, Artificial Sequence
  synthetic [barcode part1]
taacgtgtggcggaac

SEQ ID NO: 14126 - DNA, 16 bp, Artificial Sequence
  synthetic [barcode part1]
ttcacagtggacactg

SEQ ID NO: 14127 - DNA, 16 bp, Artificial Sequence
  synthetic [barcode part1]
ttcacgtcacaggagt

SEQ ID NO: 14128 - DNA, 16 bp, Artificial Sequence
  synthetic [barcode part1]
cgccaactaatacacg

SEQ ID NO: 14129 - DNA, 16 bp, Artificial Sequence
  synthetic [barcode part1]
tctcggtactatcctc

SEQ ID NO: 14130 - DNA, 16 bp, Artificial Sequence
  synthetic [barcode part1]
gtgtatccagaggacg

SEQ ID NO: 14131 - DNA, 16 bp, Artificial Sequence
  synthetic [barcode part1]
cacgttaccagttccg

SEQ ID NO: 14132 - DNA, 16 bp, Artificial Sequence
  synthetic [barcode part1]
actcgcctgtcacagt

SEQ ID NO: 14133 - DNA, 16 bp, Artificial Sequence
  synthetic [barcode part1]
cgccggaagtaatctt

SEQ ID NO: 14134 - DNA, 16 bp, Artificial Sequence
  synthetic [barcode part1]
gcctatctgagacctc

SEQ ID NO: 14135 - DNA, 16 bp, Artificial Sequence
  synthetic [barcode part1]
tcggcgtaatctctcg

SEQ ID NO: 14136 - DNA, 16 bp, Artificial Sequence
  synthetic [barcode part1]
tctccgtgaaccgttg

SEQ ID NO: 14137 - DNA, 16 bp, Artificial Sequence
  synthetic [barcode part1]
aactgaaggcagtgag

SEQ ID NO: 14138 - DNA, 16 bp, Artificial Sequence
  synthetic [barcode part1]
aaggacgaagttgttc

SEQ ID NO: 14139 - DNA, 16 bp, Artificial Sequence
  synthetic [barcode part1]
acttccgttcagtaac

SEQ ID NO: 14140 - DNA, 16 bp, Artificial Sequence
  synthetic [barcode part1]
ttccggtccttatcac

SEQ ID NO: 14141 - DNA, 16 bp, Artificial Sequence
  synthetic [barcode part1]
actacgatcgcagtac

SEQ ID NO: 14142 - DNA, 16 bp, Artificial Sequence
  synthetic [barcode part1]
cgatactacgacactg

SEQ ID NO: 14143 - DNA, 16 bp, Artificial Sequence
  synthetic [barcode part1]
agataggtaggcgagt

SEQ ID NO: 14144 - DNA, 16 bp, Artificial Sequence
  synthetic [barcode part1]
accagaggattgagag

SEQ ID NO: 14145 - DNA, 16 bp, Artificial Sequence
  synthetic [barcode part1]
tgcactaagttggaag

SEQ ID NO: 14146 - DNA, 16 bp, Artificial Sequence
  synthetic [barcode part1]
accgtccgaacttatt

SEQ ID NO: 14147 - DNA, 16 bp, Artificial Sequence
  synthetic [barcode part1]
gacacgtgtacgttgt

SEQ ID NO: 14148 - DNA, 16 bp, Artificial Sequence
  synthetic [barcode part1]
ccgtgaattcgcaagt

SEQ ID NO: 14149 - DNA, 16 bp, Artificial Sequence
  synthetic [barcode part1]
caccgttagtagtgac

SEQ ID NO: 14150 - DNA, 16 bp, Artificial Sequence
  synthetic [barcode part1]
tactacgatcgcaacg

SEQ ID NO: 14151 - DNA, 16 bp, Artificial Sequence
  synthetic [barcode part1]
gtgtctcctggtgatc

SEQ ID NO: 14152 - DNA, 16 bp, Artificial Sequence
  synthetic [barcode part1]
taagtcgaggagtatc

SEQ ID NO: 14153 - DNA, 16 bp, Artificial Sequence
  synthetic [barcode part1]
atcgtgtagtccgtag

SEQ ID NO: 14154 - DNA, 16 bp, Artificial Sequence
  synthetic [barcode part1]
cacactagaccgagag

SEQ ID NO: 14155 - DNA, 16 bp, Artificial Sequence
  synthetic [barcode part1]
gagactctgtcacagt

SEQ ID NO: 14156 - DNA, 16 bp, Artificial Sequence
  synthetic [barcode part1]
attctacgtctagacc

SEQ ID NO: 14157 - DNA, 16 bp, Artificial Sequence
  synthetic [barcode part1]
agacggtcaatccttg

SEQ ID NO: 14158 - DNA, 16 bp, Artificial Sequence
  synthetic [barcode part1]
cgtcaccagacgttct

SEQ ID NO: 14159 - DNA, 16 bp, Artificial Sequence
  synthetic [barcode part1]
gttcgaactcggatac

SEQ ID NO: 14160 - DNA, 16 bp, Artificial Sequence
  synthetic [barcode part1]
agtcaggagatatctg

SEQ ID NO: 14161 - DNA, 16 bp, Artificial Sequence
  synthetic [barcode part1]
tcggcgttctcaatcg

SEQ ID NO: 14162 - DNA, 16 bp, Artificial Sequence
  synthetic [barcode part1]
acctaccgttctaggc

SEQ ID NO: 14163 - DNA, 16 bp, Artificial Sequence
  synthetic [barcode part1]
accactccacttggac

SEQ ID NO: 14164 - DNA, 16 bp, Artificial Sequence
  synthetic [barcode part1]
cacttagattgtcctg

SEQ ID NO: 14165 - DNA, 16 bp, Artificial Sequence
  synthetic [barcode part1]
cgattcctacagttac

SEQ ID NO: 14166 - DNA, 16 bp, Artificial Sequence
  synthetic [barcode part1]
tccaggccttgacttg

SEQ ID NO: 14167 - DNA, 16 bp, Artificial Sequence
  synthetic [barcode part1]
tatagtgcgtcacggt

SEQ ID NO: 14168 - DNA, 16 bp, Artificial Sequence
  synthetic [barcode part1]
ccacaagattccttgt

SEQ ID NO: 14169 - DNA, 16 bp, Artificial Sequence
  synthetic [barcode part1]
gcgtcagtataccaac

SEQ ID NO: 14170 - DNA, 16 bp, Artificial Sequence
  synthetic [barcode part1]
ccggaatctcagagtt

SEQ ID NO: 14171 - DNA, 16 bp, Artificial Sequence
  synthetic [barcode part1]
agtgcgacaggttgtg

SEQ ID NO: 14172 - DNA, 16 bp, Artificial Sequence
  synthetic [barcode part1]
attggcactcaattcc

SEQ ID NO: 14173 - DNA, 16 bp, Artificial Sequence
  synthetic [barcode part1]
caccgaacaccaagtt

SEQ ID NO: 14174 - DNA, 16 bp, Artificial Sequence
  synthetic [barcode part1]
aggatccgcgatatct

SEQ ID NO: 14175 - DNA, 16 bp, Artificial Sequence
  synthetic [barcode part1]
gtacgactcggtcctt

SEQ ID NO: 14176 - DNA, 16 bp, Artificial Sequence
  synthetic [barcode part1]
aaggcctgagttctgt

SEQ ID NO: 14177 - DNA, 16 bp, Artificial Sequence
  synthetic [barcode part1]
ccaatctagtgtacct

SEQ ID NO: 14178 - DNA, 16 bp, Artificial Sequence
  synthetic [barcode part1]
agtcttggcgaataag

SEQ ID NO: 14179 - DNA, 16 bp, Artificial Sequence
  synthetic [barcode part1]
atcacgattacctgtc

SEQ ID NO: 14180 - DNA, 16 bp, Artificial Sequence
  synthetic [barcode part1]
ttgagattctgtccgt

SEQ ID NO: 14181 - DNA, 16 bp, Artificial Sequence
  synthetic [barcode part1]
accttacgcctaagtt

SEQ ID NO: 14182 - DNA, 16 bp, Artificial Sequence
  synthetic [barcode part1]
aggttggtatacaacg

SEQ ID NO: 14183 - DNA, 16 bp, Artificial Sequence
  synthetic [barcode part1]
atctcagtacgcgtag

SEQ ID NO: 14184 - DNA, 16 bp, Artificial Sequence
  synthetic [barcode part1]
tgacgtgtcaacgtgt

SEQ ID NO: 14185 - DNA, 16 bp, Artificial Sequence
  synthetic [barcode part1]
caacgcggtacttaac

SEQ ID NO: 14186 - DNA, 16 bp, Artificial Sequence
  synthetic [barcode part1]
gttggtgcgttaacgt

SEQ ID NO: 14187 - DNA, 16 bp, Artificial Sequence
  synthetic [barcode part1]
cgtagttcgaccttcg

SEQ ID NO: 14188 - DNA, 16 bp, Artificial Sequence
  synthetic [barcode part1]
ttccgaactatctacg

SEQ ID NO: 14189 - DNA, 16 bp, Artificial Sequence
  synthetic [barcode part1]
gtgacacttctggagt

SEQ ID NO: 14190 - DNA, 16 bp, Artificial Sequence
  synthetic [barcode part1]
tcacaggttgccgtct

SEQ ID NO: 14191 - DNA, 16 bp, Artificial Sequence
  synthetic [barcode part1]
tcgtctagacactgtt

SEQ ID NO: 14192 - DNA, 16 bp, Artificial Sequence
  synthetic [barcode part1]
cgacctcacgttggtt

SEQ ID NO: 14193 - DNA, 16 bp, Artificial Sequence
  synthetic [barcode part1]
ttgacgttgtgtgacg

SEQ ID NO: 14194 - DNA, 16 bp, Artificial Sequence
  synthetic [barcode part1]
ttagaccggtcactag

SEQ ID NO: 14195 - DNA, 16 bp, Artificial Sequence
  synthetic [barcode part1]
gtgtagttcctccgac

SEQ ID NO: 14196 - DNA, 16 bp, Artificial Sequence
  synthetic [barcode part1]
ttacgagaagttggac

SEQ ID NO: 14197 - DNA, 16 bp, Artificial Sequence
  synthetic [barcode part1]
agttaccgcgacttag

SEQ ID NO: 14198 - DNA, 16 bp, Artificial Sequence
  synthetic [barcode part1]
actgcagtacctatct

SEQ ID NO: 14199 - DNA, 16 bp, Artificial Sequence
  synthetic [barcode part1]
cagtggtaccaagtct

SEQ ID NO: 14200 - DNA, 16 bp, Artificial Sequence
  synthetic [barcode part1]
gagaacgtccggtaac

SEQ ID NO: 14201 - DNA, 16 bp, Artificial Sequence
  synthetic [barcode part1]
cctggaacaatcgact

SEQ ID NO: 14202 - DNA, 16 bp, Artificial Sequence
  synthetic [barcode part1]
tggttctggttggagt

SEQ ID NO: 14203 - DNA, 16 bp, Artificial Sequence
  synthetic [barcode part1]
acgccttaatcgtcgc

SEQ ID NO: 14204 - DNA, 16 bp, Artificial Sequence
  synthetic [barcode part1]
ttgcctatccactcgt

SEQ ID NO: 14205 - DNA, 16 bp, Artificial Sequence
  synthetic [barcode part1]
ccggtgtacgtattag

SEQ ID NO: 14206 - DNA, 16 bp, Artificial Sequence
  synthetic [barcode part1]
aactggtggagagaac

SEQ ID NO: 14207 - DNA, 16 bp, Artificial Sequence
  synthetic [barcode part1]
tctggttaccagtact

SEQ ID NO: 14208 - DNA, 16 bp, Artificial Sequence
  synthetic [barcode part1]
tcctgtctgtctggag

SEQ ID NO: 14209 - DNA, 16 bp, Artificial Sequence
  synthetic [barcode part1]
tctcaacctagacgtt

SEQ ID NO: 14210 - DNA, 16 bp, Artificial Sequence
  synthetic [barcode part1]
tgtgacggtcttaggt

SEQ ID NO: 14211 - DNA, 16 bp, Artificial Sequence
  synthetic [barcode part1]
tcctcaaccttggtct

SEQ ID NO: 14212 - DNA, 16 bp, Artificial Sequence
  synthetic [barcode part1]
ttgacagaggtgtaac

SEQ ID NO: 14213 - DNA, 16 bp, Artificial Sequence
  synthetic [barcode part1]
tcaaccaccaactgag

SEQ ID NO: 14214 - DNA, 16 bp, Artificial Sequence
  synthetic [barcode part1]
agactacttgccagac

SEQ ID NO: 14215 - DNA, 16 bp, Artificial Sequence
  synthetic [barcode part1]
cggcgcaagagtagtt

SEQ ID NO: 14216 - DNA, 16 bp, Artificial Sequence
  synthetic [barcode part1]
attagtggtgagacgt

SEQ ID NO: 14217 - DNA, 16 bp, Artificial Sequence
  synthetic [barcode part1]
gtgagtggcaatattg

SEQ ID NO: 14218 - DNA, 16 bp, Artificial Sequence
  synthetic [barcode part1]
atcggacgacgatctt

SEQ ID NO: 14219 - DNA, 16 bp, Artificial Sequence
  synthetic [barcode part1]
attccgatctcctctg

SEQ ID NO: 14220 - DNA, 16 bp, Artificial Sequence
  synthetic [barcode part1]
cactactgtccggact

SEQ ID NO: 14221 - DNA, 16 bp, Artificial Sequence
  synthetic [barcode part1]
aggtgtgaattgtcag

SEQ ID NO: 14222 - DNA, 16 bp, Artificial Sequence
  synthetic [barcode part1]
ttatccgacagtgtct

SEQ ID NO: 14223 - DNA, 16 bp, Artificial Sequence
  synthetic [barcode part1]
acctccaactcagtgc

SEQ ID NO: 14224 - DNA, 16 bp, Artificial Sequence
  synthetic [barcode part1]
tctacgttgcactcct

SEQ ID NO: 14225 - DNA, 16 bp, Artificial Sequence
  synthetic [barcode part1]
agttattgacggtccg

SEQ ID NO: 14226 - DNA, 16 bp, Artificial Sequence
  synthetic [barcode part1]
gcgtcctccgacaatt

SEQ ID NO: 14227 - DNA, 16 bp, Artificial Sequence
  synthetic [barcode part1]
ttgaagaccggcacag

SEQ ID NO: 14228 - DNA, 16 bp, Artificial Sequence
  synthetic [barcode part1]
aatctgcgaacaacag

SEQ ID NO: 14229 - DNA, 16 bp, Artificial Sequence
  synthetic [barcode part1]
gcgtataactgaccac

SEQ ID NO: 14230 - DNA, 16 bp, Artificial Sequence
  synthetic [barcode part1]
gtagtggttcgacttg

SEQ ID NO: 14231 - DNA, 16 bp, Artificial Sequence
  synthetic [barcode part1]
atctccgataatccac

SEQ ID NO: 14232 - DNA, 16 bp, Artificial Sequence
  synthetic [barcode part1]
caagtatcacgccagt

SEQ ID NO: 14233 - DNA, 16 bp, Artificial Sequence
  synthetic [barcode part1]
cgtgtaacttgcagac

SEQ ID NO: 14234 - DNA, 16 bp, Artificial Sequence
  synthetic [barcode part1]
cgcacactgtgtatag

SEQ ID NO: 14235 - DNA, 16 bp, Artificial Sequence
  synthetic [barcode part1]
cggaggatagtcgtgt

SEQ ID NO: 14236 - DNA, 16 bp, Artificial Sequence
  synthetic [barcode part1]
aggtggatccgagatc

SEQ ID NO: 14237 - DNA, 16 bp, Artificial Sequence
  synthetic [barcode part1]
ccgcacacctcttaag

SEQ ID NO: 14238 - DNA, 16 bp, Artificial Sequence
  synthetic [barcode part1]
aaggcgacctattacc

SEQ ID NO: 14239 - DNA, 16 bp, Artificial Sequence
  synthetic [barcode part1]
gactgagtgccagtag

SEQ ID NO: 14240 - DNA, 16 bp, Artificial Sequence
  synthetic [barcode part1]
cagatcaatactctcc

SEQ ID NO: 14241 - DNA, 16 bp, Artificial Sequence
  synthetic [barcode part1]
ttcgagactaaccgac

SEQ ID NO: 14242 - DNA, 16 bp, Artificial Sequence
  synthetic [barcode part1]
aatcgacgcgtgtatc

SEQ ID NO: 14243 - DNA, 16 bp, Artificial Sequence
  synthetic [barcode part1]
cgatcggcaatactac

SEQ ID NO: 14244 - DNA, 16 bp, Artificial Sequence
  synthetic [barcode part1]
tctctaagtatcggtc

SEQ ID NO: 14245 - DNA, 16 bp, Artificial Sequence
  synthetic [barcode part1]
tccaattgccggtgtc

SEQ ID NO: 14246 - DNA, 16 bp, Artificial Sequence
  synthetic [barcode part1]
gaacaccttcactgtt

SEQ ID NO: 14247 - DNA, 16 bp, Artificial Sequence
  synthetic [barcode part1]
cgtcggtccttctaag

SEQ ID NO: 14248 - DNA, 16 bp, Artificial Sequence
  synthetic [barcode part1]
aaggagttactggtgt

SEQ ID NO: 14249 - DNA, 16 bp, Artificial Sequence
  synthetic [barcode part1]
atcagtgtccgacctc

SEQ ID NO: 14250 - DNA, 16 bp, Artificial Sequence
  synthetic [barcode part1]
aacggacagtaggtag

SEQ ID NO: 14251 - DNA, 16 bp, Artificial Sequence
  synthetic [barcode part1]
taaggatccacactcg

SEQ ID NO: 14252 - DNA, 16 bp, Artificial Sequence
  synthetic [barcode part1]
taccaggcggaagtgt

SEQ ID NO: 14253 - DNA, 16 bp, Artificial Sequence
  synthetic [barcode part1]
tgatcaggactagtcc

SEQ ID NO: 14254 - DNA, 16 bp, Artificial Sequence
  synthetic [barcode part1]
aggtgagagacctcac

SEQ ID NO: 14255 - DNA, 16 bp, Artificial Sequence
  synthetic [barcode part1]
ccgttgcaacaaggtt

SEQ ID NO: 14256 - DNA, 16 bp, Artificial Sequence
  synthetic [barcode part1]
ttgaggtgagtctcac

SEQ ID NO: 14257 - DNA, 16 bp, Artificial Sequence
  synthetic [barcode part1]
actaagaggccagaag

SEQ ID NO: 14258 - DNA, 16 bp, Artificial Sequence
  synthetic [barcode part1]
cctagaaccaaccaac

SEQ ID NO: 14259 - DNA, 16 bp, Artificial Sequence
  synthetic [barcode part1]
tctcacggtataggac

SEQ ID NO: 14260 - DNA, 16 bp, Artificial Sequence
  synthetic [barcode part1]
tattggcggtcttccg

SEQ ID NO: 14261 - DNA, 16 bp, Artificial Sequence
  synthetic [barcode part1]
ttggtccagacgttcc

SEQ ID NO: 14262 - DNA, 16 bp, Artificial Sequence
  synthetic [barcode part1]
tgtcggattcgtgcct

SEQ ID NO: 14263 - DNA, 16 bp, Artificial Sequence
  synthetic [barcode part1]
gtctcctgcacgttag

SEQ ID NO: 14264 - DNA, 16 bp, Artificial Sequence
  synthetic [barcode part1]
taggacgcggattcag

SEQ ID NO: 14265 - DNA, 16 bp, Artificial Sequence
  synthetic [barcode part1]
gcagaagtccttacac

SEQ ID NO: 14266 - DNA, 16 bp, Artificial Sequence
  synthetic [barcode part1]
tcttcggattgacgcc

SEQ ID NO: 14267 - DNA, 16 bp, Artificial Sequence
  synthetic [barcode part1]
agtcagtcaaccaacc

SEQ ID NO: 14268 - DNA, 16 bp, Artificial Sequence
  synthetic [barcode part1]
ttgaggcggacggatt

SEQ ID NO: 14269 - DNA, 16 bp, Artificial Sequence
  synthetic [barcode part1]
tagtgaaggcaagacg

SEQ ID NO: 14270 - DNA, 16 bp, Artificial Sequence
  synthetic [barcode part1]
tcttcgcaggtcactg

SEQ ID NO: 14271 - DNA, 16 bp, Artificial Sequence
  synthetic [barcode part1]
tggactgcacaggagt

SEQ ID NO: 14272 - DNA, 16 bp, Artificial Sequence
  synthetic [barcode part1]
gagtatccgaacgttc

SEQ ID NO: 14273 - DNA, 16 bp, Artificial Sequence
  synthetic [barcode part1]
ttgcgtaggagaaccg

SEQ ID NO: 14274 - DNA, 16 bp, Artificial Sequence
  synthetic [barcode part1]
tgaccaacacagtacc

SEQ ID NO: 14275 - DNA, 16 bp, Artificial Sequence
  synthetic [barcode part1]
aggtggaagtgtcgtc

SEQ ID NO: 14276 - DNA, 16 bp, Artificial Sequence
  synthetic [barcode part1]
tcgttacgaacgacgt

SEQ ID NO: 14277 - DNA, 16 bp, Artificial Sequence
  synthetic [barcode part1]
gattaagtcactgccg

SEQ ID NO: 14278 - DNA, 16 bp, Artificial Sequence
  synthetic [barcode part1]
tgttggagaactgtcc

SEQ ID NO: 14279 - DNA, 16 bp, Artificial Sequence
  synthetic [barcode part1]
tctctaactggtctcc

SEQ ID NO: 14280 - DNA, 16 bp, Artificial Sequence
  synthetic [barcode part1]
tagtcaaccgactggt

SEQ ID NO: 14281 - DNA, 16 bp, Artificial Sequence
  synthetic [barcode part1]
aggttgtctcggtaac

SEQ ID NO: 14282 - DNA, 16 bp, Artificial Sequence
  synthetic [barcode part1]
accaggtcaccttcgt

SEQ ID NO: 14283 - DNA, 16 bp, Artificial Sequence
  synthetic [barcode part1]
tgcgcgtatcaactag

SEQ ID NO: 14284 - DNA, 16 bp, Artificial Sequence
  synthetic [barcode part1]
aagacggcgttatctc

SEQ ID NO: 14285 - DNA, 16 bp, Artificial Sequence
  synthetic [barcode part1]
taagttattccacgcc

SEQ ID NO: 14286 - DNA, 16 bp, Artificial Sequence
  synthetic [barcode part1]
cctagtaacctccacg

SEQ ID NO: 14287 - DNA, 16 bp, Artificial Sequence
  synthetic [barcode part1]
tctgtattcctgcgtc

SEQ ID NO: 14288 - DNA, 16 bp, Artificial Sequence
  synthetic [barcode part1]
accacttgtgaatcct

SEQ ID NO: 14289 - DNA, 16 bp, Artificial Sequence
  synthetic [barcode part1]
gcgttctatcgtcgac

SEQ ID NO: 14290 - DNA, 16 bp, Artificial Sequence
  synthetic [barcode part1]
ttagtaacaggagtgc

SEQ ID NO: 14291 - DNA, 16 bp, Artificial Sequence
  synthetic [barcode part1]
tggagagaactccttc

SEQ ID NO: 14292 - DNA, 16 bp, Artificial Sequence
  synthetic [barcode part1]
ccaggataacgtcgtt

SEQ ID NO: 14293 - DNA, 16 bp, Artificial Sequence
  synthetic [barcode part1]
ttgttcgcactcgtct

SEQ ID NO: 14294 - DNA, 16 bp, Artificial Sequence
  synthetic [barcode part1]
attggcactgttatcc

SEQ ID NO: 14295 - DNA, 16 bp, Artificial Sequence
  synthetic [barcode part1]
agagacgtaaggacac

SEQ ID NO: 14296 - DNA, 16 bp, Artificial Sequence
  synthetic [barcode part1]
cgcaagacaactcgag

SEQ ID NO: 14297 - DNA, 16 bp, Artificial Sequence
  synthetic [barcode part1]
gcctacgatcgttctg

SEQ ID NO: 14298 - DNA, 16 bp, Artificial Sequence
  synthetic [barcode part1]
gcagttgttcttcagt

SEQ ID NO: 14299 - DNA, 16 bp, Artificial Sequence
  synthetic [barcode part1]
gaggtgtaccaccaag

SEQ ID NO: 14300 - DNA, 16 bp, Artificial Sequence
  synthetic [barcode part1]
tagtggcgacctagtt

SEQ ID NO: 14301 - DNA, 16 bp, Artificial Sequence
  synthetic [barcode part1]
tcttggtcgcggatct

SEQ ID NO: 14302 - DNA, 16 bp, Artificial Sequence
  synthetic [barcode part1]
taggcacaatcgcgtt

SEQ ID NO: 14303 - DNA, 16 bp, Artificial Sequence
  synthetic [barcode part1]
gagtctactcgactcc

SEQ ID NO: 14304 - DNA, 16 bp, Artificial Sequence
  synthetic [barcode part1]
agtctcaggacagacg

SEQ ID NO: 14305 - DNA, 16 bp, Artificial Sequence
  synthetic [barcode part1]
ttattcagtgacgcct

SEQ ID NO: 14306 - DNA, 16 bp, Artificial Sequence
  synthetic [barcode part1]
tgtaggtgacacttgc

SEQ ID NO: 14307 - DNA, 16 bp, Artificial Sequence
  synthetic [barcode part1]
gtatacgcagtcaacc

SEQ ID NO: 14308 - DNA, 16 bp, Artificial Sequence
  synthetic [barcode part1]
agaagacgaacgttct

SEQ ID NO: 14309 - DNA, 16 bp, Artificial Sequence
  synthetic [barcode part1]
gaccgtagtgtatcgt

SEQ ID NO: 14310 - DNA, 16 bp, Artificial Sequence
  synthetic [barcode part1]
atccaagtcgcgaatc

SEQ ID NO: 14311 - DNA, 16 bp, Artificial Sequence
  synthetic [barcode part1]
tacgtctcggaccgtt

SEQ ID NO: 14312 - DNA, 16 bp, Artificial Sequence
  synthetic [barcode part1]
tcggatagtctacgac

SEQ ID NO: 14313 - DNA, 16 bp, Artificial Sequence
  synthetic [barcode part1]
cggtcttcgtaattac

SEQ ID NO: 14314 - DNA, 16 bp, Artificial Sequence
  synthetic [barcode part1]
gcaatactggccaatc

SEQ ID NO: 14315 - DNA, 16 bp, Artificial Sequence
  synthetic [barcode part1]
cctattgccttcgact

SEQ ID NO: 14316 - DNA, 16 bp, Artificial Sequence
  synthetic [barcode part1]
tgtcagttgacacgtg

SEQ ID NO: 14317 - DNA, 16 bp, Artificial Sequence
  synthetic [barcode part1]
tcggagtgcctacctt

SEQ ID NO: 14318 - DNA, 16 bp, Artificial Sequence
  synthetic [barcode part1]
ccaggaatctcgttag

SEQ ID NO: 14319 - DNA, 16 bp, Artificial Sequence
  synthetic [barcode part1]
gagtgacacacagtcg

SEQ ID NO: 14320 - DNA, 16 bp, Artificial Sequence
  synthetic [barcode part1]
tggccggtataacgtt

SEQ ID NO: 14321 - DNA, 16 bp, Artificial Sequence
  synthetic [barcode part1]
gtcacagacttcaggt

SEQ ID NO: 14322 - DNA, 16 bp, Artificial Sequence
  synthetic [barcode part1]
ccgtcagtataagaag

SEQ ID NO: 14323 - DNA, 16 bp, Artificial Sequence
  synthetic [barcode part1]
gatcagtgatcagtcc

SEQ ID NO: 14324 - DNA, 16 bp, Artificial Sequence
  synthetic [barcode part1]
tgacggttgatccagt

SEQ ID NO: 14325 - DNA, 16 bp, Artificial Sequence
  synthetic [barcode part1]
acaggttcctccaacc

SEQ ID NO: 14326 - DNA, 16 bp, Artificial Sequence
  synthetic [barcode part1]
taccaaggaacacaac

SEQ ID NO: 14327 - DNA, 16 bp, Artificial Sequence
  synthetic [barcode part1]
ccagtggcaggaatac

SEQ ID NO: 14328 - DNA, 16 bp, Artificial Sequence
  synthetic [barcode part1]
acgtactggtacgttg

SEQ ID NO: 14329 - DNA, 16 bp, Artificial Sequence
  synthetic [barcode part1]
ttgcacacagtcacag

SEQ ID NO: 14330 - DNA, 16 bp, Artificial Sequence
  synthetic [barcode part1]
cctctaagtcggcgtt

SEQ ID NO: 14331 - DNA, 16 bp, Artificial Sequence
  synthetic [barcode part1]
acttgtgcgtaagtcg

SEQ ID NO: 14332 - DNA, 16 bp, Artificial Sequence
  synthetic [barcode part1]
gtactcacctaccacg

SEQ ID NO: 14333 - DNA, 16 bp, Artificial Sequence
  synthetic [barcode part1]
acgaatacaagacctg

SEQ ID NO: 14334 - DNA, 16 bp, Artificial Sequence
  synthetic [barcode part1]
attgcggtgcctgtct

SEQ ID NO: 14335 - DNA, 16 bp, Artificial Sequence
  synthetic [barcode part1]
cacaactgccaaggag

SEQ ID NO: 14336 - DNA, 16 bp, Artificial Sequence
  synthetic [barcode part1]
tgaccgagattgacct

SEQ ID NO: 14337 - DNA, 16 bp, Artificial Sequence
  synthetic [barcode part1]
acgttagaccgtctcc

SEQ ID NO: 14338 - DNA, 16 bp, Artificial Sequence
  synthetic [barcode part1]
tgcgtgacgtcttatt

SEQ ID NO: 14339 - DNA, 16 bp, Artificial Sequence
  synthetic [barcode part1]
taacctggcaacctag

SEQ ID NO: 14340 - DNA, 16 bp, Artificial Sequence
  synthetic [barcode part1]
aacggtcgtgccttct

SEQ ID NO: 14341 - DNA, 16 bp, Artificial Sequence
  synthetic [barcode part1]
acggattcggtaggac

SEQ ID NO: 14342 - DNA, 16 bp, Artificial Sequence
  synthetic [barcode part1]
ccttaagtctggagtg

SEQ ID NO: 14343 - DNA, 16 bp, Artificial Sequence
  synthetic [barcode part1]
gaacggttgatcttcg

SEQ ID NO: 14344 - DNA, 16 bp, Artificial Sequence
  synthetic [barcode part1]
ttctgtgcgatagtct

SEQ ID NO: 14345 - DNA, 16 bp, Artificial Sequence
  synthetic [barcode part1]
atatcctctggcgacc

SEQ ID NO: 14346 - DNA, 16 bp, Artificial Sequence
  synthetic [barcode part1]
cagaagaatcgacgtt

SEQ ID NO: 14347 - DNA, 16 bp, Artificial Sequence
  synthetic [barcode part1]
tgttaggacgaggacc

SEQ ID NO: 14348 - DNA, 16 bp, Artificial Sequence
  synthetic [barcode part1]
tgtaacggacagatac

SEQ ID NO: 14349 - DNA, 16 bp, Artificial Sequence
  synthetic [barcode part1]
ccgttcgaagtaggtt

SEQ ID NO: 14350 - DNA, 16 bp, Artificial Sequence
  synthetic [barcode part1]
ttgacagattcggtgc

SEQ ID NO: 14351 - DNA, 16 bp, Artificial Sequence
  synthetic [barcode part1]
tgcgagttctaggtgt

SEQ ID NO: 14352 - DNA, 16 bp, Artificial Sequence
  synthetic [barcode part1]
ttggtgaagacacaac

SEQ ID NO: 14353 - DNA, 16 bp, Artificial Sequence
  synthetic [barcode part1]
cctatattcgaatcgc

SEQ ID NO: 14354 - DNA, 16 bp, Artificial Sequence
  synthetic [barcode part1]
tcaggagttggcacag

SEQ ID NO: 14355 - DNA, 16 bp, Artificial Sequence
  synthetic [barcode part1]
gagacctcactgtagt

SEQ ID NO: 14356 - DNA, 16 bp, Artificial Sequence
  synthetic [barcode part1]
taacggtccttcgtgc

SEQ ID NO: 14357 - DNA, 16 bp, Artificial Sequence
  synthetic [barcode part1]
caaccgcgataacgag

SEQ ID NO: 14358 - DNA, 16 bp, Artificial Sequence
  synthetic [barcode part1]
tgttcttccggcagtg

SEQ ID NO: 14359 - DNA, 16 bp, Artificial Sequence
  synthetic [barcode part1]
gtcaatcttgagaccg

SEQ ID NO: 14360 - DNA, 16 bp, Artificial Sequence
  synthetic [barcode part1]
tgaacacagtcgtacc

SEQ ID NO: 14361 - DNA, 16 bp, Artificial Sequence
  synthetic [barcode part1]
aaggtcggcacgattg

SEQ ID NO: 14362 - DNA, 16 bp, Artificial Sequence
  synthetic [barcode part1]
acacgttgatagtgag

SEQ ID NO: 14363 - DNA, 16 bp, Artificial Sequence
  synthetic [barcode part1]
cgaacacgatctgtgt

SEQ ID NO: 14364 - DNA, 16 bp, Artificial Sequence
  synthetic [barcode part1]
gttcttactcgcactc

SEQ ID NO: 14365 - DNA, 16 bp, Artificial Sequence
  synthetic [barcode part1]
gcagtattgcgatacc

SEQ ID NO: 14366 - DNA, 16 bp, Artificial Sequence
  synthetic [barcode part1]
acggtataaggaggac

SEQ ID NO: 14367 - DNA, 16 bp, Artificial Sequence
  synthetic [barcode part1]
ttgacggaagtcacct

SEQ ID NO: 14368 - DNA, 16 bp, Artificial Sequence
  synthetic [barcode part1]
cgagtcacaacagtct

SEQ ID NO: 14369 - DNA, 16 bp, Artificial Sequence
  synthetic [barcode part1]
gcaggtaagtgttgcg

SEQ ID NO: 14370 - DNA, 16 bp, Artificial Sequence
  synthetic [barcode part1]
atcagactactcctac

SEQ ID NO: 14371 - DNA, 16 bp, Artificial Sequence
  synthetic [barcode part1]
taaccgtacgactacg

SEQ ID NO: 14372 - DNA, 16 bp, Artificial Sequence
  synthetic [barcode part1]
ttcttccgaagtctcc

SEQ ID NO: 14373 - DNA, 16 bp, Artificial Sequence
  synthetic [barcode part1]
tacacacggagttctg

SEQ ID NO: 14374 - DNA, 16 bp, Artificial Sequence
  synthetic [barcode part1]
cagtagtggtctagtc

SEQ ID NO: 14375 - DNA, 16 bp, Artificial Sequence
  synthetic [barcode part1]
gtactggtgatagagt

SEQ ID NO: 14376 - DNA, 16 bp, Artificial Sequence
  synthetic [barcode part1]
actagtcggccaattg

SEQ ID NO: 14377 - DNA, 16 bp, Artificial Sequence
  synthetic [barcode part1]
taccaacttctaaccg

SEQ ID NO: 14378 - DNA, 16 bp, Artificial Sequence
  synthetic [barcode part1]
caaccgaaggacttct

SEQ ID NO: 14379 - DNA, 16 bp, Artificial Sequence
  synthetic [barcode part1]
tcctccttctcgaagt

SEQ ID NO: 14380 - DNA, 16 bp, Artificial Sequence
  synthetic [barcode part1]
gtatccttctcgcgtt

SEQ ID NO: 14381 - DNA, 16 bp, Artificial Sequence
  synthetic [barcode part1]
ccagataagtagaacc

SEQ ID NO: 14382 - DNA, 16 bp, Artificial Sequence
  synthetic [barcode part1]
gaagaagtcctgagag

SEQ ID NO: 14383 - DNA, 16 bp, Artificial Sequence
  synthetic [barcode part1]
tcgataatccgtacct

SEQ ID NO: 14384 - DNA, 16 bp, Artificial Sequence
  synthetic [barcode part1]
tacctatccgtagtac

SEQ ID NO: 14385 - DNA, 16 bp, Artificial Sequence
  synthetic [barcode part1]
aacactccacttcgcg

SEQ ID NO: 14386 - DNA, 16 bp, Artificial Sequence
  synthetic [barcode part1]
cctgccagttacttct

SEQ ID NO: 14387 - DNA, 16 bp, Artificial Sequence
  synthetic [barcode part1]
gttctcaacggaggtt

SEQ ID NO: 14388 - DNA, 16 bp, Artificial Sequence
  synthetic [barcode part1]
gttccgttgttagtac

SEQ ID NO: 14389 - DNA, 16 bp, Artificial Sequence
  synthetic [barcode part1]
gtggtgtacgtgtgtt

SEQ ID NO: 14390 - DNA, 16 bp, Artificial Sequence
  synthetic [barcode part1]
gaggtggtagacgtct

SEQ ID NO: 14391 - DNA, 16 bp, Artificial Sequence
  synthetic [barcode part1]
aaggacacgtctctgt

SEQ ID NO: 14392 - DNA, 16 bp, Artificial Sequence
  synthetic [barcode part1]
ccgagataggcggatt

SEQ ID NO: 14393 - DNA, 16 bp, Artificial Sequence
  synthetic [barcode part1]
ccaacaggaaccactt

SEQ ID NO: 14394 - DNA, 16 bp, Artificial Sequence
  synthetic [barcode part1]
gcgcggaacaatctag

SEQ ID NO: 14395 - DNA, 16 bp, Artificial Sequence
  synthetic [barcode part1]
aacctacaccttgccg

SEQ ID NO: 14396 - DNA, 16 bp, Artificial Sequence
  synthetic [barcode part1]
cagtaaccgactcaac

SEQ ID NO: 14397 - DNA, 16 bp, Artificial Sequence
  synthetic [barcode part1]
caattcgaacacgaag

SEQ ID NO: 14398 - DNA, 16 bp, Artificial Sequence
  synthetic [barcode part1]
cacgaacgagttcact

SEQ ID NO: 14399 - DNA, 16 bp, Artificial Sequence
  synthetic [barcode part1]
tgttcgtcggaattct

SEQ ID NO: 14400 - DNA, 16 bp, Artificial Sequence
  synthetic [barcode part1]
ccttcaatagttgcgt

SEQ ID NO: 14401 - DNA, 16 bp, Artificial Sequence
  synthetic [barcode part1]
gtggagttactcggag

SEQ ID NO: 14402 - DNA, 16 bp, Artificial Sequence
  synthetic [barcode part1]
tcgtagtgtcgtagtg

SEQ ID NO: 14403 - DNA, 16 bp, Artificial Sequence
  synthetic [barcode part1]
ccgtaagttgccgtct

SEQ ID NO: 14404 - DNA, 16 bp, Artificial Sequence
  synthetic [barcode part1]
cgttgtcactccttac

SEQ ID NO: 14405 - DNA, 16 bp, Artificial Sequence
  synthetic [barcode part1]
tcttcctcgtgtgtac

SEQ ID NO: 14406 - DNA, 16 bp, Artificial Sequence
  synthetic [barcode part1]
cctaccgtgtaccagt

SEQ ID NO: 14407 - DNA, 16 bp, Artificial Sequence
  synthetic [barcode part1]
actcaggtcacctcgt

SEQ ID NO: 14408 - DNA, 16 bp, Artificial Sequence
  synthetic [barcode part1]
cgtacaggcaaggtgt

SEQ ID NO: 14409 - DNA, 16 bp, Artificial Sequence
  synthetic [barcode part1]
gaaggcaacctaatac

SEQ ID NO: 14410 - DNA, 16 bp, Artificial Sequence
  synthetic [barcode part1]
tcaggtgaacagaact

SEQ ID NO: 14411 - DNA, 16 bp, Artificial Sequence
  synthetic [barcode part1]
agacttgaacacgtcc

SEQ ID NO: 14412 - DNA, 16 bp, Artificial Sequence
  synthetic [barcode part1]
ttcggtcactacgtgc

SEQ ID NO: 14413 - DNA, 16 bp, Artificial Sequence
  synthetic [barcode part1]
gccttctgttgtgcag

SEQ ID NO: 14414 - DNA, 16 bp, Artificial Sequence
  synthetic [barcode part1]
ccagttcctacgtgac

SEQ ID NO: 14415 - DNA, 16 bp, Artificial Sequence
  synthetic [barcode part1]
cgtacgaatctcttgt

SEQ ID NO: 14416 - DNA, 16 bp, Artificial Sequence
  synthetic [barcode part1]
ttgcgcctaagaacgt

SEQ ID NO: 14417 - DNA, 16 bp, Artificial Sequence
  synthetic [barcode part1]
cacgagtgtcctgtct

SEQ ID NO: 14418 - DNA, 16 bp, Artificial Sequence
  synthetic [barcode part1]
gatacaacactagacg

SEQ ID NO: 14419 - DNA, 16 bp, Artificial Sequence
  synthetic [barcode part1]
tatcgacagttaggag

SEQ ID NO: 14420 - DNA, 16 bp, Artificial Sequence
  synthetic [barcode part1]
ttggtgtggccagaag

SEQ ID NO: 14421 - DNA, 16 bp, Artificial Sequence
  synthetic [barcode part1]
tccaaggtgcggtatt

SEQ ID NO: 14422 - DNA, 16 bp, Artificial Sequence
  synthetic [barcode part1]
ttaaggactggacgcg

SEQ ID NO: 14423 - DNA, 16 bp, Artificial Sequence
  synthetic [barcode part1]
tggagacagaccgttg

SEQ ID NO: 14424 - DNA, 16 bp, Artificial Sequence
  synthetic [barcode part1]
accgcagttcgttcac

SEQ ID NO: 14425 - DNA, 16 bp, Artificial Sequence
  synthetic [barcode part1]
gtacgattggttgtgc

SEQ ID NO: 14426 - DNA, 16 bp, Artificial Sequence
  synthetic [barcode part1]
agaccaggttacgcag

SEQ ID NO: 14427 - DNA, 16 bp, Artificial Sequence
  synthetic [barcode part1]
tacttacaacggacgc

SEQ ID NO: 14428 - DNA, 16 bp, Artificial Sequence
  synthetic [barcode part1]
agtagagaaggcgact

SEQ ID NO: 14429 - DNA, 16 bp, Artificial Sequence
  synthetic [barcode part1]
gtgttctgactgccgt

SEQ ID NO: 14430 - DNA, 16 bp, Artificial Sequence
  synthetic [barcode part1]
aagacgacgaacactt

SEQ ID NO: 14431 - DNA, 16 bp, Artificial Sequence
  synthetic [barcode part1]
tcgtgatatacgcacg

SEQ ID NO: 14432 - DNA, 16 bp, Artificial Sequence
  synthetic [barcode part1]
actcttaaggtgtggc

SEQ ID NO: 14433 - DNA, 16 bp, Artificial Sequence
  synthetic [barcode part1]
caggtgaatctacctg

SEQ ID NO: 14434 - DNA, 16 bp, Artificial Sequence
  synthetic [barcode part1]
aaggccaactagagag

SEQ ID NO: 14435 - DNA, 16 bp, Artificial Sequence
  synthetic [barcode part1]
actattccgtccaggc

SEQ ID NO: 14436 - DNA, 16 bp, Artificial Sequence
  synthetic [barcode part1]
gtagtaaggtgtactg

SEQ ID NO: 14437 - DNA, 16 bp, Artificial Sequence
  synthetic [barcode part1]
ttgattccagactcac

SEQ ID NO: 14438 - DNA, 16 bp, Artificial Sequence
  synthetic [barcode part1]
gtcgaagaatcaggag

SEQ ID NO: 14439 - DNA, 16 bp, Artificial Sequence
  synthetic [barcode part1]
gcgacgtatattgcac

SEQ ID NO: 14440 - DNA, 16 bp, Artificial Sequence
  synthetic [barcode part1]
cctctctgtcgtaact

SEQ ID NO: 14441 - DNA, 16 bp, Artificial Sequence
  synthetic [barcode part1]
aattggagtagtcacg

SEQ ID NO: 14442 - DNA, 16 bp, Artificial Sequence
  synthetic [barcode part1]
gtccacggtatagttg

SEQ ID NO: 14443 - DNA, 16 bp, Artificial Sequence
  synthetic [barcode part1]
acaggcagataggtag

SEQ ID NO: 14444 - DNA, 16 bp, Artificial Sequence
  synthetic [barcode part1]
tcgtaaggtctcttac

SEQ ID NO: 14445 - DNA, 16 bp, Artificial Sequence
  synthetic [barcode part1]
gacgttgcacagtact

SEQ ID NO: 14446 - DNA, 16 bp, Artificial Sequence
  synthetic [barcode part1]
tgacctatagagacag

SEQ ID NO: 14447 - DNA, 16 bp, Artificial Sequence
  synthetic [barcode part1]
tcagacacagaacaac

SEQ ID NO: 14448 - DNA, 16 bp, Artificial Sequence
  synthetic [barcode part1]
gccaagaattagtgtg

SEQ ID NO: 14449 - DNA, 16 bp, Artificial Sequence
  synthetic [barcode part1]
attctcgtggatcact

SEQ ID NO: 14450 - DNA, 16 bp, Artificial Sequence
  synthetic [barcode part1]
ttcctctccaggattc

SEQ ID NO: 14451 - DNA, 16 bp, Artificial Sequence
  synthetic [barcode part1]
tatcactgcgaggtac

SEQ ID NO: 14452 - DNA, 16 bp, Artificial Sequence
  synthetic [barcode part1]
gccacggtacctatct

SEQ ID NO: 14453 - DNA, 16 bp, Artificial Sequence
  synthetic [barcode part1]
gcagattgaagactac

SEQ ID NO: 14454 - DNA, 16 bp, Artificial Sequence
  synthetic [barcode part1]
tctcaatagttacgcc

SEQ ID NO: 14455 - DNA, 16 bp, Artificial Sequence
  synthetic [barcode part1]
ccttacgcaacgatcc

SEQ ID NO: 14456 - DNA, 16 bp, Artificial Sequence
  synthetic [barcode part1]
attggtgacaaccgtc

SEQ ID NO: 14457 - DNA, 16 bp, Artificial Sequence
  synthetic [barcode part1]
tgtcaggcactggatt

SEQ ID NO: 14458 - DNA, 16 bp, Artificial Sequence
  synthetic [barcode part1]
tgaagttgcgttgcgt

SEQ ID NO: 14459 - DNA, 16 bp, Artificial Sequence
  synthetic [barcode part1]
ttgtgtccgttagact

SEQ ID NO: 14460 - DNA, 16 bp, Artificial Sequence
  synthetic [barcode part1]
aattccgttcaggacg

SEQ ID NO: 14461 - DNA, 16 bp, Artificial Sequence
  synthetic [barcode part1]
tataacgccacctgtt

SEQ ID NO: 14462 - DNA, 16 bp, Artificial Sequence
  synthetic [barcode part1]
ttagtccaacgtgtct

SEQ ID NO: 14463 - DNA, 16 bp, Artificial Sequence
  synthetic [barcode part1]
gagacacagtctgacg

SEQ ID NO: 14464 - DNA, 16 bp, Artificial Sequence
  synthetic [barcode part1]
taggcgtcttctagtt

SEQ ID NO: 14465 - DNA, 16 bp, Artificial Sequence
  synthetic [barcode part1]
atcaagtcggaccact

SEQ ID NO: 14466 - DNA, 16 bp, Artificial Sequence
  synthetic [barcode part1]
acagtgtgttgaccac

SEQ ID NO: 14467 - DNA, 16 bp, Artificial Sequence
  synthetic [barcode part1]
tagtcactcgtgcaag

SEQ ID NO: 14468 - DNA, 16 bp, Artificial Sequence
  synthetic [barcode part1]
taaccgacggtatcac

SEQ ID NO: 14469 - DNA, 16 bp, Artificial Sequence
  synthetic [barcode part1]
tgtgtccgagttgtcc

SEQ ID NO: 14470 - DNA, 16 bp, Artificial Sequence
  synthetic [barcode part1]
ccggataacggcaagt

SEQ ID NO: 14471 - DNA, 16 bp, Artificial Sequence
  synthetic [barcode part1]
ttgaagaacgtgactg

SEQ ID NO: 14472 - DNA, 16 bp, Artificial Sequence
  synthetic [barcode part1]
gttgaatcttgtgcct

SEQ ID NO: 14473 - DNA, 16 bp, Artificial Sequence
  synthetic [barcode part1]
tactggtactgacgtg

SEQ ID NO: 14474 - DNA, 16 bp, Artificial Sequence
  synthetic [barcode part1]
acagagacgacctggt

SEQ ID NO: 14475 - DNA, 16 bp, Artificial Sequence
  synthetic [barcode part1]
gtgcaccttaccactg

SEQ ID NO: 14476 - DNA, 16 bp, Artificial Sequence
  synthetic [barcode part1]
taaccttactagtgcc

SEQ ID NO: 14477 - DNA, 16 bp, Artificial Sequence
  synthetic [barcode part1]
tgtgttctccagtagt

SEQ ID NO: 14478 - DNA, 16 bp, Artificial Sequence
  synthetic [barcode part1]
tgcgaacgcaagtctt

SEQ ID NO: 14479 - DNA, 16 bp, Artificial Sequence
  synthetic [barcode part1]
acacttccgtgttcct

SEQ ID NO: 14480 - DNA, 16 bp, Artificial Sequence
  synthetic [barcode part1]
ttccgacaatcgtgcc

SEQ ID NO: 14481 - DNA, 16 bp, Artificial Sequence
  synthetic [barcode part1]
aacctgtcctactgcg

SEQ ID NO: 14482 - DNA, 16 bp, Artificial Sequence
  synthetic [barcode part1]
agtgttggtgtacacc

SEQ ID NO: 14483 - DNA, 16 bp, Artificial Sequence
  synthetic [barcode part1]
tagaccaggagtacgc

SEQ ID NO: 14484 - DNA, 16 bp, Artificial Sequence
  synthetic [barcode part1]
gagtatacggcgatcg

SEQ ID NO: 14485 - DNA, 16 bp, Artificial Sequence
  synthetic [barcode part1]
cgttgttgcaatcact

SEQ ID NO: 14486 - DNA, 16 bp, Artificial Sequence
  synthetic [barcode part1]
ttcaggaccttggaac

SEQ ID NO: 14487 - DNA, 16 bp, Artificial Sequence
  synthetic [barcode part1]
tgcagacctgccttgt

SEQ ID NO: 14488 - DNA, 16 bp, Artificial Sequence
  synthetic [barcode part1]
cgatactgtgaacaag

SEQ ID NO: 14489 - DNA, 16 bp, Artificial Sequence
  synthetic [barcode part1]
acgtgtgaaccaacct

SEQ ID NO: 14490 - DNA, 16 bp, Artificial Sequence
  synthetic [barcode part1]
gtgcgtaatcgtggtt

SEQ ID NO: 14491 - DNA, 16 bp, Artificial Sequence
  synthetic [barcode part1]
gattggttcgatcgac

SEQ ID NO: 14492 - DNA, 16 bp, Artificial Sequence
  synthetic [barcode part1]
tgagtaagtctgtccg

SEQ ID NO: 14493 - DNA, 16 bp, Artificial Sequence
  synthetic [barcode part1]
cgactctcacggttac

SEQ ID NO: 14494 - DNA, 16 bp, Artificial Sequence
  synthetic [barcode part1]
gagagtctgtgcaacg

SEQ ID NO: 14495 - DNA, 16 bp, Artificial Sequence
  synthetic [barcode part1]
aacaacactacgagtg

SEQ ID NO: 14496 - DNA, 16 bp, Artificial Sequence
  synthetic [barcode part1]
taagtgcgcacctaac

SEQ ID NO: 14497 - DNA, 16 bp, Artificial Sequence
  synthetic [barcode part1]
tgcgtaggtagtcact

SEQ ID NO: 14498 - DNA, 16 bp, Artificial Sequence
  synthetic [barcode part1]
attcttgtgtcaggtc

SEQ ID NO: 14499 - DNA, 16 bp, Artificial Sequence
  synthetic [barcode part1]
ttcaccagtactcagt

SEQ ID NO: 14500 - DNA, 16 bp, Artificial Sequence
  synthetic [barcode part1]
gtacacttgtcttacg

SEQ ID NO: 14501 - DNA, 16 bp, Artificial Sequence
  synthetic [barcode part1]
gcagttggatcctcct

SEQ ID NO: 14502 - DNA, 16 bp, Artificial Sequence
  synthetic [barcode part1]
cagagtcacacgtact

SEQ ID NO: 14503 - DNA, 16 bp, Artificial Sequence
  synthetic [barcode part1]
gtatcgaatatccggc

SEQ ID NO: 14504 - DNA, 16 bp, Artificial Sequence
  synthetic [barcode part1]
gtccgttaacagacac

SEQ ID NO: 14505 - DNA, 16 bp, Artificial Sequence
  synthetic [barcode part1]
tgtgatctcagacacg

SEQ ID NO: 14506 - DNA, 16 bp, Artificial Sequence
  synthetic [barcode part1]
tggccaagttgcgatt

SEQ ID NO: 14507 - DNA, 16 bp, Artificial Sequence
  synthetic [barcode part1]
tgacttgttcgtgccg

SEQ ID NO: 14508 - DNA, 16 bp, Artificial Sequence
  synthetic [barcode part1]
cggactactctgcact

SEQ ID NO: 14509 - DNA, 16 bp, Artificial Sequence
  synthetic [barcode part1]
atcgacaccaccgttc

SEQ ID NO: 14510 - DNA, 16 bp, Artificial Sequence
  synthetic [barcode part1]
acagttgattacgcgc

SEQ ID NO: 14511 - DNA, 16 bp, Artificial Sequence
  synthetic [barcode part1]
tcggtaagtaagaacc

SEQ ID NO: 14512 - DNA, 16 bp, Artificial Sequence
  synthetic [barcode part1]
gtcaagttaaggacac

SEQ ID NO: 14513 - DNA, 16 bp, Artificial Sequence
  synthetic [barcode part1]
gcgtaattgacacacc

SEQ ID NO: 14514 - DNA, 16 bp, Artificial Sequence
  synthetic [barcode part1]
aacggagttaagtacc

SEQ ID NO: 14515 - DNA, 16 bp, Artificial Sequence
  synthetic [barcode part1]
agatactcctgtcact

SEQ ID NO: 14516 - DNA, 16 bp, Artificial Sequence
  synthetic [barcode part1]
tcaggttgactaccag

SEQ ID NO: 14517 - DNA, 16 bp, Artificial Sequence
  synthetic [barcode part1]
tgtagaaggttcagtg

SEQ ID NO: 14518 - DNA, 16 bp, Artificial Sequence
  synthetic [barcode part1]
tggtaactcctgtatc

SEQ ID NO: 14519 - DNA, 16 bp, Artificial Sequence
  synthetic [barcode part1]
aggtgacggttgtgtg

SEQ ID NO: 14520 - DNA, 16 bp, Artificial Sequence
  synthetic [barcode part1]
gtacctccagtgatcc

SEQ ID NO: 14521 - DNA, 16 bp, Artificial Sequence
  synthetic [barcode part1]
cagatcgcgtagaggt

SEQ ID NO: 14522 - DNA, 16 bp, Artificial Sequence
  synthetic [barcode part1]
tacttcaattcgcgac

SEQ ID NO: 14523 - DNA, 16 bp, Artificial Sequence
  synthetic [barcode part1]
cgttatcagaccgagt

SEQ ID NO: 14524 - DNA, 16 bp, Artificial Sequence
  synthetic [barcode part1]
gcgacggtgaattcag

SEQ ID NO: 14525 - DNA, 16 bp, Artificial Sequence
  synthetic [barcode part1]
cgccgccacaactatt

SEQ ID NO: 14526 - DNA, 16 bp, Artificial Sequence
  synthetic [barcode part1]
ccgacttcgtcagtac

SEQ ID NO: 14527 - DNA, 16 bp, Artificial Sequence
  synthetic [barcode part1]
tcagtggatagagact

SEQ ID NO: 14528 - DNA, 16 bp, Artificial Sequence
  synthetic [barcode part1]
tcaccaactccacgtg

SEQ ID NO: 14529 - DNA, 16 bp, Artificial Sequence
  synthetic [barcode part1]
agaatcctcgtctgcc

SEQ ID NO: 14530 - DNA, 16 bp, Artificial Sequence
  synthetic [barcode part1]
agaataccggtctaag

SEQ ID NO: 14531 - DNA, 16 bp, Artificial Sequence
  synthetic [barcode part1]
tgcagttgcgtgattg

SEQ ID NO: 14532 - DNA, 16 bp, Artificial Sequence
  synthetic [barcode part1]
tgaagtcacacacgtc

SEQ ID NO: 14533 - DNA, 16 bp, Artificial Sequence
  synthetic [barcode part1]
tccgtggaggcaatag

SEQ ID NO: 14534 - DNA, 16 bp, Artificial Sequence
  synthetic [barcode part1]
acacggtcgcaattgt

SEQ ID NO: 14535 - DNA, 16 bp, Artificial Sequence
  synthetic [barcode part1]
cgttcgccgaagttct

SEQ ID NO: 14536 - DNA, 16 bp, Artificial Sequence
  synthetic [barcode part1]
gatcacttctggcaag

SEQ ID NO: 14537 - DNA, 16 bp, Artificial Sequence
  synthetic [barcode part1]
gattgcgtgtagtcgt

SEQ ID NO: 14538 - DNA, 16 bp, Artificial Sequence
  synthetic [barcode part1]
acacgccgataacgag

SEQ ID NO: 14539 - DNA, 16 bp, Artificial Sequence
  synthetic [barcode part1]
ccggaattctgcctgt

SEQ ID NO: 14540 - DNA, 16 bp, Artificial Sequence
  synthetic [barcode part1]
gttggcagttcgaact

SEQ ID NO: 14541 - DNA, 16 bp, Artificial Sequence
  synthetic [barcode part1]
ccttcctagttccagt

SEQ ID NO: 14542 - DNA, 16 bp, Artificial Sequence
  synthetic [barcode part1]
actggttagtcggttg

SEQ ID NO: 14543 - DNA, 16 bp, Artificial Sequence
  synthetic [barcode part1]
cagacagaacgtcgtg

SEQ ID NO: 14544 - DNA, 16 bp, Artificial Sequence
  synthetic [barcode part1]
aatctctggaacggtc

SEQ ID NO: 14545 - DNA, 16 bp, Artificial Sequence
  synthetic [barcode part1]
cagttctcacaactgt

SEQ ID NO: 14546 - DNA, 16 bp, Artificial Sequence
  synthetic [barcode part1]
aactgtgtgtgcagtc

SEQ ID NO: 14547 - DNA, 16 bp, Artificial Sequence
  synthetic [barcode part1]
gaaggtcctaatcctg

SEQ ID NO: 14548 - DNA, 16 bp, Artificial Sequence
  synthetic [barcode part1]
gcaataagaaccggag

SEQ ID NO: 14549 - DNA, 16 bp, Artificial Sequence
  synthetic [barcode part1]
atcgcggaatatcgtc

SEQ ID NO: 14550 - DNA, 16 bp, Artificial Sequence
  synthetic [barcode part1]
agactgtaagtgcggc

SEQ ID NO: 14551 - DNA, 16 bp, Artificial Sequence
  synthetic [barcode part1]
cgcgtctagtacaagt

SEQ ID NO: 14552 - DNA, 16 bp, Artificial Sequence
  synthetic [barcode part1]
tcttgacctccactgt

SEQ ID NO: 14553 - DNA, 16 bp, Artificial Sequence
  synthetic [barcode part1]
cgaagaattctggcct

SEQ ID NO: 14554 - DNA, 16 bp, Artificial Sequence
  synthetic [barcode part1]
gagtgtcggtggaact

SEQ ID NO: 14555 - DNA, 16 bp, Artificial Sequence
  synthetic [barcode part1]
agagagatctcctctg

SEQ ID NO: 14556 - DNA, 16 bp, Artificial Sequence
  synthetic [barcode part1]
aactaatcgcggtacc

SEQ ID NO: 14557 - DNA, 16 bp, Artificial Sequence
  synthetic [barcode part1]
tcagacaagacctgtc

SEQ ID NO: 14558 - DNA, 16 bp, Artificial Sequence
  synthetic [barcode part1]
acgatcgacacactgt

SEQ ID NO: 14559 - DNA, 16 bp, Artificial Sequence
  synthetic [barcode part1]
gttaggttgccgaatc

SEQ ID NO: 14560 - DNA, 16 bp, Artificial Sequence
  synthetic [barcode part1]
ttataccactcggtac

SEQ ID NO: 14561 - DNA, 16 bp, Artificial Sequence
  synthetic [barcode part1]
attcttggtctccacc

SEQ ID NO: 14562 - DNA, 16 bp, Artificial Sequence
  synthetic [barcode part1]
gttctcaggcaatctt

SEQ ID NO: 14563 - DNA, 16 bp, Artificial Sequence
  synthetic [barcode part1]
acaatagacggttacg

SEQ ID NO: 14564 - DNA, 16 bp, Artificial Sequence
  synthetic [barcode part1]
taggtcggtcgaatct

SEQ ID NO: 14565 - DNA, 16 bp, Artificial Sequence
  synthetic [barcode part1]
gagattaggagtggtg

SEQ ID NO: 14566 - DNA, 16 bp, Artificial Sequence
  synthetic [barcode part1]
aggtatagtcagactg

SEQ ID NO: 14567 - DNA, 16 bp, Artificial Sequence
  synthetic [barcode part1]
tccaggacttctctct

SEQ ID NO: 14568 - DNA, 16 bp, Artificial Sequence
  synthetic [barcode part1]
tgaggactgtcagacg

SEQ ID NO: 14569 - DNA, 16 bp, Artificial Sequence
  synthetic [barcode part1]
gacaggactaacgtgc

SEQ ID NO: 14570 - DNA, 16 bp, Artificial Sequence
  synthetic [barcode part1]
ccggataacaagtcct

SEQ ID NO: 14571 - DNA, 16 bp, Artificial Sequence
  synthetic [barcode part1]
acactggtcctaccgt

SEQ ID NO: 14572 - DNA, 16 bp, Artificial Sequence
  synthetic [barcode part1]
gactggtactggttgt

SEQ ID NO: 14573 - DNA, 16 bp, Artificial Sequence
  synthetic [barcode part1]
cggatcaaggacgtgt

SEQ ID NO: 14574 - DNA, 16 bp, Artificial Sequence
  synthetic [barcode part1]
gtatagtcgactgcgt

SEQ ID NO: 14575 - DNA, 16 bp, Artificial Sequence
  synthetic [barcode part1]
gacactgatatcgcgt

SEQ ID NO: 14576 - DNA, 16 bp, Artificial Sequence
  synthetic [barcode part1]
tctacgttcagactgt

SEQ ID NO: 14577 - DNA, 16 bp, Artificial Sequence
  synthetic [barcode part1]
taccgttcctacaagt

SEQ ID NO: 14578 - DNA, 16 bp, Artificial Sequence
  synthetic [barcode part1]
gtgccactaggtagag

SEQ ID NO: 14579 - DNA, 16 bp, Artificial Sequence
  synthetic [barcode part1]
gacgtgaggattaccg

SEQ ID NO: 14580 - DNA, 16 bp, Artificial Sequence
  synthetic [barcode part1]
tctaactcggtgtatc

SEQ ID NO: 14581 - DNA, 16 bp, Artificial Sequence
  synthetic [barcode part1]
agaggtcaatcttccg

SEQ ID NO: 14582 - DNA, 16 bp, Artificial Sequence
  synthetic [barcode part1]
gatctagtatagaggc

SEQ ID NO: 14583 - DNA, 16 bp, Artificial Sequence
  synthetic [barcode part1]
tctcttcaccgtagtc

SEQ ID NO: 14584 - DNA, 16 bp, Artificial Sequence
  synthetic [barcode part1]
cgacgtagtgttcagt

SEQ ID NO: 14585 - DNA, 16 bp, Artificial Sequence
  synthetic [barcode part1]
tgaataggcgagtgag

SEQ ID NO: 14586 - DNA, 16 bp, Artificial Sequence
  synthetic [barcode part1]
tgtagtactcactcgt

SEQ ID NO: 14587 - DNA, 16 bp, Artificial Sequence
  synthetic [barcode part1]
agattcgttcgcgaac

SEQ ID NO: 14588 - DNA, 16 bp, Artificial Sequence
  synthetic [barcode part1]
caactaccactctgcg

SEQ ID NO: 14589 - DNA, 16 bp, Artificial Sequence
  synthetic [barcode part1]
ttggtagtaggtcgtc

SEQ ID NO: 14590 - DNA, 16 bp, Artificial Sequence
  synthetic [barcode part1]
gcgtagaagattactg

SEQ ID NO: 14591 - DNA, 16 bp, Artificial Sequence
  synthetic [barcode part1]
aggtactgcctcactc

SEQ ID NO: 14592 - DNA, 16 bp, Artificial Sequence
  synthetic [barcode part1]
cctattagtgtccggc

SEQ ID NO: 14593 - DNA, 16 bp, Artificial Sequence
  synthetic [barcode part1]
acgaggtcctgagtag

SEQ ID NO: 14594 - DNA, 16 bp, Artificial Sequence
  synthetic [barcode part1]
acgaccgtctcagttc

SEQ ID NO: 14595 - DNA, 16 bp, Artificial Sequence
  synthetic [barcode part1]
gaataggcgaagtctt

SEQ ID NO: 14596 - DNA, 16 bp, Artificial Sequence
  synthetic [barcode part1]
tcgaggtattcgtctt

SEQ ID NO: 14597 - DNA, 16 bp, Artificial Sequence
  synthetic [barcode part1]
ttcgtgccggtaactc

SEQ ID NO: 14598 - DNA, 16 bp, Artificial Sequence
  synthetic [barcode part1]
gagtctgaggccaagt

SEQ ID NO: 14599 - DNA, 16 bp, Artificial Sequence
  synthetic [barcode part1]
aacctggacgccttct

SEQ ID NO: 14600 - DNA, 16 bp, Artificial Sequence
  synthetic [barcode part1]
gcgaattaaccgtacc

SEQ ID NO: 14601 - DNA, 16 bp, Artificial Sequence
  synthetic [barcode part1]
gtatcgtgttccgaag

SEQ ID NO: 14602 - DNA, 16 bp, Artificial Sequence
  synthetic [barcode part1]
caggatcgtacgtact

SEQ ID NO: 14603 - DNA, 16 bp, Artificial Sequence
  synthetic [barcode part1]
ttgatccgtggttgtt

SEQ ID NO: 14604 - DNA, 16 bp, Artificial Sequence
  synthetic [barcode part1]
tgacgagatagacttg

SEQ ID NO: 14605 - DNA, 16 bp, Artificial Sequence
  synthetic [barcode part1]
gacaattgcgcctcct

SEQ ID NO: 14606 - DNA, 16 bp, Artificial Sequence
  synthetic [barcode part1]
aggcgataattcgtag

SEQ ID NO: 14607 - DNA, 16 bp, Artificial Sequence
  synthetic [barcode part1]
accgcgttaacctctg

SEQ ID NO: 14608 - DNA, 16 bp, Artificial Sequence
  synthetic [barcode part1]
ccttcgtggactgttg

SEQ ID NO: 14609 - DNA, 16 bp, Artificial Sequence
  synthetic [barcode part1]
gcggtgtatattgtgc

SEQ ID NO: 14610 - DNA, 16 bp, Artificial Sequence
  synthetic [barcode part1]
caagtacgaggcgatc

SEQ ID NO: 14611 - DNA, 16 bp, Artificial Sequence
  synthetic [barcode part1]
cctctcttcggaactt

SEQ ID NO: 14612 - DNA, 16 bp, Artificial Sequence
  synthetic [barcode part1]
acaacacgatctcgac

SEQ ID NO: 14613 - DNA, 16 bp, Artificial Sequence
  synthetic [barcode part1]
gagtatcggtacctac

SEQ ID NO: 14614 - DNA, 16 bp, Artificial Sequence
  synthetic [barcode part1]
taacaatcgacggtcc

SEQ ID NO: 14615 - DNA, 16 bp, Artificial Sequence
  synthetic [barcode part1]
gccgtaaggtgttgtt

SEQ ID NO: 14616 - DNA, 16 bp, Artificial Sequence
  synthetic [barcode part1]
gccaataccgtcgttc

SEQ ID NO: 14617 - DNA, 16 bp, Artificial Sequence
  synthetic [barcode part1]
aggtatctaggcactc

SEQ ID NO: 14618 - DNA, 16 bp, Artificial Sequence
  synthetic [barcode part1]
tcgaatcagagtgtag

SEQ ID NO: 14619 - DNA, 16 bp, Artificial Sequence
  synthetic [barcode part1]
aattcctgagagtcgc

SEQ ID NO: 14620 - DNA, 16 bp, Artificial Sequence
  synthetic [barcode part1]
caagacttacggtgtc

SEQ ID NO: 14621 - DNA, 16 bp, Artificial Sequence
  synthetic [barcode part1]
agtctggacgcaaggt

SEQ ID NO: 14622 - DNA, 16 bp, Artificial Sequence
  synthetic [barcode part1]
ccttcgttgaaggtag

SEQ ID NO: 14623 - DNA, 16 bp, Artificial Sequence
  synthetic [barcode part1]
aagtgtcgatatccgc

SEQ ID NO: 14624 - DNA, 16 bp, Artificial Sequence
  synthetic [barcode part1]
acttaggagtgaggcc

SEQ ID NO: 14625 - DNA, 16 bp, Artificial Sequence
  synthetic [barcode part1]
atatctcgtcgagttc

SEQ ID NO: 14626 - DNA, 16 bp, Artificial Sequence
  synthetic [barcode part1]
gaagtctataggtgac

SEQ ID NO: 14627 - DNA, 16 bp, Artificial Sequence
  synthetic [barcode part1]
tctggaatctcaaggc

SEQ ID NO: 14628 - DNA, 16 bp, Artificial Sequence
  synthetic [barcode part1]
acgtaggaggttgtcg

SEQ ID NO: 14629 - DNA, 16 bp, Artificial Sequence
  synthetic [barcode part1]
ttactcggtccgttct

SEQ ID NO: 14630 - DNA, 16 bp, Artificial Sequence
  synthetic [barcode part1]
tactggacgtcctcac

SEQ ID NO: 14631 - DNA, 16 bp, Artificial Sequence
  synthetic [barcode part1]
agtctccttggcacac

SEQ ID NO: 14632 - DNA, 16 bp, Artificial Sequence
  synthetic [barcode part1]
acctgtacaatctctg

SEQ ID NO: 14633 - DNA, 16 bp, Artificial Sequence
  synthetic [barcode part1]
caactggcaatcgact

SEQ ID NO: 14634 - DNA, 16 bp, Artificial Sequence
  synthetic [barcode part1]
tagtgtcgcgaataag

SEQ ID NO: 14635 - DNA, 16 bp, Artificial Sequence
  synthetic [barcode part1]
ccggtacaaccaagag

SEQ ID NO: 14636 - DNA, 16 bp, Artificial Sequence
  synthetic [barcode part1]
tgtgaacttactccac

SEQ ID NO: 14637 - DNA, 16 bp, Artificial Sequence
  synthetic [barcode part1]
tgttatcagaccggac

SEQ ID NO: 14638 - DNA, 16 bp, Artificial Sequence
  synthetic [barcode part1]
gtgattgttagaaggc

SEQ ID NO: 14639 - DNA, 16 bp, Artificial Sequence
  synthetic [barcode part1]
acaatcacgacgcact

SEQ ID NO: 14640 - DNA, 16 bp, Artificial Sequence
  synthetic [barcode part1]
aatacgtgactgaggt

SEQ ID NO: 14641 - DNA, 16 bp, Artificial Sequence
  synthetic [barcode part1]
gttatctgtgaactcc

SEQ ID NO: 14642 - DNA, 16 bp, Artificial Sequence
  synthetic [barcode part1]
atcgtcttaagtgcct

SEQ ID NO: 14643 - DNA, 16 bp, Artificial Sequence
  synthetic [barcode part1]
cgtatagtgtcagtgc

SEQ ID NO: 14644 - DNA, 16 bp, Artificial Sequence
  synthetic [barcode part1]
cgttaggccgttaagt

SEQ ID NO: 14645 - DNA, 16 bp, Artificial Sequence
  synthetic [barcode part1]
atctccggacaacctc

SEQ ID NO: 14646 - DNA, 16 bp, Artificial Sequence
  synthetic [barcode part1]
gtgacttcctgacaag

SEQ ID NO: 14647 - DNA, 16 bp, Artificial Sequence
  synthetic [barcode part1]
acaacctcctacgtcg

SEQ ID NO: 14648 - DNA, 16 bp, Artificial Sequence
  synthetic [barcode part1]
acctctgtgaattgtc

SEQ ID NO: 14649 - DNA, 16 bp, Artificial Sequence
  synthetic [barcode part1]
tagatatcgtaccggc

SEQ ID NO: 14650 - DNA, 16 bp, Artificial Sequence
  synthetic [barcode part1]
gtactctgattgtcgt

SEQ ID NO: 14651 - DNA, 16 bp, Artificial Sequence
  synthetic [barcode part1]
atccaccgtcctgaac

SEQ ID NO: 14652 - DNA, 16 bp, Artificial Sequence
  synthetic [barcode part1]
acaggagtgacttggc

SEQ ID NO: 14653 - DNA, 16 bp, Artificial Sequence
  synthetic [barcode part1]
acggttacgtgtagtc

SEQ ID NO: 14654 - DNA, 16 bp, Artificial Sequence
  synthetic [barcode part1]
tgcagtgcaagtaagt

SEQ ID NO: 14655 - DNA, 16 bp, Artificial Sequence
  synthetic [barcode part1]
acacgcacgcaatact

SEQ ID NO: 14656 - DNA, 16 bp, Artificial Sequence
  synthetic [barcode part1]
cacaggttatccgagt

SEQ ID NO: 14657 - DNA, 16 bp, Artificial Sequence
  synthetic [barcode part1]
ttggtggacaactcgt

SEQ ID NO: 14658 - DNA, 16 bp, Artificial Sequence
  synthetic [barcode part1]
ttgacagattcctacc

SEQ ID NO: 14659 - DNA, 16 bp, Artificial Sequence
  synthetic [barcode part1]
cctgaccgcactaact

SEQ ID NO: 14660 - DNA, 16 bp, Artificial Sequence
  synthetic [barcode part1]
gactgtaaccgtacac

SEQ ID NO: 14661 - DNA, 16 bp, Artificial Sequence
  synthetic [barcode part1]
ataaggacggtagttc

SEQ ID NO: 14662 - DNA, 16 bp, Artificial Sequence
  synthetic [barcode part1]
ttcttcaacgatcgtg

SEQ ID NO: 14663 - DNA, 16 bp, Artificial Sequence
  synthetic [barcode part1]
gttgcaggttcgcctt

SEQ ID NO: 14664 - DNA, 16 bp, Artificial Sequence
  synthetic [barcode part1]
taatcgccagaaggcg

SEQ ID NO: 14665 - DNA, 16 bp, Artificial Sequence
  synthetic [barcode part1]
aagtaccgcagtggac

SEQ ID NO: 14666 - DNA, 16 bp, Artificial Sequence
  synthetic [barcode part1]
atattgaaccgaaggc

SEQ ID NO: 14667 - DNA, 16 bp, Artificial Sequence
  synthetic [barcode part1]
cactccagaataacgc

SEQ ID NO: 14668 - DNA, 16 bp, Artificial Sequence
  synthetic [barcode part1]
ttgcaacggagttctg

SEQ ID NO: 14669 - DNA, 16 bp, Artificial Sequence
  synthetic [barcode part1]
cgaccttattgtgtac

SEQ ID NO: 14670 - DNA, 16 bp, Artificial Sequence
  synthetic [barcode part1]
aaccaacctccagaac

SEQ ID NO: 14671 - DNA, 16 bp, Artificial Sequence
  synthetic [barcode part1]
agtcagttgtgtgcac

SEQ ID NO: 14672 - DNA, 16 bp, Artificial Sequence
  synthetic [barcode part1]
attccgagaccgattg

SEQ ID NO: 14673 - DNA, 16 bp, Artificial Sequence
  synthetic [barcode part1]
gagaaccagaagatcg

SEQ ID NO: 14674 - DNA, 16 bp, Artificial Sequence
  synthetic [barcode part1]
tggtccgttacacctg

SEQ ID NO: 14675 - DNA, 16 bp, Artificial Sequence
  synthetic [barcode part1]
actgtagacgagtaac

SEQ ID NO: 14676 - DNA, 16 bp, Artificial Sequence
  synthetic [barcode part1]
tctgatcgtgtgccgt

SEQ ID NO: 14677 - DNA, 16 bp, Artificial Sequence
  synthetic [barcode part1]
tcggcagtgtctctac

SEQ ID NO: 14678 - DNA, 16 bp, Artificial Sequence
  synthetic [barcode part1]
gcgtcggtaactcctt

SEQ ID NO: 14679 - DNA, 16 bp, Artificial Sequence
  synthetic [barcode part1]
tcgacttacgactgtt

SEQ ID NO: 14680 - DNA, 16 bp, Artificial Sequence
  synthetic [barcode part1]
gaacacgcaatagttg

SEQ ID NO: 14681 - DNA, 16 bp, Artificial Sequence
  synthetic [barcode part1]
tccgtataccgaactt

SEQ ID NO: 14682 - DNA, 16 bp, Artificial Sequence
  synthetic [barcode part1]
attcgtgcgacctctg

SEQ ID NO: 14683 - DNA, 16 bp, Artificial Sequence
  synthetic [barcode part1]
attgtccgtagatcct

SEQ ID NO: 14684 - DNA, 16 bp, Artificial Sequence
  synthetic [barcode part1]
actcaacggttcagtg

SEQ ID NO: 14685 - DNA, 16 bp, Artificial Sequence
  synthetic [barcode part1]
cctatagtcgtagacg

SEQ ID NO: 14686 - DNA, 16 bp, Artificial Sequence
  synthetic [barcode part1]
caagaatcgcctctag

SEQ ID NO: 14687 - DNA, 16 bp, Artificial Sequence
  synthetic [barcode part1]
atcgcgaggtgttgtt

SEQ ID NO: 14688 - DNA, 16 bp, Artificial Sequence
  synthetic [barcode part1]
tcctcgattctccaac

SEQ ID NO: 14689 - DNA, 16 bp, Artificial Sequence
  synthetic [barcode part1]
gacagactgccgtaag

SEQ ID NO: 14690 - DNA, 16 bp, Artificial Sequence
  synthetic [barcode part1]
cctggtcgcaccaatt

SEQ ID NO: 14691 - DNA, 16 bp, Artificial Sequence
  synthetic [barcode part1]
attggatcctgtacct

SEQ ID NO: 14692 - DNA, 16 bp, Artificial Sequence
  synthetic [barcode part1]
tagttctatcgcgcgc

SEQ ID NO: 14693 - DNA, 16 bp, Artificial Sequence
  synthetic [barcode part1]
tcgtatcagactgtct

SEQ ID NO: 14694 - DNA, 16 bp, Artificial Sequence
  synthetic [barcode part1]
cgatcgacgtaacgtt

SEQ ID NO: 14695 - DNA, 16 bp, Artificial Sequence
  synthetic [barcode part1]
gcgatcgatatcgatc

SEQ ID NO: 14696 - DNA, 16 bp, Artificial Sequence
  synthetic [barcode part1]
accaagtacctgacac

SEQ ID NO: 14697 - DNA, 16 bp, Artificial Sequence
  synthetic [barcode part1]
atccaccggtattgcc

SEQ ID NO: 14698 - DNA, 16 bp, Artificial Sequence
  synthetic [barcode part1]
cacacgagtgagacgt

SEQ ID NO: 14699 - DNA, 16 bp, Artificial Sequence
  synthetic [barcode part1]
ccaagacctcggaatt

SEQ ID NO: 14700 - DNA, 16 bp, Artificial Sequence
  synthetic [barcode part1]
aattccggcggtattg

SEQ ID NO: 14701 - DNA, 16 bp, Artificial Sequence
  synthetic [barcode part1]
tatctgccgaacgagt

SEQ ID NO: 14702 - DNA, 16 bp, Artificial Sequence
  synthetic [barcode part1]
tcctagatcacggtag

SEQ ID NO: 14703 - DNA, 16 bp, Artificial Sequence
  synthetic [barcode part1]
cgtagtacctagaacc

SEQ ID NO: 14704 - DNA, 16 bp, Artificial Sequence
  synthetic [barcode part1]
tggcagaatctcgttg

SEQ ID NO: 14705 - DNA, 16 bp, Artificial Sequence
  synthetic [barcode part1]
gcacgtattggagtct

SEQ ID NO: 14706 - DNA, 16 bp, Artificial Sequence
  synthetic [barcode part1]
aaggaatctacgtgac

SEQ ID NO: 14707 - DNA, 16 bp, Artificial Sequence
  synthetic [barcode part1]
gtcgttccactatctc

SEQ ID NO: 14708 - DNA, 16 bp, Artificial Sequence
  synthetic [barcode part1]
gatctggaatccggtt

SEQ ID NO: 14709 - DNA, 16 bp, Artificial Sequence
  synthetic [barcode part1]
cgtaactagagtaacg

SEQ ID NO: 14710 - DNA, 16 bp, Artificial Sequence
  synthetic [barcode part1]
ttctaacaggacggtc

SEQ ID NO: 14711 - DNA, 16 bp, Artificial Sequence
  synthetic [barcode part1]
tcgtcggattgaactg

SEQ ID NO: 14712 - DNA, 16 bp, Artificial Sequence
  synthetic [barcode part1]
cggtctggtaacttag

SEQ ID NO: 14713 - DNA, 16 bp, Artificial Sequence
  synthetic [barcode part1]
cctctcacggattcag

SEQ ID NO: 14714 - DNA, 16 bp, Artificial Sequence
  synthetic [barcode part1]
aacgacgttcgttacg

SEQ ID NO: 14715 - DNA, 16 bp, Artificial Sequence
  synthetic [barcode part1]
gtgtaacgcgttagtc

SEQ ID NO: 14716 - DNA, 16 bp, Artificial Sequence
  synthetic [barcode part1]
agagtcggtattcaag

SEQ ID NO: 14717 - DNA, 16 bp, Artificial Sequence
  synthetic [barcode part1]
ttcgaacgtccaagtg

SEQ ID NO: 14718 - DNA, 16 bp, Artificial Sequence
  synthetic [barcode part1]
taaccggttggttggt

SEQ ID NO: 14719 - DNA, 16 bp, Artificial Sequence
  synthetic [barcode part1]
ccgtatccgaatcacc

SEQ ID NO: 14720 - DNA, 16 bp, Artificial Sequence
  synthetic [barcode part1]
ttcgacttggtcgcgt

SEQ ID NO: 14721 - DNA, 16 bp, Artificial Sequence
  synthetic [barcode part1]
tatcgtccaccgacgt

SEQ ID NO: 14722 - DNA, 16 bp, Artificial Sequence
  synthetic [barcode part1]
tcttggataggcggag

SEQ ID NO: 14723 - DNA, 16 bp, Artificial Sequence
  synthetic [barcode part1]
taccgcctattaacgt

SEQ ID NO: 14724 - DNA, 16 bp, Artificial Sequence
  synthetic [barcode part1]
tatacaggtgaggtgt

SEQ ID NO: 14725 - DNA, 16 bp, Artificial Sequence
  synthetic [barcode part1]
aagagtgccgtactct

SEQ ID NO: 14726 - DNA, 16 bp, Artificial Sequence
  synthetic [barcode part1]
atcgcgcactgagaag

SEQ ID NO: 14727 - DNA, 16 bp, Artificial Sequence
  synthetic [barcode part1]
agtgttacacggcgtt

SEQ ID NO: 14728 - DNA, 16 bp, Artificial Sequence
  synthetic [barcode part1]
tatcgttggtgacgac

SEQ ID NO: 14729 - DNA, 16 bp, Artificial Sequence
  synthetic [barcode part1]
tataccgtgcggttag

SEQ ID NO: 14730 - DNA, 16 bp, Artificial Sequence
  synthetic [barcode part1]
cagaaggcgactacac

SEQ ID NO: 14731 - DNA, 16 bp, Artificial Sequence
  synthetic [barcode part1]
acagatccacactgac

SEQ ID NO: 14732 - DNA, 16 bp, Artificial Sequence
  synthetic [barcode part1]
gattaaccacgcgtgt

SEQ ID NO: 14733 - DNA, 16 bp, Artificial Sequence
  synthetic [barcode part1]
gatatcctcacacgag

SEQ ID NO: 14734 - DNA, 16 bp, Artificial Sequence
  synthetic [barcode part1]
acgtcggttccgttac

SEQ ID NO: 14735 - DNA, 16 bp, Artificial Sequence
  synthetic [barcode part1]
tcctcaacgaccgtgt

SEQ ID NO: 14736 - DNA, 16 bp, Artificial Sequence
  synthetic [barcode part1]
cggtattaacaccacg

SEQ ID NO: 14737 - DNA, 16 bp, Artificial Sequence
  synthetic [barcode part1]
ttcgcctgtgataccg

SEQ ID NO: 14738 - DNA, 16 bp, Artificial Sequence
  synthetic [barcode part1]
cgcgcaattacacaac

SEQ ID NO: 14739 - DNA, 16 bp, Artificial Sequence
  synthetic [barcode part1]
tggtggattactccag

SEQ ID NO: 14740 - DNA, 16 bp, Artificial Sequence
  synthetic [barcode part1]
ataggttgaggatcgt

SEQ ID NO: 14741 - DNA, 16 bp, Artificial Sequence
  synthetic [barcode part1]
tctggtaacgaaggcg

SEQ ID NO: 14742 - DNA, 16 bp, Artificial Sequence
  synthetic [barcode part1]
actggcgcagaagatc

SEQ ID NO: 14743 - DNA, 16 bp, Artificial Sequence
  synthetic [barcode part1]
caagtctcggagtgag

SEQ ID NO: 14744 - DNA, 16 bp, Artificial Sequence
  synthetic [barcode part1]
acagtcagtacgttgc

SEQ ID NO: 14745 - DNA, 16 bp, Artificial Sequence
  synthetic [barcode part1]
ccgataacgaactacc

SEQ ID NO: 14746 - DNA, 16 bp, Artificial Sequence
  synthetic [barcode part1]
gtgtggaataaggacg

SEQ ID NO: 14747 - DNA, 16 bp, Artificial Sequence
  synthetic [barcode part1]
tctcgcaatcaagttc

SEQ ID NO: 14748 - DNA, 16 bp, Artificial Sequence
  synthetic [barcode part1]
tatactacggtgcgtg

SEQ ID NO: 14749 - DNA, 16 bp, Artificial Sequence
  synthetic [barcode part1]
tgagacgaacagtgag

SEQ ID NO: 14750 - DNA, 16 bp, Artificial Sequence
  synthetic [barcode part1]
cagacgcactactctc

SEQ ID NO: 14751 - DNA, 16 bp, Artificial Sequence
  synthetic [barcode part1]
cggaccgaatctaact

SEQ ID NO: 14752 - DNA, 16 bp, Artificial Sequence
  synthetic [barcode part1]
aacttctatatccggc

SEQ ID NO: 14753 - DNA, 16 bp, Artificial Sequence
  synthetic [barcode part1]
tacgttggacttcttg

SEQ ID NO: 14754 - DNA, 16 bp, Artificial Sequence
  synthetic [barcode part1]
cgaattgttccacgcc

SEQ ID NO: 14755 - DNA, 16 bp, Artificial Sequence
  synthetic [barcode part1]
aagtacaggtccgacg

SEQ ID NO: 14756 - DNA, 16 bp, Artificial Sequence
  synthetic [barcode part1]
ttcctcggaactgaag

SEQ ID NO: 14757 - DNA, 16 bp, Artificial Sequence
  synthetic [barcode part1]
cgcaataccacctacc

SEQ ID NO: 14758 - DNA, 16 bp, Artificial Sequence
  synthetic [barcode part1]
attcaggactctgttc

SEQ ID NO: 14759 - DNA, 16 bp, Artificial Sequence
  synthetic [barcode part1]
gaggttggtacagtcg

SEQ ID NO: 14760 - DNA, 16 bp, Artificial Sequence
  synthetic [barcode part1]
gaccaatataccacgc

SEQ ID NO: 14761 - DNA, 16 bp, Artificial Sequence
  synthetic [barcode part1]
tgcgaatagatctgcc

SEQ ID NO: 14762 - DNA, 16 bp, Artificial Sequence
  synthetic [barcode part1]
accgcaagtaggtggt

SEQ ID NO: 14763 - DNA, 16 bp, Artificial Sequence
  synthetic [barcode part1]
cgattctgtgttgact

SEQ ID NO: 14764 - DNA, 16 bp, Artificial Sequence
  synthetic [barcode part1]
tgtccgcctgtaacgt

SEQ ID NO: 14765 - DNA, 16 bp, Artificial Sequence
  synthetic [barcode part1]
gtcgcgatacctactc

SEQ ID NO: 14766 - DNA, 16 bp, Artificial Sequence
  synthetic [barcode part1]
agtcaggcaggtctag

SEQ ID NO: 14767 - DNA, 16 bp, Artificial Sequence
  synthetic [barcode part1]
tgtatatcggcaccag

SEQ ID NO: 14768 - DNA, 16 bp, Artificial Sequence
  synthetic [barcode part1]
tccagattcaccaccg

SEQ ID NO: 14769 - DNA, 16 bp, Artificial Sequence
  synthetic [barcode part1]
ccgatagtcgttgagt

SEQ ID NO: 14770 - DNA, 16 bp, Artificial Sequence
  synthetic [barcode part1]
tgagttcgcgaattcg

SEQ ID NO: 14771 - DNA, 16 bp, Artificial Sequence
  synthetic [barcode part1]
agatcacgtctagtgc

SEQ ID NO: 14772 - DNA, 16 bp, Artificial Sequence
  synthetic [barcode part1]
tcgaagtgtcttaggc

SEQ ID NO: 14773 - DNA, 16 bp, Artificial Sequence
  synthetic [barcode part1]
tcggaatcttgagacc

SEQ ID NO: 14774 - DNA, 16 bp, Artificial Sequence
  synthetic [barcode part1]
agacgttcctaccacc

SEQ ID NO: 14775 - DNA, 16 bp, Artificial Sequence
  synthetic [barcode part1]
atcctagtggtcaacg

SEQ ID NO: 14776 - DNA, 16 bp, Artificial Sequence
  synthetic [barcode part1]
agtactgccaatcgac

SEQ ID NO: 14777 - DNA, 16 bp, Artificial Sequence
  synthetic [barcode part1]
gtgaatcaggaattgc

SEQ ID NO: 14778 - DNA, 16 bp, Artificial Sequence
  synthetic [barcode part1]
agtgtggtattaggtg

SEQ ID NO: 14779 - DNA, 16 bp, Artificial Sequence
  synthetic [barcode part1]
acagaccactagaagt

SEQ ID NO: 14780 - DNA, 16 bp, Artificial Sequence
  synthetic [barcode part1]
tacggacctacaggtt

SEQ ID NO: 14781 - DNA, 16 bp, Artificial Sequence
  synthetic [barcode part1]
aacgtactgcagttgc

SEQ ID NO: 14782 - DNA, 16 bp, Artificial Sequence
  synthetic [barcode part1]
aggacttgtgaacggc

SEQ ID NO: 14783 - DNA, 16 bp, Artificial Sequence
  synthetic [barcode part1]
tcacagattacgtggc

SEQ ID NO: 14784 - DNA, 16 bp, Artificial Sequence
  synthetic [barcode part1]
atctgactacgttctg

SEQ ID NO: 14785 - DNA, 16 bp, Artificial Sequence
  synthetic [barcode part1]
tcaactgtggtcaacg

SEQ ID NO: 14786 - DNA, 16 bp, Artificial Sequence
  synthetic [barcode part1]
tatacggcactagtgc

SEQ ID NO: 14787 - DNA, 16 bp, Artificial Sequence
  synthetic [barcode part1]
gtgaccgatacactac

SEQ ID NO: 14788 - DNA, 16 bp, Artificial Sequence
  synthetic [barcode part1]
accggtggaatcagac

SEQ ID NO: 14789 - DNA, 16 bp, Artificial Sequence
  synthetic [barcode part1]
attggcgattcttcgt

SEQ ID NO: 14790 - DNA, 16 bp, Artificial Sequence
  synthetic [barcode part1]
aagaccggagaatcag

SEQ ID NO: 14791 - DNA, 16 bp, Artificial Sequence
  synthetic [barcode part1]
tagtacgacgtggttc

SEQ ID NO: 14792 - DNA, 16 bp, Artificial Sequence
  synthetic [barcode part1]
tcctcttgaggagaac

SEQ ID NO: 14793 - DNA, 16 bp, Artificial Sequence
  synthetic [barcode part1]
aggatcgactgttctg

SEQ ID NO: 14794 - DNA, 16 bp, Artificial Sequence
  synthetic [barcode part1]
gcagagattgacaatc

SEQ ID NO: 14795 - DNA, 16 bp, Artificial Sequence
  synthetic [barcode part1]
tgactgtatagtcgcg

SEQ ID NO: 14796 - DNA, 16 bp, Artificial Sequence
  synthetic [barcode part1]
tgtgttgaattcctcg

SEQ ID NO: 14797 - DNA, 16 bp, Artificial Sequence
  synthetic [barcode part1]
gtcctgcaggtgttct

SEQ ID NO: 14798 - DNA, 16 bp, Artificial Sequence
  synthetic [barcode part1]
cctctacgttcaatag

SEQ ID NO: 14799 - DNA, 16 bp, Artificial Sequence
  synthetic [barcode part1]
agacaaggcctcaggt

SEQ ID NO: 14800 - DNA, 16 bp, Artificial Sequence
  synthetic [barcode part1]
acggtccaataactcg

SEQ ID NO: 14801 - DNA, 16 bp, Artificial Sequence
  synthetic [barcode part1]
tcagttctaccagtgt

SEQ ID NO: 14802 - DNA, 16 bp, Artificial Sequence
  synthetic [barcode part1]
gtggacctcctatcac

SEQ ID NO: 14803 - DNA, 16 bp, Artificial Sequence
  synthetic [barcode part1]
gttcagtaccaagtcg

SEQ ID NO: 14804 - DNA, 16 bp, Artificial Sequence
  synthetic [barcode part1]
tgatacgtacgttggc

SEQ ID NO: 14805 - DNA, 16 bp, Artificial Sequence
  synthetic [barcode part1]
ttacgttcgccgaacc

SEQ ID NO: 14806 - DNA, 16 bp, Artificial Sequence
  synthetic [barcode part1]
gcacctcgtcactagt

SEQ ID NO: 14807 - DNA, 16 bp, Artificial Sequence
  synthetic [barcode part1]
tgaagatcgttagacg

SEQ ID NO: 14808 - DNA, 16 bp, Artificial Sequence
  synthetic [barcode part1]
atctgttgtcctgaac

SEQ ID NO: 14809 - DNA, 16 bp, Artificial Sequence
  synthetic [barcode part1]
gtccttctctcaactg

SEQ ID NO: 14810 - DNA, 16 bp, Artificial Sequence
  synthetic [barcode part1]
tgaagaacacacagtc

SEQ ID NO: 14811 - DNA, 16 bp, Artificial Sequence
  synthetic [barcode part1]
tggactaatcaggtcc

SEQ ID NO: 14812 - DNA, 16 bp, Artificial Sequence
  synthetic [barcode part1]
agaggtaggtaacctt

SEQ ID NO: 14813 - DNA, 16 bp, Artificial Sequence
  synthetic [barcode part1]
cgaatcacacgaggac

SEQ ID NO: 14814 - DNA, 16 bp, Artificial Sequence
  synthetic [barcode part1]
gttattcgagtctacc

SEQ ID NO: 14815 - DNA, 16 bp, Artificial Sequence
  synthetic [barcode part1]
tgtgactaagagtcag

SEQ ID NO: 14816 - DNA, 16 bp, Artificial Sequence
  synthetic [barcode part1]
ttacttccacggattg

SEQ ID NO: 14817 - DNA, 16 bp, Artificial Sequence
  synthetic [barcode part1]
cctcgttgcgaatctg

SEQ ID NO: 14818 - DNA, 16 bp, Artificial Sequence
  synthetic [barcode part1]
ttgcggatagactcgt

SEQ ID NO: 14819 - DNA, 16 bp, Artificial Sequence
  synthetic [barcode part1]
cgttgtcgacgataac

SEQ ID NO: 14820 - DNA, 16 bp, Artificial Sequence
  synthetic [barcode part1]
ttcaggtctcgtgaag

SEQ ID NO: 14821 - DNA, 16 bp, Artificial Sequence
  synthetic [barcode part1]
cacaatcgttatctcg

SEQ ID NO: 14822 - DNA, 16 bp, Artificial Sequence
  synthetic [barcode part1]
tcggcagatagagacc

SEQ ID NO: 14823 - DNA, 16 bp, Artificial Sequence
  synthetic [barcode part1]
gttgagtagtggttcc

SEQ ID NO: 14824 - DNA, 16 bp, Artificial Sequence
  synthetic [barcode part1]
tcgcaatcgtgtacag

SEQ ID NO: 14825 - DNA, 16 bp, Artificial Sequence
  synthetic [barcode part1]
tcacgatatcgtgacg

SEQ ID NO: 14826 - DNA, 16 bp, Artificial Sequence
  synthetic [barcode part1]
gatcaactgtgcgtac

SEQ ID NO: 14827 - DNA, 16 bp, Artificial Sequence
  synthetic [barcode part1]
actactgcgatccaag

SEQ ID NO: 14828 - DNA, 16 bp, Artificial Sequence
  synthetic [barcode part1]
gtcagatacctagtgc

SEQ ID NO: 14829 - DNA, 16 bp, Artificial Sequence
  synthetic [barcode part1]
agttattggaccgtcg

SEQ ID NO: 14830 - DNA, 16 bp, Artificial Sequence
  synthetic [barcode part1]
cctactatcggatact

SEQ ID NO: 14831 - DNA, 16 bp, Artificial Sequence
  synthetic [barcode part1]
aattactcagaccgcg

SEQ ID NO: 14832 - DNA, 16 bp, Artificial Sequence
  synthetic [barcode part1]
gacgtgaggtaatccg

SEQ ID NO: 14833 - DNA, 16 bp, Artificial Sequence
  synthetic [barcode part1]
ttctagttctcaccgc

SEQ ID NO: 14834 - DNA, 16 bp, Artificial Sequence
  synthetic [barcode part1]
tgaaccagaggacacc

SEQ ID NO: 14835 - DNA, 16 bp, Artificial Sequence
  synthetic [barcode part1]
aaccaactgtggtgtc

SEQ ID NO: 14836 - DNA, 16 bp, Artificial Sequence
  synthetic [barcode part1]
caatcaagaccgacct

SEQ ID NO: 14837 - DNA, 16 bp, Artificial Sequence
  synthetic [barcode part1]
tccgactcaactgtgc

SEQ ID NO: 14838 - DNA, 16 bp, Artificial Sequence
  synthetic [barcode part1]
accgttctctgagtgc

SEQ ID NO: 14839 - DNA, 16 bp, Artificial Sequence
  synthetic [barcode part1]
tgcgattgacctacag

SEQ ID NO: 14840 - DNA, 16 bp, Artificial Sequence
  synthetic [barcode part1]
gattctcgtatccagt

SEQ ID NO: 14841 - DNA, 16 bp, Artificial Sequence
  synthetic [barcode part1]
ttacgagtcgttgttc

SEQ ID NO: 14842 - DNA, 16 bp, Artificial Sequence
  synthetic [barcode part1]
agaccagtctcctaag

SEQ ID NO: 14843 - DNA, 16 bp, Artificial Sequence
  synthetic [barcode part1]
tcacctcaagacagtg

SEQ ID NO: 14844 - DNA, 16 bp, Artificial Sequence
  synthetic [barcode part1]
ttcaggtgtgatcgtg

SEQ ID NO: 14845 - DNA, 16 bp, Artificial Sequence
  synthetic [barcode part1]
agatccacggaggatc

SEQ ID NO: 14846 - DNA, 16 bp, Artificial Sequence
  synthetic [barcode part1]
ttcgccaccttatcac

SEQ ID NO: 14847 - DNA, 16 bp, Artificial Sequence
  synthetic [barcode part1]
acagtgtgttgtggtc

SEQ ID NO: 14848 - DNA, 16 bp, Artificial Sequence
  synthetic [barcode part1]
aatctccttctgccgt

SEQ ID NO: 14849 - DNA, 16 bp, Artificial Sequence
  synthetic [barcode part1]
gtgcagaaggtgtaag

SEQ ID NO: 14850 - DNA, 16 bp, Artificial Sequence
  synthetic [barcode part1]
tcgactctctgcgaac

SEQ ID NO: 14851 - DNA, 16 bp, Artificial Sequence
  synthetic [barcode part1]
cacaacagtggtgttc

SEQ ID NO: 14852 - DNA, 16 bp, Artificial Sequence
  synthetic [barcode part1]
cgaaggttatctccag

SEQ ID NO: 14853 - DNA, 16 bp, Artificial Sequence
  synthetic [barcode part1]
acgagttgccagagac

SEQ ID NO: 14854 - DNA, 16 bp, Artificial Sequence
  synthetic [barcode part1]
caggccaaggagtatc

SEQ ID NO: 14855 - DNA, 16 bp, Artificial Sequence
  synthetic [barcode part1]
gcgttataagtgagtg

SEQ ID NO: 14856 - DNA, 16 bp, Artificial Sequence
  synthetic [barcode part1]
taagttacacggagac

SEQ ID NO: 14857 - DNA, 16 bp, Artificial Sequence
  synthetic [barcode part1]
gcacgcgtaatcagtt

SEQ ID NO: 14858 - DNA, 16 bp, Artificial Sequence
  synthetic [barcode part1]
cctataccgtgagagt

SEQ ID NO: 14859 - DNA, 16 bp, Artificial Sequence
  synthetic [barcode part1]
tagaagtaggcacgag

SEQ ID NO: 14860 - DNA, 16 bp, Artificial Sequence
  synthetic [barcode part1]
agtgactgtgtaagac

SEQ ID NO: 14861 - DNA, 16 bp, Artificial Sequence
  synthetic [barcode part1]
ccgaacaagatagtgt

SEQ ID NO: 14862 - DNA, 16 bp, Artificial Sequence
  synthetic [barcode part1]
acgaatcgcgttcaac

SEQ ID NO: 14863 - DNA, 16 bp, Artificial Sequence
  synthetic [barcode part1]
agtaccttagaaggtg

SEQ ID NO: 14864 - DNA, 16 bp, Artificial Sequence
  synthetic [barcode part1]
cggagattgaattgtg

SEQ ID NO: 14865 - DNA, 16 bp, Artificial Sequence
  synthetic [barcode part1]
gtgaatctccttggcc

SEQ ID NO: 14866 - DNA, 16 bp, Artificial Sequence
  synthetic [barcode part1]
gtaatcgaccacacac

SEQ ID NO: 14867 - DNA, 16 bp, Artificial Sequence
  synthetic [barcode part1]
cagactgatatctcct

SEQ ID NO: 14868 - DNA, 16 bp, Artificial Sequence
  synthetic [barcode part1]
ttgttgccttgaacgt

SEQ ID NO: 14869 - DNA, 16 bp, Artificial Sequence
  synthetic [barcode part1]
ttgtcgcagacagtac

SEQ ID NO: 14870 - DNA, 16 bp, Artificial Sequence
  synthetic [barcode part1]
ttgaatacaaggcgac

SEQ ID NO: 14871 - DNA, 16 bp, Artificial Sequence
  synthetic [barcode part1]
caggcgtgaaggttac

SEQ ID NO: 14872 - DNA, 16 bp, Artificial Sequence
  synthetic [barcode part1]
cgttgtctaccttacc

SEQ ID NO: 14873 - DNA, 16 bp, Artificial Sequence
  synthetic [barcode part1]
agaccgaagagttgag

SEQ ID NO: 14874 - DNA, 16 bp, Artificial Sequence
  synthetic [barcode part1]
tacgtacaaccagtcg

SEQ ID NO: 14875 - DNA, 16 bp, Artificial Sequence
  synthetic [barcode part1]
aagaagtacaaccacc

SEQ ID NO: 14876 - DNA, 16 bp, Artificial Sequence
  synthetic [barcode part1]
tctcctctcttggagt

SEQ ID NO: 14877 - DNA, 16 bp, Artificial Sequence
  synthetic [barcode part1]
gtgtctcttagtaacc

SEQ ID NO: 14878 - DNA, 16 bp, Artificial Sequence
  synthetic [barcode part1]
aatcgtctatctccag

SEQ ID NO: 14879 - DNA, 16 bp, Artificial Sequence
  synthetic [barcode part1]
tgtaacaggcaccgtt

SEQ ID NO: 14880 - DNA, 16 bp, Artificial Sequence
  synthetic [barcode part1]
gactgacctagttggt

SEQ ID NO: 14881 - DNA, 16 bp, Artificial Sequence
  synthetic [barcode part1]
actcgttcactcacct

SEQ ID NO: 14882 - DNA, 16 bp, Artificial Sequence
  synthetic [barcode part1]
cgagagatacaaccgc

SEQ ID NO: 14883 - DNA, 16 bp, Artificial Sequence
  synthetic [barcode part1]
gtcacctgtaataggc

SEQ ID NO: 14884 - DNA, 16 bp, Artificial Sequence
  synthetic [barcode part1]
tgcgcgataccttgtc

SEQ ID NO: 14885 - DNA, 16 bp, Artificial Sequence
  synthetic [barcode part1]
gtccgagtcacttcac

SEQ ID NO: 14886 - DNA, 16 bp, Artificial Sequence
  synthetic [barcode part1]
aacttaggtgcgaagt

SEQ ID NO: 14887 - DNA, 16 bp, Artificial Sequence
  synthetic [barcode part1]
cgcctacgaatcctgt

SEQ ID NO: 14888 - DNA, 16 bp, Artificial Sequence
  synthetic [barcode part1]
acgacgtggttaacct

SEQ ID NO: 14889 - DNA, 16 bp, Artificial Sequence
  synthetic [barcode part1]
aatcaaggtgatcgtg

SEQ ID NO: 14890 - DNA, 16 bp, Artificial Sequence
  synthetic [barcode part1]
cgattctggaggatct

SEQ ID NO: 14891 - DNA, 16 bp, Artificial Sequence
  synthetic [barcode part1]
gcaatacgtattgcgc

SEQ ID NO: 14892 - DNA, 16 bp, Artificial Sequence
  synthetic [barcode part1]
gatccggttaacaacc

SEQ ID NO: 14893 - DNA, 16 bp, Artificial Sequence
  synthetic [barcode part1]
tgcacgaggtagtggt

SEQ ID NO: 14894 - DNA, 16 bp, Artificial Sequence
  synthetic [barcode part1]
tgtggatagtgttcgc

SEQ ID NO: 14895 - DNA, 16 bp, Artificial Sequence
  synthetic [barcode part1]
tgaggttgtgttacgc

SEQ ID NO: 14896 - DNA, 16 bp, Artificial Sequence
  synthetic [barcode part1]
acgaacttgtaccgac

SEQ ID NO: 14897 - DNA, 16 bp, Artificial Sequence
  synthetic [barcode part1]
acacctcctaggttgc

SEQ ID NO: 14898 - DNA, 16 bp, Artificial Sequence
  synthetic [barcode part1]
ttacgcactaacttcg

SEQ ID NO: 14899 - DNA, 16 bp, Artificial Sequence
  synthetic [barcode part1]
acttccagacgatctt

SEQ ID NO: 14900 - DNA, 16 bp, Artificial Sequence
  synthetic [barcode part1]
tgcgcctacagttcgt

SEQ ID NO: 14901 - DNA, 16 bp, Artificial Sequence
  synthetic [barcode part1]
gatagtataccgcctg

SEQ ID NO: 14902 - DNA, 16 bp, Artificial Sequence
  synthetic [barcode part1]
agacctacggaaggtc

SEQ ID NO: 14903 - DNA, 16 bp, Artificial Sequence
  synthetic [barcode part1]
ccagtgattacgttct

SEQ ID NO: 14904 - DNA, 16 bp, Artificial Sequence
  synthetic [barcode part1]
accacagtatcacggt

SEQ ID NO: 14905 - DNA, 16 bp, Artificial Sequence
  synthetic [barcode part1]
cagaattctgaggcct

SEQ ID NO: 14906 - DNA, 16 bp, Artificial Sequence
  synthetic [barcode part1]
gaatccgatctcttgt

SEQ ID NO: 14907 - DNA, 16 bp, Artificial Sequence
  synthetic [barcode part1]
tacgtgttgaccagtg

SEQ ID NO: 14908 - DNA, 16 bp, Artificial Sequence
  synthetic [barcode part1]
actatagtcgtccgtt

SEQ ID NO: 14909 - DNA, 16 bp, Artificial Sequence
  synthetic [barcode part1]
tcactgatcttcgtag

SEQ ID NO: 14910 - DNA, 16 bp, Artificial Sequence
  synthetic [barcode part1]
gtggtaccagttggtt

SEQ ID NO: 14911 - DNA, 16 bp, Artificial Sequence
  synthetic [barcode part1]
cgactagtggtatcgt

SEQ ID NO: 14912 - DNA, 16 bp, Artificial Sequence
  synthetic [barcode part1]
cggaattctccagaac

SEQ ID NO: 14913 - DNA, 16 bp, Artificial Sequence
  synthetic [barcode part1]
aaggcgacaggataac

SEQ ID NO: 14914 - DNA, 16 bp, Artificial Sequence
  synthetic [barcode part1]
tcgtacctattagacc

SEQ ID NO: 14915 - DNA, 16 bp, Artificial Sequence
  synthetic [barcode part1]
cgtgcggcaagaagtt

SEQ ID NO: 14916 - DNA, 16 bp, Artificial Sequence
  synthetic [barcode part1]
attggtcgaccaatcg

SEQ ID NO: 14917 - DNA, 16 bp, Artificial Sequence
  synthetic [barcode part1]
atcctcacggaccact

SEQ ID NO: 14918 - DNA, 16 bp, Artificial Sequence
  synthetic [barcode part1]
actgactggccaattg

SEQ ID NO: 14919 - DNA, 16 bp, Artificial Sequence
  synthetic [barcode part1]
tctcgtactaggccgt

SEQ ID NO: 14920 - DNA, 16 bp, Artificial Sequence
  synthetic [barcode part1]
aacttgcctaccttag

SEQ ID NO: 14921 - DNA, 16 bp, Artificial Sequence
  synthetic [barcode part1]
gcgtagtaaggaactt

SEQ ID NO: 14922 - DNA, 16 bp, Artificial Sequence
  synthetic [barcode part1]
taagtagtatccgccg

SEQ ID NO: 14923 - DNA, 16 bp, Artificial Sequence
  synthetic [barcode part1]
gattggtatcggttgc

SEQ ID NO: 14924 - DNA, 16 bp, Artificial Sequence
  synthetic [barcode part1]
gcgcacagatcttaac

SEQ ID NO: 14925 - DNA, 16 bp, Artificial Sequence
  synthetic [barcode part1]
ttctctatctacggag

SEQ ID NO: 14926 - DNA, 16 bp, Artificial Sequence
  synthetic [barcode part1]
aattccgcaccacaag

SEQ ID NO: 14927 - DNA, 16 bp, Artificial Sequence
  synthetic [barcode part1]
gataagtgcgagtgag

SEQ ID NO: 14928 - DNA, 16 bp, Artificial Sequence
  synthetic [barcode part1]
attcgaccacgccttg

SEQ ID NO: 14929 - DNA, 16 bp, Artificial Sequence
  synthetic [barcode part1]
tctctaggccgatatt

SEQ ID NO: 14930 - DNA, 16 bp, Artificial Sequence
  synthetic [barcode part1]
aacggaccttggagtg

SEQ ID NO: 14931 - DNA, 16 bp, Artificial Sequence
  synthetic [barcode part1]
cgtaccttcgtacttc

SEQ ID NO: 14932 - DNA, 16 bp, Artificial Sequence
  synthetic [barcode part1]
ttccgtctctatcgtg

SEQ ID NO: 14933 - DNA, 16 bp, Artificial Sequence
  synthetic [barcode part1]
tcgttgccttgttgtc

SEQ ID NO: 14934 - DNA, 16 bp, Artificial Sequence
  synthetic [barcode part1]
acggtcactgactcct

SEQ ID NO: 14935 - DNA, 16 bp, Artificial Sequence
  synthetic [barcode part1]
cacgagtcgaatacct

SEQ ID NO: 14936 - DNA, 16 bp, Artificial Sequence
  synthetic [barcode part1]
aaggagtcctgacctt

SEQ ID NO: 14937 - DNA, 16 bp, Artificial Sequence
  synthetic [barcode part1]
tgcgatattgcctgcc

SEQ ID NO: 14938 - DNA, 16 bp, Artificial Sequence
  synthetic [barcode part1]
accttaccaccgacgt

SEQ ID NO: 14939 - DNA, 16 bp, Artificial Sequence
  synthetic [barcode part1]
acgttcacgtcgttcg

SEQ ID NO: 14940 - DNA, 16 bp, Artificial Sequence
  synthetic [barcode part1]
aataaccacgtctcct

SEQ ID NO: 14941 - DNA, 16 bp, Artificial Sequence
  synthetic [barcode part1]
acgtgtggtactacgt

SEQ ID NO: 14942 - DNA, 16 bp, Artificial Sequence
  synthetic [barcode part1]
atccaccgaactccac

SEQ ID NO: 14943 - DNA, 16 bp, Artificial Sequence
  synthetic [barcode part1]
agacaggagtactgcc

SEQ ID NO: 14944 - DNA, 16 bp, Artificial Sequence
  synthetic [barcode part1]
accgtgatatcacggt

SEQ ID NO: 14945 - DNA, 16 bp, Artificial Sequence
  synthetic [barcode part1]
gttctacgttcagact

SEQ ID NO: 14946 - DNA, 16 bp, Artificial Sequence
  synthetic [barcode part1]
cgaggtactattgtcg

SEQ ID NO: 14947 - DNA, 16 bp, Artificial Sequence
  synthetic [barcode part1]
tataatctctccgacg

SEQ ID NO: 14948 - DNA, 16 bp, Artificial Sequence
  synthetic [barcode part1]
tgactctgcactaact

SEQ ID NO: 14949 - DNA, 16 bp, Artificial Sequence
  synthetic [barcode part1]
cggtgatcgtgtcctt

SEQ ID NO: 14950 - DNA, 16 bp, Artificial Sequence
  synthetic [barcode part1]
gtgtatacaacgccgt

SEQ ID NO: 14951 - DNA, 16 bp, Artificial Sequence
  synthetic [barcode part1]
aattgtggaggagtct

SEQ ID NO: 14952 - DNA, 16 bp, Artificial Sequence
  synthetic [barcode part1]
ccggtagattcttgcc

SEQ ID NO: 14953 - DNA, 16 bp, Artificial Sequence
  synthetic [barcode part1]
tctgactcggcgtact

SEQ ID NO: 14954 - DNA, 16 bp, Artificial Sequence
  synthetic [barcode part1]
tagttgcacggaatag

SEQ ID NO: 14955 - DNA, 16 bp, Artificial Sequence
  synthetic [barcode part1]
ttattagaggacgcag

SEQ ID NO: 14956 - DNA, 16 bp, Artificial Sequence
  synthetic [barcode part1]
ttcgagtccgttaccg

SEQ ID NO: 14957 - DNA, 16 bp, Artificial Sequence
  synthetic [barcode part1]
ttactacactcgcggc

SEQ ID NO: 14958 - DNA, 16 bp, Artificial Sequence
  synthetic [barcode part1]
ccgatctattcggacc

SEQ ID NO: 14959 - DNA, 16 bp, Artificial Sequence
  synthetic [barcode part1]
atattcctagtccgac

SEQ ID NO: 14960 - DNA, 16 bp, Artificial Sequence
  synthetic [barcode part1]
gacaatcctggcaatc

SEQ ID NO: 14961 - DNA, 16 bp, Artificial Sequence
  synthetic [barcode part1]
gattcggccagtgatt

SEQ ID NO: 14962 - DNA, 16 bp, Artificial Sequence
  synthetic [barcode part1]
tctacttcaaggttcg

SEQ ID NO: 14963 - DNA, 16 bp, Artificial Sequence
  synthetic [barcode part1]
atcacgaacttgtctc

SEQ ID NO: 14964 - DNA, 16 bp, Artificial Sequence
  synthetic [barcode part1]
caggtacttctcagtt

SEQ ID NO: 14965 - DNA, 16 bp, Artificial Sequence
  synthetic [barcode part1]
tggacagtgttcactg

SEQ ID NO: 14966 - DNA, 16 bp, Artificial Sequence
  synthetic [barcode part1]
tactacttccgcaggc

SEQ ID NO: 14967 - DNA, 16 bp, Artificial Sequence
  synthetic [barcode part1]
cactcgcacttatcct

SEQ ID NO: 14968 - DNA, 16 bp, Artificial Sequence
  synthetic [barcode part1]
ttcctgacagtgtgtt

SEQ ID NO: 14969 - DNA, 16 bp, Artificial Sequence
  synthetic [barcode part1]
tacagacgtaggttcc

SEQ ID NO: 14970 - DNA, 16 bp, Artificial Sequence
  synthetic [barcode part1]
gaattgtctcgcactt

SEQ ID NO: 14971 - DNA, 16 bp, Artificial Sequence
  synthetic [barcode part1]
acaattgcgtgcgact

SEQ ID NO: 14972 - DNA, 16 bp, Artificial Sequence
  synthetic [barcode part1]
tacgacttacggactg

SEQ ID NO: 14973 - DNA, 16 bp, Artificial Sequence
  synthetic [barcode part1]
attgtatccttcgacg

SEQ ID NO: 14974 - DNA, 16 bp, Artificial Sequence
  synthetic [barcode part1]
ttcggatattcctcag

SEQ ID NO: 14975 - DNA, 16 bp, Artificial Sequence
  synthetic [barcode part1]
gacggtcttagtaacc

SEQ ID NO: 14976 - DNA, 16 bp, Artificial Sequence
  synthetic [barcode part1]
accggcaacaattacc

SEQ ID NO: 14977 - DNA, 16 bp, Artificial Sequence
  synthetic [barcode part1]
ttgcgtaggttctccg

SEQ ID NO: 14978 - DNA, 16 bp, Artificial Sequence
  synthetic [barcode part1]
tcaattcagtggcgac

SEQ ID NO: 14979 - DNA, 16 bp, Artificial Sequence
  synthetic [barcode part1]
actctagtggtgtcag

SEQ ID NO: 14980 - DNA, 16 bp, Artificial Sequence
  synthetic [barcode part1]
cgagtccgaacagtag

SEQ ID NO: 14981 - DNA, 16 bp, Artificial Sequence
  synthetic [barcode part1]
acagttcgcaggaacg

SEQ ID NO: 14982 - DNA, 16 bp, Artificial Sequence
  synthetic [barcode part1]
gcactctatacgagac

SEQ ID NO: 14983 - DNA, 16 bp, Artificial Sequence
  synthetic [barcode part1]
caatctctggcgcact

SEQ ID NO: 14984 - DNA, 16 bp, Artificial Sequence
  synthetic [barcode part1]
acggtattcctgagac

SEQ ID NO: 14985 - DNA, 16 bp, Artificial Sequence
  synthetic [barcode part1]
tgaacctgcagatctg

SEQ ID NO: 14986 - DNA, 16 bp, Artificial Sequence
  synthetic [barcode part1]
ccgtacgtcttagtcg

SEQ ID NO: 14987 - DNA, 16 bp, Artificial Sequence
  synthetic [barcode part1]
tcttgtacttccgtgc

SEQ ID NO: 14988 - DNA, 16 bp, Artificial Sequence
  synthetic [barcode part1]
gacacaccagtgtact

SEQ ID NO: 14989 - DNA, 16 bp, Artificial Sequence
  synthetic [barcode part1]
acaacaatctgcagag

SEQ ID NO: 14990 - DNA, 16 bp, Artificial Sequence
  synthetic [barcode part1]
ttgaattgccgtcgag

SEQ ID NO: 14991 - DNA, 16 bp, Artificial Sequence
  synthetic [barcode part1]
agtacactgcaaccac

SEQ ID NO: 14992 - DNA, 16 bp, Artificial Sequence
  synthetic [barcode part1]
aataatcggaacgcac

SEQ ID NO: 14993 - DNA, 16 bp, Artificial Sequence
  synthetic [barcode part1]
gttaacaacggccgtt

SEQ ID NO: 14994 - DNA, 16 bp, Artificial Sequence
  synthetic [barcode part1]
ccttgcaatcgccaac

SEQ ID NO: 14995 - DNA, 16 bp, Artificial Sequence
  synthetic [barcode part1]
agaggatctcggtctt

SEQ ID NO: 14996 - DNA, 16 bp, Artificial Sequence
  synthetic [barcode part1]
attcgaggcgacagac

SEQ ID NO: 14997 - DNA, 16 bp, Artificial Sequence
  synthetic [barcode part1]
ccgattcaggtacctc

SEQ ID NO: 14998 - DNA, 16 bp, Artificial Sequence
  synthetic [barcode part1]
gtgaggtgtagtgaag

SEQ ID NO: 14999 - DNA, 16 bp, Artificial Sequence
  synthetic [barcode part1]
caatcgtacctcttag

SEQ ID NO: 15000 - DNA, 16 bp, Artificial Sequence
  synthetic [barcode part1]
attacctggacttgtc

SEQ ID NO: 15001 - DNA, 16 bp, Artificial Sequence
  synthetic [barcode part1]
ttggtaagttcggcgt

SEQ ID NO: 15002 - DNA, 16 bp, Artificial Sequence
  synthetic [barcode part1]
actcagagaacggtgc

SEQ ID NO: 15003 - DNA, 16 bp, Artificial Sequence
  synthetic [barcode part1]
gtgcgaacagactgtg

SEQ ID NO: 15004 - DNA, 16 bp, Artificial Sequence
  synthetic [barcode part1]
cagttccaactggaac

SEQ ID NO: 15005 - DNA, 16 bp, Artificial Sequence
  synthetic [barcode part1]
gttcctccagtacacg

SEQ ID NO: 15006 - DNA, 16 bp, Artificial Sequence
  synthetic [barcode part1]
gagatcgaagacagtg

SEQ ID NO: 15007 - DNA, 16 bp, Artificial Sequence
  synthetic [barcode part1]
cgtcgagaagttatcc

SEQ ID NO: 15008 - DNA, 16 bp, Artificial Sequence
  synthetic [barcode part1]
ttactaacttccgcag

SEQ ID NO: 15009 - DNA, 16 bp, Artificial Sequence
  synthetic [barcode part1]
gttgcggttgttcacc

SEQ ID NO: 15010 - DNA, 16 bp, Artificial Sequence
  synthetic [barcode part1]
ccgtcgttaagtgcct

SEQ ID NO: 15011 - DNA, 16 bp, Artificial Sequence
  synthetic [barcode part1]
tagagtcacgttgtgc

SEQ ID NO: 15012 - DNA, 16 bp, Artificial Sequence
  synthetic [barcode part1]
cacggtcagagtagtg

SEQ ID NO: 15013 - DNA, 16 bp, Artificial Sequence
  synthetic [barcode part1]
ttgtcacacctcacct

SEQ ID NO: 15014 - DNA, 16 bp, Artificial Sequence
  synthetic [barcode part1]
atcactccgttgtcct

SEQ ID NO: 15015 - DNA, 16 bp, Artificial Sequence
  synthetic [barcode part1]
gcgtcgattggatatc

SEQ ID NO: 15016 - DNA, 16 bp, Artificial Sequence
  synthetic [barcode part1]
tcttaatccggtgtgt

SEQ ID NO: 15017 - DNA, 16 bp, Artificial Sequence
  synthetic [barcode part1]
agtgaccttcctgcgt

SEQ ID NO: 15018 - DNA, 16 bp, Artificial Sequence
  synthetic [barcode part1]
aaccacacgattacgc

SEQ ID NO: 15019 - DNA, 16 bp, Artificial Sequence
  synthetic [barcode part1]
gtacgatcagtgtgtc

SEQ ID NO: 15020 - DNA, 16 bp, Artificial Sequence
  synthetic [barcode part1]
tcgccactactactct

SEQ ID NO: 15021 - DNA, 16 bp, Artificial Sequence
  synthetic [barcode part1]
ttgtaggttaccgttc

SEQ ID NO: 15022 - DNA, 16 bp, Artificial Sequence
  synthetic [barcode part1]
aacactggtcaaccac

SEQ ID NO: 15023 - DNA, 16 bp, Artificial Sequence
  synthetic [barcode part1]
gacacgttgacgtgtt

SEQ ID NO: 15024 - DNA, 16 bp, Artificial Sequence
  synthetic [barcode part1]
gagttaagttggtacg

SEQ ID NO: 15025 - DNA, 16 bp, Artificial Sequence
  synthetic [barcode part1]
acctagatcacctcgc

SEQ ID NO: 15026 - DNA, 16 bp, Artificial Sequence
  synthetic [barcode part1]
tgactggactaaccgt

SEQ ID NO: 15027 - DNA, 16 bp, Artificial Sequence
  synthetic [barcode part1]
gttagaacagtgtgtg

SEQ ID NO: 15028 - DNA, 16 bp, Artificial Sequence
  synthetic [barcode part1]
gttgcctcacctgaac

SEQ ID NO: 15029 - DNA, 16 bp, Artificial Sequence
  synthetic [barcode part1]
aggtcttgtcacagtg

SEQ ID NO: 15030 - DNA, 16 bp, Artificial Sequence
  synthetic [barcode part1]
accggcactcaatctc

SEQ ID NO: 15031 - DNA, 16 bp, Artificial Sequence
  synthetic [barcode part1]
aatatctcgtcctacg

SEQ ID NO: 15032 - DNA, 16 bp, Artificial Sequence
  synthetic [barcode part1]
ataatctctcggcgag

SEQ ID NO: 15033 - DNA, 16 bp, Artificial Sequence
  synthetic [barcode part1]
tgtgaggaagaacgtg

SEQ ID NO: 15034 - DNA, 16 bp, Artificial Sequence
  synthetic [barcode part1]
acaagagtcaacgact

SEQ ID NO: 15035 - DNA, 16 bp, Artificial Sequence
  synthetic [barcode part1]
cgtagacaggtctact

SEQ ID NO: 15036 - DNA, 16 bp, Artificial Sequence
  synthetic [barcode part1]
aggcgatatcgaagag

SEQ ID NO: 15037 - DNA, 16 bp, Artificial Sequence
  synthetic [barcode part1]
ttagtggtacctccgc

SEQ ID NO: 15038 - DNA, 16 bp, Artificial Sequence
  synthetic [barcode part1]
caatcacggtgtgttg

SEQ ID NO: 15039 - DNA, 16 bp, Artificial Sequence
  synthetic [barcode part1]
gagaatatccggtggc

SEQ ID NO: 15040 - DNA, 16 bp, Artificial Sequence
  synthetic [barcode part1]
tctaatccacgtagtc

SEQ ID NO: 15041 - DNA, 16 bp, Artificial Sequence
  synthetic [barcode part1]
gagtcgcagactattc

SEQ ID NO: 15042 - DNA, 16 bp, Artificial Sequence
  synthetic [barcode part1]
tgcgtaagtaaccacc

SEQ ID NO: 15043 - DNA, 16 bp, Artificial Sequence
  synthetic [barcode part1]
acgacttcacctccag

SEQ ID NO: 15044 - DNA, 16 bp, Artificial Sequence
  synthetic [barcode part1]
tggaaggcacgtagtc

SEQ ID NO: 15045 - DNA, 16 bp, Artificial Sequence
  synthetic [barcode part1]
ccggtaataccggatt

SEQ ID NO: 15046 - DNA, 16 bp, Artificial Sequence
  synthetic [barcode part1]
cggtgcgttgagtatt

SEQ ID NO: 15047 - DNA, 16 bp, Artificial Sequence
  synthetic [barcode part1]
aattagtgcactgcgc

SEQ ID NO: 15048 - DNA, 16 bp, Artificial Sequence
  synthetic [barcode part1]
ccgtagagacgtactt

SEQ ID NO: 15049 - DNA, 16 bp, Artificial Sequence
  synthetic [barcode part1]
cgtatcctctgtatcc

SEQ ID NO: 15050 - DNA, 16 bp, Artificial Sequence
  synthetic [barcode part1]
aatcaagaggtcggag

SEQ ID NO: 15051 - DNA, 16 bp, Artificial Sequence
  synthetic [barcode part1]
aggtcactcgtgtcct

SEQ ID NO: 15052 - DNA, 16 bp, Artificial Sequence
  synthetic [barcode part1]
ttccttcggaactctc

SEQ ID NO: 15053 - DNA, 16 bp, Artificial Sequence
  synthetic [barcode part1]
caggacaagacactcg

SEQ ID NO: 15054 - DNA, 16 bp, Artificial Sequence
  synthetic [barcode part1]
attagttaccggccag

SEQ ID NO: 15055 - DNA, 16 bp, Artificial Sequence
  synthetic [barcode part1]
tacacagagtgacaac

SEQ ID NO: 15056 - DNA, 16 bp, Artificial Sequence
  synthetic [barcode part1]
gtggttacgtgactac

SEQ ID NO: 15057 - DNA, 16 bp, Artificial Sequence
  synthetic [barcode part1]
gcgtgtctattggtag

SEQ ID NO: 15058 - DNA, 16 bp, Artificial Sequence
  synthetic [barcode part1]
tgcgtgcagttaactg

SEQ ID NO: 15059 - DNA, 16 bp, Artificial Sequence
  synthetic [barcode part1]
cctcagttataccaac

SEQ ID NO: 15060 - DNA, 16 bp, Artificial Sequence
  synthetic [barcode part1]
gcgtcgatcttcagtc

SEQ ID NO: 15061 - DNA, 16 bp, Artificial Sequence
  synthetic [barcode part1]
ttctcaacaatcgtgc

SEQ ID NO: 15062 - DNA, 16 bp, Artificial Sequence
  synthetic [barcode part1]
gaggaatcggagagtt

SEQ ID NO: 15063 - DNA, 16 bp, Artificial Sequence
  synthetic [barcode part1]
ttatcgttccactgcc

SEQ ID NO: 15064 - DNA, 16 bp, Artificial Sequence
  synthetic [barcode part1]
gtctctcaggaagttg

SEQ ID NO: 15065 - DNA, 16 bp, Artificial Sequence
  synthetic [barcode part1]
tcggtctctgttactc

SEQ ID NO: 15066 - DNA, 16 bp, Artificial Sequence
  synthetic [barcode part1]
gcgtatacagtaccac

SEQ ID NO: 15067 - DNA, 16 bp, Artificial Sequence
  synthetic [barcode part1]
cagaatattgtcgccg

SEQ ID NO: 15068 - DNA, 16 bp, Artificial Sequence
  synthetic [barcode part1]
tctgtcgcaataggac

SEQ ID NO: 15069 - DNA, 16 bp, Artificial Sequence
  synthetic [barcode part1]
ttgccggaattaccag

SEQ ID NO: 15070 - DNA, 16 bp, Artificial Sequence
  synthetic [barcode part1]
ttaactaacgcacgcg

SEQ ID NO: 15071 - DNA, 16 bp, Artificial Sequence
  synthetic [barcode part1]
gaactggaggattgag

SEQ ID NO: 15072 - DNA, 16 bp, Artificial Sequence
  synthetic [barcode part1]
agtcctctacggatcc

SEQ ID NO: 15073 - DNA, 16 bp, Artificial Sequence
  synthetic [barcode part1]
ttctgccaggttcgtg

SEQ ID NO: 15074 - DNA, 16 bp, Artificial Sequence
  synthetic [barcode part1]
ccagacgtcgttctac

SEQ ID NO: 15075 - DNA, 16 bp, Artificial Sequence
  synthetic [barcode part1]
ataaggagtcgaatcc

SEQ ID NO: 15076 - DNA, 16 bp, Artificial Sequence
  synthetic [barcode part1]
tcggcaaccacacctt

SEQ ID NO: 15077 - DNA, 16 bp, Artificial Sequence
  synthetic [barcode part1]
atctgtcgtggcgtct

SEQ ID NO: 15078 - DNA, 16 bp, Artificial Sequence
  synthetic [barcode part1]
ttcaacgatctctacg

SEQ ID NO: 15079 - DNA, 16 bp, Artificial Sequence
  synthetic [barcode part1]
taggtattctcaccgt

SEQ ID NO: 15080 - DNA, 16 bp, Artificial Sequence
  synthetic [barcode part1]
tcttgcgccaggttac

SEQ ID NO: 15081 - DNA, 16 bp, Artificial Sequence
  synthetic [barcode part1]
tgcaatagtccgttct

SEQ ID NO: 15082 - DNA, 16 bp, Artificial Sequence
  synthetic [barcode part1]
agatccactaccgtcc

SEQ ID NO: 15083 - DNA, 16 bp, Artificial Sequence
  synthetic [barcode part1]
actacgtggagtggtg

SEQ ID NO: 15084 - DNA, 16 bp, Artificial Sequence
  synthetic [barcode part1]
gaatcaacgactgtag

SEQ ID NO: 15085 - DNA, 16 bp, Artificial Sequence
  synthetic [barcode part1]
cgcgcgataaggagtt

SEQ ID NO: 15086 - DNA, 16 bp, Artificial Sequence
  synthetic [barcode part1]
ttacgagtgtctcgcc

SEQ ID NO: 15087 - DNA, 16 bp, Artificial Sequence
  synthetic [barcode part1]
cgccaactcttggttg

SEQ ID NO: 15088 - DNA, 16 bp, Artificial Sequence
  synthetic [barcode part1]
aactgactacgtacgc

SEQ ID NO: 15089 - DNA, 16 bp, Artificial Sequence
  synthetic [barcode part1]
atacttctcggcggtc

SEQ ID NO: 15090 - DNA, 16 bp, Artificial Sequence
  synthetic [barcode part1]
acaggtccttctgatt

SEQ ID NO: 15091 - DNA, 16 bp, Artificial Sequence
  synthetic [barcode part1]
tacgtgattcaactcc

SEQ ID NO: 15092 - DNA, 16 bp, Artificial Sequence
  synthetic [barcode part1]
ttgcagaaggtgtctc

SEQ ID NO: 15093 - DNA, 16 bp, Artificial Sequence
  synthetic [barcode part1]
cggaattgatcggttc

SEQ ID NO: 15094 - DNA, 16 bp, Artificial Sequence
  synthetic [barcode part1]
gtgaaggttagtaacc

SEQ ID NO: 15095 - DNA, 16 bp, Artificial Sequence
  synthetic [barcode part1]
gttcagtacacttctg

SEQ ID NO: 15096 - DNA, 16 bp, Artificial Sequence
  synthetic [barcode part1]
atccttatatcggacc

SEQ ID NO: 15097 - DNA, 16 bp, Artificial Sequence
  synthetic [barcode part1]
ttctccgtatctcgtg

SEQ ID NO: 15098 - DNA, 16 bp, Artificial Sequence
  synthetic [barcode part1]
cgataacaccgttgac

SEQ ID NO: 15099 - DNA, 16 bp, Artificial Sequence
  synthetic [barcode part1]
atcgtactacggatcg

SEQ ID NO: 15100 - DNA, 16 bp, Artificial Sequence
  synthetic [barcode part1]
tgtaatacctgaggcc

SEQ ID NO: 15101 - DNA, 16 bp, Artificial Sequence
  synthetic [barcode part1]
gcaactacgtgtgatc

SEQ ID NO: 15102 - DNA, 16 bp, Artificial Sequence
  synthetic [barcode part1]
gcacgtcaatacactg

SEQ ID NO: 15103 - DNA, 16 bp, Artificial Sequence
  synthetic [barcode part1]
agattccggaatctcg

SEQ ID NO: 15104 - DNA, 16 bp, Artificial Sequence
  synthetic [barcode part1]
ttattatatccgcggc

SEQ ID NO: 15105 - DNA, 16 bp, Artificial Sequence
  synthetic [barcode part1]
cgcgtaacgttaacgt

SEQ ID NO: 15106 - DNA, 16 bp, Artificial Sequence
  synthetic [barcode part1]
tcgtgaagaattggac

SEQ ID NO: 15107 - DNA, 16 bp, Artificial Sequence
  synthetic [barcode part1]
actccacgtccaagtc

SEQ ID NO: 15108 - DNA, 16 bp, Artificial Sequence
  synthetic [barcode part1]
tagactatctctgcgt

SEQ ID NO: 15109 - DNA, 16 bp, Artificial Sequence
  synthetic [barcode part1]
tggttgatctcaggac

SEQ ID NO: 15110 - DNA, 16 bp, Artificial Sequence
  synthetic [barcode part1]
aggatagactcacagt

SEQ ID NO: 15111 - DNA, 16 bp, Artificial Sequence
  synthetic [barcode part1]
aacggtctgtactctt

SEQ ID NO: 15112 - DNA, 16 bp, Artificial Sequence
  synthetic [barcode part1]
actgaactggaggcac

SEQ ID NO: 15113 - DNA, 16 bp, Artificial Sequence
  synthetic [barcode part1]
aaggcaagaactcgtt

SEQ ID NO: 15114 - DNA, 16 bp, Artificial Sequence
  synthetic [barcode part1]
attgacgcgttccacc

SEQ ID NO: 15115 - DNA, 16 bp, Artificial Sequence
  synthetic [barcode part1]
tgtcgagtcgtatctt

SEQ ID NO: 15116 - DNA, 16 bp, Artificial Sequence
  synthetic [barcode part1]
atcaggtgtgatctgc

SEQ ID NO: 15117 - DNA, 16 bp, Artificial Sequence
  synthetic [barcode part1]
tgcggaaccgaactag

SEQ ID NO: 15118 - DNA, 16 bp, Artificial Sequence
  synthetic [barcode part1]
caagtaacgccacgag

SEQ ID NO: 15119 - DNA, 16 bp, Artificial Sequence
  synthetic [barcode part1]
gtcaagtatccttgtc

SEQ ID NO: 15120 - DNA, 16 bp, Artificial Sequence
  synthetic [barcode part1]
gtgaatctcaacacgc

SEQ ID NO: 15121 - DNA, 16 bp, Artificial Sequence
  synthetic [barcode part1]
gcggttaggtcgaagt

SEQ ID NO: 15122 - DNA, 16 bp, Artificial Sequence
  synthetic [barcode part1]
tctggtcgccagtatc

SEQ ID NO: 15123 - DNA, 16 bp, Artificial Sequence
  synthetic [barcode part1]
tcaacgaacagttcgc

SEQ ID NO: 15124 - DNA, 16 bp, Artificial Sequence
  synthetic [barcode part1]
ccagtgcgattgagag

SEQ ID NO: 15125 - DNA, 16 bp, Artificial Sequence
  synthetic [barcode part1]
gcgtaatcctcaattc

SEQ ID NO: 15126 - DNA, 16 bp, Artificial Sequence
  synthetic [barcode part1]
aggatcgtgtggatcg

SEQ ID NO: 15127 - DNA, 16 bp, Artificial Sequence
  synthetic [barcode part1]
gtctgcggttaaggag

SEQ ID NO: 15128 - DNA, 16 bp, Artificial Sequence
  synthetic [barcode part1]
acaactgcacagttgc

SEQ ID NO: 15129 - DNA, 16 bp, Artificial Sequence
  synthetic [barcode part1]
tctcctgtgccaacag

SEQ ID NO: 15130 - DNA, 16 bp, Artificial Sequence
  synthetic [barcode part1]
gaattagaccgacgcg

SEQ ID NO: 15131 - DNA, 16 bp, Artificial Sequence
  synthetic [barcode part1]
aacgttacgcacacgt

SEQ ID NO: 15132 - DNA, 16 bp, Artificial Sequence
  synthetic [barcode part1]
tcgtaggaacggcagt

SEQ ID NO: 15133 - DNA, 16 bp, Artificial Sequence
  synthetic [barcode part1]
accgcagagtattgtc

SEQ ID NO: 15134 - DNA, 16 bp, Artificial Sequence
  synthetic [barcode part1]
gtgatcaaccggtatc

SEQ ID NO: 15135 - DNA, 16 bp, Artificial Sequence
  synthetic [barcode part1]
cgtaactcgtgagttg

SEQ ID NO: 15136 - DNA, 16 bp, Artificial Sequence
  synthetic [barcode part1]
accttcaaggtcactt

SEQ ID NO: 15137 - DNA, 16 bp, Artificial Sequence
  synthetic [barcode part1]
taagtccacaggtctg

SEQ ID NO: 15138 - DNA, 16 bp, Artificial Sequence
  synthetic [barcode part1]
attgtataccgtcctg

SEQ ID NO: 15139 - DNA, 16 bp, Artificial Sequence
  synthetic [barcode part1]
gttacaaggcaccgtt

SEQ ID NO: 15140 - DNA, 16 bp, Artificial Sequence
  synthetic [barcode part1]
gaacggtgcacttgag

SEQ ID NO: 15141 - DNA, 16 bp, Artificial Sequence
  synthetic [barcode part1]
cctcagtagtccgtac

SEQ ID NO: 15142 - DNA, 16 bp, Artificial Sequence
  synthetic [barcode part1]
tgtacctacggtccgt

SEQ ID NO: 15143 - DNA, 16 bp, Artificial Sequence
  synthetic [barcode part1]
atatcgccttaaggcg

SEQ ID NO: 15144 - DNA, 16 bp, Artificial Sequence
  synthetic [barcode part1]
aacaattcctcacacc

SEQ ID NO: 15145 - DNA, 16 bp, Artificial Sequence
  synthetic [barcode part1]
cctctctgaagttcct

SEQ ID NO: 15146 - DNA, 16 bp, Artificial Sequence
  synthetic [barcode part1]
acgcaagtccgacaag

SEQ ID NO: 15147 - DNA, 16 bp, Artificial Sequence
  synthetic [barcode part1]
cgttggagagtcactt

SEQ ID NO: 15148 - DNA, 16 bp, Artificial Sequence
  synthetic [barcode part1]
ttcgagacggttagtc

SEQ ID NO: 15149 - DNA, 16 bp, Artificial Sequence
  synthetic [barcode part1]
gaacgtgtaacgaccg

SEQ ID NO: 15150 - DNA, 16 bp, Artificial Sequence
  synthetic [barcode part1]
attccgagattgaccg

SEQ ID NO: 15151 - DNA, 16 bp, Artificial Sequence
  synthetic [barcode part1]
gtcaatacgtcctgtt

SEQ ID NO: 15152 - DNA, 16 bp, Artificial Sequence
  synthetic [barcode part1]
attacctgttcacgac

SEQ ID NO: 15153 - DNA, 16 bp, Artificial Sequence
  synthetic [barcode part1]
ttcctaacaatcgcac

SEQ ID NO: 15154 - DNA, 16 bp, Artificial Sequence
  synthetic [barcode part1]
caacgtgacgcaatct

SEQ ID NO: 15155 - DNA, 16 bp, Artificial Sequence
  synthetic [barcode part1]
acctaaggcgacagac

SEQ ID NO: 15156 - DNA, 16 bp, Artificial Sequence
  synthetic [barcode part1]
actctattgttccgcc

SEQ ID NO: 15157 - DNA, 16 bp, Artificial Sequence
  synthetic [barcode part1]
cacactactggtcctg

SEQ ID NO: 15158 - DNA, 16 bp, Artificial Sequence
  synthetic [barcode part1]
ttatccactgtggtac

SEQ ID NO: 15159 - DNA, 16 bp, Artificial Sequence
  synthetic [barcode part1]
cgattgaaccgattgc

SEQ ID NO: 15160 - DNA, 16 bp, Artificial Sequence
  synthetic [barcode part1]
tgcaggtccacagatt

SEQ ID NO: 15161 - DNA, 16 bp, Artificial Sequence
  synthetic [barcode part1]
ttctgcactaggttgt

SEQ ID NO: 15162 - DNA, 16 bp, Artificial Sequence
  synthetic [barcode part1]
tgtaattgccgtcttg

SEQ ID NO: 15163 - DNA, 16 bp, Artificial Sequence
  synthetic [barcode part1]
gaaggatagtggtggt

SEQ ID NO: 15164 - DNA, 16 bp, Artificial Sequence
  synthetic [barcode part1]
tgacctacttggtgag

SEQ ID NO: 15165 - DNA, 16 bp, Artificial Sequence
  synthetic [barcode part1]
agtgaattcgttcgcg

SEQ ID NO: 15166 - DNA, 16 bp, Artificial Sequence
  synthetic [barcode part1]
aaccgatcgtacacac

SEQ ID NO: 15167 - DNA, 16 bp, Artificial Sequence
  synthetic [barcode part1]
tggttcctgatacgcc

SEQ ID NO: 15168 - DNA, 16 bp, Artificial Sequence
  synthetic [barcode part1]
accggaataacgcgtg

SEQ ID NO: 15169 - DNA, 16 bp, Artificial Sequence
  synthetic [barcode part1]
tagacacgaggtgacc

SEQ ID NO: 15170 - DNA, 16 bp, Artificial Sequence
  synthetic [barcode part1]
tccgtcaacacgactc

SEQ ID NO: 15171 - DNA, 16 bp, Artificial Sequence
  synthetic [barcode part1]
ttatcggcacggagag

SEQ ID NO: 15172 - DNA, 16 bp, Artificial Sequence
  synthetic [barcode part1]
tcgatactctcaatcg

SEQ ID NO: 15173 - DNA, 16 bp, Artificial Sequence
  synthetic [barcode part1]
aacctggtcaagtcgt

SEQ ID NO: 15174 - DNA, 16 bp, Artificial Sequence
  synthetic [barcode part1]
tgtcgtctaggttcgc

SEQ ID NO: 15175 - DNA, 16 bp, Artificial Sequence
  synthetic [barcode part1]
gagttggtgacgtacg

SEQ ID NO: 15176 - DNA, 16 bp, Artificial Sequence
  synthetic [barcode part1]
cgtattcctcgcactt

SEQ ID NO: 15177 - DNA, 16 bp, Artificial Sequence
  synthetic [barcode part1]
gtacgttggtgacgag

SEQ ID NO: 15178 - DNA, 16 bp, Artificial Sequence
  synthetic [barcode part1]
taattccgttacacgc

SEQ ID NO: 15179 - DNA, 16 bp, Artificial Sequence
  synthetic [barcode part1]
tgcctcactacggatc

SEQ ID NO: 15180 - DNA, 16 bp, Artificial Sequence
  synthetic [barcode part1]
tgactagtgaccgatc

SEQ ID NO: 15181 - DNA, 16 bp, Artificial Sequence
  synthetic [barcode part1]
atccagaggtacctac

SEQ ID NO: 15182 - DNA, 16 bp, Artificial Sequence
  synthetic [barcode part1]
ataaggaagttgccac

SEQ ID NO: 15183 - DNA, 16 bp, Artificial Sequence
  synthetic [barcode part1]
tcacgccttattgagt

SEQ ID NO: 15184 - DNA, 16 bp, Artificial Sequence
  synthetic [barcode part1]
ttcttgttccggtaag

SEQ ID NO: 15185 - DNA, 16 bp, Artificial Sequence
  synthetic [barcode part1]
cacaagtagtactcgc

SEQ ID NO: 15186 - DNA, 16 bp, Artificial Sequence
  synthetic [barcode part1]
gccgatactacgtagt

SEQ ID NO: 15187 - DNA, 16 bp, Artificial Sequence
  synthetic [barcode part1]
atcttcggtctagtgt

SEQ ID NO: 15188 - DNA, 16 bp, Artificial Sequence
  synthetic [barcode part1]
gccgatacggaagact

SEQ ID NO: 15189 - DNA, 16 bp, Artificial Sequence
  synthetic [barcode part1]
tgacggcaattcagtc

SEQ ID NO: 15190 - DNA, 16 bp, Artificial Sequence
  synthetic [barcode part1]
gcacagagaacacaag

SEQ ID NO: 15191 - DNA, 16 bp, Artificial Sequence
  synthetic [barcode part1]
acgtccgtgttgtctg

SEQ ID NO: 15192 - DNA, 16 bp, Artificial Sequence
  synthetic [barcode part1]
tgtattcggcggtctc

SEQ ID NO: 15193 - DNA, 16 bp, Artificial Sequence
  synthetic [barcode part1]
cggaaggtacacaatt

SEQ ID NO: 15194 - DNA, 16 bp, Artificial Sequence
  synthetic [barcode part1]
aactgtgtgactgtgc

SEQ ID NO: 15195 - DNA, 16 bp, Artificial Sequence
  synthetic [barcode part1]
acggtgaattcaggcg

SEQ ID NO: 15196 - DNA, 16 bp, Artificial Sequence
  synthetic [barcode part1]
gtctcaaggaaggaag

SEQ ID NO: 15197 - DNA, 16 bp, Artificial Sequence
  synthetic [barcode part1]
tccacgtagtcaccac

SEQ ID NO: 15198 - DNA, 16 bp, Artificial Sequence
  synthetic [barcode part1]
aacgtggtgaactgcg

SEQ ID NO: 15199 - DNA, 16 bp, Artificial Sequence
  synthetic [barcode part1]
gatacgttacggttgc

SEQ ID NO: 15200 - DNA, 16 bp, Artificial Sequence
  synthetic [barcode part1]
taggttgttggaccac

SEQ ID NO: 15201 - DNA, 16 bp, Artificial Sequence
  synthetic [barcode part1]
gaattaggtgcactag

SEQ ID NO: 15202 - DNA, 16 bp, Artificial Sequence
  synthetic [barcode part1]
tcttggcagttacgcc

SEQ ID NO: 15203 - DNA, 16 bp, Artificial Sequence
  synthetic [barcode part1]
tggtggtacacctcct

SEQ ID NO: 15204 - DNA, 16 bp, Artificial Sequence
  synthetic [barcode part1]
taccgtccagatccac

SEQ ID NO: 15205 - DNA, 16 bp, Artificial Sequence
  synthetic [barcode part1]
acttcttggaggatcg

SEQ ID NO: 15206 - DNA, 16 bp, Artificial Sequence
  synthetic [barcode part1]
accgagaagaggattg

SEQ ID NO: 15207 - DNA, 16 bp, Artificial Sequence
  synthetic [barcode part1]
gttctgtggtgtatct

SEQ ID NO: 15208 - DNA, 16 bp, Artificial Sequence
  synthetic [barcode part1]
ccgtaagactcggatt

SEQ ID NO: 15209 - DNA, 16 bp, Artificial Sequence
  synthetic [barcode part1]
tattgcctccggttct

SEQ ID NO: 15210 - DNA, 16 bp, Artificial Sequence
  synthetic [barcode part1]
cgaagaggagagattc

SEQ ID NO: 15211 - DNA, 16 bp, Artificial Sequence
  synthetic [barcode part1]
agtgactggttaccac

SEQ ID NO: 15212 - DNA, 16 bp, Artificial Sequence
  synthetic [barcode part1]
ttagtcgccgactaag

SEQ ID NO: 15213 - DNA, 16 bp, Artificial Sequence
  synthetic [barcode part1]
ttaaggtcagacgagt

SEQ ID NO: 15214 - DNA, 16 bp, Artificial Sequence
  synthetic [barcode part1]
gcgtcaccttgtctag

SEQ ID NO: 15215 - DNA, 16 bp, Artificial Sequence
  synthetic [barcode part1]
aggccactaggagtac

SEQ ID NO: 15216 - DNA, 16 bp, Artificial Sequence
  synthetic [barcode part1]
tcaacgtacgtaccag

SEQ ID NO: 15217 - DNA, 16 bp, Artificial Sequence
  synthetic [barcode part1]
aaggtgcgtcgtcaag

SEQ ID NO: 15218 - DNA, 16 bp, Artificial Sequence
  synthetic [barcode part1]
cactggattgtactct

SEQ ID NO: 15219 - DNA, 16 bp, Artificial Sequence
  synthetic [barcode part1]
agttggtcgcgtatac

SEQ ID NO: 15220 - DNA, 16 bp, Artificial Sequence
  synthetic [barcode part1]
ttaggcacaggtatcc

SEQ ID NO: 15221 - DNA, 16 bp, Artificial Sequence
  synthetic [barcode part1]
actctgattggtcgag

SEQ ID NO: 15222 - DNA, 16 bp, Artificial Sequence
  synthetic [barcode part1]
agtacgtgtcagtgtc

SEQ ID NO: 15223 - DNA, 16 bp, Artificial Sequence
  synthetic [barcode part1]
ttgacctggtgtgcct

SEQ ID NO: 15224 - DNA, 16 bp, Artificial Sequence
  synthetic [barcode part1]
cgaattccaccgtctg

SEQ ID NO: 15225 - DNA, 16 bp, Artificial Sequence
  synthetic [barcode part1]
actgaggcgtaaccag

SEQ ID NO: 15226 - DNA, 16 bp, Artificial Sequence
  synthetic [barcode part1]
gagttactgagttgcc

SEQ ID NO: 15227 - DNA, 16 bp, Artificial Sequence
  synthetic [barcode part1]
tgcggcaatagacgac

SEQ ID NO: 15228 - DNA, 16 bp, Artificial Sequence
  synthetic [barcode part1]
tggcgtgagagtagtc

SEQ ID NO: 15229 - DNA, 16 bp, Artificial Sequence
  synthetic [barcode part1]
gacactgcaaccaact

SEQ ID NO: 15230 - DNA, 16 bp, Artificial Sequence
  synthetic [barcode part1]
cgtgaacagtgaagtt

SEQ ID NO: 15231 - DNA, 16 bp, Artificial Sequence
  synthetic [barcode part1]
gatcacggattaaggt

SEQ ID NO: 15232 - DNA, 16 bp, Artificial Sequence
  synthetic [barcode part1]
acgacaccgatcagtt

SEQ ID NO: 15233 - DNA, 16 bp, Artificial Sequence
  synthetic [barcode part1]
tggagtcagaacctct

SEQ ID NO: 15234 - DNA, 16 bp, Artificial Sequence
  synthetic [barcode part1]
tagtgactcttcgcgc

SEQ ID NO: 15235 - DNA, 16 bp, Artificial Sequence
  synthetic [barcode part1]
taccactatccgaact

SEQ ID NO: 15236 - DNA, 16 bp, Artificial Sequence
  synthetic [barcode part1]
tatagtacgttcgtcc

SEQ ID NO: 15237 - DNA, 16 bp, Artificial Sequence
  synthetic [barcode part1]
aggtcgacaacgtacg

SEQ ID NO: 15238 - DNA, 16 bp, Artificial Sequence
  synthetic [barcode part1]
cacagacaggtctgtt

SEQ ID NO: 15239 - DNA, 16 bp, Artificial Sequence
  synthetic [barcode part1]
gagagaagaggtcttg

SEQ ID NO: 15240 - DNA, 16 bp, Artificial Sequence
  synthetic [barcode part1]
gagtggtgatctgcag

SEQ ID NO: 15241 - DNA, 16 bp, Artificial Sequence
  synthetic [barcode part1]
aagaggtgagtcaggt

SEQ ID NO: 15242 - DNA, 16 bp, Artificial Sequence
  synthetic [barcode part1]
ccgagtacttgccact

SEQ ID NO: 15243 - DNA, 16 bp, Artificial Sequence
  synthetic [barcode part1]
gtcttcggaatacgac

SEQ ID NO: 15244 - DNA, 16 bp, Artificial Sequence
  synthetic [barcode part1]
caacttgcgagttgtg

SEQ ID NO: 15245 - DNA, 16 bp, Artificial Sequence
  synthetic [barcode part1]
gtgaactcggtgagac

SEQ ID NO: 15246 - DNA, 16 bp, Artificial Sequence
  synthetic [barcode part1]
ttgcgttgtaacctgt

SEQ ID NO: 15247 - DNA, 16 bp, Artificial Sequence
  synthetic [barcode part1]
gtgaaggtaacagttc

SEQ ID NO: 15248 - DNA, 16 bp, Artificial Sequence
  synthetic [barcode part1]
aattccttacactggc

SEQ ID NO: 15249 - DNA, 16 bp, Artificial Sequence
  synthetic [barcode part1]
taattgacacggtgcc

SEQ ID NO: 15250 - DNA, 16 bp, Artificial Sequence
  synthetic [barcode part1]
accaccgtgtaggaag

SEQ ID NO: 15251 - DNA, 16 bp, Artificial Sequence
  synthetic [barcode part1]
agttgtcttcgtatcg

SEQ ID NO: 15252 - DNA, 16 bp, Artificial Sequence
  synthetic [barcode part1]
agacttgtgtcagtgc

SEQ ID NO: 15253 - DNA, 16 bp, Artificial Sequence
  synthetic [barcode part1]
cgaccaacaactggtt

SEQ ID NO: 15254 - DNA, 16 bp, Artificial Sequence
  synthetic [barcode part1]
tagtctggtctccacg

SEQ ID NO: 15255 - DNA, 16 bp, Artificial Sequence
  synthetic [barcode part1]
tcaccacaacgagatc

SEQ ID NO: 15256 - DNA, 16 bp, Artificial Sequence
  synthetic [barcode part1]
gaacaatagttacgcg

SEQ ID NO: 15257 - DNA, 16 bp, Artificial Sequence
  synthetic [barcode part1]
caccttccttctgtag

SEQ ID NO: 15258 - DNA, 16 bp, Artificial Sequence
  synthetic [barcode part1]
tatagtgcacctacct

SEQ ID NO: 15259 - DNA, 16 bp, Artificial Sequence
  synthetic [barcode part1]
gtcacagttactcact

SEQ ID NO: 15260 - DNA, 16 bp, Artificial Sequence
  synthetic [barcode part1]
ttaacggtgaagacac

SEQ ID NO: 15261 - DNA, 16 bp, Artificial Sequence
  synthetic [barcode part1]
aggtgagagtgtcacc

SEQ ID NO: 15262 - DNA, 16 bp, Artificial Sequence
  synthetic [barcode part1]
cctgaaggccaattgt

SEQ ID NO: 15263 - DNA, 16 bp, Artificial Sequence
  synthetic [barcode part1]
gtgtcggtcctactac

SEQ ID NO: 15264 - DNA, 16 bp, Artificial Sequence
  synthetic [barcode part1]
tggtccggagtacaag

SEQ ID NO: 15265 - DNA, 16 bp, Artificial Sequence
  synthetic [barcode part1]
atctcgagaggaagag

SEQ ID NO: 15266 - DNA, 16 bp, Artificial Sequence
  synthetic [barcode part1]
ccgttacggattcgtc

SEQ ID NO: 15267 - DNA, 16 bp, Artificial Sequence
  synthetic [barcode part1]
gtcttgccgttaatac

SEQ ID NO: 15268 - DNA, 16 bp, Artificial Sequence
  synthetic [barcode part1]
aggtaatacgtgactg

SEQ ID NO: 15269 - DNA, 16 bp, Artificial Sequence
  synthetic [barcode part1]
cacgtgcaactaactg

SEQ ID NO: 15270 - DNA, 16 bp, Artificial Sequence
  synthetic [barcode part1]
tgatctccgacgcgtt

SEQ ID NO: 15271 - DNA, 16 bp, Artificial Sequence
  synthetic [barcode part1]
gagtaaggtaacgtct

SEQ ID NO: 15272 - DNA, 16 bp, Artificial Sequence
  synthetic [barcode part1]
cgaatcaaccgagttc

SEQ ID NO: 15273 - DNA, 16 bp, Artificial Sequence
  synthetic [barcode part1]
aactatacgcgtgacc

SEQ ID NO: 15274 - DNA, 16 bp, Artificial Sequence
  synthetic [barcode part1]
cgaccaaggttgatct

SEQ ID NO: 15275 - DNA, 16 bp, Artificial Sequence
  synthetic [barcode part1]
caacgacggaacacgt

SEQ ID NO: 15276 - DNA, 16 bp, Artificial Sequence
  synthetic [barcode part1]
atcgcctctgcaagtc

SEQ ID NO: 15277 - DNA, 16 bp, Artificial Sequence
  synthetic [barcode part1]
aacttaggaccgtcgt

SEQ ID NO: 15278 - DNA, 16 bp, Artificial Sequence
  synthetic [barcode part1]
tactgagaggtacggc

SEQ ID NO: 15279 - DNA, 16 bp, Artificial Sequence
  synthetic [barcode part1]
cgtaatcgtgcaactg

SEQ ID NO: 15280 - DNA, 16 bp, Artificial Sequence
  synthetic [barcode part1]
taggaggattacgtac

SEQ ID NO: 15281 - DNA, 16 bp, Artificial Sequence
  synthetic [barcode part1]
gcactccagtctgact

SEQ ID NO: 15282 - DNA, 16 bp, Artificial Sequence
  synthetic [barcode part1]
aactgtgtgtgactgc

SEQ ID NO: 15283 - DNA, 16 bp, Artificial Sequence
  synthetic [barcode part1]
tgtcctaggacctatt

SEQ ID NO: 15284 - DNA, 16 bp, Artificial Sequence
  synthetic [barcode part1]
atatcggattgtcctc

SEQ ID NO: 15285 - DNA, 16 bp, Artificial Sequence
  synthetic [barcode part1]
aaggccaccagtgtag

SEQ ID NO: 15286 - DNA, 16 bp, Artificial Sequence
  synthetic [barcode part1]
gatcaatccgatcggt

SEQ ID NO: 15287 - DNA, 16 bp, Artificial Sequence
  synthetic [barcode part1]
caatcacgtaaggtag

SEQ ID NO: 15288 - DNA, 16 bp, Artificial Sequence
  synthetic [barcode part1]
aaggaacttcacaggt

SEQ ID NO: 15289 - DNA, 16 bp, Artificial Sequence
  synthetic [barcode part1]
ccgttacgagtagtac

SEQ ID NO: 15290 - DNA, 16 bp, Artificial Sequence
  synthetic [barcode part1]
cgttccttaacgattg

SEQ ID NO: 15291 - DNA, 16 bp, Artificial Sequence
  synthetic [barcode part1]
cctggtgtagagacag

SEQ ID NO: 15292 - DNA, 16 bp, Artificial Sequence
  synthetic [barcode part1]
caaggtcaaggtctct

SEQ ID NO: 15293 - DNA, 16 bp, Artificial Sequence
  synthetic [barcode part1]
gcagttgcctctcagt

SEQ ID NO: 15294 - DNA, 16 bp, Artificial Sequence
  synthetic [barcode part1]
cagtctcgaagaatcc

SEQ ID NO: 15295 - DNA, 16 bp, Artificial Sequence
  synthetic [barcode part1]
gtaccagtggccttct

SEQ ID NO: 15296 - DNA, 16 bp, Artificial Sequence
  synthetic [barcode part1]
tgtcctaggacaacgt

SEQ ID NO: 15297 - DNA, 16 bp, Artificial Sequence
  synthetic [barcode part1]
ttgatctgcggagtac

SEQ ID NO: 15298 - DNA, 16 bp, Artificial Sequence
  synthetic [barcode part1]
gtacgtgtacacacgt

SEQ ID NO: 15299 - DNA, 16 bp, Artificial Sequence
  synthetic [barcode part1]
gtacggtgattgaagt

SEQ ID NO: 15300 - DNA, 16 bp, Artificial Sequence
  synthetic [barcode part1]
ccaaggcgtctatctc

SEQ ID NO: 15301 - DNA, 16 bp, Artificial Sequence
  synthetic [barcode part1]
ttcggtaacagaggcg

SEQ ID NO: 15302 - DNA, 16 bp, Artificial Sequence
  synthetic [barcode part1]
atccttaaggttgtcc

SEQ ID NO: 15303 - DNA, 16 bp, Artificial Sequence
  synthetic [barcode part1]
tacacgttgactggtg

SEQ ID NO: 15304 - DNA, 16 bp, Artificial Sequence
  synthetic [barcode part1]
tataggattgacggtg

SEQ ID NO: 15305 - DNA, 16 bp, Artificial Sequence
  synthetic [barcode part1]
agtaagtacggtgccg

SEQ ID NO: 15306 - DNA, 16 bp, Artificial Sequence
  synthetic [barcode part1]
aagtccagtggttacc

SEQ ID NO: 15307 - DNA, 16 bp, Artificial Sequence
  synthetic [barcode part1]
tcttactccgtaggcg

SEQ ID NO: 15308 - DNA, 16 bp, Artificial Sequence
  synthetic [barcode part1]
aataatcgaccaccgc

SEQ ID NO: 15309 - DNA, 16 bp, Artificial Sequence
  synthetic [barcode part1]
tcctagaatccgtccg

SEQ ID NO: 15310 - DNA, 16 bp, Artificial Sequence
  synthetic [barcode part1]
cactagtggaaccgag

SEQ ID NO: 15311 - DNA, 16 bp, Artificial Sequence
  synthetic [barcode part1]
gtctcacgatacgtcc

SEQ ID NO: 15312 - DNA, 16 bp, Artificial Sequence
  synthetic [barcode part1]
tgattaactccgaggc

SEQ ID NO: 15313 - DNA, 16 bp, Artificial Sequence
  synthetic [barcode part1]
tccgttcttattcgcg

SEQ ID NO: 15314 - DNA, 16 bp, Artificial Sequence
  synthetic [barcode part1]
gtctcaattgaccgag

SEQ ID NO: 15315 - DNA, 16 bp, Artificial Sequence
  synthetic [barcode part1]
aggattcaacgaacac

SEQ ID NO: 15316 - DNA, 16 bp, Artificial Sequence
  synthetic [barcode part1]
taccgttaacacgtct

SEQ ID NO: 15317 - DNA, 16 bp, Artificial Sequence
  synthetic [barcode part1]
cgtgtagaacgtacct

SEQ ID NO: 15318 - DNA, 16 bp, Artificial Sequence
  synthetic [barcode part1]
agatccgtggatctgt

SEQ ID NO: 15319 - DNA, 16 bp, Artificial Sequence
  synthetic [barcode part1]
caggttgtatactcct

SEQ ID NO: 15320 - DNA, 16 bp, Artificial Sequence
  synthetic [barcode part1]
attgtgcaatcgtgcg

SEQ ID NO: 15321 - DNA, 16 bp, Artificial Sequence
  synthetic [barcode part1]
gcaaccgtacagttac

SEQ ID NO: 15322 - DNA, 16 bp, Artificial Sequence
  synthetic [barcode part1]
gtgagttccttcaatc

SEQ ID NO: 15323 - DNA, 16 bp, Artificial Sequence
  synthetic [barcode part1]
aggttcacgtcgatac

SEQ ID NO: 15324 - DNA, 16 bp, Artificial Sequence
  synthetic [barcode part1]
cactctacctggacgt

SEQ ID NO: 15325 - DNA, 16 bp, Artificial Sequence
  synthetic [barcode part1]
gtgaatatctaggacg

SEQ ID NO: 15326 - DNA, 16 bp, Artificial Sequence
  synthetic [barcode part1]
acgtacgcaacactgt

SEQ ID NO: 15327 - DNA, 16 bp, Artificial Sequence
  synthetic [barcode part1]
ccacgtgttgacttcg

SEQ ID NO: 15328 - DNA, 16 bp, Artificial Sequence
  synthetic [barcode part1]
gaagtgcaactcgacg

SEQ ID NO: 15329 - DNA, 16 bp, Artificial Sequence
  synthetic [barcode part1]
agaatactcggcggtg

SEQ ID NO: 15330 - DNA, 16 bp, Artificial Sequence
  synthetic [barcode part1]
gtgcaattctcggtcc

SEQ ID NO: 15331 - DNA, 16 bp, Artificial Sequence
  synthetic [barcode part1]
gtattgcaccttggag

SEQ ID NO: 15332 - DNA, 16 bp, Artificial Sequence
  synthetic [barcode part1]
ccacctactacaacgc

SEQ ID NO: 15333 - DNA, 16 bp, Artificial Sequence
  synthetic [barcode part1]
agtaagtcgcctactg

SEQ ID NO: 15334 - DNA, 16 bp, Artificial Sequence
  synthetic [barcode part1]
tcaggcctacgtcttg

SEQ ID NO: 15335 - DNA, 16 bp, Artificial Sequence
  synthetic [barcode part1]
tacacgtgtcacaacg

SEQ ID NO: 15336 - DNA, 16 bp, Artificial Sequence
  synthetic [barcode part1]
ataatcgcctcctagt

SEQ ID NO: 15337 - DNA, 16 bp, Artificial Sequence
  synthetic [barcode part1]
taatctcaccgcgtgc

SEQ ID NO: 15338 - DNA, 16 bp, Artificial Sequence
  synthetic [barcode part1]
ttacctggcggcactt

SEQ ID NO: 15339 - DNA, 16 bp, Artificial Sequence
  synthetic [barcode part1]
aataggttcgcggcag

SEQ ID NO: 15340 - DNA, 16 bp, Artificial Sequence
  synthetic [barcode part1]
ttgactcctcacaagt

SEQ ID NO: 15341 - DNA, 16 bp, Artificial Sequence
  synthetic [barcode part1]
atccagagtaggtctc

SEQ ID NO: 15342 - DNA, 16 bp, Artificial Sequence
  synthetic [barcode part1]
gaacaggtgtctatcc

SEQ ID NO: 15343 - DNA, 16 bp, Artificial Sequence
  synthetic [barcode part1]
tattccggtgagttct

SEQ ID NO: 15344 - DNA, 16 bp, Artificial Sequence
  synthetic [barcode part1]
tcgtgcgagttggaag

SEQ ID NO: 15345 - DNA, 16 bp, Artificial Sequence
  synthetic [barcode part1]
acctgtcggtgttacc

SEQ ID NO: 15346 - DNA, 16 bp, Artificial Sequence
  synthetic [barcode part1]
ccttgtaccgagtcgt

SEQ ID NO: 15347 - DNA, 16 bp, Artificial Sequence
  synthetic [barcode part1]
gccagtactgtgtagt

SEQ ID NO: 15348 - DNA, 16 bp, Artificial Sequence
  synthetic [barcode part1]
atcggttcagtgtcag

SEQ ID NO: 15349 - DNA, 16 bp, Artificial Sequence
  synthetic [barcode part1]
gtctgtacttctagtg

SEQ ID NO: 15350 - DNA, 16 bp, Artificial Sequence
  synthetic [barcode part1]
aggtccaatccaggtt

SEQ ID NO: 15351 - DNA, 16 bp, Artificial Sequence
  synthetic [barcode part1]
attagacgcggaagtt

SEQ ID NO: 15352 - DNA, 16 bp, Artificial Sequence
  synthetic [barcode part1]
agaccacgcaacttgt

SEQ ID NO: 15353 - DNA, 16 bp, Artificial Sequence
  synthetic [barcode part1]
atcggtattgttgtcc

SEQ ID NO: 15354 - DNA, 16 bp, Artificial Sequence
  synthetic [barcode part1]
ccttctgatccgaacg

SEQ ID NO: 15355 - DNA, 16 bp, Artificial Sequence
  synthetic [barcode part1]
gcagttgagaatcagt

SEQ ID NO: 15356 - DNA, 16 bp, Artificial Sequence
  synthetic [barcode part1]
ttcgttagtgcagttc

SEQ ID NO: 15357 - DNA, 16 bp, Artificial Sequence
  synthetic [barcode part1]
ttccaattcggcgcac

SEQ ID NO: 15358 - DNA, 16 bp, Artificial Sequence
  synthetic [barcode part1]
tcacaaggaacactcc

SEQ ID NO: 15359 - DNA, 16 bp, Artificial Sequence
  synthetic [barcode part1]
acgtgttgacacgttg

SEQ ID NO: 15360 - DNA, 16 bp, Artificial Sequence
  synthetic [barcode part1]
gaggcaacgtctagac

SEQ ID NO: 15361 - DNA, 16 bp, Artificial Sequence
  synthetic [barcode part1]
gtcctaccggattcac

SEQ ID NO: 15362 - DNA, 16 bp, Artificial Sequence
  synthetic [barcode part1]
ttcctcgtgttagtag

SEQ ID NO: 15363 - DNA, 16 bp, Artificial Sequence
  synthetic [barcode part1]
agtctactcacagacg

SEQ ID NO: 15364 - DNA, 16 bp, Artificial Sequence
  synthetic [barcode part1]
cacttcggtaataggc

SEQ ID NO: 15365 - DNA, 16 bp, Artificial Sequence
  synthetic [barcode part1]
tccacgtggagtatac

SEQ ID NO: 15366 - DNA, 16 bp, Artificial Sequence
  synthetic [barcode part1]
gtgtgacctccgatct

SEQ ID NO: 15367 - DNA, 16 bp, Artificial Sequence
  synthetic [barcode part1]
atcttcgcactagact

SEQ ID NO: 15368 - DNA, 16 bp, Artificial Sequence
  synthetic [barcode part1]
tcgaacgaggtggtgt

SEQ ID NO: 15369 - DNA, 16 bp, Artificial Sequence
  synthetic [barcode part1]
aggactcactctaggt

SEQ ID NO: 15370 - DNA, 16 bp, Artificial Sequence
  synthetic [barcode part1]
cgtaatccgacttccg

SEQ ID NO: 15371 - DNA, 16 bp, Artificial Sequence
  synthetic [barcode part1]
aaccgaccgactaact

SEQ ID NO: 15372 - DNA, 16 bp, Artificial Sequence
  synthetic [barcode part1]
tgattgaacgccgtgt

SEQ ID NO: 15373 - DNA, 16 bp, Artificial Sequence
  synthetic [barcode part1]
tcaggccttctgtacg

SEQ ID NO: 15374 - DNA, 16 bp, Artificial Sequence
  synthetic [barcode part1]
aatattggccaaccgc

SEQ ID NO: 15375 - DNA, 16 bp, Artificial Sequence
  synthetic [barcode part1]
aggcactctactccgt

SEQ ID NO: 15376 - DNA, 16 bp, Artificial Sequence
  synthetic [barcode part1]
ttcctcctatacgcgt

SEQ ID NO: 15377 - DNA, 16 bp, Artificial Sequence
  synthetic [barcode part1]
gaccttcagttcgtgc

SEQ ID NO: 15378 - DNA, 16 bp, Artificial Sequence
  synthetic [barcode part1]
cgacagaattctgtcg

SEQ ID NO: 15379 - DNA, 16 bp, Artificial Sequence
  synthetic [barcode part1]
gataagactccactgc

SEQ ID NO: 15380 - DNA, 16 bp, Artificial Sequence
  synthetic [barcode part1]
acaacactcaggactc

SEQ ID NO: 15381 - DNA, 16 bp, Artificial Sequence
  synthetic [barcode part1]
tccgtacttggtgacc

SEQ ID NO: 15382 - DNA, 16 bp, Artificial Sequence
  synthetic [barcode part1]
ccaaccgttagttgag

SEQ ID NO: 15383 - DNA, 16 bp, Artificial Sequence
  synthetic [barcode part1]
ttctcggactaatacc

SEQ ID NO: 15384 - DNA, 16 bp, Artificial Sequence
  synthetic [barcode part1]
caattcctagtcgtgt

SEQ ID NO: 15385 - DNA, 16 bp, Artificial Sequence
  synthetic [barcode part1]
tatcttctgcgaggag

SEQ ID NO: 15386 - DNA, 16 bp, Artificial Sequence
  synthetic [barcode part1]
caacgaggtctacgag

SEQ ID NO: 15387 - DNA, 16 bp, Artificial Sequence
  synthetic [barcode part1]
caattgaaccggtcgt

SEQ ID NO: 15388 - DNA, 16 bp, Artificial Sequence
  synthetic [barcode part1]
ttcagtggtagaagtg

SEQ ID NO: 15389 - DNA, 16 bp, Artificial Sequence
  synthetic [barcode part1]
acaaggcgtctataag

SEQ ID NO: 15390 - DNA, 16 bp, Artificial Sequence
  synthetic [barcode part1]
gtactacgataccacg

SEQ ID NO: 15391 - DNA, 16 bp, Artificial Sequence
  synthetic [barcode part1]
gactctactatctgtg

SEQ ID NO: 15392 - DNA, 16 bp, Artificial Sequence
  synthetic [barcode part1]
tagtcacaagtcgaag

SEQ ID NO: 15393 - DNA, 16 bp, Artificial Sequence
  synthetic [barcode part1]
gtagtcagatcagaac

SEQ ID NO: 15394 - DNA, 16 bp, Artificial Sequence
  synthetic [barcode part1]
actgataaggccaagt

SEQ ID NO: 15395 - DNA, 16 bp, Artificial Sequence
  synthetic [barcode part1]
aggccgtcgaagatac

SEQ ID NO: 15396 - DNA, 16 bp, Artificial Sequence
  synthetic [barcode part1]
aacacgtaaccagaac

SEQ ID NO: 15397 - DNA, 16 bp, Artificial Sequence
  synthetic [barcode part1]
aataggatcggtgcgc

SEQ ID NO: 15398 - DNA, 16 bp, Artificial Sequence
  synthetic [barcode part1]
cctggttaagaagtcc

SEQ ID NO: 15399 - DNA, 16 bp, Artificial Sequence
  synthetic [barcode part1]
tctgtcctaggtagag

SEQ ID NO: 15400 - DNA, 16 bp, Artificial Sequence
  synthetic [barcode part1]
tgacttcgcgtattgt

SEQ ID NO: 15401 - DNA, 16 bp, Artificial Sequence
  synthetic [barcode part1]
gtaatccgcgagaacg

SEQ ID NO: 15402 - DNA, 16 bp, Artificial Sequence
  synthetic [barcode part1]
gtcaactactacggtg

SEQ ID NO: 15403 - DNA, 16 bp, Artificial Sequence
  synthetic [barcode part1]
agtgaggtgcaggttc

SEQ ID NO: 15404 - DNA, 16 bp, Artificial Sequence
  synthetic [barcode part1]
tcacaacgttggtcag

SEQ ID NO: 15405 - DNA, 16 bp, Artificial Sequence
  synthetic [barcode part1]
cggtgcggttagaagt

SEQ ID NO: 15406 - DNA, 16 bp, Artificial Sequence
  synthetic [barcode part1]
tcttgacggcctgtgt

SEQ ID NO: 15407 - DNA, 16 bp, Artificial Sequence
  synthetic [barcode part1]
gtccgttcttgagacc

SEQ ID NO: 15408 - DNA, 16 bp, Artificial Sequence
  synthetic [barcode part1]
tccttctgtactgcac

SEQ ID NO: 15409 - DNA, 16 bp, Artificial Sequence
  synthetic [barcode part1]
gcagagacggttcaac

SEQ ID NO: 15410 - DNA, 16 bp, Artificial Sequence
  synthetic [barcode part1]
gtggtgtagaactcct

SEQ ID NO: 15411 - DNA, 16 bp, Artificial Sequence
  synthetic [barcode part1]
actgcgataagtaggt

SEQ ID NO: 15412 - DNA, 16 bp, Artificial Sequence
  synthetic [barcode part1]
ccaggtacaaggcagt

SEQ ID NO: 15413 - DNA, 16 bp, Artificial Sequence
  synthetic [barcode part1]
tcagacgtaaggtagt

SEQ ID NO: 15414 - DNA, 16 bp, Artificial Sequence
  synthetic [barcode part1]
aacaccgaaggtctct

SEQ ID NO: 15415 - DNA, 16 bp, Artificial Sequence
  synthetic [barcode part1]
cagatcacgtgtctcc

SEQ ID NO: 15416 - DNA, 16 bp, Artificial Sequence
  synthetic [barcode part1]
gtgtgataatcctctc

SEQ ID NO: 15417 - DNA, 16 bp, Artificial Sequence
  synthetic [barcode part1]
tggtgcacgtaagtct

SEQ ID NO: 15418 - DNA, 16 bp, Artificial Sequence
  synthetic [barcode part1]
gtgacacgttgcaact

SEQ ID NO: 15419 - DNA, 16 bp, Artificial Sequence
  synthetic [barcode part1]
gcggtggtattaatag

SEQ ID NO: 15420 - DNA, 16 bp, Artificial Sequence
  synthetic [barcode part1]
cgtagacgaacggtgt

SEQ ID NO: 15421 - DNA, 16 bp, Artificial Sequence
  synthetic [barcode part1]
tccagttgtcggcact

SEQ ID NO: 15422 - DNA, 16 bp, Artificial Sequence
  synthetic [barcode part1]
gagtgtgacacagaag

SEQ ID NO: 15423 - DNA, 16 bp, Artificial Sequence
  synthetic [barcode part1]
gtacacgttcctcctt

SEQ ID NO: 15424 - DNA, 16 bp, Artificial Sequence
  synthetic [barcode part1]
accgagattgagagag

SEQ ID NO: 15425 - DNA, 16 bp, Artificial Sequence
  synthetic [barcode part1]
ttctagtaactacgcc

SEQ ID NO: 15426 - DNA, 16 bp, Artificial Sequence
  synthetic [barcode part1]
gcggtaatcgtgcaag

SEQ ID NO: 15427 - DNA, 16 bp, Artificial Sequence
  synthetic [barcode part1]
tgtgtactggtaccag

SEQ ID NO: 15428 - DNA, 16 bp, Artificial Sequence
  synthetic [barcode part1]
gagtgacacgtgatcg

SEQ ID NO: 15429 - DNA, 16 bp, Artificial Sequence
  synthetic [barcode part1]
acgaactacgcagttc

SEQ ID NO: 15430 - DNA, 16 bp, Artificial Sequence
  synthetic [barcode part1]
acgcaatccgatctcc

SEQ ID NO: 15431 - DNA, 16 bp, Artificial Sequence
  synthetic [barcode part1]
gtgacagataatcacg

SEQ ID NO: 15432 - DNA, 16 bp, Artificial Sequence
  synthetic [barcode part1]
acagtgtcaaccaacc

SEQ ID NO: 15433 - DNA, 16 bp, Artificial Sequence
  synthetic [barcode part1]
gactcagtgtgttctt

SEQ ID NO: 15434 - DNA, 16 bp, Artificial Sequence
  synthetic [barcode part1]
atatctagtcctgtcg

SEQ ID NO: 15435 - DNA, 16 bp, Artificial Sequence
  synthetic [barcode part1]
acagactagtctacgc

SEQ ID NO: 15436 - DNA, 16 bp, Artificial Sequence
  synthetic [barcode part1]
tctcgcagagaatacc

SEQ ID NO: 15437 - DNA, 16 bp, Artificial Sequence
  synthetic [barcode part1]
acttgagacagtgaac

SEQ ID NO: 15438 - DNA, 16 bp, Artificial Sequence
  synthetic [barcode part1]
ataccgaactatctcc

SEQ ID NO: 15439 - DNA, 16 bp, Artificial Sequence
  synthetic [barcode part1]
tgaggcaacaaccacg

SEQ ID NO: 15440 - DNA, 16 bp, Artificial Sequence
  synthetic [barcode part1]
tgatcactctggcctg

SEQ ID NO: 15441 - DNA, 16 bp, Artificial Sequence
  synthetic [barcode part1]
tgatccagtggttcag

SEQ ID NO: 15442 - DNA, 16 bp, Artificial Sequence
  synthetic [barcode part1]
gttctcgaggtcgttc

SEQ ID NO: 15443 - DNA, 16 bp, Artificial Sequence
  synthetic [barcode part1]
agttacgcgattgcac

SEQ ID NO: 15444 - DNA, 16 bp, Artificial Sequence
  synthetic [barcode part1]
tcacggaatcctccgt

SEQ ID NO: 15445 - DNA, 16 bp, Artificial Sequence
  synthetic [barcode part1]
tcagtctcttgcaagt

SEQ ID NO: 15446 - DNA, 16 bp, Artificial Sequence
  synthetic [barcode part1]
gactataacacgccgt

SEQ ID NO: 15447 - DNA, 16 bp, Artificial Sequence
  synthetic [barcode part1]
gaacggacggaatctc

SEQ ID NO: 15448 - DNA, 16 bp, Artificial Sequence
  synthetic [barcode part1]
acacagtgtgttgacc

SEQ ID NO: 15449 - DNA, 16 bp, Artificial Sequence
  synthetic [barcode part1]
caactagtcgagatcc

SEQ ID NO: 15450 - DNA, 16 bp, Artificial Sequence
  synthetic [barcode part1]
gtgtatctccgacctg

SEQ ID NO: 15451 - DNA, 16 bp, Artificial Sequence
  synthetic [barcode part1]
gtactgtctgtggtag

SEQ ID NO: 15452 - DNA, 16 bp, Artificial Sequence
  synthetic [barcode part1]
gagttatccgcgcctt

SEQ ID NO: 15453 - DNA, 16 bp, Artificial Sequence
  synthetic [barcode part1]
aggtatcgcggtgaac

SEQ ID NO: 15454 - DNA, 16 bp, Artificial Sequence
  synthetic [barcode part1]
tgcagttcgcaagttg

SEQ ID NO: 15455 - DNA, 16 bp, Artificial Sequence
  synthetic [barcode part1]
aaggtctcacttgttc

SEQ ID NO: 15456 - DNA, 16 bp, Artificial Sequence
  synthetic [barcode part1]
cactgttagaccaggt

SEQ ID NO: 15457 - DNA, 16 bp, Artificial Sequence
  synthetic [barcode part1]
gaaccttcgactagtg

SEQ ID NO: 15458 - DNA, 16 bp, Artificial Sequence
  synthetic [barcode part1]
accgcagtagacagac

SEQ ID NO: 15459 - DNA, 16 bp, Artificial Sequence
  synthetic [barcode part1]
tccgtggtaagtatcg

SEQ ID NO: 15460 - DNA, 16 bp, Artificial Sequence
  synthetic [barcode part1]
tcgttgttctaggtgt

SEQ ID NO: 15461 - DNA, 16 bp, Artificial Sequence
  synthetic [barcode part1]
tagaggaatcacacgt

SEQ ID NO: 15462 - DNA, 16 bp, Artificial Sequence
  synthetic [barcode part1]
gtaacactacgacacc

SEQ ID NO: 15463 - DNA, 16 bp, Artificial Sequence
  synthetic [barcode part1]
ttataccgcagaggtc

SEQ ID NO: 15464 - DNA, 16 bp, Artificial Sequence
  synthetic [barcode part1]
gataaccggaggtgtc

SEQ ID NO: 15465 - DNA, 16 bp, Artificial Sequence
  synthetic [barcode part1]
tggtggtaacctggtt

SEQ ID NO: 15466 - DNA, 16 bp, Artificial Sequence
  synthetic [barcode part1]
gtaggagttggatcgc

SEQ ID NO: 15467 - DNA, 16 bp, Artificial Sequence
  synthetic [barcode part1]
attaagtctgtgcctc

SEQ ID NO: 15468 - DNA, 16 bp, Artificial Sequence
  synthetic [barcode part1]
acctgtatacaccgag

SEQ ID NO: 15469 - DNA, 16 bp, Artificial Sequence
  synthetic [barcode part1]
gaccttcaactacgcc

SEQ ID NO: 15470 - DNA, 16 bp, Artificial Sequence
  synthetic [barcode part1]
gaggcgagatagagtt

SEQ ID NO: 15471 - DNA, 16 bp, Artificial Sequence
  synthetic [barcode part1]
tacgttcgcgacctgt

SEQ ID NO: 15472 - DNA, 16 bp, Artificial Sequence
  synthetic [barcode part1]
tcaactggaggaagag

SEQ ID NO: 15473 - DNA, 16 bp, Artificial Sequence
  synthetic [barcode part1]
acgcacgttagaactc

SEQ ID NO: 15474 - DNA, 16 bp, Artificial Sequence
  synthetic [barcode part1]
agaagacgagtgtctt

SEQ ID NO: 15475 - DNA, 16 bp, Artificial Sequence
  synthetic [barcode part1]
gaaggtccttcaactg

SEQ ID NO: 15476 - DNA, 16 bp, Artificial Sequence
  synthetic [barcode part1]
ttccgtggttatcaac

SEQ ID NO: 15477 - DNA, 16 bp, Artificial Sequence
  synthetic [barcode part1]
tcgtgaatctgatctc

SEQ ID NO: 15478 - DNA, 16 bp, Artificial Sequence
  synthetic [barcode part1]
tgagttaccttgcact

SEQ ID NO: 15479 - DNA, 16 bp, Artificial Sequence
  synthetic [barcode part1]
atcagattctgcgtct

SEQ ID NO: 15480 - DNA, 16 bp, Artificial Sequence
  synthetic [barcode part1]
tcaactcctgtcacct

SEQ ID NO: 15481 - DNA, 16 bp, Artificial Sequence
  synthetic [barcode part1]
tctagactgttctgtg

SEQ ID NO: 15482 - DNA, 16 bp, Artificial Sequence
  synthetic [barcode part1]
ttggcgactgtgcctt

SEQ ID NO: 15483 - DNA, 16 bp, Artificial Sequence
  synthetic [barcode part1]
ccttgtgtcgaactgc

SEQ ID NO: 15484 - DNA, 16 bp, Artificial Sequence
  synthetic [barcode part1]
aactacgagtcgaggc

SEQ ID NO: 15485 - DNA, 16 bp, Artificial Sequence
  synthetic [barcode part1]
agaaggcgacgtactc

SEQ ID NO: 15486 - DNA, 16 bp, Artificial Sequence
  synthetic [barcode part1]
atctggtaccaggttg

SEQ ID NO: 15487 - DNA, 16 bp, Artificial Sequence
  synthetic [barcode part1]
gtcgaagtagtatacg

SEQ ID NO: 15488 - DNA, 16 bp, Artificial Sequence
  synthetic [barcode part1]
tacaccttcaccaagt

SEQ ID NO: 15489 - DNA, 16 bp, Artificial Sequence
  synthetic [barcode part1]
gacgccgtgtgatatt

SEQ ID NO: 15490 - DNA, 16 bp, Artificial Sequence
  synthetic [barcode part1]
gtgactagaccaggac

SEQ ID NO: 15491 - DNA, 16 bp, Artificial Sequence
  synthetic [barcode part1]
gaacgcagacctagtg

SEQ ID NO: 15492 - DNA, 16 bp, Artificial Sequence
  synthetic [barcode part1]
tagaactcgtggcgtt

SEQ ID NO: 15493 - DNA, 16 bp, Artificial Sequence
  synthetic [barcode part1]
aatagacgcctactcg

SEQ ID NO: 15494 - DNA, 16 bp, Artificial Sequence
  synthetic [barcode part1]
agacagataggcaggt

SEQ ID NO: 15495 - DNA, 16 bp, Artificial Sequence
  synthetic [barcode part1]
aggtataatcgtcgag

SEQ ID NO: 15496 - DNA, 16 bp, Artificial Sequence
  synthetic [barcode part1]
tgaacgcaggataact

SEQ ID NO: 15497 - DNA, 16 bp, Artificial Sequence
  synthetic [barcode part1]
acacactggtgacgag

SEQ ID NO: 15498 - DNA, 16 bp, Artificial Sequence
  synthetic [barcode part1]
gcgatactgatcgact

SEQ ID NO: 15499 - DNA, 16 bp, Artificial Sequence
  synthetic [barcode part1]
actcagaccgtcttgc

SEQ ID NO: 15500 - DNA, 16 bp, Artificial Sequence
  synthetic [barcode part1]
atcttgtcagacttgc

SEQ ID NO: 15501 - DNA, 16 bp, Artificial Sequence
  synthetic [barcode part1]
cctcgtgtgtactctt

SEQ ID NO: 15502 - DNA, 16 bp, Artificial Sequence
  synthetic [barcode part1]
ttgacttccgtcactc

SEQ ID NO: 15503 - DNA, 16 bp, Artificial Sequence
  synthetic [barcode part1]
gtcggtaaggtcaggt

SEQ ID NO: 15504 - DNA, 16 bp, Artificial Sequence
  synthetic [barcode part1]
atagtcagactgaggt

SEQ ID NO: 15505 - DNA, 16 bp, Artificial Sequence
  synthetic [barcode part1]
atcctagagaactccg

SEQ ID NO: 15506 - DNA, 16 bp, Artificial Sequence
  synthetic [barcode part1]
acacgagttgcacttg

SEQ ID NO: 15507 - DNA, 16 bp, Artificial Sequence
  synthetic [barcode part1]
gcaccttaatctaacc

SEQ ID NO: 15508 - DNA, 16 bp, Artificial Sequence
  synthetic [barcode part1]
tccgatcacgttgacc

SEQ ID NO: 15509 - DNA, 16 bp, Artificial Sequence
  synthetic [barcode part1]
gtgcaattcctaatcc

SEQ ID NO: 15510 - DNA, 16 bp, Artificial Sequence
  synthetic [barcode part1]
cctcactagtagagtg

SEQ ID NO: 15511 - DNA, 16 bp, Artificial Sequence
  synthetic [barcode part1]
gacgttgacacgtgtt

SEQ ID NO: 15512 - DNA, 16 bp, Artificial Sequence
  synthetic [barcode part1]
tccggtgttattggag

SEQ ID NO: 15513 - DNA, 16 bp, Artificial Sequence
  synthetic [barcode part1]
tgagatcgtactgtgc

SEQ ID NO: 15514 - DNA, 16 bp, Artificial Sequence
  synthetic [barcode part1]
tgcgtcgttagtctcg

SEQ ID NO: 15515 - DNA, 16 bp, Artificial Sequence
  synthetic [barcode part1]
cgtaatcactactctg

SEQ ID NO: 15516 - DNA, 16 bp, Artificial Sequence
  synthetic [barcode part1]
attctgttcacgcaac

SEQ ID NO: 15517 - DNA, 16 bp, Artificial Sequence
  synthetic [barcode part1]
tggacgtatcggaggt

SEQ ID NO: 15518 - DNA, 16 bp, Artificial Sequence
  synthetic [barcode part1]
tcgtcggttaggttag

SEQ ID NO: 15519 - DNA, 16 bp, Artificial Sequence
  synthetic [barcode part1]
ttagtcttgtcagtgc

SEQ ID NO: 15520 - DNA, 16 bp, Artificial Sequence
  synthetic [barcode part1]
tgcctcttcggatcag

SEQ ID NO: 15521 - DNA, 16 bp, Artificial Sequence
  synthetic [barcode part1]
gtgtcttctaggccgt

SEQ ID NO: 15522 - DNA, 16 bp, Artificial Sequence
  synthetic [barcode part1]
ccttgataaggcggtt

SEQ ID NO: 15523 - DNA, 16 bp, Artificial Sequence
  synthetic [barcode part1]
taggttcggcagaacg

SEQ ID NO: 15524 - DNA, 16 bp, Artificial Sequence
  synthetic [barcode part1]
attaggtctcgcgcct

SEQ ID NO: 15525 - DNA, 16 bp, Artificial Sequence
  synthetic [barcode part1]
tcgagttcttctgtag

SEQ ID NO: 15526 - DNA, 16 bp, Artificial Sequence
  synthetic [barcode part1]
ccgattacaactggtg

SEQ ID NO: 15527 - DNA, 16 bp, Artificial Sequence
  synthetic [barcode part1]
cctctgataattacgc

SEQ ID NO: 15528 - DNA, 16 bp, Artificial Sequence
  synthetic [barcode part1]
ccgactcctcaattct

SEQ ID NO: 15529 - DNA, 16 bp, Artificial Sequence
  synthetic [barcode part1]
tcgattcgagtgttct

SEQ ID NO: 15530 - DNA, 16 bp, Artificial Sequence
  synthetic [barcode part1]
gatcagtcgatactgc

SEQ ID NO: 15531 - DNA, 16 bp, Artificial Sequence
  synthetic [barcode part1]
ttcttacagactaccg

SEQ ID NO: 15532 - DNA, 16 bp, Artificial Sequence
  synthetic [barcode part1]
cgttcacaacaccacc

SEQ ID NO: 15533 - DNA, 16 bp, Artificial Sequence
  synthetic [barcode part1]
acgaattgtacggcct

SEQ ID NO: 15534 - DNA, 16 bp, Artificial Sequence
  synthetic [barcode part1]
ttactcgacgaacggt

SEQ ID NO: 15535 - DNA, 16 bp, Artificial Sequence
  synthetic [barcode part1]
atagtcctcgcactcg

SEQ ID NO: 15536 - DNA, 16 bp, Artificial Sequence
  synthetic [barcode part1]
tacagtggaacggacc

SEQ ID NO: 15537 - DNA, 16 bp, Artificial Sequence
  synthetic [barcode part1]
tgcggtgttcgttcac

SEQ ID NO: 15538 - DNA, 16 bp, Artificial Sequence
  synthetic [barcode part1]
tgatctcttccggtct

SEQ ID NO: 15539 - DNA, 16 bp, Artificial Sequence
  synthetic [barcode part1]
cgaacttgcctcactg

SEQ ID NO: 15540 - DNA, 16 bp, Artificial Sequence
  synthetic [barcode part1]
acggagatcggcaatc

SEQ ID NO: 15541 - DNA, 16 bp, Artificial Sequence
  synthetic [barcode part1]
atactaaggaacgacc

SEQ ID NO: 15542 - DNA, 16 bp, Artificial Sequence
  synthetic [barcode part1]
tgaggttcagtcgatc

SEQ ID NO: 15543 - DNA, 16 bp, Artificial Sequence
  synthetic [barcode part1]
tcctgtctgaagtgag

SEQ ID NO: 15544 - DNA, 16 bp, Artificial Sequence
  synthetic [barcode part1]
gtctaagaagtccgtc

SEQ ID NO: 15545 - DNA, 16 bp, Artificial Sequence
  synthetic [barcode part1]
agtagagtgtaccagt

SEQ ID NO: 15546 - DNA, 16 bp, Artificial Sequence
  synthetic [barcode part1]
aaccggaactcttcag

SEQ ID NO: 15547 - DNA, 16 bp, Artificial Sequence
  synthetic [barcode part1]
tgtgtcttaccgagtt

SEQ ID NO: 15548 - DNA, 16 bp, Artificial Sequence
  synthetic [barcode part1]
gcctatagtacggttg

SEQ ID NO: 15549 - DNA, 16 bp, Artificial Sequence
  synthetic [barcode part1]
tacgagtgaacggtgc

SEQ ID NO: 15550 - DNA, 16 bp, Artificial Sequence
  synthetic [barcode part1]
acacgacagagaatct

SEQ ID NO: 15551 - DNA, 16 bp, Artificial Sequence
  synthetic [barcode part1]
gtcctaatccttctcg

SEQ ID NO: 15552 - DNA, 16 bp, Artificial Sequence
  synthetic [barcode part1]
agaggcgaatagttct

SEQ ID NO: 15553 - DNA, 16 bp, Artificial Sequence
  synthetic [barcode part1]
cgtatcctcaccgaac

SEQ ID NO: 15554 - DNA, 16 bp, Artificial Sequence
  synthetic [barcode part1]
ttgttcttcagacacg

SEQ ID NO: 15555 - DNA, 16 bp, Artificial Sequence
  synthetic [barcode part1]
gaatccagacgataac

SEQ ID NO: 15556 - DNA, 16 bp, Artificial Sequence
  synthetic [barcode part1]
ttaaggtggcgtcgtt

SEQ ID NO: 15557 - DNA, 16 bp, Artificial Sequence
  synthetic [barcode part1]
cagtacgtcttactgt

SEQ ID NO: 15558 - DNA, 16 bp, Artificial Sequence
  synthetic [barcode part1]
agtacgtacaccagtc

SEQ ID NO: 15559 - DNA, 16 bp, Artificial Sequence
  synthetic [barcode part1]
atcaagaggaggactg

SEQ ID NO: 15560 - DNA, 16 bp, Artificial Sequence
  synthetic [barcode part1]
tcgtccttaactctcg

SEQ ID NO: 15561 - DNA, 16 bp, Artificial Sequence
  synthetic [barcode part1]
cgaactacgacttgac

SEQ ID NO: 15562 - DNA, 16 bp, Artificial Sequence
  synthetic [barcode part1]
ccggtcttccaatctt

SEQ ID NO: 15563 - DNA, 16 bp, Artificial Sequence
  synthetic [barcode part1]
cagtgcaagaacaact

SEQ ID NO: 15564 - DNA, 16 bp, Artificial Sequence
  synthetic [barcode part1]
atcacggtcacctatt

SEQ ID NO: 15565 - DNA, 16 bp, Artificial Sequence
  synthetic [barcode part1]
cgttgtccttgacttc

SEQ ID NO: 15566 - DNA, 16 bp, Artificial Sequence
  synthetic [barcode part1]
gccaatagtagaacac

SEQ ID NO: 15567 - DNA, 16 bp, Artificial Sequence
  synthetic [barcode part1]
atctcgagtacgtgtg

SEQ ID NO: 15568 - DNA, 16 bp, Artificial Sequence
  synthetic [barcode part1]
aaggcctagactctgt

SEQ ID NO: 15569 - DNA, 16 bp, Artificial Sequence
  synthetic [barcode part1]
taaccgagagacttcc

SEQ ID NO: 15570 - DNA, 16 bp, Artificial Sequence
  synthetic [barcode part1]
acacggccagtatatc

SEQ ID NO: 15571 - DNA, 16 bp, Artificial Sequence
  synthetic [barcode part1]
cgtaacgtatcgtggt

SEQ ID NO: 15572 - DNA, 16 bp, Artificial Sequence
  synthetic [barcode part1]
tgttgacgaggtcgag

SEQ ID NO: 15573 - DNA, 16 bp, Artificial Sequence
  synthetic [barcode part1]
gcagtagtctaatccg

SEQ ID NO: 15574 - DNA, 16 bp, Artificial Sequence
  synthetic [barcode part1]
aagattgaactgcacg

SEQ ID NO: 15575 - DNA, 16 bp, Artificial Sequence
  synthetic [barcode part1]
cctgttacgtgaatct

SEQ ID NO: 15576 - DNA, 16 bp, Artificial Sequence
  synthetic [barcode part1]
acggttagagaggtcc

SEQ ID NO: 15577 - DNA, 16 bp, Artificial Sequence
  synthetic [barcode part1]
acgtcggattgtctcc

SEQ ID NO: 15578 - DNA, 16 bp, Artificial Sequence
  synthetic [barcode part1]
agtgactctccacacc

SEQ ID NO: 15579 - DNA, 16 bp, Artificial Sequence
  synthetic [barcode part1]
acagatctcgagtgtc

SEQ ID NO: 15580 - DNA, 16 bp, Artificial Sequence
  synthetic [barcode part1]
agtaagacagtgaggc

SEQ ID NO: 15581 - DNA, 16 bp, Artificial Sequence
  synthetic [barcode part1]
ataccttgattgccac

SEQ ID NO: 15582 - DNA, 16 bp, Artificial Sequence
  synthetic [barcode part1]
cgttccttgtaggaag

SEQ ID NO: 15583 - DNA, 16 bp, Artificial Sequence
  synthetic [barcode part1]
acgtgtaaggatctcc

SEQ ID NO: 15584 - DNA, 16 bp, Artificial Sequence
  synthetic [barcode part1]
attccttccgattccg

SEQ ID NO: 15585 - DNA, 16 bp, Artificial Sequence
  synthetic [barcode part1]
agttgcgagagttagt

SEQ ID NO: 15586 - DNA, 16 bp, Artificial Sequence
  synthetic [barcode part1]
gtgtggtcgattacgt

SEQ ID NO: 15587 - DNA, 16 bp, Artificial Sequence
  synthetic [barcode part1]
cctctcaggtgtgttg

SEQ ID NO: 15588 - DNA, 16 bp, Artificial Sequence
  synthetic [barcode part1]
acactactctggaacg

SEQ ID NO: 15589 - DNA, 16 bp, Artificial Sequence
  synthetic [barcode part1]
tggttctcgatacgtt

SEQ ID NO: 15590 - DNA, 16 bp, Artificial Sequence
  synthetic [barcode part1]
cgcggcaatagacagt

SEQ ID NO: 15591 - DNA, 16 bp, Artificial Sequence
  synthetic [barcode part1]
gccacttccacgaatc

SEQ ID NO: 15592 - DNA, 16 bp, Artificial Sequence
  synthetic [barcode part1]
atctctgtgtcctcgt

SEQ ID NO: 15593 - DNA, 16 bp, Artificial Sequence
  synthetic [barcode part1]
gttgacaagacgttcc

SEQ ID NO: 15594 - DNA, 16 bp, Artificial Sequence
  synthetic [barcode part1]
tagtaccgcaggtgag

SEQ ID NO: 15595 - DNA, 16 bp, Artificial Sequence
  synthetic [barcode part1]
gccagactgagagtac

SEQ ID NO: 15596 - DNA, 16 bp, Artificial Sequence
  synthetic [barcode part1]
cggcaacgtacaagac

SEQ ID NO: 15597 - DNA, 16 bp, Artificial Sequence
  synthetic [barcode part1]
ttccttccgacactac

SEQ ID NO: 15598 - DNA, 16 bp, Artificial Sequence
  synthetic [barcode part1]
gagtacgcaacggttg

SEQ ID NO: 15599 - DNA, 16 bp, Artificial Sequence
  synthetic [barcode part1]
tcgtaggtacttcact

SEQ ID NO: 15600 - DNA, 16 bp, Artificial Sequence
  synthetic [barcode part1]
tcctctggtaattgtg

SEQ ID NO: 15601 - DNA, 16 bp, Artificial Sequence
  synthetic [barcode part1]
aataggtcgtcacaag

SEQ ID NO: 15602 - DNA, 16 bp, Artificial Sequence
  synthetic [barcode part1]
caggccaagttgttac

SEQ ID NO: 15603 - DNA, 16 bp, Artificial Sequence
  synthetic [barcode part1]
acgatcgcagtgtgtt

SEQ ID NO: 15604 - DNA, 16 bp, Artificial Sequence
  synthetic [barcode part1]
actacgaggtagacgc

SEQ ID NO: 15605 - DNA, 16 bp, Artificial Sequence
  synthetic [barcode part1]
atatcaagaaggtcgc

SEQ ID NO: 15606 - DNA, 16 bp, Artificial Sequence
  synthetic [barcode part1]
tgaagaacgcgtaatc

SEQ ID NO: 15607 - DNA, 16 bp, Artificial Sequence
  synthetic [barcode part1]
gtgcctgcagaacaag

SEQ ID NO: 15608 - DNA, 16 bp, Artificial Sequence
  synthetic [barcode part1]
tacgtagatcttccac

SEQ ID NO: 15609 - DNA, 16 bp, Artificial Sequence
  synthetic [barcode part1]
tcagttgactgcaacg

SEQ ID NO: 15610 - DNA, 16 bp, Artificial Sequence
  synthetic [barcode part1]
agacgttcactgcctc

SEQ ID NO: 15611 - DNA, 16 bp, Artificial Sequence
  synthetic [barcode part1]
gacacgatatcaagtg

SEQ ID NO: 15612 - DNA, 16 bp, Artificial Sequence
  synthetic [barcode part1]
atagtcgtgcggttac

SEQ ID NO: 15613 - DNA, 16 bp, Artificial Sequence
  synthetic [barcode part1]
gcaagttgttaaggac

SEQ ID NO: 15614 - DNA, 16 bp, Artificial Sequence
  synthetic [barcode part1]
gacacgactatcggag

SEQ ID NO: 15615 - DNA, 16 bp, Artificial Sequence
  synthetic [barcode part1]
gcgcaattacacggtt

SEQ ID NO: 15616 - DNA, 16 bp, Artificial Sequence
  synthetic [barcode part1]
gcaatactagtcgacc

SEQ ID NO: 15617 - DNA, 16 bp, Artificial Sequence
  synthetic [barcode part1]
tggttgaaggatctcc

SEQ ID NO: 15618 - DNA, 16 bp, Artificial Sequence
  synthetic [barcode part1]
caacggacggatactg

SEQ ID NO: 15619 - DNA, 16 bp, Artificial Sequence
  synthetic [barcode part1]
tgtgcaagaactagac

SEQ ID NO: 15620 - DNA, 16 bp, Artificial Sequence
  synthetic [barcode part1]
gaagttcacggataac

SEQ ID NO: 15621 - DNA, 16 bp, Artificial Sequence
  synthetic [barcode part1]
cacttgttgccgtggt

SEQ ID NO: 15622 - DNA, 16 bp, Artificial Sequence
  synthetic [barcode part1]
tgacgaggtctataag

SEQ ID NO: 15623 - DNA, 16 bp, Artificial Sequence
  synthetic [barcode part1]
aggagacgtagtcacc

SEQ ID NO: 15624 - DNA, 16 bp, Artificial Sequence
  synthetic [barcode part1]
gtagagatagtccagt

SEQ ID NO: 15625 - DNA, 16 bp, Artificial Sequence
  synthetic [barcode part1]
gagtcgtgatagtcct

SEQ ID NO: 15626 - DNA, 16 bp, Artificial Sequence
  synthetic [barcode part1]
tacttcagtagacctc

SEQ ID NO: 15627 - DNA, 16 bp, Artificial Sequence
  synthetic [barcode part1]
atctcgcgagtactcc

SEQ ID NO: 15628 - DNA, 16 bp, Artificial Sequence
  synthetic [barcode part1]
acaaccgtcggaaggt

SEQ ID NO: 15629 - DNA, 16 bp, Artificial Sequence
  synthetic [barcode part1]
agtgatattgcgaacg

SEQ ID NO: 15630 - DNA, 16 bp, Artificial Sequence
  synthetic [barcode part1]
gcacgaacagactacg

SEQ ID NO: 15631 - DNA, 16 bp, Artificial Sequence
  synthetic [barcode part1]
ttcgcgcgttgttggt

SEQ ID NO: 15632 - DNA, 16 bp, Artificial Sequence
  synthetic [barcode part1]
agagaattcgtacgac

SEQ ID NO: 15633 - DNA, 16 bp, Artificial Sequence
  synthetic [barcode part1]
cactgaagtaaggatc

SEQ ID NO: 15634 - DNA, 16 bp, Artificial Sequence
  synthetic [barcode part1]
gttacctctcaagtgt

SEQ ID NO: 15635 - DNA, 16 bp, Artificial Sequence
  synthetic [barcode part1]
tacaggcaacaggatt

SEQ ID NO: 15636 - DNA, 16 bp, Artificial Sequence
  synthetic [barcode part1]
tgaacctgttcacgag

SEQ ID NO: 15637 - DNA, 16 bp, Artificial Sequence
  synthetic [barcode part1]
gaattccaaggccttg

SEQ ID NO: 15638 - DNA, 16 bp, Artificial Sequence
  synthetic [barcode part1]
cagattctgttacctg

SEQ ID NO: 15639 - DNA, 16 bp, Artificial Sequence
  synthetic [barcode part1]
tccagtcgtacaccac

SEQ ID NO: 15640 - DNA, 16 bp, Artificial Sequence
  synthetic [barcode part1]
tcgattccttacgagt

SEQ ID NO: 15641 - DNA, 16 bp, Artificial Sequence
  synthetic [barcode part1]
atcactctgaacgtct

SEQ ID NO: 15642 - DNA, 16 bp, Artificial Sequence
  synthetic [barcode part1]
gagtacttggaacggc

SEQ ID NO: 15643 - DNA, 16 bp, Artificial Sequence
  synthetic [barcode part1]
agtaagtctgtccgtg

SEQ ID NO: 15644 - DNA, 16 bp, Artificial Sequence
  synthetic [barcode part1]
agagtatcgcagagag

SEQ ID NO: 15645 - DNA, 16 bp, Artificial Sequence
  synthetic [barcode part1]
tccgttcttgcaatag

SEQ ID NO: 15646 - DNA, 16 bp, Artificial Sequence
  synthetic [barcode part1]
agtaacagttccaccg

SEQ ID NO: 15647 - DNA, 16 bp, Artificial Sequence
  synthetic [barcode part1]
cacgttcacaactcgc

SEQ ID NO: 15648 - DNA, 16 bp, Artificial Sequence
  synthetic [barcode part1]
tcgtgcgtgattgtag

SEQ ID NO: 15649 - DNA, 16 bp, Artificial Sequence
  synthetic [barcode part1]
tctgttagaccgtatc

SEQ ID NO: 15650 - DNA, 16 bp, Artificial Sequence
  synthetic [barcode part1]
agtgaagtcctcgact

SEQ ID NO: 15651 - DNA, 16 bp, Artificial Sequence
  synthetic [barcode part1]
cactgtcgatatactc

SEQ ID NO: 15652 - DNA, 16 bp, Artificial Sequence
  synthetic [barcode part1]
cggactctcactctag

SEQ ID NO: 15653 - DNA, 16 bp, Artificial Sequence
  synthetic [barcode part1]
caacaacgccgttaac

SEQ ID NO: 15654 - DNA, 16 bp, Artificial Sequence
  synthetic [barcode part1]
cacgaatcactattcc

SEQ ID NO: 15655 - DNA, 16 bp, Artificial Sequence
  synthetic [barcode part1]
ttcggcgatcttcacg

SEQ ID NO: 15656 - DNA, 16 bp, Artificial Sequence
  synthetic [barcode part1]
tcaggagagtcgtgtg

SEQ ID NO: 15657 - DNA, 16 bp, Artificial Sequence
  synthetic [barcode part1]
accgcactgtattgag

SEQ ID NO: 15658 - DNA, 16 bp, Artificial Sequence
  synthetic [barcode part1]
agaggcagtaattcac

SEQ ID NO: 15659 - DNA, 16 bp, Artificial Sequence
  synthetic [barcode part1]
tcttggcgaccgtatc

SEQ ID NO: 15660 - DNA, 16 bp, Artificial Sequence
  synthetic [barcode part1]
gagattcttgtctgtc

SEQ ID NO: 15661 - DNA, 16 bp, Artificial Sequence
  synthetic [barcode part1]
tattgaggtcctcact

SEQ ID NO: 15662 - DNA, 16 bp, Artificial Sequence
  synthetic [barcode part1]
acagttgtgtggtcac

SEQ ID NO: 15663 - DNA, 16 bp, Artificial Sequence
  synthetic [barcode part1]
cgagatctgcagtact

SEQ ID NO: 15664 - DNA, 16 bp, Artificial Sequence
  synthetic [barcode part1]
caaccggtggtattac

SEQ ID NO: 15665 - DNA, 16 bp, Artificial Sequence
  synthetic [barcode part1]
atccgatcctcgtacg

SEQ ID NO: 15666 - DNA, 16 bp, Artificial Sequence
  synthetic [barcode part1]
gtccggtagagtacag

SEQ ID NO: 15667 - DNA, 16 bp, Artificial Sequence
  synthetic [barcode part1]
gagaacgcaagaacac

SEQ ID NO: 15668 - DNA, 16 bp, Artificial Sequence
  synthetic [barcode part1]
gcgactattagtctct

SEQ ID NO: 15669 - DNA, 16 bp, Artificial Sequence
  synthetic [barcode part1]
gtcggactaagttacc

SEQ ID NO: 15670 - DNA, 16 bp, Artificial Sequence
  synthetic [barcode part1]
aagttgaccaggagag

SEQ ID NO: 15671 - DNA, 16 bp, Artificial Sequence
  synthetic [barcode part1]
agtcgcgtgcaattac

SEQ ID NO: 15672 - DNA, 16 bp, Artificial Sequence
  synthetic [barcode part1]
gcgttaggtgcaactt

SEQ ID NO: 15673 - DNA, 16 bp, Artificial Sequence
  synthetic [barcode part1]
tatcgtcgagtacctt

SEQ ID NO: 15674 - DNA, 16 bp, Artificial Sequence
  synthetic [barcode part1]
tgcggattgccgttct

SEQ ID NO: 15675 - DNA, 16 bp, Artificial Sequence
  synthetic [barcode part1]
cgtgcaattcacgagt

SEQ ID NO: 15676 - DNA, 16 bp, Artificial Sequence
  synthetic [barcode part1]
aaccggagatacaccg

SEQ ID NO: 15677 - DNA, 16 bp, Artificial Sequence
  synthetic [barcode part1]
aaccttcacgcaatct

SEQ ID NO: 15678 - DNA, 16 bp, Artificial Sequence
  synthetic [barcode part1]
tacgacagtagacggc

SEQ ID NO: 15679 - DNA, 16 bp, Artificial Sequence
  synthetic [barcode part1]
tgaacgtcctcactgc

SEQ ID NO: 15680 - DNA, 16 bp, Artificial Sequence
  synthetic [barcode part1]
gttgcggaacgagtac

SEQ ID NO: 15681 - DNA, 16 bp, Artificial Sequence
  synthetic [barcode part1]
cagagacaacgatccg

SEQ ID NO: 15682 - DNA, 16 bp, Artificial Sequence
  synthetic [barcode part1]
gactgtgagaatcagt

SEQ ID NO: 15683 - DNA, 16 bp, Artificial Sequence
  synthetic [barcode part1]
gttggccttaagatcg

SEQ ID NO: 15684 - DNA, 16 bp, Artificial Sequence
  synthetic [barcode part1]
tacggtggtggacagt

SEQ ID NO: 15685 - DNA, 16 bp, Artificial Sequence
  synthetic [barcode part1]
tatacaatcacgcggc

SEQ ID NO: 15686 - DNA, 16 bp, Artificial Sequence
  synthetic [barcode part1]
tgacgagaccttatcg

SEQ ID NO: 15687 - DNA, 16 bp, Artificial Sequence
  synthetic [barcode part1]
taggaggacgtaccac

SEQ ID NO: 15688 - DNA, 16 bp, Artificial Sequence
  synthetic [barcode part1]
taaggcgatctaagtg

SEQ ID NO: 15689 - DNA, 16 bp, Artificial Sequence
  synthetic [barcode part1]
agactggagttctctg

SEQ ID NO: 15690 - DNA, 16 bp, Artificial Sequence
  synthetic [barcode part1]
actctgtggacgtcct

SEQ ID NO: 15691 - DNA, 16 bp, Artificial Sequence
  synthetic [barcode part1]
taacggtatcaccgac

SEQ ID NO: 15692 - DNA, 16 bp, Artificial Sequence
  synthetic [barcode part1]
cgcaatagagttctgc

SEQ ID NO: 15693 - DNA, 16 bp, Artificial Sequence
  synthetic [barcode part1]
tagaaccacgttacgc

SEQ ID NO: 15694 - DNA, 16 bp, Artificial Sequence
  synthetic [barcode part1]
cacctcacggatatcc

SEQ ID NO: 15695 - DNA, 16 bp, Artificial Sequence
  synthetic [barcode part1]
tggtcaagttacgacc

SEQ ID NO: 15696 - DNA, 16 bp, Artificial Sequence
  synthetic [barcode part1]
tgatcctcggtcgtgt

SEQ ID NO: 15697 - DNA, 16 bp, Artificial Sequence
  synthetic [barcode part1]
tcagtcaattacggcg

SEQ ID NO: 15698 - DNA, 16 bp, Artificial Sequence
  synthetic [barcode part1]
tcggcacgagaagttg

SEQ ID NO: 15699 - DNA, 16 bp, Artificial Sequence
  synthetic [barcode part1]
tgcgttctgtcgaacc

SEQ ID NO: 15700 - DNA, 16 bp, Artificial Sequence
  synthetic [barcode part1]
cagatatctccactgt

SEQ ID NO: 15701 - DNA, 16 bp, Artificial Sequence
  synthetic [barcode part1]
aatcgacggtcaactc

SEQ ID NO: 15702 - DNA, 16 bp, Artificial Sequence
  synthetic [barcode part1]
tatcgccagatcgaac

SEQ ID NO: 15703 - DNA, 16 bp, Artificial Sequence
  synthetic [barcode part1]
ttctcggatcacacgc

SEQ ID NO: 15704 - DNA, 16 bp, Artificial Sequence
  synthetic [barcode part1]
tcgaaggattgtcctg

SEQ ID NO: 15705 - DNA, 16 bp, Artificial Sequence
  synthetic [barcode part1]
gttattcacgagtctc

SEQ ID NO: 15706 - DNA, 16 bp, Artificial Sequence
  synthetic [barcode part1]
caaggtcgattgacct

SEQ ID NO: 15707 - DNA, 16 bp, Artificial Sequence
  synthetic [barcode part1]
aaggaacctatcgcct

SEQ ID NO: 15708 - DNA, 16 bp, Artificial Sequence
  synthetic [barcode part1]
tctgactggagtcagt

SEQ ID NO: 15709 - DNA, 16 bp, Artificial Sequence
  synthetic [barcode part1]
ttctcgatacgatcgt

SEQ ID NO: 15710 - DNA, 16 bp, Artificial Sequence
  synthetic [barcode part1]
cgactctaggactaac

SEQ ID NO: 15711 - DNA, 16 bp, Artificial Sequence
  synthetic [barcode part1]
aaccagtagtcggttc

SEQ ID NO: 15712 - DNA, 16 bp, Artificial Sequence
  synthetic [barcode part1]
tcctaagaggcagacg

SEQ ID NO: 15713 - DNA, 16 bp, Artificial Sequence
  synthetic [barcode part1]
ccagtaagtcttcgcc

SEQ ID NO: 15714 - DNA, 16 bp, Artificial Sequence
  synthetic [barcode part1]
gaccacgtcaactctc

SEQ ID NO: 15715 - DNA, 16 bp, Artificial Sequence
  synthetic [barcode part1]
aattctagaacggacg

SEQ ID NO: 15716 - DNA, 16 bp, Artificial Sequence
  synthetic [barcode part1]
acaaccagtacgtcac

SEQ ID NO: 15717 - DNA, 16 bp, Artificial Sequence
  synthetic [barcode part1]
tgccactacaattacc

SEQ ID NO: 15718 - DNA, 16 bp, Artificial Sequence
  synthetic [barcode part1]
tcctcacttcgacgag

SEQ ID NO: 15719 - DNA, 16 bp, Artificial Sequence
  synthetic [barcode part1]
cgacgtggagacaatc

SEQ ID NO: 15720 - DNA, 16 bp, Artificial Sequence
  synthetic [barcode part1]
tccgcactagtaactt

SEQ ID NO: 15721 - DNA, 16 bp, Artificial Sequence
  synthetic [barcode part1]
tcaggagtgtgccaag

SEQ ID NO: 15722 - DNA, 16 bp, Artificial Sequence
  synthetic [barcode part1]
aggaaccgttgacgtg

SEQ ID NO: 15723 - DNA, 16 bp, Artificial Sequence
  synthetic [barcode part1]
gtataattcgacctcc

SEQ ID NO: 15724 - DNA, 16 bp, Artificial Sequence
  synthetic [barcode part1]
gttcaagaggtgatac

SEQ ID NO: 15725 - DNA, 16 bp, Artificial Sequence
  synthetic [barcode part1]
atcgtcttgaacgtct

SEQ ID NO: 15726 - DNA, 16 bp, Artificial Sequence
  synthetic [barcode part1]
tgtactccactggatt

SEQ ID NO: 15727 - DNA, 16 bp, Artificial Sequence
  synthetic [barcode part1]
cgttgagaatacgagt

SEQ ID NO: 15728 - DNA, 16 bp, Artificial Sequence
  synthetic [barcode part1]
gcgactcaagttactg

SEQ ID NO: 15729 - DNA, 16 bp, Artificial Sequence
  synthetic [barcode part1]
agacggactcacttac

SEQ ID NO: 15730 - DNA, 16 bp, Artificial Sequence
  synthetic [barcode part1]
gttactgcctctgcag

SEQ ID NO: 15731 - DNA, 16 bp, Artificial Sequence
  synthetic [barcode part1]
gtacacgtcggttagt

SEQ ID NO: 15732 - DNA, 16 bp, Artificial Sequence
  synthetic [barcode part1]
cgtgagttatccgagt

SEQ ID NO: 15733 - DNA, 16 bp, Artificial Sequence
  synthetic [barcode part1]
cggtggcaacttagtt

SEQ ID NO: 15734 - DNA, 16 bp, Artificial Sequence
  synthetic [barcode part1]
tgaagaagttgtgcac

SEQ ID NO: 15735 - DNA, 16 bp, Artificial Sequence
  synthetic [barcode part1]
aaccacaacacgttgc

SEQ ID NO: 15736 - DNA, 16 bp, Artificial Sequence
  synthetic [barcode part1]
tgattggactgcaacc

SEQ ID NO: 15737 - DNA, 16 bp, Artificial Sequence
  synthetic [barcode part1]
cgccactacggttact

SEQ ID NO: 15738 - DNA, 16 bp, Artificial Sequence
  synthetic [barcode part1]
agactcttgtagtgcg

SEQ ID NO: 15739 - DNA, 16 bp, Artificial Sequence
  synthetic [barcode part1]
tacgcaatctagtctc

SEQ ID NO: 15740 - DNA, 16 bp, Artificial Sequence
  synthetic [barcode part1]
tggttgtacgatcgtg

SEQ ID NO: 15741 - DNA, 16 bp, Artificial Sequence
  synthetic [barcode part1]
taacggtctaagtcgc

SEQ ID NO: 15742 - DNA, 16 bp, Artificial Sequence
  synthetic [barcode part1]
acacgcgtatacacac

SEQ ID NO: 15743 - DNA, 16 bp, Artificial Sequence
  synthetic [barcode part1]
tgtgtggacctggatt

SEQ ID NO: 15744 - DNA, 16 bp, Artificial Sequence
  synthetic [barcode part1]
tccgatctgcacaacc

SEQ ID NO: 15745 - DNA, 16 bp, Artificial Sequence
  synthetic [barcode part1]
tatctctggaacgcag

SEQ ID NO: 15746 - DNA, 16 bp, Artificial Sequence
  synthetic [barcode part1]
tactcgaaccacctcg

SEQ ID NO: 15747 - DNA, 16 bp, Artificial Sequence
  synthetic [barcode part1]
aatcacacaaccgcgt

SEQ ID NO: 15748 - DNA, 16 bp, Artificial Sequence
  synthetic [barcode part1]
gaagagtacgactgtt

SEQ ID NO: 15749 - DNA, 16 bp, Artificial Sequence
  synthetic [barcode part1]
cgtaccgagttgagag

SEQ ID NO: 15750 - DNA, 16 bp, Artificial Sequence
  synthetic [barcode part1]
tcttagtgtcgaaggc

SEQ ID NO: 15751 - DNA, 16 bp, Artificial Sequence
  synthetic [barcode part1]
aacacgcaactaaggt

SEQ ID NO: 15752 - DNA, 16 bp, Artificial Sequence
  synthetic [barcode part1]
aactggttcgagatcc

SEQ ID NO: 15753 - DNA, 16 bp, Artificial Sequence
  synthetic [barcode part1]
tctacgtctagtggtt

SEQ ID NO: 15754 - DNA, 16 bp, Artificial Sequence
  synthetic [barcode part1]
tcacctgacttcaggc

SEQ ID NO: 15755 - DNA, 16 bp, Artificial Sequence
  synthetic [barcode part1]
aacgtcagtactgtgc

SEQ ID NO: 15756 - DNA, 16 bp, Artificial Sequence
  synthetic [barcode part1]
acactgttccagaacg

SEQ ID NO: 15757 - DNA, 16 bp, Artificial Sequence
  synthetic [barcode part1]
ccaagagtagtcttcg

SEQ ID NO: 15758 - DNA, 16 bp, Artificial Sequence
  synthetic [barcode part1]
accttcagaaccactt

SEQ ID NO: 15759 - DNA, 16 bp, Artificial Sequence
  synthetic [barcode part1]
gatacctctactactg

SEQ ID NO: 15760 - DNA, 16 bp, Artificial Sequence
  synthetic [barcode part1]
gaatagacggaattcc

SEQ ID NO: 15761 - DNA, 16 bp, Artificial Sequence
  synthetic [barcode part1]
accagacaacgtaagt

SEQ ID NO: 15762 - DNA, 16 bp, Artificial Sequence
  synthetic [barcode part1]
ccagtggcctatatcc

SEQ ID NO: 15763 - DNA, 16 bp, Artificial Sequence
  synthetic [barcode part1]
accttccagaggattg

SEQ ID NO: 15764 - DNA, 16 bp, Artificial Sequence
  synthetic [barcode part1]
actcacagttgaagag

SEQ ID NO: 15765 - DNA, 16 bp, Artificial Sequence
  synthetic [barcode part1]
tactcttgccgtcgag

SEQ ID NO: 15766 - DNA, 16 bp, Artificial Sequence
  synthetic [barcode part1]
gtaattgttccgacct

SEQ ID NO: 15767 - DNA, 16 bp, Artificial Sequence
  synthetic [barcode part1]
gagttgtcctgtgtcc

SEQ ID NO: 15768 - DNA, 16 bp, Artificial Sequence
  synthetic [barcode part1]
gcgagaaggagatatc

SEQ ID NO: 15769 - DNA, 16 bp, Artificial Sequence
  synthetic [barcode part1]
tatcactcgagtccgc

SEQ ID NO: 15770 - DNA, 16 bp, Artificial Sequence
  synthetic [barcode part1]
cgagatccacaacact

SEQ ID NO: 15771 - DNA, 16 bp, Artificial Sequence
  synthetic [barcode part1]
caattgacgtggcgtt

SEQ ID NO: 15772 - DNA, 16 bp, Artificial Sequence
  synthetic [barcode part1]
ttatcgtggactcgcc

SEQ ID NO: 15773 - DNA, 16 bp, Artificial Sequence
  synthetic [barcode part1]
atcaagaggagagtcg

SEQ ID NO: 15774 - DNA, 16 bp, Artificial Sequence
  synthetic [barcode part1]
tctcacgtacacttcc

SEQ ID NO: 15775 - DNA, 16 bp, Artificial Sequence
  synthetic [barcode part1]
attctcggtccggtgt

SEQ ID NO: 15776 - DNA, 16 bp, Artificial Sequence
  synthetic [barcode part1]
aaggacgtgtcggatc

SEQ ID NO: 15777 - DNA, 16 bp, Artificial Sequence
  synthetic [barcode part1]
gtagagagtcgaatct

SEQ ID NO: 15778 - DNA, 16 bp, Artificial Sequence
  synthetic [barcode part1]
aactgtggtactgacc

SEQ ID NO: 15779 - DNA, 16 bp, Artificial Sequence
  synthetic [barcode part1]
ttatccagacgttgtc

SEQ ID NO: 15780 - DNA, 16 bp, Artificial Sequence
  synthetic [barcode part1]
ttccagttggtctcct

SEQ ID NO: 15781 - DNA, 16 bp, Artificial Sequence
  synthetic [barcode part1]
tacggttggagattag

SEQ ID NO: 15782 - DNA, 16 bp, Artificial Sequence
  synthetic [barcode part1]
atactgacctcgccgt

SEQ ID NO: 15783 - DNA, 16 bp, Artificial Sequence
  synthetic [barcode part1]
tataacgtcgcgacgt

SEQ ID NO: 15784 - DNA, 16 bp, Artificial Sequence
  synthetic [barcode part1]
agaccacagacacggt

SEQ ID NO: 15785 - DNA, 16 bp, Artificial Sequence
  synthetic [barcode part1]
gtgacgaggtacgttg

SEQ ID NO: 15786 - DNA, 16 bp, Artificial Sequence
  synthetic [barcode part1]
gtagtgtgactccaac

SEQ ID NO: 15787 - DNA, 16 bp, Artificial Sequence
  synthetic [barcode part1]
acgtcaactcttagtc

SEQ ID NO: 15788 - DNA, 16 bp, Artificial Sequence
  synthetic [barcode part1]
gcaacttatcttcgtg

SEQ ID NO: 15789 - DNA, 16 bp, Artificial Sequence
  synthetic [barcode part1]
agtgatcaccactgac

SEQ ID NO: 15790 - DNA, 16 bp, Artificial Sequence
  synthetic [barcode part1]
gtcgaattctgtactc

SEQ ID NO: 15791 - DNA, 16 bp, Artificial Sequence
  synthetic [barcode part1]
tatcgacttgagagag

SEQ ID NO: 15792 - DNA, 16 bp, Artificial Sequence
  synthetic [barcode part1]
agtgtcagttgtggtc

SEQ ID NO: 15793 - DNA, 16 bp, Artificial Sequence
  synthetic [barcode part1]
tgtcgcgcagtattag

SEQ ID NO: 15794 - DNA, 16 bp, Artificial Sequence
  synthetic [barcode part1]
cgcgcagaacaacagt

SEQ ID NO: 15795 - DNA, 16 bp, Artificial Sequence
  synthetic [barcode part1]
cacaaggttagatcag

SEQ ID NO: 15796 - DNA, 16 bp, Artificial Sequence
  synthetic [barcode part1]
tctcggccgtactagt

SEQ ID NO: 15797 - DNA, 16 bp, Artificial Sequence
  synthetic [barcode part1]
cggcgatattatcgac

SEQ ID NO: 15798 - DNA, 16 bp, Artificial Sequence
  synthetic [barcode part1]
cctctgagtcaacacc

SEQ ID NO: 15799 - DNA, 16 bp, Artificial Sequence
  synthetic [barcode part1]
agtctgtgcgacgaag

SEQ ID NO: 15800 - DNA, 16 bp, Artificial Sequence
  synthetic [barcode part1]
tcacgccgaattgcct

SEQ ID NO: 15801 - DNA, 16 bp, Artificial Sequence
  synthetic [barcode part1]
gattcacacggatctg

SEQ ID NO: 15802 - DNA, 16 bp, Artificial Sequence
  synthetic [barcode part1]
tcgacaacgagaacgc

SEQ ID NO: 15803 - DNA, 16 bp, Artificial Sequence
  synthetic [barcode part1]
gatcgattggtaccac

SEQ ID NO: 15804 - DNA, 16 bp, Artificial Sequence
  synthetic [barcode part1]
aacaagagtgtccaac

SEQ ID NO: 15805 - DNA, 16 bp, Artificial Sequence
  synthetic [barcode part1]
accgcgttctctaacg

SEQ ID NO: 15806 - DNA, 16 bp, Artificial Sequence
  synthetic [barcode part1]
actgcctctattctgc

SEQ ID NO: 15807 - DNA, 16 bp, Artificial Sequence
  synthetic [barcode part1]
tgccggtgattgagag

SEQ ID NO: 15808 - DNA, 16 bp, Artificial Sequence
  synthetic [barcode part1]
tacggtacttatctgc

SEQ ID NO: 15809 - DNA, 16 bp, Artificial Sequence
  synthetic [barcode part1]
agtcagttaatcggcc

SEQ ID NO: 15810 - DNA, 16 bp, Artificial Sequence
  synthetic [barcode part1]
tgttcagttggacacg

SEQ ID NO: 15811 - DNA, 16 bp, Artificial Sequence
  synthetic [barcode part1]
ttatctcaatccgcag

SEQ ID NO: 15812 - DNA, 16 bp, Artificial Sequence
  synthetic [barcode part1]
atccgtcagtgttgcc

SEQ ID NO: 15813 - DNA, 16 bp, Artificial Sequence
  synthetic [barcode part1]
gcgcgagaacaacttg

SEQ ID NO: 15814 - DNA, 16 bp, Artificial Sequence
  synthetic [barcode part1]
accacctagtatctac

SEQ ID NO: 15815 - DNA, 16 bp, Artificial Sequence
  synthetic [barcode part1]
attgcgtgaagtggcg

SEQ ID NO: 15816 - DNA, 16 bp, Artificial Sequence
  synthetic [barcode part1]
tcactcagtctgtcct

SEQ ID NO: 15817 - DNA, 16 bp, Artificial Sequence
  synthetic [barcode part1]
ttagtgaggcggtctt

SEQ ID NO: 15818 - DNA, 16 bp, Artificial Sequence
  synthetic [barcode part1]
aaggacgagatcgtcc

SEQ ID NO: 15819 - DNA, 16 bp, Artificial Sequence
  synthetic [barcode part1]
acgacgactatcactg

SEQ ID NO: 15820 - DNA, 16 bp, Artificial Sequence
  synthetic [barcode part1]
acctgcctatccactt

SEQ ID NO: 15821 - DNA, 16 bp, Artificial Sequence
  synthetic [barcode part1]
acgaacgtgttgtaag

SEQ ID NO: 15822 - DNA, 16 bp, Artificial Sequence
  synthetic [barcode part1]
cggatagaagtgaacg

SEQ ID NO: 15823 - DNA, 16 bp, Artificial Sequence
  synthetic [barcode part1]
tcaacacctccgactg

SEQ ID NO: 15824 - DNA, 16 bp, Artificial Sequence
  synthetic [barcode part1]
ttgcaacctccttctg

SEQ ID NO: 15825 - DNA, 16 bp, Artificial Sequence
  synthetic [barcode part1]
actcctgcaagtcgtc

SEQ ID NO: 15826 - DNA, 16 bp, Artificial Sequence
  synthetic [barcode part1]
tctgcactgattcggc

SEQ ID NO: 15827 - DNA, 16 bp, Artificial Sequence
  synthetic [barcode part1]
aacagatcgccgtgag

SEQ ID NO: 15828 - DNA, 16 bp, Artificial Sequence
  synthetic [barcode part1]
tcgactagtcgactag

SEQ ID NO: 15829 - DNA, 16 bp, Artificial Sequence
  synthetic [barcode part1]
tagaccggcgtagagt

SEQ ID NO: 15830 - DNA, 16 bp, Artificial Sequence
  synthetic [barcode part1]
gtctccacttggtgac

SEQ ID NO: 15831 - DNA, 16 bp, Artificial Sequence
  synthetic [barcode part1]
tacgagtacgaacctc

SEQ ID NO: 15832 - DNA, 16 bp, Artificial Sequence
  synthetic [barcode part1]
ttcactagaaggtcgc

SEQ ID NO: 15833 - DNA, 16 bp, Artificial Sequence
  synthetic [barcode part1]
tattagtgtcgcgcag

SEQ ID NO: 15834 - DNA, 16 bp, Artificial Sequence
  synthetic [barcode part1]
gactatccaagtcacg

SEQ ID NO: 15835 - DNA, 16 bp, Artificial Sequence
  synthetic [barcode part1]
tactacctcgtcgtct

SEQ ID NO: 15836 - DNA, 16 bp, Artificial Sequence
  synthetic [barcode part1]
agtcggaagattggag

SEQ ID NO: 15837 - DNA, 16 bp, Artificial Sequence
  synthetic [barcode part1]
cctaggcagtagtgag

SEQ ID NO: 15838 - DNA, 16 bp, Artificial Sequence
  synthetic [barcode part1]
tgacttctgcgtgatt

SEQ ID NO: 15839 - DNA, 16 bp, Artificial Sequence
  synthetic [barcode part1]
tgtgccttaggttgcc

SEQ ID NO: 15840 - DNA, 16 bp, Artificial Sequence
  synthetic [barcode part1]
ccggacaagacttatc

SEQ ID NO: 15841 - DNA, 16 bp, Artificial Sequence
  synthetic [barcode part1]
tctcgaatctaggacg

SEQ ID NO: 15842 - DNA, 16 bp, Artificial Sequence
  synthetic [barcode part1]
cgtgttattagttccg

SEQ ID NO: 15843 - DNA, 16 bp, Artificial Sequence
  synthetic [barcode part1]
accacggtagaattcc

SEQ ID NO: 15844 - DNA, 16 bp, Artificial Sequence
  synthetic [barcode part1]
cctcaacactgtcttc

SEQ ID NO: 15845 - DNA, 16 bp, Artificial Sequence
  synthetic [barcode part1]
tccactatctcgtcgt

SEQ ID NO: 15846 - DNA, 16 bp, Artificial Sequence
  synthetic [barcode part1]
gccgtaatcgtccact

SEQ ID NO: 15847 - DNA, 16 bp, Artificial Sequence
  synthetic [barcode part1]
cacgataactcgcctc

SEQ ID NO: 15848 - DNA, 16 bp, Artificial Sequence
  synthetic [barcode part1]
cgaacgatacttgtcg

SEQ ID NO: 15849 - DNA, 16 bp, Artificial Sequence
  synthetic [barcode part1]
atatcgcgcggtattg

SEQ ID NO: 15850 - DNA, 16 bp, Artificial Sequence
  synthetic [barcode part1]
cacaacttaacaggag

SEQ ID NO: 15851 - DNA, 16 bp, Artificial Sequence
  synthetic [barcode part1]
ttgattcctgcacggc

SEQ ID NO: 15852 - DNA, 16 bp, Artificial Sequence
  synthetic [barcode part1]
gactctcgtgcaactc

SEQ ID NO: 15853 - DNA, 16 bp, Artificial Sequence
  synthetic [barcode part1]
tctgaaggttagtcgc

SEQ ID NO: 15854 - DNA, 16 bp, Artificial Sequence
  synthetic [barcode part1]
acggattctcttgatc

SEQ ID NO: 15855 - DNA, 16 bp, Artificial Sequence
  synthetic [barcode part1]
acttgaattcgccact

SEQ ID NO: 15856 - DNA, 16 bp, Artificial Sequence
  synthetic [barcode part1]
gaggtgataggcactc

SEQ ID NO: 15857 - DNA, 16 bp, Artificial Sequence
  synthetic [barcode part1]
ttactcgccacctgtt

SEQ ID NO: 15858 - DNA, 16 bp, Artificial Sequence
  synthetic [barcode part1]
cagtcgattctgaggt

SEQ ID NO: 15859 - DNA, 16 bp, Artificial Sequence
  synthetic [barcode part1]
aacaccttcgttgccg

SEQ ID NO: 15860 - DNA, 16 bp, Artificial Sequence
  synthetic [barcode part1]
cgtcgaggtaagaacc

SEQ ID NO: 15861 - DNA, 16 bp, Artificial Sequence
  synthetic [barcode part1]
gtccaccggtattatt

SEQ ID NO: 15862 - DNA, 16 bp, Artificial Sequence
  synthetic [barcode part1]
cgaaccgtgtactctc

SEQ ID NO: 15863 - DNA, 16 bp, Artificial Sequence
  synthetic [barcode part1]
acgaacgaatattgcg

SEQ ID NO: 15864 - DNA, 16 bp, Artificial Sequence
  synthetic [barcode part1]
tacttgtgaaccttgc

SEQ ID NO: 15865 - DNA, 16 bp, Artificial Sequence
  synthetic [barcode part1]
caactaggatcggttc

SEQ ID NO: 15866 - DNA, 16 bp, Artificial Sequence
  synthetic [barcode part1]
gcaaggttaggtattg

SEQ ID NO: 15867 - DNA, 16 bp, Artificial Sequence
  synthetic [barcode part1]
gcgtctccggtaatct

SEQ ID NO: 15868 - DNA, 16 bp, Artificial Sequence
  synthetic [barcode part1]
acaagaggccaggtct

SEQ ID NO: 15869 - DNA, 16 bp, Artificial Sequence
  synthetic [barcode part1]
cgttattactcgagtc

SEQ ID NO: 15870 - DNA, 16 bp, Artificial Sequence
  synthetic [barcode part1]
gcgttaagtacttggc

SEQ ID NO: 15871 - DNA, 16 bp, Artificial Sequence
  synthetic [barcode part1]
acttgtgtggtaagag

SEQ ID NO: 15872 - DNA, 16 bp, Artificial Sequence
  synthetic [barcode part1]
tggttccttgacttcc

SEQ ID NO: 15873 - DNA, 16 bp, Artificial Sequence
  synthetic [barcode part1]
actagtaggacgcctt

SEQ ID NO: 15874 - DNA, 16 bp, Artificial Sequence
  synthetic [barcode part1]
aagactctcacttgtc

SEQ ID NO: 15875 - DNA, 16 bp, Artificial Sequence
  synthetic [barcode part1]
atcctagactgcagtg

SEQ ID NO: 15876 - DNA, 16 bp, Artificial Sequence
  synthetic [barcode part1]
ccttgactcgagtacc

SEQ ID NO: 15877 - DNA, 16 bp, Artificial Sequence
  synthetic [barcode part1]
aggaaccacgtcaacg

SEQ ID NO: 15878 - DNA, 16 bp, Artificial Sequence
  synthetic [barcode part1]
gcgtgtgaattggttc

SEQ ID NO: 15879 - DNA, 16 bp, Artificial Sequence
  synthetic [barcode part1]
gcgaagtcctattacg

SEQ ID NO: 15880 - DNA, 16 bp, Artificial Sequence
  synthetic [barcode part1]
ttcagacggatacctg

SEQ ID NO: 15881 - DNA, 16 bp, Artificial Sequence
  synthetic [barcode part1]
gccacgttcgatatag

SEQ ID NO: 15882 - DNA, 16 bp, Artificial Sequence
  synthetic [barcode part1]
tgagactactgtgacc

SEQ ID NO: 15883 - DNA, 16 bp, Artificial Sequence
  synthetic [barcode part1]
aacgaagtgcgttagt

SEQ ID NO: 15884 - DNA, 16 bp, Artificial Sequence
  synthetic [barcode part1]
ttcactgatatccggt

SEQ ID NO: 15885 - DNA, 16 bp, Artificial Sequence
  synthetic [barcode part1]
attctgtggtgtactc

SEQ ID NO: 15886 - DNA, 16 bp, Artificial Sequence
  synthetic [barcode part1]
gccgacagacaacaac

SEQ ID NO: 15887 - DNA, 16 bp, Artificial Sequence
  synthetic [barcode part1]
cgcggtatactcgttc

SEQ ID NO: 15888 - DNA, 16 bp, Artificial Sequence
  synthetic [barcode part1]
aggaattgtaccagtg

SEQ ID NO: 15889 - DNA, 16 bp, Artificial Sequence
  synthetic [barcode part1]
gtcaatatcgcgcagt

SEQ ID NO: 15890 - DNA, 16 bp, Artificial Sequence
  synthetic [barcode part1]
aacgactaagacacac

SEQ ID NO: 15891 - DNA, 16 bp, Artificial Sequence
  synthetic [barcode part1]
aagacaggccttgtct

SEQ ID NO: 15892 - DNA, 16 bp, Artificial Sequence
  synthetic [barcode part1]
gactctctcaacacgc

SEQ ID NO: 15893 - DNA, 16 bp, Artificial Sequence
  synthetic [barcode part1]
gactacactctgattc

SEQ ID NO: 15894 - DNA, 16 bp, Artificial Sequence
  synthetic [barcode part1]
ttgattcctcgtgaac

SEQ ID NO: 15895 - DNA, 16 bp, Artificial Sequence
  synthetic [barcode part1]
tagtataggcctgtgc

SEQ ID NO: 15896 - DNA, 16 bp, Artificial Sequence
  synthetic [barcode part1]
tactccactgtaggtt

SEQ ID NO: 15897 - DNA, 16 bp, Artificial Sequence
  synthetic [barcode part1]
acctacttgttacggt

SEQ ID NO: 15898 - DNA, 16 bp, Artificial Sequence
  synthetic [barcode part1]
ccgattccaaggaatc

SEQ ID NO: 15899 - DNA, 16 bp, Artificial Sequence
  synthetic [barcode part1]
ccaataggttcttgtc

SEQ ID NO: 15900 - DNA, 16 bp, Artificial Sequence
  synthetic [barcode part1]
tccgtcgtgatctctt

SEQ ID NO: 15901 - DNA, 16 bp, Artificial Sequence
  synthetic [barcode part1]
ttatccttctccgacg

SEQ ID NO: 15902 - DNA, 16 bp, Artificial Sequence
  synthetic [barcode part1]
gaggttctcacttgtt

SEQ ID NO: 15903 - DNA, 16 bp, Artificial Sequence
  synthetic [barcode part1]
cggtagttacagaagt

SEQ ID NO: 15904 - DNA, 16 bp, Artificial Sequence
  synthetic [barcode part1]
agtacacgttgtgcac

SEQ ID NO: 15905 - DNA, 16 bp, Artificial Sequence
  synthetic [barcode part1]
tcaatctctcggtctc

SEQ ID NO: 15906 - DNA, 16 bp, Artificial Sequence
  synthetic [barcode part1]
gacttggatatcctct

SEQ ID NO: 15907 - DNA, 16 bp, Artificial Sequence
  synthetic [barcode part1]
agactggtacaatcag

SEQ ID NO: 15908 - DNA, 16 bp, Artificial Sequence
  synthetic [barcode part1]
ttgtgagtaggtccac

SEQ ID NO: 15909 - DNA, 16 bp, Artificial Sequence
  synthetic [barcode part1]
tgaagagtgatcgtgt

SEQ ID NO: 15910 - DNA, 16 bp, Artificial Sequence
  synthetic [barcode part1]
gtattcggttcacgag

SEQ ID NO: 15911 - DNA, 16 bp, Artificial Sequence
  synthetic [barcode part1]
acctgtaactacttcg

SEQ ID NO: 15912 - DNA, 16 bp, Artificial Sequence
  synthetic [barcode part1]
tcttatacggcggcct

SEQ ID NO: 15913 - DNA, 16 bp, Artificial Sequence
  synthetic [barcode part1]
gattacctccaacgag

SEQ ID NO: 15914 - DNA, 16 bp, Artificial Sequence
  synthetic [barcode part1]
cgtgcaggataacgac

SEQ ID NO: 15915 - DNA, 16 bp, Artificial Sequence
  synthetic [barcode part1]
tgcaacgagacaagtt

SEQ ID NO: 15916 - DNA, 16 bp, Artificial Sequence
  synthetic [barcode part1]
taccaacacaccaacg

SEQ ID NO: 15917 - DNA, 16 bp, Artificial Sequence
  synthetic [barcode part1]
tgatcggagagtctct

SEQ ID NO: 15918 - DNA, 16 bp, Artificial Sequence
  synthetic [barcode part1]
tgcggtgcctattcac

SEQ ID NO: 15919 - DNA, 16 bp, Artificial Sequence
  synthetic [barcode part1]
ttgtgagtgttgacgc

SEQ ID NO: 15920 - DNA, 16 bp, Artificial Sequence
  synthetic [barcode part1]
tccaagtacggttgtg

SEQ ID NO: 15921 - DNA, 16 bp, Artificial Sequence
  synthetic [barcode part1]
gattgaaggtgtatcg

SEQ ID NO: 15922 - DNA, 16 bp, Artificial Sequence
  synthetic [barcode part1]
atatctagacaggacg

SEQ ID NO: 15923 - DNA, 16 bp, Artificial Sequence
  synthetic [barcode part1]
tgaggcactcaattcg

SEQ ID NO: 15924 - DNA, 16 bp, Artificial Sequence
  synthetic [barcode part1]
ttcaaccgtacactgt

SEQ ID NO: 15925 - DNA, 16 bp, Artificial Sequence
  synthetic [barcode part1]
cgaccagtaaccaatc

SEQ ID NO: 15926 - DNA, 16 bp, Artificial Sequence
  synthetic [barcode part1]
aggtcgaactgacacg

SEQ ID NO: 15927 - DNA, 16 bp, Artificial Sequence
  synthetic [barcode part1]
acgtgtggatcttggt

SEQ ID NO: 15928 - DNA, 16 bp, Artificial Sequence
  synthetic [barcode part1]
gacttgacacgccttc

SEQ ID NO: 15929 - DNA, 16 bp, Artificial Sequence
  synthetic [barcode part1]
ccactaatacagagag

SEQ ID NO: 15930 - DNA, 16 bp, Artificial Sequence
  synthetic [barcode part1]
gataaccgttgtcgac

SEQ ID NO: 15931 - DNA, 16 bp, Artificial Sequence
  synthetic [barcode part1]
gcagtcagttgacact

SEQ ID NO: 15932 - DNA, 16 bp, Artificial Sequence
  synthetic [barcode part1]
gagtacctaaggtagt

SEQ ID NO: 15933 - DNA, 16 bp, Artificial Sequence
  synthetic [barcode part1]
ttgcagagacacactc

SEQ ID NO: 15934 - DNA, 16 bp, Artificial Sequence
  synthetic [barcode part1]
gatcgactcggaatct

SEQ ID NO: 15935 - DNA, 16 bp, Artificial Sequence
  synthetic [barcode part1]
ttgccgtgagtctacc

SEQ ID NO: 15936 - DNA, 16 bp, Artificial Sequence
  synthetic [barcode part1]
ccttctcaaggtcctt

SEQ ID NO: 15937 - DNA, 16 bp, Artificial Sequence
  synthetic [barcode part1]
tcagtaacacttccgt

SEQ ID NO: 15938 - DNA, 16 bp, Artificial Sequence
  synthetic [barcode part1]
ccaagtattatcctgc

SEQ ID NO: 15939 - DNA, 16 bp, Artificial Sequence
  synthetic [barcode part1]
cgagaggcaacgtact

SEQ ID NO: 15940 - DNA, 16 bp, Artificial Sequence
  synthetic [barcode part1]
gatagtccgcgaagac

SEQ ID NO: 15941 - DNA, 16 bp, Artificial Sequence
  synthetic [barcode part1]
atatccgccacctcag

SEQ ID NO: 15942 - DNA, 16 bp, Artificial Sequence
  synthetic [barcode part1]
gtaatccttgccgaag

SEQ ID NO: 15943 - DNA, 16 bp, Artificial Sequence
  synthetic [barcode part1]
aacctgaagtctggtc

SEQ ID NO: 15944 - DNA, 16 bp, Artificial Sequence
  synthetic [barcode part1]
gttcgcgatatccaag

SEQ ID NO: 15945 - DNA, 16 bp, Artificial Sequence
  synthetic [barcode part1]
gttgtctcgagtatct

SEQ ID NO: 15946 - DNA, 16 bp, Artificial Sequence
  synthetic [barcode part1]
gcaattcgacacggag

SEQ ID NO: 15947 - DNA, 16 bp, Artificial Sequence
  synthetic [barcode part1]
tatcgagacaaggatc

SEQ ID NO: 15948 - DNA, 16 bp, Artificial Sequence
  synthetic [barcode part1]
tgagacgcactaatag

SEQ ID NO: 15949 - DNA, 16 bp, Artificial Sequence
  synthetic [barcode part1]
ttgcgagtagatccgt

SEQ ID NO: 15950 - DNA, 16 bp, Artificial Sequence
  synthetic [barcode part1]
tagagtccagtgttgc

SEQ ID NO: 15951 - DNA, 16 bp, Artificial Sequence
  synthetic [barcode part1]
tggatcgtgtgcctct

SEQ ID NO: 15952 - DNA, 16 bp, Artificial Sequence
  synthetic [barcode part1]
tgcacaataccaacgc

SEQ ID NO: 15953 - DNA, 16 bp, Artificial Sequence
  synthetic [barcode part1]
tggtcaagtcgattgc

SEQ ID NO: 15954 - DNA, 16 bp, Artificial Sequence
  synthetic [barcode part1]
gacacttcgtctcacg

SEQ ID NO: 15955 - DNA, 16 bp, Artificial Sequence
  synthetic [barcode part1]
ataccgtatctgtctg

SEQ ID NO: 15956 - DNA, 16 bp, Artificial Sequence
  synthetic [barcode part1]
cacactcactcctatc

SEQ ID NO: 15957 - DNA, 16 bp, Artificial Sequence
  synthetic [barcode part1]
agaaggtgacacactt

SEQ ID NO: 15958 - DNA, 16 bp, Artificial Sequence
  synthetic [barcode part1]
gcgacgtgttgattac

SEQ ID NO: 15959 - DNA, 16 bp, Artificial Sequence
  synthetic [barcode part1]
tgccgacagagagttg

SEQ ID NO: 15960 - DNA, 16 bp, Artificial Sequence
  synthetic [barcode part1]
tccactggatcgtacc

SEQ ID NO: 15961 - DNA, 16 bp, Artificial Sequence
  synthetic [barcode part1]
aattgcgataccggtc

SEQ ID NO: 15962 - DNA, 16 bp, Artificial Sequence
  synthetic [barcode part1]
tccgactcgattatac

SEQ ID NO: 15963 - DNA, 16 bp, Artificial Sequence
  synthetic [barcode part1]
gtaagtccacagactc

SEQ ID NO: 15964 - DNA, 16 bp, Artificial Sequence
  synthetic [barcode part1]
ttctcggtaactgcgc

SEQ ID NO: 15965 - DNA, 16 bp, Artificial Sequence
  synthetic [barcode part1]
cggtatagaggactgc

SEQ ID NO: 15966 - DNA, 16 bp, Artificial Sequence
  synthetic [barcode part1]
tgtggcagacgaacgt

SEQ ID NO: 15967 - DNA, 16 bp, Artificial Sequence
  synthetic [barcode part1]
ttctgcactccacact

SEQ ID NO: 15968 - DNA, 16 bp, Artificial Sequence
  synthetic [barcode part1]
tccacgtactggatcc

SEQ ID NO: 15969 - DNA, 16 bp, Artificial Sequence
  synthetic [barcode part1]
tatcggtagagagttg

SEQ ID NO: 15970 - DNA, 16 bp, Artificial Sequence
  synthetic [barcode part1]
gttgttcggacttact

SEQ ID NO: 15971 - DNA, 16 bp, Artificial Sequence
  synthetic [barcode part1]
gagtcttaagactccg

SEQ ID NO: 15972 - DNA, 16 bp, Artificial Sequence
  synthetic [barcode part1]
tggttctcggcgtgtt

SEQ ID NO: 15973 - DNA, 16 bp, Artificial Sequence
  synthetic [barcode part1]
aaggtaacactcagac

SEQ ID NO: 15974 - DNA, 16 bp, Artificial Sequence
  synthetic [barcode part1]
ttggaaccgtctattc

SEQ ID NO: 15975 - DNA, 16 bp, Artificial Sequence
  synthetic [barcode part1]
agagtctcgagatctc

SEQ ID NO: 15976 - DNA, 16 bp, Artificial Sequence
  synthetic [barcode part1]
gtaccaattctcagtc

SEQ ID NO: 15977 - DNA, 16 bp, Artificial Sequence
  synthetic [barcode part1]
gaactaccgttaggtc

SEQ ID NO: 15978 - DNA, 16 bp, Artificial Sequence
  synthetic [barcode part1]
cacctcaacggacttc

SEQ ID NO: 15979 - DNA, 16 bp, Artificial Sequence
  synthetic [barcode part1]
aggaatacaccttcgc

SEQ ID NO: 15980 - DNA, 16 bp, Artificial Sequence
  synthetic [barcode part1]
gtcgtatcgtgaactg

SEQ ID NO: 15981 - DNA, 16 bp, Artificial Sequence
  synthetic [barcode part1]
aatccgaccgaatcac

SEQ ID NO: 15982 - DNA, 16 bp, Artificial Sequence
  synthetic [barcode part1]
tgtacagtgccttgcc

SEQ ID NO: 15983 - DNA, 16 bp, Artificial Sequence
  synthetic [barcode part1]
accgacgactccttac

SEQ ID NO: 15984 - DNA, 16 bp, Artificial Sequence
  synthetic [barcode part1]
tcgtagagttctccgc

SEQ ID NO: 15985 - DNA, 16 bp, Artificial Sequence
  synthetic [barcode part1]
gaggaacgagtacctc

SEQ ID NO: 15986 - DNA, 16 bp, Artificial Sequence
  synthetic [barcode part1]
gccacttcgtctgaac

SEQ ID NO: 15987 - DNA, 16 bp, Artificial Sequence
  synthetic [barcode part1]
gagtatcacgagtctc

SEQ ID NO: 15988 - DNA, 16 bp, Artificial Sequence
  synthetic [barcode part1]
tccttaactccttggc

SEQ ID NO: 15989 - DNA, 16 bp, Artificial Sequence
  synthetic [barcode part1]
tctcaattgtaccgac

SEQ ID NO: 15990 - DNA, 16 bp, Artificial Sequence
  synthetic [barcode part1]
tggtaacaacttggcc

SEQ ID NO: 15991 - DNA, 16 bp, Artificial Sequence
  synthetic [barcode part1]
agtctaggactaccac

SEQ ID NO: 15992 - DNA, 16 bp, Artificial Sequence
  synthetic [barcode part1]
gcaatctcagatcgtg

SEQ ID NO: 15993 - DNA, 16 bp, Artificial Sequence
  synthetic [barcode part1]
tgcctcgacttacggt

SEQ ID NO: 15994 - DNA, 16 bp, Artificial Sequence
  synthetic [barcode part1]
atcctgaacgtcacag

SEQ ID NO: 15995 - DNA, 16 bp, Artificial Sequence
  synthetic [barcode part1]
gtggattgaagtggcc

SEQ ID NO: 15996 - DNA, 16 bp, Artificial Sequence
  synthetic [barcode part1]
atcctcgagtgactcc

SEQ ID NO: 15997 - DNA, 16 bp, Artificial Sequence
  synthetic [barcode part1]
gtgattcacagtccag

SEQ ID NO: 15998 - DNA, 16 bp, Artificial Sequence
  synthetic [barcode part1]
atcctcggaacacaac

SEQ ID NO: 15999 - DNA, 16 bp, Artificial Sequence
  synthetic [barcode part1]
gtagaggatcgaattc

SEQ ID NO: 16000 - DNA, 16 bp, Artificial Sequence
  synthetic [barcode part1]
cctcgtagactactgc

SEQ ID NO: 16001 - DNA, 16 bp, Artificial Sequence
  synthetic [barcode part1]
tgtgtcctgttagatc

SEQ ID NO: 16002 - DNA, 16 bp, Artificial Sequence
  synthetic [barcode part1]
gtctgaacttgtcgcc

SEQ ID NO: 16003 - DNA, 16 bp, Artificial Sequence
  synthetic [barcode part1]
cgtcgaagtgatctgt

SEQ ID NO: 16004 - DNA, 16 bp, Artificial Sequence
  synthetic [barcode part1]
tgcgtaaggaccgaac

SEQ ID NO: 16005 - DNA, 16 bp, Artificial Sequence
  synthetic [barcode part1]
taggttcggtgagacg

SEQ ID NO: 16006 - DNA, 16 bp, Artificial Sequence
  synthetic [barcode part1]
aattggcgagactctc

SEQ ID NO: 16007 - DNA, 16 bp, Artificial Sequence
  synthetic [barcode part1]
aataccgccttctctc

SEQ ID NO: 16008 - DNA, 16 bp, Artificial Sequence
  synthetic [barcode part1]
gtccgttgtcttggac

SEQ ID NO: 16009 - DNA, 16 bp, Artificial Sequence
  synthetic [barcode part1]
tgcacaaggtgataac

SEQ ID NO: 16010 - DNA, 16 bp, Artificial Sequence
  synthetic [barcode part1]
ttctcgaggttcctct

SEQ ID NO: 16011 - DNA, 16 bp, Artificial Sequence
  synthetic [barcode part1]
tcgtgaactgtcgtcc

SEQ ID NO: 16012 - DNA, 16 bp, Artificial Sequence
  synthetic [barcode part1]
cgagtacagtcacgtt

SEQ ID NO: 16013 - DNA, 16 bp, Artificial Sequence
  synthetic [barcode part1]
actacgttggttcttg

SEQ ID NO: 16014 - DNA, 16 bp, Artificial Sequence
  synthetic [barcode part1]
tgttctgactcgtagt

SEQ ID NO: 16015 - DNA, 16 bp, Artificial Sequence
  synthetic [barcode part1]
aaggtgagtccgcagt

SEQ ID NO: 16016 - DNA, 16 bp, Artificial Sequence
  synthetic [barcode part1]
aacggaacacgtcggt

SEQ ID NO: 16017 - DNA, 16 bp, Artificial Sequence
  synthetic [barcode part1]
ccgtagacgaggaact

SEQ ID NO: 16018 - DNA, 16 bp, Artificial Sequence
  synthetic [barcode part1]
agtgacttgacctgac

SEQ ID NO: 16019 - DNA, 16 bp, Artificial Sequence
  synthetic [barcode part1]
cctagattaccggtag

SEQ ID NO: 16020 - DNA, 16 bp, Artificial Sequence
  synthetic [barcode part1]
actgccttatcgttcc

SEQ ID NO: 16021 - DNA, 16 bp, Artificial Sequence
  synthetic [barcode part1]
tgagatctgtggtacc

SEQ ID NO: 16022 - DNA, 16 bp, Artificial Sequence
  synthetic [barcode part1]
ccaaggttgcctgtct

SEQ ID NO: 16023 - DNA, 16 bp, Artificial Sequence
  synthetic [barcode part1]
ttgtgtgactgacgtg

SEQ ID NO: 16024 - DNA, 16 bp, Artificial Sequence
  synthetic [barcode part1]
gacacgtgtgttgact

SEQ ID NO: 16025 - DNA, 16 bp, Artificial Sequence
  synthetic [barcode part1]
ttgaggttatccgttc

SEQ ID NO: 16026 - DNA, 16 bp, Artificial Sequence
  synthetic [barcode part1]
tcgccagtacagagag

SEQ ID NO: 16027 - DNA, 16 bp, Artificial Sequence
  synthetic [barcode part1]
gcagagattcctgtac

SEQ ID NO: 16028 - DNA, 16 bp, Artificial Sequence
  synthetic [barcode part1]
ttgataggtggaggtt

SEQ ID NO: 16029 - DNA, 16 bp, Artificial Sequence
  synthetic [barcode part1]
aacgttgaccagttgc

SEQ ID NO: 16030 - DNA, 16 bp, Artificial Sequence
  synthetic [barcode part1]
taccgtcttcacggac

SEQ ID NO: 16031 - DNA, 16 bp, Artificial Sequence
  synthetic [barcode part1]
tgcgttcctgtatctc

SEQ ID NO: 16032 - DNA, 16 bp, Artificial Sequence
  synthetic [barcode part1]
gtgccaaggttgtgtt

SEQ ID NO: 16033 - DNA, 16 bp, Artificial Sequence
  synthetic [barcode part1]
agagtgactgccttgt

SEQ ID NO: 16034 - DNA, 16 bp, Artificial Sequence
  synthetic [barcode part1]
cagtgatccgaatcac

SEQ ID NO: 16035 - DNA, 16 bp, Artificial Sequence
  synthetic [barcode part1]
ttggtacagtcaagag

SEQ ID NO: 16036 - DNA, 16 bp, Artificial Sequence
  synthetic [barcode part1]
tgtgtcaggagttaag

SEQ ID NO: 16037 - DNA, 16 bp, Artificial Sequence
  synthetic [barcode part1]
gactagtgccaattgc

SEQ ID NO: 16038 - DNA, 16 bp, Artificial Sequence
  synthetic [barcode part1]
actgtaggaacggacc

SEQ ID NO: 16039 - DNA, 16 bp, Artificial Sequence
  synthetic [barcode part1]
tgtgaacttcactgtc

SEQ ID NO: 16040 - DNA, 16 bp, Artificial Sequence
  synthetic [barcode part1]
ttgtgttgagtacggc

SEQ ID NO: 16041 - DNA, 16 bp, Artificial Sequence
  synthetic [barcode part1]
tctgtgtggaggtact

SEQ ID NO: 16042 - DNA, 16 bp, Artificial Sequence
  synthetic [barcode part1]
tctccgattcctcaac

SEQ ID NO: 16043 - DNA, 16 bp, Artificial Sequence
  synthetic [barcode part1]
cgttacctcacgcaac

SEQ ID NO: 16044 - DNA, 16 bp, Artificial Sequence
  synthetic [barcode part1]
ttggtagtgaggacgc

SEQ ID NO: 16045 - DNA, 16 bp, Artificial Sequence
  synthetic [barcode part1]
acgcctcgatccagtt

SEQ ID NO: 16046 - DNA, 16 bp, Artificial Sequence
  synthetic [barcode part1]
agtacgccttctcggt

SEQ ID NO: 16047 - DNA, 16 bp, Artificial Sequence
  synthetic [barcode part1]
actggtgtccagtcct

SEQ ID NO: 16048 - DNA, 16 bp, Artificial Sequence
  synthetic [barcode part1]
agtgatctcgaactgc

SEQ ID NO: 16049 - DNA, 16 bp, Artificial Sequence
  synthetic [barcode part1]
ccacggacgttaatac

SEQ ID NO: 16050 - DNA, 16 bp, Artificial Sequence
  synthetic [barcode part1]
ttcgtactgacaacct

SEQ ID NO: 16051 - DNA, 16 bp, Artificial Sequence
  synthetic [barcode part1]
atcgaacttaccggac

SEQ ID NO: 16052 - DNA, 16 bp, Artificial Sequence
  synthetic [barcode part1]
cctgtgtacacaagac

SEQ ID NO: 16053 - DNA, 16 bp, Artificial Sequence
  synthetic [barcode part1]
ttacacctgttggact

SEQ ID NO: 16054 - DNA, 16 bp, Artificial Sequence
  synthetic [barcode part1]
ataagtccgcgaacct

SEQ ID NO: 16055 - DNA, 16 bp, Artificial Sequence
  synthetic [barcode part1]
gttagacgtgacctac

SEQ ID NO: 16056 - DNA, 16 bp, Artificial Sequence
  synthetic [barcode part1]
tgttggattgtactcc

SEQ ID NO: 16057 - DNA, 16 bp, Artificial Sequence
  synthetic [barcode part1]
ataccggtgtggatct

SEQ ID NO: 16058 - DNA, 16 bp, Artificial Sequence
  synthetic [barcode part1]
acaggaaccgataact

SEQ ID NO: 16059 - DNA, 16 bp, Artificial Sequence
  synthetic [barcode part1]
caacagtatcggactc

SEQ ID NO: 16060 - DNA, 16 bp, Artificial Sequence
  synthetic [barcode part1]
taggactgtaccacac

SEQ ID NO: 16061 - DNA, 16 bp, Artificial Sequence
  synthetic [barcode part1]
caaggacggactgttg

SEQ ID NO: 16062 - DNA, 16 bp, Artificial Sequence
  synthetic [barcode part1]
gcagactacacctagt

SEQ ID NO: 16063 - DNA, 16 bp, Artificial Sequence
  synthetic [barcode part1]
gaactggaactggaag

SEQ ID NO: 16064 - DNA, 16 bp, Artificial Sequence
  synthetic [barcode part1]
tctactgcgcgagtct

SEQ ID NO: 16065 - DNA, 16 bp, Artificial Sequence
  synthetic [barcode part1]
gacttactgccactcg

SEQ ID NO: 16066 - DNA, 16 bp, Artificial Sequence
  synthetic [barcode part1]
tgacggcgaggtatac

SEQ ID NO: 16067 - DNA, 16 bp, Artificial Sequence
  synthetic [barcode part1]
caccgagtctgataac

SEQ ID NO: 16068 - DNA, 16 bp, Artificial Sequence
  synthetic [barcode part1]
tgaacacagtccacac

SEQ ID NO: 16069 - DNA, 16 bp, Artificial Sequence
  synthetic [barcode part1]
actacagagtgtcacc

SEQ ID NO: 16070 - DNA, 16 bp, Artificial Sequence
  synthetic [barcode part1]
acagttgtgacacgtc

SEQ ID NO: 16071 - DNA, 16 bp, Artificial Sequence
  synthetic [barcode part1]
gtacaggactcttgtg

SEQ ID NO: 16072 - DNA, 16 bp, Artificial Sequence
  synthetic [barcode part1]
caccttgtattcgaac

SEQ ID NO: 16073 - DNA, 16 bp, Artificial Sequence
  synthetic [barcode part1]
agtacaacttggtgag

SEQ ID NO: 16074 - DNA, 16 bp, Artificial Sequence
  synthetic [barcode part1]
agtgatattcggacag

SEQ ID NO: 16075 - DNA, 16 bp, Artificial Sequence
  synthetic [barcode part1]
tatcgaacaaggacgt

SEQ ID NO: 16076 - DNA, 16 bp, Artificial Sequence
  synthetic [barcode part1]
ttctgcaatcgttggt

SEQ ID NO: 16077 - DNA, 16 bp, Artificial Sequence
  synthetic [barcode part1]
cgtagattgtcgcctc

SEQ ID NO: 16078 - DNA, 16 bp, Artificial Sequence
  synthetic [barcode part1]
tgttacgcctcagaag

SEQ ID NO: 16079 - DNA, 16 bp, Artificial Sequence
  synthetic [barcode part1]
caagattcgtgcgtgt

SEQ ID NO: 16080 - DNA, 16 bp, Artificial Sequence
  synthetic [barcode part1]
cgtccagaaggtagtg

SEQ ID NO: 16081 - DNA, 16 bp, Artificial Sequence
  synthetic [barcode part1]
ccagtccttacacggt

SEQ ID NO: 16082 - DNA, 16 bp, Artificial Sequence
  synthetic [barcode part1]
gacacgattgtactcg

SEQ ID NO: 16083 - DNA, 16 bp, Artificial Sequence
  synthetic [barcode part1]
accagtgccgtcactt

SEQ ID NO: 16084 - DNA, 16 bp, Artificial Sequence
  synthetic [barcode part1]
cctgttcttcggagtg

SEQ ID NO: 16085 - DNA, 16 bp, Artificial Sequence
  synthetic [barcode part1]
ttaactcgtggccacc

SEQ ID NO: 16086 - DNA, 16 bp, Artificial Sequence
  synthetic [barcode part1]
gttcacttcgtagtgt

SEQ ID NO: 16087 - DNA, 16 bp, Artificial Sequence
  synthetic [barcode part1]
tccggtgtgaattgtg

SEQ ID NO: 16088 - DNA, 16 bp, Artificial Sequence
  synthetic [barcode part1]
cgaagtcggttgactt

SEQ ID NO: 16089 - DNA, 16 bp, Artificial Sequence
  synthetic [barcode part1]
cgttggaagacacggt

SEQ ID NO: 16090 - DNA, 16 bp, Artificial Sequence
  synthetic [barcode part1]
ttcgaagtctcgagac

SEQ ID NO: 16091 - DNA, 16 bp, Artificial Sequence
  synthetic [barcode part1]
tccaccgcaatctctt

SEQ ID NO: 16092 - DNA, 16 bp, Artificial Sequence
  synthetic [barcode part1]
cctagtcttaagaggc

SEQ ID NO: 16093 - DNA, 16 bp, Artificial Sequence
  synthetic [barcode part1]
tctggtctcaaggaac

SEQ ID NO: 16094 - DNA, 16 bp, Artificial Sequence
  synthetic [barcode part1]
gagtcgtacggaggtt

SEQ ID NO: 16095 - DNA, 16 bp, Artificial Sequence
  synthetic [barcode part1]
cggagtctaatactgc

SEQ ID NO: 16096 - DNA, 16 bp, Artificial Sequence
  synthetic [barcode part1]
agacaatatacgaccg

SEQ ID NO: 16097 - DNA, 16 bp, Artificial Sequence
  synthetic [barcode part1]
ccgaagacgtagactg

SEQ ID NO: 16098 - DNA, 16 bp, Artificial Sequence
  synthetic [barcode part1]
gcacttcgtatcttcc

SEQ ID NO: 16099 - DNA, 16 bp, Artificial Sequence
  synthetic [barcode part1]
tctgccgccaagtgtt

SEQ ID NO: 16100 - DNA, 16 bp, Artificial Sequence
  synthetic [barcode part1]
ttacctagatactgcc

SEQ ID NO: 16101 - DNA, 16 bp, Artificial Sequence
  synthetic [barcode part1]
accttatcactggtac

SEQ ID NO: 16102 - DNA, 16 bp, Artificial Sequence
  synthetic [barcode part1]
ttaatacggtcggaag

SEQ ID NO: 16103 - DNA, 16 bp, Artificial Sequence
  synthetic [barcode part1]
atcctatcaagaggcc

SEQ ID NO: 16104 - DNA, 16 bp, Artificial Sequence
  synthetic [barcode part1]
agatctgttcgcagac

SEQ ID NO: 16105 - DNA, 16 bp, Artificial Sequence
  synthetic [barcode part1]
cgcggcgaatattatc

SEQ ID NO: 16106 - DNA, 16 bp, Artificial Sequence
  synthetic [barcode part1]
agtcctcttggatatc

SEQ ID NO: 16107 - DNA, 16 bp, Artificial Sequence
  synthetic [barcode part1]
cggttgactaaccagt

SEQ ID NO: 16108 - DNA, 16 bp, Artificial Sequence
  synthetic [barcode part1]
cggcaatacgcagagt

SEQ ID NO: 16109 - DNA, 16 bp, Artificial Sequence
  synthetic [barcode part1]
gtcaggatacacgacg

SEQ ID NO: 16110 - DNA, 16 bp, Artificial Sequence
  synthetic [barcode part1]
ttgcaacgttgcaacg

SEQ ID NO: 16111 - DNA, 16 bp, Artificial Sequence
  synthetic [barcode part1]
aaccaggatagttacg

SEQ ID NO: 16112 - DNA, 16 bp, Artificial Sequence
  synthetic [barcode part1]
cagtaacctggtagtc

SEQ ID NO: 16113 - DNA, 16 bp, Artificial Sequence
  synthetic [barcode part1]
tacgataggacctcgt

SEQ ID NO: 16114 - DNA, 16 bp, Artificial Sequence
  synthetic [barcode part1]
cacggtaggtactgtt

SEQ ID NO: 16115 - DNA, 16 bp, Artificial Sequence
  synthetic [barcode part1]
acgataccaatcgacc

SEQ ID NO: 16116 - DNA, 16 bp, Artificial Sequence
  synthetic [barcode part1]
tcggcaggaattatcc

SEQ ID NO: 16117 - DNA, 16 bp, Artificial Sequence
  synthetic [barcode part1]
actgtcaggaggtgtg

SEQ ID NO: 16118 - DNA, 16 bp, Artificial Sequence
  synthetic [barcode part1]
cgacggtgttattgac

SEQ ID NO: 16119 - DNA, 16 bp, Artificial Sequence
  synthetic [barcode part1]
gaaccacgagttacct

SEQ ID NO: 16120 - DNA, 16 bp, Artificial Sequence
  synthetic [barcode part1]
ccaataccgtgatcag

SEQ ID NO: 16121 - DNA, 16 bp, Artificial Sequence
  synthetic [barcode part1]
tgtgccttatcagatc

SEQ ID NO: 16122 - DNA, 16 bp, Artificial Sequence
  synthetic [barcode part1]
tacagactcgcgaatc

SEQ ID NO: 16123 - DNA, 16 bp, Artificial Sequence
  synthetic [barcode part1]
tacctccgttgagtcg

SEQ ID NO: 16124 - DNA, 16 bp, Artificial Sequence
  synthetic [barcode part1]
tgcgaccgttatcctg

SEQ ID NO: 16125 - DNA, 16 bp, Artificial Sequence
  synthetic [barcode part1]
gattggcagttggtct

SEQ ID NO: 16126 - DNA, 16 bp, Artificial Sequence
  synthetic [barcode part1]
gttacgtggagattag

SEQ ID NO: 16127 - DNA, 16 bp, Artificial Sequence
  synthetic [barcode part1]
tccttggtgcacaacc

SEQ ID NO: 16128 - DNA, 16 bp, Artificial Sequence
  synthetic [barcode part1]
gtggattgcgttcaac

SEQ ID NO: 16129 - DNA, 16 bp, Artificial Sequence
  synthetic [barcode part1]
acacgatcaactacgc

SEQ ID NO: 16130 - DNA, 16 bp, Artificial Sequence
  synthetic [barcode part1]
acaagtagacgccgtg

SEQ ID NO: 16131 - DNA, 16 bp, Artificial Sequence
  synthetic [barcode part1]
cgtcaatagaggaccg

SEQ ID NO: 16132 - DNA, 16 bp, Artificial Sequence
  synthetic [barcode part1]
tgagaggacgtcagtc

SEQ ID NO: 16133 - DNA, 16 bp, Artificial Sequence
  synthetic [barcode part1]
tgcgcggcaaggaatt

SEQ ID NO: 16134 - DNA, 16 bp, Artificial Sequence
  synthetic [barcode part1]
accgcggttgttcact

SEQ ID NO: 16135 - DNA, 16 bp, Artificial Sequence
  synthetic [barcode part1]
caaggacgttcaatag

SEQ ID NO: 16136 - DNA, 16 bp, Artificial Sequence
  synthetic [barcode part1]
gaggatccaacgtgtg

SEQ ID NO: 16137 - DNA, 16 bp, Artificial Sequence
  synthetic [barcode part1]
gtccaatcggttcaag

SEQ ID NO: 16138 - DNA, 16 bp, Artificial Sequence
  synthetic [barcode part1]
tatcgaccttcctaag

SEQ ID NO: 16139 - DNA, 16 bp, Artificial Sequence
  synthetic [barcode part1]
tgcggtcaaggtagtg

SEQ ID NO: 16140 - DNA, 16 bp, Artificial Sequence
  synthetic [barcode part1]
tctccaacgtacagtt

SEQ ID NO: 16141 - DNA, 16 bp, Artificial Sequence
  synthetic [barcode part1]
gcggtcgttccaactt

SEQ ID NO: 16142 - DNA, 16 bp, Artificial Sequence
  synthetic [barcode part1]
ttgtgttgcggtctgc

SEQ ID NO: 16143 - DNA, 16 bp, Artificial Sequence
  synthetic [barcode part1]
acagaggaacctggtc

SEQ ID NO: 16144 - DNA, 16 bp, Artificial Sequence
  synthetic [barcode part1]
atcggaggttgtgcag

SEQ ID NO: 16145 - DNA, 16 bp, Artificial Sequence
  synthetic [barcode part1]
tctgttgtcaggtgtt

SEQ ID NO: 16146 - DNA, 16 bp, Artificial Sequence
  synthetic [barcode part1]
tgaaccgatcaccagt

SEQ ID NO: 16147 - DNA, 16 bp, Artificial Sequence
  synthetic [barcode part1]
tactggatatccttgc

SEQ ID NO: 16148 - DNA, 16 bp, Artificial Sequence
  synthetic [barcode part1]
ccacactctgttggac

SEQ ID NO: 16149 - DNA, 16 bp, Artificial Sequence
  synthetic [barcode part1]
tggtactacaggcgag

SEQ ID NO: 16150 - DNA, 16 bp, Artificial Sequence
  synthetic [barcode part1]
gttaacgtccgtgaac

SEQ ID NO: 16151 - DNA, 16 bp, Artificial Sequence
  synthetic [barcode part1]
tcttcagtacgcgatt

SEQ ID NO: 16152 - DNA, 16 bp, Artificial Sequence
  synthetic [barcode part1]
gcgttcgatcctactg

SEQ ID NO: 16153 - DNA, 16 bp, Artificial Sequence
  synthetic [barcode part1]
aggtatcggtatctgc

SEQ ID NO: 16154 - DNA, 16 bp, Artificial Sequence
  synthetic [barcode part1]
tatccgaagagtaacg

SEQ ID NO: 16155 - DNA, 16 bp, Artificial Sequence
  synthetic [barcode part1]
gtatctgacctcgtcg

SEQ ID NO: 16156 - DNA, 16 bp, Artificial Sequence
  synthetic [barcode part1]
gtgccagatcactctc

SEQ ID NO: 16157 - DNA, 16 bp, Artificial Sequence
  synthetic [barcode part1]
gaggcagaagtaacgt

SEQ ID NO: 16158 - DNA, 16 bp, Artificial Sequence
  synthetic [barcode part1]
gttacgataggacctc

SEQ ID NO: 16159 - DNA, 16 bp, Artificial Sequence
  synthetic [barcode part1]
agactggcgtgatcag

SEQ ID NO: 16160 - DNA, 16 bp, Artificial Sequence
  synthetic [barcode part1]
ttggttgtcgaccaag

SEQ ID NO: 16161 - DNA, 16 bp, Artificial Sequence
  synthetic [barcode part1]
cggaatcggaactctt

SEQ ID NO: 16162 - DNA, 16 bp, Artificial Sequence
  synthetic [barcode part1]
actgtcagttgaaccg

SEQ ID NO: 16163 - DNA, 16 bp, Artificial Sequence
  synthetic [barcode part1]
gagtcgataatcacag

SEQ ID NO: 16164 - DNA, 16 bp, Artificial Sequence
  synthetic [barcode part1]
cgcgttcgtaacctgt

SEQ ID NO: 16165 - DNA, 16 bp, Artificial Sequence
  synthetic [barcode part1]
cgagaagaacttctcc

SEQ ID NO: 16166 - DNA, 16 bp, Artificial Sequence
  synthetic [barcode part1]
gcacttcttgatagtc

SEQ ID NO: 16167 - DNA, 16 bp, Artificial Sequence
  synthetic [barcode part1]
tgaattggtgcagagt

SEQ ID NO: 16168 - DNA, 16 bp, Artificial Sequence
  synthetic [barcode part1]
gacacttagtgacaag

SEQ ID NO: 16169 - DNA, 16 bp, Artificial Sequence
  synthetic [barcode part1]
ttgtgcagatctcttg

SEQ ID NO: 16170 - DNA, 16 bp, Artificial Sequence
  synthetic [barcode part1]
atcggatagtgcaggc

SEQ ID NO: 16171 - DNA, 16 bp, Artificial Sequence
  synthetic [barcode part1]
gtacttggtggattcg

SEQ ID NO: 16172 - DNA, 16 bp, Artificial Sequence
  synthetic [barcode part1]
ttattccgtgcaatcg

SEQ ID NO: 16173 - DNA, 16 bp, Artificial Sequence
  synthetic [barcode part1]
acaactaggaactggt

SEQ ID NO: 16174 - DNA, 16 bp, Artificial Sequence
  synthetic [barcode part1]
gcgttaggttacttct

SEQ ID NO: 16175 - DNA, 16 bp, Artificial Sequence
  synthetic [barcode part1]
actggtgactctccgt

SEQ ID NO: 16176 - DNA, 16 bp, Artificial Sequence
  synthetic [barcode part1]
tctctcttaacaccgc

SEQ ID NO: 16177 - DNA, 16 bp, Artificial Sequence
  synthetic [barcode part1]
gccagtaggcagtagt

SEQ ID NO: 16178 - DNA, 16 bp, Artificial Sequence
  synthetic [barcode part1]
gacacactacgcgatt

SEQ ID NO: 16179 - DNA, 16 bp, Artificial Sequence
  synthetic [barcode part1]
aaccgagttatcaccg

SEQ ID NO: 16180 - DNA, 16 bp, Artificial Sequence
  synthetic [barcode part1]
cacacgaagtggtggt

SEQ ID NO: 16181 - DNA, 16 bp, Artificial Sequence
  synthetic [barcode part1]
gtgaggttgaggtaag

SEQ ID NO: 16182 - DNA, 16 bp, Artificial Sequence
  synthetic [barcode part1]
aactggcctctctctt

SEQ ID NO: 16183 - DNA, 16 bp, Artificial Sequence
  synthetic [barcode part1]
cactcgtaacaccacc

SEQ ID NO: 16184 - DNA, 16 bp, Artificial Sequence
  synthetic [barcode part1]
tcttagtgagacgacc

SEQ ID NO: 16185 - DNA, 16 bp, Artificial Sequence
  synthetic [barcode part1]
acactctaactaccgt

SEQ ID NO: 16186 - DNA, 16 bp, Artificial Sequence
  synthetic [barcode part1]
tgtactctcgtgtcct

SEQ ID NO: 16187 - DNA, 16 bp, Artificial Sequence
  synthetic [barcode part1]
ccgtaaggtaaggcgt

SEQ ID NO: 16188 - DNA, 16 bp, Artificial Sequence
  synthetic [barcode part1]
gtattctagtctggtc

SEQ ID NO: 16189 - DNA, 16 bp, Artificial Sequence
  synthetic [barcode part1]
tacggatcttaggtgc

SEQ ID NO: 16190 - DNA, 16 bp, Artificial Sequence
  synthetic [barcode part1]
gtctccagtaaggatc

SEQ ID NO: 16191 - DNA, 16 bp, Artificial Sequence
  synthetic [barcode part1]
aagtacacgtgtctcg

SEQ ID NO: 16192 - DNA, 16 bp, Artificial Sequence
  synthetic [barcode part1]
gtccgcagttacttcg

SEQ ID NO: 16193 - DNA, 16 bp, Artificial Sequence
  synthetic [barcode part1]
gcgttatcaggcagag

SEQ ID NO: 16194 - DNA, 16 bp, Artificial Sequence
  synthetic [barcode part1]
aagttgtgccttcgtt

SEQ ID NO: 16195 - DNA, 16 bp, Artificial Sequence
  synthetic [barcode part1]
gtaactgtggttacgc

SEQ ID NO: 16196 - DNA, 16 bp, Artificial Sequence
  synthetic [barcode part1]
aacacgtagaatcgac

SEQ ID NO: 16197 - DNA, 16 bp, Artificial Sequence
  synthetic [barcode part1]
actctcgtgccagatc

SEQ ID NO: 16198 - DNA, 16 bp, Artificial Sequence
  synthetic [barcode part1]
gaccgcgttaacctct

SEQ ID NO: 16199 - DNA, 16 bp, Artificial Sequence
  synthetic [barcode part1]
tgagtcgtctcgtatt

SEQ ID NO: 16200 - DNA, 16 bp, Artificial Sequence
  synthetic [barcode part1]
tgcaggccttgttacc

SEQ ID NO: 16201 - DNA, 16 bp, Artificial Sequence
  synthetic [barcode part1]
gtcgattggaattccg

SEQ ID NO: 16202 - DNA, 16 bp, Artificial Sequence
  synthetic [barcode part1]
gtgtgcaatatcgcgt

SEQ ID NO: 16203 - DNA, 16 bp, Artificial Sequence
  synthetic [barcode part1]
gtagattctggcacgt

SEQ ID NO: 16204 - DNA, 16 bp, Artificial Sequence
  synthetic [barcode part1]
cacactctaccagacc

SEQ ID NO: 16205 - DNA, 16 bp, Artificial Sequence
  synthetic [barcode part1]
aggtctaccaccactc

SEQ ID NO: 16206 - DNA, 16 bp, Artificial Sequence
  synthetic [barcode part1]
ttaagactccgtctgt

SEQ ID NO: 16207 - DNA, 16 bp, Artificial Sequence
  synthetic [barcode part1]
gattcgtgataagacg

SEQ ID NO: 16208 - DNA, 16 bp, Artificial Sequence
  synthetic [barcode part1]
gaagtaagtggatctc

SEQ ID NO: 16209 - DNA, 16 bp, Artificial Sequence
  synthetic [barcode part1]
cggagagaatcttcct

SEQ ID NO: 16210 - DNA, 16 bp, Artificial Sequence
  synthetic [barcode part1]
taagaactgttggacg

SEQ ID NO: 16211 - DNA, 16 bp, Artificial Sequence
  synthetic [barcode part1]
gcctgccagtgttatc

SEQ ID NO: 16212 - DNA, 16 bp, Artificial Sequence
  synthetic [barcode part1]
tatagttgcgtgaccg

SEQ ID NO: 16213 - DNA, 16 bp, Artificial Sequence
  synthetic [barcode part1]
ccacggaatcctctac

SEQ ID NO: 16214 - DNA, 16 bp, Artificial Sequence
  synthetic [barcode part1]
gcagattccttcaatc

SEQ ID NO: 16215 - DNA, 16 bp, Artificial Sequence
  synthetic [barcode part1]
gaacgaaggcgtcgtt

SEQ ID NO: 16216 - DNA, 16 bp, Artificial Sequence
  synthetic [barcode part1]
actgcggaatactgtc

SEQ ID NO: 16217 - DNA, 16 bp, Artificial Sequence
  synthetic [barcode part1]
cagactagtattctcc

SEQ ID NO: 16218 - DNA, 16 bp, Artificial Sequence
  synthetic [barcode part1]
atcaacctgcacacag

SEQ ID NO: 16219 - DNA, 16 bp, Artificial Sequence
  synthetic [barcode part1]
agttcagttggcaacc

SEQ ID NO: 16220 - DNA, 16 bp, Artificial Sequence
  synthetic [barcode part1]
aaggaagttccgagag

SEQ ID NO: 16221 - DNA, 16 bp, Artificial Sequence
  synthetic [barcode part1]
tgtgaaccaccgttcc

SEQ ID NO: 16222 - DNA, 16 bp, Artificial Sequence
  synthetic [barcode part1]
caccaccaggtgttct

SEQ ID NO: 16223 - DNA, 16 bp, Artificial Sequence
  synthetic [barcode part1]
aagaatcgcgttaacg

SEQ ID NO: 16224 - DNA, 16 bp, Artificial Sequence
  synthetic [barcode part1]
tccgacttggttgtgc

SEQ ID NO: 16225 - DNA, 16 bp, Artificial Sequence
  synthetic [barcode part1]
cagtagtgaagtgcgc

SEQ ID NO: 16226 - DNA, 16 bp, Artificial Sequence
  synthetic [barcode part1]
cctatcgcgtatcgac

SEQ ID NO: 16227 - DNA, 16 bp, Artificial Sequence
  synthetic [barcode part1]
tgcctatccgttcact

SEQ ID NO: 16228 - DNA, 16 bp, Artificial Sequence
  synthetic [barcode part1]
agttcagtggtgatcc

SEQ ID NO: 16229 - DNA, 16 bp, Artificial Sequence
  synthetic [barcode part1]
cgtcctgttgttctgt

SEQ ID NO: 16230 - DNA, 16 bp, Artificial Sequence
  synthetic [barcode part1]
atcgacttgcacgtag

SEQ ID NO: 16231 - DNA, 16 bp, Artificial Sequence
  synthetic [barcode part1]
cgcaacgagtgaacac

SEQ ID NO: 16232 - DNA, 16 bp, Artificial Sequence
  synthetic [barcode part1]
tatacgcgtatacgcg

SEQ ID NO: 16233 - DNA, 16 bp, Artificial Sequence
  synthetic [barcode part1]
cgtaggaaccggattg

SEQ ID NO: 16234 - DNA, 16 bp, Artificial Sequence
  synthetic [barcode part1]
gacctaacttcacgcc

SEQ ID NO: 16235 - DNA, 16 bp, Artificial Sequence
  synthetic [barcode part1]
tcggtctcaggttcac

SEQ ID NO: 16236 - DNA, 16 bp, Artificial Sequence
  synthetic [barcode part1]
gtctggaacgaactct

SEQ ID NO: 16237 - DNA, 16 bp, Artificial Sequence
  synthetic [barcode part1]
tcgcgaagagtcaggt

SEQ ID NO: 16238 - DNA, 16 bp, Artificial Sequence
  synthetic [barcode part1]
gattctcctctcgact

SEQ ID NO: 16239 - DNA, 16 bp, Artificial Sequence
  synthetic [barcode part1]
gcggccagattagagt

SEQ ID NO: 16240 - DNA, 16 bp, Artificial Sequence
  synthetic [barcode part1]
tacaaccgttgttctg

SEQ ID NO: 16241 - DNA, 16 bp, Artificial Sequence
  synthetic [barcode part1]
cctactgaagagttgc

SEQ ID NO: 16242 - DNA, 16 bp, Artificial Sequence
  synthetic [barcode part1]
acgcctgaatactcag

SEQ ID NO: 16243 - DNA, 16 bp, Artificial Sequence
  synthetic [barcode part1]
actacgtacacctgag

SEQ ID NO: 16244 - DNA, 16 bp, Artificial Sequence
  synthetic [barcode part1]
tcaattcttacgcgac

SEQ ID NO: 16245 - DNA, 16 bp, Artificial Sequence
  synthetic [barcode part1]
cgagagactctaatcc

SEQ ID NO: 16246 - DNA, 16 bp, Artificial Sequence
  synthetic [barcode part1]
ttaccagattggaccg

SEQ ID NO: 16247 - DNA, 16 bp, Artificial Sequence
  synthetic [barcode part1]
aagactctcgtagtgc

SEQ ID NO: 16248 - DNA, 16 bp, Artificial Sequence
  synthetic [barcode part1]
tccaatcgacctctct

SEQ ID NO: 16249 - DNA, 16 bp, Artificial Sequence
  synthetic [barcode part1]
cagtcctggaattgac

SEQ ID NO: 16250 - DNA, 16 bp, Artificial Sequence
  synthetic [barcode part1]
actcgtctactacggc

SEQ ID NO: 16251 - DNA, 16 bp, Artificial Sequence
  synthetic [barcode part1]
aagtctctctcaggag

SEQ ID NO: 16252 - DNA, 16 bp, Artificial Sequence
  synthetic [barcode part1]
tcagatctacgttctg

SEQ ID NO: 16253 - DNA, 16 bp, Artificial Sequence
  synthetic [barcode part1]
aatacagacttggcag

SEQ ID NO: 16254 - DNA, 16 bp, Artificial Sequence
  synthetic [barcode part1]
aggccaagaggttaag

SEQ ID NO: 16255 - DNA, 16 bp, Artificial Sequence
  synthetic [barcode part1]
tataactgcgtggtcg

SEQ ID NO: 16256 - DNA, 16 bp, Artificial Sequence
  synthetic [barcode part1]
ttcggtaagacgtaag

SEQ ID NO: 16257 - DNA, 16 bp, Artificial Sequence
  synthetic [barcode part1]
cctaagagtgtacacc

SEQ ID NO: 16258 - DNA, 16 bp, Artificial Sequence
  synthetic [barcode part1]
gtaccggttctcaacc

SEQ ID NO: 16259 - DNA, 16 bp, Artificial Sequence
  synthetic [barcode part1]
gcggtaatccaattcg

SEQ ID NO: 16260 - DNA, 16 bp, Artificial Sequence
  synthetic [barcode part1]
tcggagattcctagtg

SEQ ID NO: 16261 - DNA, 16 bp, Artificial Sequence
  synthetic [barcode part1]
atctaggaacgtctgc

SEQ ID NO: 16262 - DNA, 16 bp, Artificial Sequence
  synthetic [barcode part1]
gtggtcctacttccag

SEQ ID NO: 16263 - DNA, 16 bp, Artificial Sequence
  synthetic [barcode part1]
cgtcgacgattggaag

SEQ ID NO: 16264 - DNA, 16 bp, Artificial Sequence
  synthetic [barcode part1]
gaactgcgtccttatt

SEQ ID NO: 16265 - DNA, 16 bp, Artificial Sequence
  synthetic [barcode part1]
tcgtgtagtattggcg

SEQ ID NO: 16266 - DNA, 16 bp, Artificial Sequence
  synthetic [barcode part1]
acgaaggaactcggtc

SEQ ID NO: 16267 - DNA, 16 bp, Artificial Sequence
  synthetic [barcode part1]
tgtccgtacttgtctc

SEQ ID NO: 16268 - DNA, 16 bp, Artificial Sequence
  synthetic [barcode part1]
gacctcgagtggatag

SEQ ID NO: 16269 - DNA, 16 bp, Artificial Sequence
  synthetic [barcode part1]
caggatcctgattggt

SEQ ID NO: 16270 - DNA, 16 bp, Artificial Sequence
  synthetic [barcode part1]
aacacctatccttcag

SEQ ID NO: 16271 - DNA, 16 bp, Artificial Sequence
  synthetic [barcode part1]
cggatactgcgaatct

SEQ ID NO: 16272 - DNA, 16 bp, Artificial Sequence
  synthetic [barcode part1]
cgttgtcgacgtactc

SEQ ID NO: 16273 - DNA, 16 bp, Artificial Sequence
  synthetic [barcode part1]
gcacaccagtgacaag

SEQ ID NO: 16274 - DNA, 16 bp, Artificial Sequence
  synthetic [barcode part1]
atccaccttactcacc

SEQ ID NO: 16275 - DNA, 16 bp, Artificial Sequence
  synthetic [barcode part1]
tgtggcgtctacttgc

SEQ ID NO: 16276 - DNA, 16 bp, Artificial Sequence
  synthetic [barcode part1]
gtattagtcctgtcgt

SEQ ID NO: 16277 - DNA, 16 bp, Artificial Sequence
  synthetic [barcode part1]
tatctctctctcgcag

SEQ ID NO: 16278 - DNA, 16 bp, Artificial Sequence
  synthetic [barcode part1]
cgtgttaaggattgag

SEQ ID NO: 16279 - DNA, 16 bp, Artificial Sequence
  synthetic [barcode part1]
cactcctccagatcag

SEQ ID NO: 16280 - DNA, 16 bp, Artificial Sequence
  synthetic [barcode part1]
gactaactgtaacgcc

SEQ ID NO: 16281 - DNA, 16 bp, Artificial Sequence
  synthetic [barcode part1]
tctgttaagttcacgc

SEQ ID NO: 16282 - DNA, 16 bp, Artificial Sequence
  synthetic [barcode part1]
tacgatccgtaccaag

SEQ ID NO: 16283 - DNA, 16 bp, Artificial Sequence
  synthetic [barcode part1]
cgcacttgagttattc

SEQ ID NO: 16284 - DNA, 16 bp, Artificial Sequence
  synthetic [barcode part1]
gtgattcacgaggacg

SEQ ID NO: 16285 - DNA, 16 bp, Artificial Sequence
  synthetic [barcode part1]
aagtccttgcgtgtag

SEQ ID NO: 16286 - DNA, 16 bp, Artificial Sequence
  synthetic [barcode part1]
acaacggatccaggtg

SEQ ID NO: 16287 - DNA, 16 bp, Artificial Sequence
  synthetic [barcode part1]
acgtatcttgttgtcg

SEQ ID NO: 16288 - DNA, 16 bp, Artificial Sequence
  synthetic [barcode part1]
atcttcactcgtgtcc

SEQ ID NO: 16289 - DNA, 16 bp, Artificial Sequence
  synthetic [barcode part1]
ttgaggcacctgcctt

SEQ ID NO: 16290 - DNA, 16 bp, Artificial Sequence
  synthetic [barcode part1]
tcaattccaccggtgc

SEQ ID NO: 16291 - DNA, 16 bp, Artificial Sequence
  synthetic [barcode part1]
agatccgtctagttct

SEQ ID NO: 16292 - DNA, 16 bp, Artificial Sequence
  synthetic [barcode part1]
gagttcttgaccagtg

SEQ ID NO: 16293 - DNA, 16 bp, Artificial Sequence
  synthetic [barcode part1]
cagtctagtcctcgtg

SEQ ID NO: 16294 - DNA, 16 bp, Artificial Sequence
  synthetic [barcode part1]
cacgagtaacgttcgt

SEQ ID NO: 16295 - DNA, 16 bp, Artificial Sequence
  synthetic [barcode part1]
ttcaaggcgaccaatc

SEQ ID NO: 16296 - DNA, 16 bp, Artificial Sequence
  synthetic [barcode part1]
tactcgatcgacgtag

SEQ ID NO: 16297 - DNA, 16 bp, Artificial Sequence
  synthetic [barcode part1]
actgagttgcctctgc

SEQ ID NO: 16298 - DNA, 16 bp, Artificial Sequence
  synthetic [barcode part1]
tacgacgcgttgtagt

SEQ ID NO: 16299 - DNA, 16 bp, Artificial Sequence
  synthetic [barcode part1]
cgtgaagttgagttag

SEQ ID NO: 16300 - DNA, 16 bp, Artificial Sequence
  synthetic [barcode part1]
tcaagtatcacctcgt

SEQ ID NO: 16301 - DNA, 16 bp, Artificial Sequence
  synthetic [barcode part1]
gcctgtcaagtcctgt

SEQ ID NO: 16302 - DNA, 16 bp, Artificial Sequence
  synthetic [barcode part1]
ttgatagacggcctgt

SEQ ID NO: 16303 - DNA, 16 bp, Artificial Sequence
  synthetic [barcode part1]
actcaacaccactgag

SEQ ID NO: 16304 - DNA, 16 bp, Artificial Sequence
  synthetic [barcode part1]
ttgcgccgaatcacct

SEQ ID NO: 16305 - DNA, 16 bp, Artificial Sequence
  synthetic [barcode part1]
agacaatcgcagattg

SEQ ID NO: 16306 - DNA, 16 bp, Artificial Sequence
  synthetic [barcode part1]
atacctgtatcacctg

SEQ ID NO: 16307 - DNA, 16 bp, Artificial Sequence
  synthetic [barcode part1]
accaacgattcttcgt

SEQ ID NO: 16308 - DNA, 16 bp, Artificial Sequence
  synthetic [barcode part1]
agtcaacacacacacc

SEQ ID NO: 16309 - DNA, 16 bp, Artificial Sequence
  synthetic [barcode part1]
tataacaacggcgtcc

SEQ ID NO: 16310 - DNA, 16 bp, Artificial Sequence
  synthetic [barcode part1]
tgtcgagttcggtagt

SEQ ID NO: 16311 - DNA, 16 bp, Artificial Sequence
  synthetic [barcode part1]
tctaatcgtgcgccac

SEQ ID NO: 16312 - DNA, 16 bp, Artificial Sequence
  synthetic [barcode part1]
cctcgagacaagtgag

SEQ ID NO: 16313 - DNA, 16 bp, Artificial Sequence
  synthetic [barcode part1]
cgtccactgagactct

SEQ ID NO: 16314 - DNA, 16 bp, Artificial Sequence
  synthetic [barcode part1]
atacgtccgtctcacg

SEQ ID NO: 16315 - DNA, 16 bp, Artificial Sequence
  synthetic [barcode part1]
ttccagatactcgttg

SEQ ID NO: 16316 - DNA, 16 bp, Artificial Sequence
  synthetic [barcode part1]
gtggtcgccttgattc

SEQ ID NO: 16317 - DNA, 16 bp, Artificial Sequence
  synthetic [barcode part1]
caatcttggttcctcc

SEQ ID NO: 16318 - DNA, 16 bp, Artificial Sequence
  synthetic [barcode part1]
aacactgtgacgttgc

SEQ ID NO: 16319 - DNA, 16 bp, Artificial Sequence
  synthetic [barcode part1]
acttaccgtggacagt

SEQ ID NO: 16320 - DNA, 16 bp, Artificial Sequence
  synthetic [barcode part1]
actcttaacagaggcc

SEQ ID NO: 16321 - DNA, 16 bp, Artificial Sequence
  synthetic [barcode part1]
ttggtcagtacacgtg

SEQ ID NO: 16322 - DNA, 16 bp, Artificial Sequence
  synthetic [barcode part1]
tgcgcgatcactgttc

SEQ ID NO: 16323 - DNA, 16 bp, Artificial Sequence
  synthetic [barcode part1]
actgacaataaccgcc

SEQ ID NO: 16324 - DNA, 16 bp, Artificial Sequence
  synthetic [barcode part1]
gcaattggattctctc

SEQ ID NO: 16325 - DNA, 16 bp, Artificial Sequence
  synthetic [barcode part1]
tcttcgatcaggaggt

SEQ ID NO: 16326 - DNA, 16 bp, Artificial Sequence
  synthetic [barcode part1]
ttcacgtaaccactgt

SEQ ID NO: 16327 - DNA, 16 bp, Artificial Sequence
  synthetic [barcode part1]
gtgtcctgtattctcc

SEQ ID NO: 16328 - DNA, 16 bp, Artificial Sequence
  synthetic [barcode part1]
actaccaactgtcgag

SEQ ID NO: 16329 - DNA, 16 bp, Artificial Sequence
  synthetic [barcode part1]
cgttactagtgtacct

SEQ ID NO: 16330 - DNA, 16 bp, Artificial Sequence
  synthetic [barcode part1]
acttcacaggcgcctt

SEQ ID NO: 16331 - DNA, 16 bp, Artificial Sequence
  synthetic [barcode part1]
cacaccttagattgtc

SEQ ID NO: 16332 - DNA, 16 bp, Artificial Sequence
  synthetic [barcode part1]
attggacctgtattcc

SEQ ID NO: 16333 - DNA, 16 bp, Artificial Sequence
  synthetic [barcode part1]
ccacttcactaggaag

SEQ ID NO: 16334 - DNA, 16 bp, Artificial Sequence
  synthetic [barcode part1]
ccgattctgagttcgc

SEQ ID NO: 16335 - DNA, 16 bp, Artificial Sequence
  synthetic [barcode part1]
gccaacgtactgatac

SEQ ID NO: 16336 - DNA, 16 bp, Artificial Sequence
  synthetic [barcode part1]
accgatagttctccgc

SEQ ID NO: 16337 - DNA, 16 bp, Artificial Sequence
  synthetic [barcode part1]
gaatcgtgacgattcc

SEQ ID NO: 16338 - DNA, 16 bp, Artificial Sequence
  synthetic [barcode part1]
atagacctctcgtcgc

SEQ ID NO: 16339 - DNA, 16 bp, Artificial Sequence
  synthetic [barcode part1]
atcgcgattgcaacgt

SEQ ID NO: 16340 - DNA, 16 bp, Artificial Sequence
  synthetic [barcode part1]
acttgtggtacaaccg

SEQ ID NO: 16341 - DNA, 16 bp, Artificial Sequence
  synthetic [barcode part1]
cgttctcttgaatcag

SEQ ID NO: 16342 - DNA, 16 bp, Artificial Sequence
  synthetic [barcode part1]
agttaactgcgtgcgt

SEQ ID NO: 16343 - DNA, 16 bp, Artificial Sequence
  synthetic [barcode part1]
cgagttatcggactac

SEQ ID NO: 16344 - DNA, 16 bp, Artificial Sequence
  synthetic [barcode part1]
gtggcgtattgtagtc

SEQ ID NO: 16345 - DNA, 16 bp, Artificial Sequence
  synthetic [barcode part1]
acttggtgtcaggttg

SEQ ID NO: 16346 - DNA, 16 bp, Artificial Sequence
  synthetic [barcode part1]
gcgactattcctcggt

SEQ ID NO: 16347 - DNA, 16 bp, Artificial Sequence
  synthetic [barcode part1]
tggttaactccggagt

SEQ ID NO: 16348 - DNA, 16 bp, Artificial Sequence
  synthetic [barcode part1]
ttgttacctgcgaatc

SEQ ID NO: 16349 - DNA, 16 bp, Artificial Sequence
  synthetic [barcode part1]
aattgcaccaacctct

SEQ ID NO: 16350 - DNA, 16 bp, Artificial Sequence
  synthetic [barcode part1]
tcgaggacaattctcg

SEQ ID NO: 16351 - DNA, 16 bp, Artificial Sequence
  synthetic [barcode part1]
cgcctgtcctaagact

SEQ ID NO: 16352 - DNA, 16 bp, Artificial Sequence
  synthetic [barcode part1]
caatctgacctctgcg

SEQ ID NO: 16353 - DNA, 16 bp, Artificial Sequence
  synthetic [barcode part1]
caacgttgtaagtgag

SEQ ID NO: 16354 - DNA, 16 bp, Artificial Sequence
  synthetic [barcode part1]
aactcgacacacctcc

SEQ ID NO: 16355 - DNA, 16 bp, Artificial Sequence
  synthetic [barcode part1]
actgacgacctgagtt

SEQ ID NO: 16356 - DNA, 16 bp, Artificial Sequence
  synthetic [barcode part1]
actaggttggactgtc

SEQ ID NO: 16357 - DNA, 16 bp, Artificial Sequence
  synthetic [barcode part1]
aactgactgtgtgtgc

SEQ ID NO: 16358 - DNA, 16 bp, Artificial Sequence
  synthetic [barcode part1]
agatcacggtgtaggc

SEQ ID NO: 16359 - DNA, 16 bp, Artificial Sequence
  synthetic [barcode part1]
gtgacttctcgtattg

SEQ ID NO: 16360 - DNA, 16 bp, Artificial Sequence
  synthetic [barcode part1]
gtcacagacagtgtct

SEQ ID NO: 16361 - DNA, 16 bp, Artificial Sequence
  synthetic [barcode part1]
agaggtgacaagagtc

SEQ ID NO: 16362 - DNA, 16 bp, Artificial Sequence
  synthetic [barcode part1]
atactgattggcgcgt

SEQ ID NO: 16363 - DNA, 16 bp, Artificial Sequence
  synthetic [barcode part1]
cgccgcgattaattag

SEQ ID NO: 16364 - DNA, 16 bp, Artificial Sequence
  synthetic [barcode part1]
cgagattctctctctc

SEQ ID NO: 16365 - DNA, 16 bp, Artificial Sequence
  synthetic [barcode part1]
aacagtacgcctggag

SEQ ID NO: 16366 - DNA, 16 bp, Artificial Sequence
  synthetic [barcode part1]
gatcctcgtgtagtcc

SEQ ID NO: 16367 - DNA, 16 bp, Artificial Sequence
  synthetic [barcode part1]
aacacaacggattacg

SEQ ID NO: 16368 - DNA, 16 bp, Artificial Sequence
  synthetic [barcode part1]
agactcacctacagac

SEQ ID NO: 16369 - DNA, 16 bp, Artificial Sequence
  synthetic [barcode part1]
caacttcgcgtcaatt

SEQ ID NO: 16370 - DNA, 16 bp, Artificial Sequence
  synthetic [barcode part1]
caaggaagtgccggtt

SEQ ID NO: 16371 - DNA, 16 bp, Artificial Sequence
  synthetic [barcode part1]
aacgacgtgtccgaag

SEQ ID NO: 16372 - DNA, 16 bp, Artificial Sequence
  synthetic [barcode part1]
gaaccacggtacaggt

SEQ ID NO: 16373 - DNA, 16 bp, Artificial Sequence
  synthetic [barcode part1]
tcaacagtactggacc

SEQ ID NO: 16374 - DNA, 16 bp, Artificial Sequence
  synthetic [barcode part1]
atcgtgaaggttctgc

SEQ ID NO: 16375 - DNA, 16 bp, Artificial Sequence
  synthetic [barcode part1]
cagtggtcctcacact

SEQ ID NO: 16376 - DNA, 16 bp, Artificial Sequence
  synthetic [barcode part1]
tgtgacagtagacaac

SEQ ID NO: 16377 - DNA, 16 bp, Artificial Sequence
  synthetic [barcode part1]
aacaagtatccgcctg

SEQ ID NO: 16378 - DNA, 16 bp, Artificial Sequence
  synthetic [barcode part1]
tctctggtgtacgacc

SEQ ID NO: 16379 - DNA, 16 bp, Artificial Sequence
  synthetic [barcode part1]
tgtacagtgccgatac

SEQ ID NO: 16380 - DNA, 16 bp, Artificial Sequence
  synthetic [barcode part1]
acaacactgacactgc

SEQ ID NO: 16381 - DNA, 16 bp, Artificial Sequence
  synthetic [barcode part1]
gtgtcaagattgcgtc

SEQ ID NO: 16382 - DNA, 16 bp, Artificial Sequence
  synthetic [barcode part1]
caaccaaccggttaac

SEQ ID NO: 16383 - DNA, 16 bp, Artificial Sequence
  synthetic [barcode part1]
aactggtccaaggttc

SEQ ID NO: 16384 - DNA, 16 bp, Artificial Sequence
  synthetic [barcode part1]
tggacgtatcgcctct

SEQ ID NO: 16385 - DNA, 16 bp, Artificial Sequence
  synthetic [barcode part1]
taagacagacacgttg

SEQ ID NO: 16386 - DNA, 16 bp, Artificial Sequence
  synthetic [barcode part1]
tgtagtggagtggacc

SEQ ID NO: 16387 - DNA, 16 bp, Artificial Sequence
  synthetic [barcode part1]
cgagaggacgtgttgt

SEQ ID NO: 16388 - DNA, 16 bp, Artificial Sequence
  synthetic [barcode part1]
gtcctctcacgtaacg

SEQ ID NO: 16389 - DNA, 16 bp, Artificial Sequence
  synthetic [barcode part1]
caacgagagtatctag

SEQ ID NO: 16390 - DNA, 16 bp, Artificial Sequence
  synthetic [barcode part1]
gcgtccttagtctggt

SEQ ID NO: 16391 - DNA, 16 bp, Artificial Sequence
  synthetic [barcode part1]
aggccggactgtatag

SEQ ID NO: 16392 - DNA, 16 bp, Artificial Sequence
  synthetic [barcode part1]
cgcggttattattctg

SEQ ID NO: 16393 - DNA, 16 bp, Artificial Sequence
  synthetic [barcode part1]
ttgtgaggacagtaac

SEQ ID NO: 16394 - DNA, 16 bp, Artificial Sequence
  synthetic [barcode part1]
tcaatcgagtcgatcg

SEQ ID NO: 16395 - DNA, 16 bp, Artificial Sequence
  synthetic [barcode part1]
ataccagacgcaactc

SEQ ID NO: 16396 - DNA, 16 bp, Artificial Sequence
  synthetic [barcode part1]
gactctccgcaagttc

SEQ ID NO: 16397 - DNA, 16 bp, Artificial Sequence
  synthetic [barcode part1]
tggacgcaggacaatc

SEQ ID NO: 16398 - DNA, 16 bp, Artificial Sequence
  synthetic [barcode part1]
tgtctcgaggtgatac

SEQ ID NO: 16399 - DNA, 16 bp, Artificial Sequence
  synthetic [barcode part1]
taacagaccacaagtg

SEQ ID NO: 16400 - DNA, 16 bp, Artificial Sequence
  synthetic [barcode part1]
agactgtgtaagagtc

SEQ ID NO: 16401 - DNA, 16 bp, Artificial Sequence
  synthetic [barcode part1]
gtccgtgaacttgtag

SEQ ID NO: 16402 - DNA, 16 bp, Artificial Sequence
  synthetic [barcode part1]
caccggttctcttgag

SEQ ID NO: 16403 - DNA, 16 bp, Artificial Sequence
  synthetic [barcode part1]
acgtacttaggtccag

SEQ ID NO: 16404 - DNA, 16 bp, Artificial Sequence
  synthetic [barcode part1]
aacgactactgtcgac

SEQ ID NO: 16405 - DNA, 16 bp, Artificial Sequence
  synthetic [barcode part1]
cgtaatacctgttcgt

SEQ ID NO: 16406 - DNA, 16 bp, Artificial Sequence
  synthetic [barcode part1]
attataacgtccgcct

SEQ ID NO: 16407 - DNA, 16 bp, Artificial Sequence
  synthetic [barcode part1]
tgacgttgatagacag

SEQ ID NO: 16408 - DNA, 16 bp, Artificial Sequence
  synthetic [barcode part1]
ttccgcactggactac

SEQ ID NO: 16409 - DNA, 16 bp, Artificial Sequence
  synthetic [barcode part1]
ttccaactacggatct

SEQ ID NO: 16410 - DNA, 16 bp, Artificial Sequence
  synthetic [barcode part1]
gacacgcgttatacac

SEQ ID NO: 16411 - DNA, 16 bp, Artificial Sequence
  synthetic [barcode part1]
gcggatagtcttggag

SEQ ID NO: 16412 - DNA, 16 bp, Artificial Sequence
  synthetic [barcode part1]
ttggtccgtgagatac

SEQ ID NO: 16413 - DNA, 16 bp, Artificial Sequence
  synthetic [barcode part1]
tgtcgtagatcgactg

SEQ ID NO: 16414 - DNA, 16 bp, Artificial Sequence
  synthetic [barcode part1]
aagtggagtaggcagt

SEQ ID NO: 16415 - DNA, 16 bp, Artificial Sequence
  synthetic [barcode part1]
gatctcagaataggtg

SEQ ID NO: 16416 - DNA, 16 bp, Artificial Sequence
  synthetic [barcode part1]
ttgcgccagtacaagt

SEQ ID NO: 16417 - DNA, 16 bp, Artificial Sequence
  synthetic [barcode part1]
tcttatcagtgcctag

SEQ ID NO: 16418 - DNA, 16 bp, Artificial Sequence
  synthetic [barcode part1]
ttgcaaggtccagatc

SEQ ID NO: 16419 - DNA, 16 bp, Artificial Sequence
  synthetic [barcode part1]
acaagttgaaggtcgt

SEQ ID NO: 16420 - DNA, 16 bp, Artificial Sequence
  synthetic [barcode part1]
tatctgtctcactcgc

SEQ ID NO: 16421 - DNA, 16 bp, Artificial Sequence
  synthetic [barcode part1]
gaagtattggcgaccg

SEQ ID NO: 16422 - DNA, 16 bp, Artificial Sequence
  synthetic [barcode part1]
gcgtattcgttgacag

SEQ ID NO: 16423 - DNA, 16 bp, Artificial Sequence
  synthetic [barcode part1]
gtcagttaactccgag

SEQ ID NO: 16424 - DNA, 16 bp, Artificial Sequence
  synthetic [barcode part1]
tatcggatctgacgac

SEQ ID NO: 16425 - DNA, 16 bp, Artificial Sequence
  synthetic [barcode part1]
gaccaatctggtcaac

SEQ ID NO: 16426 - DNA, 16 bp, Artificial Sequence
  synthetic [barcode part1]
ccaggacgcgaataac

SEQ ID NO: 16427 - DNA, 16 bp, Artificial Sequence
  synthetic [barcode part1]
agttggtcaacgtcac

SEQ ID NO: 16428 - DNA, 16 bp, Artificial Sequence
  synthetic [barcode part1]
caactaggttgaccac

SEQ ID NO: 16429 - DNA, 16 bp, Artificial Sequence
  synthetic [barcode part1]
agacggactacggtac

SEQ ID NO: 16430 - DNA, 16 bp, Artificial Sequence
  synthetic [barcode part1]
tgcaagtgttcgcaac

SEQ ID NO: 16431 - DNA, 16 bp, Artificial Sequence
  synthetic [barcode part1]
actcgtatacgtcgag

SEQ ID NO: 16432 - DNA, 16 bp, Artificial Sequence
  synthetic [barcode part1]
tacgtgttgacgtcag

SEQ ID NO: 16433 - DNA, 16 bp, Artificial Sequence
  synthetic [barcode part1]
cactgaggacaactct

SEQ ID NO: 16434 - DNA, 16 bp, Artificial Sequence
  synthetic [barcode part1]
acagtctgcagagacg

SEQ ID NO: 16435 - DNA, 16 bp, Artificial Sequence
  synthetic [barcode part1]
ccggttcacaaccgtt

SEQ ID NO: 16436 - DNA, 16 bp, Artificial Sequence
  synthetic [barcode part1]
actgtggtagagtcct

SEQ ID NO: 16437 - DNA, 16 bp, Artificial Sequence
  synthetic [barcode part1]
ttacggatcacacgac

SEQ ID NO: 16438 - DNA, 16 bp, Artificial Sequence
  synthetic [barcode part1]
ttcggtaaggtacaag

SEQ ID NO: 16439 - DNA, 16 bp, Artificial Sequence
  synthetic [barcode part1]
agtaaccgtgtagaac

SEQ ID NO: 16440 - DNA, 16 bp, Artificial Sequence
  synthetic [barcode part1]
tgtaataccacttgcc

SEQ ID NO: 16441 - DNA, 16 bp, Artificial Sequence
  synthetic [barcode part1]
ttccgtgttgataacc

SEQ ID NO: 16442 - DNA, 16 bp, Artificial Sequence
  synthetic [barcode part1]
gagtgttcttatcgtc

SEQ ID NO: 16443 - DNA, 16 bp, Artificial Sequence
  synthetic [barcode part1]
tatctctgcgttcctg

SEQ ID NO: 16444 - DNA, 16 bp, Artificial Sequence
  synthetic [barcode part1]
cgacacctgttcgttg

SEQ ID NO: 16445 - DNA, 16 bp, Artificial Sequence
  synthetic [barcode part1]
acgcggtatactgatc

SEQ ID NO: 16446 - DNA, 16 bp, Artificial Sequence
  synthetic [barcode part1]
atagaggccggactgt

SEQ ID NO: 16447 - DNA, 16 bp, Artificial Sequence
  synthetic [barcode part1]
cgcgatagtcttgagt

SEQ ID NO: 16448 - DNA, 16 bp, Artificial Sequence
  synthetic [barcode part1]
tgcagttgtgcctaag

SEQ ID NO: 16449 - DNA, 16 bp, Artificial Sequence
  synthetic [barcode part1]
tggaactgaccttgac

SEQ ID NO: 16450 - DNA, 16 bp, Artificial Sequence
  synthetic [barcode part1]
tcttaatcggcggagt

SEQ ID NO: 16451 - DNA, 16 bp, Artificial Sequence
  synthetic [barcode part1]
gaaggcactacacttc

SEQ ID NO: 16452 - DNA, 16 bp, Artificial Sequence
  synthetic [barcode part1]
agtcagtgttgcaacc

SEQ ID NO: 16453 - DNA, 16 bp, Artificial Sequence
  synthetic [barcode part1]
aatctggattgtcggc

SEQ ID NO: 16454 - DNA, 16 bp, Artificial Sequence
  synthetic [barcode part1]
caccagaagtgcaggt

SEQ ID NO: 16455 - DNA, 16 bp, Artificial Sequence
  synthetic [barcode part1]
cacctgtggtgttacc

SEQ ID NO: 16456 - DNA, 16 bp, Artificial Sequence
  synthetic [barcode part1]
actcgcctcacttact

SEQ ID NO: 16457 - DNA, 16 bp, Artificial Sequence
  synthetic [barcode part1]
accaggacacgtagtg

SEQ ID NO: 16458 - DNA, 16 bp, Artificial Sequence
  synthetic [barcode part1]
gtcctgtacaaggtac

SEQ ID NO: 16459 - DNA, 16 bp, Artificial Sequence
  synthetic [barcode part1]
cgagaggtgtgcaact

SEQ ID NO: 16460 - DNA, 16 bp, Artificial Sequence
  synthetic [barcode part1]
cgtaatataggcaggt

SEQ ID NO: 16461 - DNA, 16 bp, Artificial Sequence
  synthetic [barcode part1]
gttagtgccacacaac

SEQ ID NO: 16462 - DNA, 16 bp, Artificial Sequence
  synthetic [barcode part1]
tgttgtcgcagttact

SEQ ID NO: 16463 - DNA, 16 bp, Artificial Sequence
  synthetic [barcode part1]
tccgttaatacgacct

SEQ ID NO: 16464 - DNA, 16 bp, Artificial Sequence
  synthetic [barcode part1]
ttaccacggatctgtt

SEQ ID NO: 16465 - DNA, 16 bp, Artificial Sequence
  synthetic [barcode part1]
ataaggacgcaccttc

SEQ ID NO: 16466 - DNA, 16 bp, Artificial Sequence
  synthetic [barcode part1]
agtcaacgtactgtgc

SEQ ID NO: 16467 - DNA, 16 bp, Artificial Sequence
  synthetic [barcode part1]
tgccaggaacacgaac

SEQ ID NO: 16468 - DNA, 16 bp, Artificial Sequence
  synthetic [barcode part1]
tgagtgcgtcgtcctt

SEQ ID NO: 16469 - DNA, 16 bp, Artificial Sequence
  synthetic [barcode part1]
gatcgacagttccagt

SEQ ID NO: 16470 - DNA, 16 bp, Artificial Sequence
  synthetic [barcode part1]
tacaacacgaggcctt

SEQ ID NO: 16471 - DNA, 16 bp, Artificial Sequence
  synthetic [barcode part1]
cagtatcttactcgtg

SEQ ID NO: 16472 - DNA, 16 bp, Artificial Sequence
  synthetic [barcode part1]
actacacaacctgcag

SEQ ID NO: 16473 - DNA, 16 bp, Artificial Sequence
  synthetic [barcode part1]
gcctcttaagatcgag

SEQ ID NO: 16474 - DNA, 16 bp, Artificial Sequence
  synthetic [barcode part1]
gcctcgattggttaag

SEQ ID NO: 16475 - DNA, 16 bp, Artificial Sequence
  synthetic [barcode part1]
gtcgattgaagtcctg

SEQ ID NO: 16476 - DNA, 16 bp, Artificial Sequence
  synthetic [barcode part1]
accaatccttcaggag

SEQ ID NO: 16477 - DNA, 16 bp, Artificial Sequence
  synthetic [barcode part1]
gactacttgagtcacg

SEQ ID NO: 16478 - DNA, 16 bp, Artificial Sequence
  synthetic [barcode part1]
acttcgcgtgagatac

SEQ ID NO: 16479 - DNA, 16 bp, Artificial Sequence
  synthetic [barcode part1]
agagaacgcctggact

SEQ ID NO: 16480 - DNA, 16 bp, Artificial Sequence
  synthetic [barcode part1]
caagaccgtcgtgatt

SEQ ID NO: 16481 - DNA, 16 bp, Artificial Sequence
  synthetic [barcode part1]
tgtgtgatatcctgtc

SEQ ID NO: 16482 - DNA, 16 bp, Artificial Sequence
  synthetic [barcode part1]
accttactactggtgt

SEQ ID NO: 16483 - DNA, 16 bp, Artificial Sequence
  synthetic [barcode part1]
gttcctatcacgtcct

SEQ ID NO: 16484 - DNA, 16 bp, Artificial Sequence
  synthetic [barcode part1]
gtcacaactgtggtac

SEQ ID NO: 16485 - DNA, 16 bp, Artificial Sequence
  synthetic [barcode part1]
gcacgaagagttaccg

SEQ ID NO: 16486 - DNA, 16 bp, Artificial Sequence
  synthetic [barcode part1]
tcttggcaactcgtgc

SEQ ID NO: 16487 - DNA, 16 bp, Artificial Sequence
  synthetic [barcode part1]
ttggcgcggttaagag

SEQ ID NO: 16488 - DNA, 16 bp, Artificial Sequence
  synthetic [barcode part1]
gatctgtcgttacttg

SEQ ID NO: 16489 - DNA, 16 bp, Artificial Sequence
  synthetic [barcode part1]
cacctaaccagtacag

SEQ ID NO: 16490 - DNA, 16 bp, Artificial Sequence
  synthetic [barcode part1]
atctccggtaggaatc

SEQ ID NO: 16491 - DNA, 16 bp, Artificial Sequence
  synthetic [barcode part1]
ttacttactgcgacgt

SEQ ID NO: 16492 - DNA, 16 bp, Artificial Sequence
  synthetic [barcode part1]
agaggcggagttacct

SEQ ID NO: 16493 - DNA, 16 bp, Artificial Sequence
  synthetic [barcode part1]
gatccaagtcaagtcc

SEQ ID NO: 16494 - DNA, 16 bp, Artificial Sequence
  synthetic [barcode part1]
aggtcacctcacacct

SEQ ID NO: 16495 - DNA, 16 bp, Artificial Sequence
  synthetic [barcode part1]
caatattggacgaacg

SEQ ID NO: 16496 - DNA, 16 bp, Artificial Sequence
  synthetic [barcode part1]
tcacagttggtcaacg

SEQ ID NO: 16497 - DNA, 16 bp, Artificial Sequence
  synthetic [barcode part1]
cgaacacagtcacact

SEQ ID NO: 16498 - DNA, 16 bp, Artificial Sequence
  synthetic [barcode part1]
acctcgccttaactct

SEQ ID NO: 16499 - DNA, 16 bp, Artificial Sequence
  synthetic [barcode part1]
agacttgtccacgaac

SEQ ID NO: 16500 - DNA, 16 bp, Artificial Sequence
  synthetic [barcode part1]
gtgagaagactgccgt

SEQ ID NO: 16501 - DNA, 16 bp, Artificial Sequence
  synthetic [barcode part1]
tcgaagtcctagagtc

SEQ ID NO: 16502 - DNA, 16 bp, Artificial Sequence
  synthetic [barcode part1]
tgcactcacggttcac

SEQ ID NO: 16503 - DNA, 16 bp, Artificial Sequence
  synthetic [barcode part1]
ttgactcaacacacct

SEQ ID NO: 16504 - DNA, 16 bp, Artificial Sequence
  synthetic [barcode part1]
tccagaacagttgacc

SEQ ID NO: 16505 - DNA, 16 bp, Artificial Sequence
  synthetic [barcode part1]
agactcgttcacgagt

SEQ ID NO: 16506 - DNA, 16 bp, Artificial Sequence
  synthetic [barcode part1]
gcacacacaacgttgt

SEQ ID NO: 16507 - DNA, 16 bp, Artificial Sequence
  synthetic [barcode part1]
caaccttccagtcctt

SEQ ID NO: 16508 - DNA, 16 bp, Artificial Sequence
  synthetic [barcode part1]
cctatcgacacttggc

SEQ ID NO: 16509 - DNA, 16 bp, Artificial Sequence
  synthetic [barcode part1]
tcggttatcctgagag

SEQ ID NO: 16510 - DNA, 16 bp, Artificial Sequence
  synthetic [barcode part1]
tcggtcgtagttagtg

SEQ ID NO: 16511 - DNA, 16 bp, Artificial Sequence
  synthetic [barcode part1]
agtaccggaagttcct

SEQ ID NO: 16512 - DNA, 16 bp, Artificial Sequence
  synthetic [barcode part1]
cacacagagacacctt

SEQ ID NO: 16513 - DNA, 16 bp, Artificial Sequence
  synthetic [barcode part1]
caacacgcgactctct

SEQ ID NO: 16514 - DNA, 16 bp, Artificial Sequence
  synthetic [barcode part1]
gaactacgcagttcac

SEQ ID NO: 16515 - DNA, 16 bp, Artificial Sequence
  synthetic [barcode part1]
tcagtagacgaaggcc

SEQ ID NO: 16516 - DNA, 16 bp, Artificial Sequence
  synthetic [barcode part1]
gtgatctcacctccag

SEQ ID NO: 16517 - DNA, 16 bp, Artificial Sequence
  synthetic [barcode part1]
tggtctactcgtaccg

SEQ ID NO: 16518 - DNA, 16 bp, Artificial Sequence
  synthetic [barcode part1]
tctaccgtgtaagttc

SEQ ID NO: 16519 - DNA, 16 bp, Artificial Sequence
  synthetic [barcode part1]
cacaatcctctgttag

SEQ ID NO: 16520 - DNA, 16 bp, Artificial Sequence
  synthetic [barcode part1]
attgtgcgcgtagttg

SEQ ID NO: 16521 - DNA, 16 bp, Artificial Sequence
  synthetic [barcode part1]
gagtatcagacggtgc

SEQ ID NO: 16522 - DNA, 16 bp, Artificial Sequence
  synthetic [barcode part1]
ttcaccggtgcagttc

SEQ ID NO: 16523 - DNA, 16 bp, Artificial Sequence
  synthetic [barcode part1]
cgcagatactcacagt

SEQ ID NO: 16524 - DNA, 16 bp, Artificial Sequence
  synthetic [barcode part1]
tctggatatctctcag

SEQ ID NO: 16525 - DNA, 16 bp, Artificial Sequence
  synthetic [barcode part1]
tcacaagacgaagtac

SEQ ID NO: 16526 - DNA, 16 bp, Artificial Sequence
  synthetic [barcode part1]
tggatcttcgcctcag

SEQ ID NO: 16527 - DNA, 16 bp, Artificial Sequence
  synthetic [barcode part1]
actaggtgagtgcgac

SEQ ID NO: 16528 - DNA, 16 bp, Artificial Sequence
  synthetic [barcode part1]
ttactaacacgccttg

SEQ ID NO: 16529 - DNA, 16 bp, Artificial Sequence
  synthetic [barcode part1]
aacggactaagatctg

SEQ ID NO: 16530 - DNA, 16 bp, Artificial Sequence
  synthetic [barcode part1]
atacgcgtcgagactt

SEQ ID NO: 16531 - DNA, 16 bp, Artificial Sequence
  synthetic [barcode part1]
gcctcgtaagttaggt

SEQ ID NO: 16532 - DNA, 16 bp, Artificial Sequence
  synthetic [barcode part1]
ccgtcaccttgaacgt

SEQ ID NO: 16533 - DNA, 16 bp, Artificial Sequence
  synthetic [barcode part1]
tggcgtacctcactgt

SEQ ID NO: 16534 - DNA, 16 bp, Artificial Sequence
  synthetic [barcode part1]
taatctcaccgtacac

SEQ ID NO: 16535 - DNA, 16 bp, Artificial Sequence
  synthetic [barcode part1]
ccagacagagtggtgt

SEQ ID NO: 16536 - DNA, 16 bp, Artificial Sequence
  synthetic [barcode part1]
acaagatcgaggtgag

SEQ ID NO: 16537 - DNA, 16 bp, Artificial Sequence
  synthetic [barcode part1]
gcgtaccacaaggtag

SEQ ID NO: 16538 - DNA, 16 bp, Artificial Sequence
  synthetic [barcode part1]
cactgattagtacgcg

SEQ ID NO: 16539 - DNA, 16 bp, Artificial Sequence
  synthetic [barcode part1]
ttcggtcgtatatcac

SEQ ID NO: 16540 - DNA, 16 bp, Artificial Sequence
  synthetic [barcode part1]
ttgaatactgcggacc

SEQ ID NO: 16541 - DNA, 16 bp, Artificial Sequence
  synthetic [barcode part1]
ttgtgtcgcgaagact

SEQ ID NO: 16542 - DNA, 16 bp, Artificial Sequence
  synthetic [barcode part1]
ttggcctattcaggcc

SEQ ID NO: 16543 - DNA, 16 bp, Artificial Sequence
  synthetic [barcode part1]
acctgatctctgtgcg

SEQ ID NO: 16544 - DNA, 16 bp, Artificial Sequence
  synthetic [barcode part1]
gttgttccactgtcct

SEQ ID NO: 16545 - DNA, 16 bp, Artificial Sequence
  synthetic [barcode part1]
gtagacctcctgtcgt

SEQ ID NO: 16546 - DNA, 16 bp, Artificial Sequence
  synthetic [barcode part1]
aacgagatcggcgtgt

SEQ ID NO: 16547 - DNA, 16 bp, Artificial Sequence
  synthetic [barcode part1]
gcgttccttgaattgt

SEQ ID NO: 16548 - DNA, 16 bp, Artificial Sequence
  synthetic [barcode part1]
ttcgatctgcacgatt

SEQ ID NO: 16549 - DNA, 16 bp, Artificial Sequence
  synthetic [barcode part1]
tgttcacgtggtgcct

SEQ ID NO: 16550 - DNA, 16 bp, Artificial Sequence
  synthetic [barcode part1]
caggcgttagtaaggc

SEQ ID NO: 16551 - DNA, 16 bp, Artificial Sequence
  synthetic [barcode part1]
gtgcgcaactaactac

SEQ ID NO: 16552 - DNA, 16 bp, Artificial Sequence
  synthetic [barcode part1]
gtacctaggacttgtg

SEQ ID NO: 16553 - DNA, 16 bp, Artificial Sequence
  synthetic [barcode part1]
tcgtctggatagacac

SEQ ID NO: 16554 - DNA, 16 bp, Artificial Sequence
  synthetic [barcode part1]
taccgcgtcttaagag

SEQ ID NO: 16555 - DNA, 16 bp, Artificial Sequence
  synthetic [barcode part1]
actacacttggcgtag

SEQ ID NO: 16556 - DNA, 16 bp, Artificial Sequence
  synthetic [barcode part1]
gtgattgccagtcctc

SEQ ID NO: 16557 - DNA, 16 bp, Artificial Sequence
  synthetic [barcode part1]
gatcacacgattgcac

SEQ ID NO: 16558 - DNA, 16 bp, Artificial Sequence
  synthetic [barcode part1]
tacactccgccagact

SEQ ID NO: 16559 - DNA, 16 bp, Artificial Sequence
  synthetic [barcode part1]
gaactcgcagaagatt

SEQ ID NO: 16560 - DNA, 16 bp, Artificial Sequence
  synthetic [barcode part1]
tctccgtgtagtccag

SEQ ID NO: 16561 - DNA, 16 bp, Artificial Sequence
  synthetic [barcode part1]
aacctgagaggtgcac

SEQ ID NO: 16562 - DNA, 16 bp, Artificial Sequence
  synthetic [barcode part1]
aaggcggaggtctgtt

SEQ ID NO: 16563 - DNA, 16 bp, Artificial Sequence
  synthetic [barcode part1]
cagtaatagaacgcgt

SEQ ID NO: 16564 - DNA, 16 bp, Artificial Sequence
  synthetic [barcode part1]
acactgaagaagtcac

SEQ ID NO: 16565 - DNA, 16 bp, Artificial Sequence
  synthetic [barcode part1]
tatccgcgcgatactc

SEQ ID NO: 16566 - DNA, 16 bp, Artificial Sequence
  synthetic [barcode part1]
cgcagaagtgtagaag

SEQ ID NO: 16567 - DNA, 16 bp, Artificial Sequence
  synthetic [barcode part1]
gaattcgtctgatctc

SEQ ID NO: 16568 - DNA, 16 bp, Artificial Sequence
  synthetic [barcode part1]
gactcaggactactgt

SEQ ID NO: 16569 - DNA, 16 bp, Artificial Sequence
  synthetic [barcode part1]
tccagttgaaggacct

SEQ ID NO: 16570 - DNA, 16 bp, Artificial Sequence
  synthetic [barcode part1]
cgtatcaattggcgtg

SEQ ID NO: 16571 - DNA, 16 bp, Artificial Sequence
  synthetic [barcode part1]
aacgcgtgacctctct

SEQ ID NO: 16572 - DNA, 16 bp, Artificial Sequence
  synthetic [barcode part1]
aggcgtactcctatag

SEQ ID NO: 16573 - DNA, 16 bp, Artificial Sequence
  synthetic [barcode part1]
taactgcgccttccag

SEQ ID NO: 16574 - DNA, 16 bp, Artificial Sequence
  synthetic [barcode part1]
aggagactgagaagtc

SEQ ID NO: 16575 - DNA, 16 bp, Artificial Sequence
  synthetic [barcode part1]
ttccgcgacacttctt

SEQ ID NO: 16576 - DNA, 16 bp, Artificial Sequence
  synthetic [barcode part1]
gccacaattcgtccgt

SEQ ID NO: 16577 - DNA, 16 bp, Artificial Sequence
  synthetic [barcode part1]
cgcgaactactgtctc

SEQ ID NO: 16578 - DNA, 16 bp, Artificial Sequence
  synthetic [barcode part1]
tagatcacgacctggt

SEQ ID NO: 16579 - DNA, 16 bp, Artificial Sequence
  synthetic [barcode part1]
gaggtggttcgaacgt

SEQ ID NO: 16580 - DNA, 16 bp, Artificial Sequence
  synthetic [barcode part1]
ataaggtcgtcgttcg

SEQ ID NO: 16581 - DNA, 16 bp, Artificial Sequence
  synthetic [barcode part1]
ccgccgtctataagtc

SEQ ID NO: 16582 - DNA, 16 bp, Artificial Sequence
  synthetic [barcode part1]
gagactcgcagtactt

SEQ ID NO: 16583 - DNA, 16 bp, Artificial Sequence
  synthetic [barcode part1]
cactcacctcagaacc

SEQ ID NO: 16584 - DNA, 16 bp, Artificial Sequence
  synthetic [barcode part1]
tctggaacttctcctc

SEQ ID NO: 16585 - DNA, 16 bp, Artificial Sequence
  synthetic [barcode part1]
cggtacgtaataagac

SEQ ID NO: 16586 - DNA, 16 bp, Artificial Sequence
  synthetic [barcode part1]
gtacgagtattagacg

SEQ ID NO: 16587 - DNA, 16 bp, Artificial Sequence
  synthetic [barcode part1]
tgttacgaagactccg

SEQ ID NO: 16588 - DNA, 16 bp, Artificial Sequence
  synthetic [barcode part1]
cacagtgacttactct

SEQ ID NO: 16589 - DNA, 16 bp, Artificial Sequence
  synthetic [barcode part1]
tgtagacggtaagatc

SEQ ID NO: 16590 - DNA, 16 bp, Artificial Sequence
  synthetic [barcode part1]
accttgcctgttgttc

SEQ ID NO: 16591 - DNA, 16 bp, Artificial Sequence
  synthetic [barcode part1]
tggtgacaaccactgt

SEQ ID NO: 16592 - DNA, 16 bp, Artificial Sequence
  synthetic [barcode part1]
gtattcgccgccttag

SEQ ID NO: 16593 - DNA, 16 bp, Artificial Sequence
  synthetic [barcode part1]
gaatctcttgaccgag

SEQ ID NO: 16594 - DNA, 16 bp, Artificial Sequence
  synthetic [barcode part1]
cgccgttatccaggtt

SEQ ID NO: 16595 - DNA, 16 bp, Artificial Sequence
  synthetic [barcode part1]
tgttatagtcacggcg

SEQ ID NO: 16596 - DNA, 16 bp, Artificial Sequence
  synthetic [barcode part1]
agtgttaggtctcggt

SEQ ID NO: 16597 - DNA, 16 bp, Artificial Sequence
  synthetic [barcode part1]
gtaactgtggtcgtac

SEQ ID NO: 16598 - DNA, 16 bp, Artificial Sequence
  synthetic [barcode part1]
gcaaggacggtctaac

SEQ ID NO: 16599 - DNA, 16 bp, Artificial Sequence
  synthetic [barcode part1]
acttgttccacggcac

SEQ ID NO: 16600 - DNA, 16 bp, Artificial Sequence
  synthetic [barcode part1]
agactaactggttccg

SEQ ID NO: 16601 - DNA, 16 bp, Artificial Sequence
  synthetic [barcode part1]
tcaatctctcgcaggc

SEQ ID NO: 16602 - DNA, 16 bp, Artificial Sequence
  synthetic [barcode part1]
cgtagtgccactcact

SEQ ID NO: 16603 - DNA, 16 bp, Artificial Sequence
  synthetic [barcode part1]
cgactgaagtcgatct

SEQ ID NO: 16604 - DNA, 16 bp, Artificial Sequence
  synthetic [barcode part1]
actacacgtgtggttg

SEQ ID NO: 16605 - DNA, 16 bp, Artificial Sequence
  synthetic [barcode part1]
aatcgaatccgatccg

SEQ ID NO: 16606 - DNA, 16 bp, Artificial Sequence
  synthetic [barcode part1]
acgcaataggatcaac

SEQ ID NO: 16607 - DNA, 16 bp, Artificial Sequence
  synthetic [barcode part1]
gattcctgaaggtcgt

SEQ ID NO: 16608 - DNA, 16 bp, Artificial Sequence
  synthetic [barcode part1]
actcctctaatcacag

SEQ ID NO: 16609 - DNA, 16 bp, Artificial Sequence
  synthetic [barcode part1]
ccgtgttctatcaggc

SEQ ID NO: 16610 - DNA, 16 bp, Artificial Sequence
  synthetic [barcode part1]
attacgcactatctcg

SEQ ID NO: 16611 - DNA, 16 bp, Artificial Sequence
  synthetic [barcode part1]
cagtggttcagatcgt

SEQ ID NO: 16612 - DNA, 16 bp, Artificial Sequence
  synthetic [barcode part1]
aactccaacaacaccg

SEQ ID NO: 16613 - DNA, 16 bp, Artificial Sequence
  synthetic [barcode part1]
actgtagaggttctgc

SEQ ID NO: 16614 - DNA, 16 bp, Artificial Sequence
  synthetic [barcode part1]
actgtagtgttacggc

SEQ ID NO: 16615 - DNA, 16 bp, Artificial Sequence
  synthetic [barcode part1]
tctgacttacgtggtt

SEQ ID NO: 16616 - DNA, 16 bp, Artificial Sequence
  synthetic [barcode part1]
agtaccttaaggagtg

SEQ ID NO: 16617 - DNA, 16 bp, Artificial Sequence
  synthetic [barcode part1]
gacaacttcaagtcgc

SEQ ID NO: 16618 - DNA, 16 bp, Artificial Sequence
  synthetic [barcode part1]
gcgatatactgtgacc

SEQ ID NO: 16619 - DNA, 16 bp, Artificial Sequence
  synthetic [barcode part1]
tggcagaaggtctgtg

SEQ ID NO: 16620 - DNA, 16 bp, Artificial Sequence
  synthetic [barcode part1]
tctatcttggacggag

SEQ ID NO: 16621 - DNA, 16 bp, Artificial Sequence
  synthetic [barcode part1]
cacttgaagttacgcg

SEQ ID NO: 16622 - DNA, 16 bp, Artificial Sequence
  synthetic [barcode part1]
accacagatctcaggt

SEQ ID NO: 16623 - DNA, 16 bp, Artificial Sequence
  synthetic [barcode part1]
acgtgtatagtcggtc

SEQ ID NO: 16624 - DNA, 16 bp, Artificial Sequence
  synthetic [barcode part1]
gcaatcagtcgtgtac

SEQ ID NO: 16625 - DNA, 16 bp, Artificial Sequence
  synthetic [barcode part1]
tcgagacagacagatt

SEQ ID NO: 16626 - DNA, 16 bp, Artificial Sequence
  synthetic [barcode part1]
ttacacctgagtcgtt

SEQ ID NO: 16627 - DNA, 16 bp, Artificial Sequence
  synthetic [barcode part1]
ccacaatctcttctcg

SEQ ID NO: 16628 - DNA, 16 bp, Artificial Sequence
  synthetic [barcode part1]
tacacactcgagatcg

SEQ ID NO: 16629 - DNA, 16 bp, Artificial Sequence
  synthetic [barcode part1]
ccgaagtcgttcacct

SEQ ID NO: 16630 - DNA, 16 bp, Artificial Sequence
  synthetic [barcode part1]
acggcggattcaagtg

SEQ ID NO: 16631 - DNA, 16 bp, Artificial Sequence
  synthetic [barcode part1]
accgtatccgaatacg

SEQ ID NO: 16632 - DNA, 16 bp, Artificial Sequence
  synthetic [barcode part1]
tcgtgtatcaattccg

SEQ ID NO: 16633 - DNA, 16 bp, Artificial Sequence
  synthetic [barcode part1]
cacggcgatctacctt

SEQ ID NO: 16634 - DNA, 16 bp, Artificial Sequence
  synthetic [barcode part1]
tgaatcgaaccgtcac

SEQ ID NO: 16635 - DNA, 16 bp, Artificial Sequence
  synthetic [barcode part1]
aggttctcctcagaag

SEQ ID NO: 16636 - DNA, 16 bp, Artificial Sequence
  synthetic [barcode part1]
tgttgactggtacacg

SEQ ID NO: 16637 - DNA, 16 bp, Artificial Sequence
  synthetic [barcode part1]
ataacagacgactacg

SEQ ID NO: 16638 - DNA, 16 bp, Artificial Sequence
  synthetic [barcode part1]
aagtagtgaccacgcg

SEQ ID NO: 16639 - DNA, 16 bp, Artificial Sequence
  synthetic [barcode part1]
gcctcttctagtcttg

SEQ ID NO: 16640 - DNA, 16 bp, Artificial Sequence
  synthetic [barcode part1]
ttatagaacggaacgc

SEQ ID NO: 16641 - DNA, 16 bp, Artificial Sequence
  synthetic [barcode part1]
tctctgaggagagtct

SEQ ID NO: 16642 - DNA, 16 bp, Artificial Sequence
  synthetic [barcode part1]
attcttcactagtgcg

SEQ ID NO: 16643 - DNA, 16 bp, Artificial Sequence
  synthetic [barcode part1]
taatcctatcacacgc

SEQ ID NO: 16644 - DNA, 16 bp, Artificial Sequence
  synthetic [barcode part1]
aattgcgttcctcaac

SEQ ID NO: 16645 - DNA, 16 bp, Artificial Sequence
  synthetic [barcode part1]
tctggaatacagtgcc

SEQ ID NO: 16646 - DNA, 16 bp, Artificial Sequence
  synthetic [barcode part1]
tcgaggattgacgcag

SEQ ID NO: 16647 - DNA, 16 bp, Artificial Sequence
  synthetic [barcode part1]
tacacgtcagttggtg

SEQ ID NO: 16648 - DNA, 16 bp, Artificial Sequence
  synthetic [barcode part1]
cgttgccgaacacctt

SEQ ID NO: 16649 - DNA, 16 bp, Artificial Sequence
  synthetic [barcode part1]
tgaatcctagacaccg

SEQ ID NO: 16650 - DNA, 16 bp, Artificial Sequence
  synthetic [barcode part1]
gtcctcagtaatccgc

SEQ ID NO: 16651 - DNA, 16 bp, Artificial Sequence
  synthetic [barcode part1]
atctgagtgagacggc

SEQ ID NO: 16652 - DNA, 16 bp, Artificial Sequence
  synthetic [barcode part1]
acgcaagtggatcacg

SEQ ID NO: 16653 - DNA, 16 bp, Artificial Sequence
  synthetic [barcode part1]
tgcctctaatctaacg

SEQ ID NO: 16654 - DNA, 16 bp, Artificial Sequence
  synthetic [barcode part1]
aatacttccgtgcgag

SEQ ID NO: 16655 - DNA, 16 bp, Artificial Sequence
  synthetic [barcode part1]
agagaacagtgtgtct

SEQ ID NO: 16656 - DNA, 16 bp, Artificial Sequence
  synthetic [barcode part1]
tgactgtctgttatcg

SEQ ID NO: 16657 - DNA, 16 bp, Artificial Sequence
  synthetic [barcode part1]
aacttctggaggttgc

SEQ ID NO: 16658 - DNA, 16 bp, Artificial Sequence
  synthetic [barcode part1]
gaaccgaactagtgcg

SEQ ID NO: 16659 - DNA, 16 bp, Artificial Sequence
  synthetic [barcode part1]
ttattccgagacggtg

SEQ ID NO: 16660 - DNA, 16 bp, Artificial Sequence
  synthetic [barcode part1]
attcgagttcgttacc

SEQ ID NO: 16661 - DNA, 16 bp, Artificial Sequence
  synthetic [barcode part1]
tccagttgcgtcaatt

SEQ ID NO: 16662 - DNA, 16 bp, Artificial Sequence
  synthetic [barcode part1]
ccggcagataggaact

SEQ ID NO: 16663 - DNA, 16 bp, Artificial Sequence
  synthetic [barcode part1]
ttatccaagtaccacc

SEQ ID NO: 16664 - DNA, 16 bp, Artificial Sequence
  synthetic [barcode part1]
aacacacgatctcttc

SEQ ID NO: 16665 - DNA, 16 bp, Artificial Sequence
  synthetic [barcode part1]
gcgaaggttccgtatt

SEQ ID NO: 16666 - DNA, 16 bp, Artificial Sequence
  synthetic [barcode part1]
tggtgccggtaagtag

SEQ ID NO: 16667 - DNA, 16 bp, Artificial Sequence
  synthetic [barcode part1]
tcaggcgagtgagatc

SEQ ID NO: 16668 - DNA, 16 bp, Artificial Sequence
  synthetic [barcode part1]
tgttgtgcagtgtcag

SEQ ID NO: 16669 - DNA, 16 bp, Artificial Sequence
  synthetic [barcode part1]
ccaattcttcacgagt

SEQ ID NO: 16670 - DNA, 16 bp, Artificial Sequence
  synthetic [barcode part1]
tgaatcgtcttgtacc

SEQ ID NO: 16671 - DNA, 16 bp, Artificial Sequence
  synthetic [barcode part1]
gaacttctagttggcg

SEQ ID NO: 16672 - DNA, 16 bp, Artificial Sequence
  synthetic [barcode part1]
tattctcggtcgccag

SEQ ID NO: 16673 - DNA, 16 bp, Artificial Sequence
  synthetic [barcode part1]
cgtacaactcaacttc

SEQ ID NO: 16674 - DNA, 16 bp, Artificial Sequence
  synthetic [barcode part1]
cggagttctctgaagt

SEQ ID NO: 16675 - DNA, 16 bp, Artificial Sequence
  synthetic [barcode part1]
gaacgacctaagtgcg

SEQ ID NO: 16676 - DNA, 16 bp, Artificial Sequence
  synthetic [barcode part1]
tgtgtcagtgtaccag

SEQ ID NO: 16677 - DNA, 16 bp, Artificial Sequence
  synthetic [barcode part1]
agatctaggatcaggt

SEQ ID NO: 16678 - DNA, 16 bp, Artificial Sequence
  synthetic [barcode part1]
agtgttccgaggaacg

SEQ ID NO: 16679 - DNA, 16 bp, Artificial Sequence
  synthetic [barcode part1]
tgactgttattctgcg

SEQ ID NO: 16680 - DNA, 16 bp, Artificial Sequence
  synthetic [barcode part1]
ttgcacttctggtagt

SEQ ID NO: 16681 - DNA, 16 bp, Artificial Sequence
  synthetic [barcode part1]
aagttagtctcggtcg

SEQ ID NO: 16682 - DNA, 16 bp, Artificial Sequence
  synthetic [barcode part1]
tacgacaacgaacggc

SEQ ID NO: 16683 - DNA, 16 bp, Artificial Sequence
  synthetic [barcode part1]
gtactcttcctgcgtt

SEQ ID NO: 16684 - DNA, 16 bp, Artificial Sequence
  synthetic [barcode part1]
aggagatcctagtcct

SEQ ID NO: 16685 - DNA, 16 bp, Artificial Sequence
  synthetic [barcode part1]
gccaagtacggagact

SEQ ID NO: 16686 - DNA, 16 bp, Artificial Sequence
  synthetic [barcode part1]
gtgtgtaaggaccttc

SEQ ID NO: 16687 - DNA, 16 bp, Artificial Sequence
  synthetic [barcode part1]
gtccaggaccttactc

SEQ ID NO: 16688 - DNA, 16 bp, Artificial Sequence
  synthetic [barcode part1]
cctggttctagagaac

SEQ ID NO: 16689 - DNA, 16 bp, Artificial Sequence
  synthetic [barcode part1]
acgcggtgaagttgac

SEQ ID NO: 16690 - DNA, 16 bp, Artificial Sequence
  synthetic [barcode part1]
caattcgtcacgcctg

SEQ ID NO: 16691 - DNA, 16 bp, Artificial Sequence
  synthetic [barcode part1]
tagagtacacttcgcg

SEQ ID NO: 16692 - DNA, 16 bp, Artificial Sequence
  synthetic [barcode part1]
cgagtgcaggaattgc

SEQ ID NO: 16693 - DNA, 16 bp, Artificial Sequence
  synthetic [barcode part1]
agtgattcacgttcct

SEQ ID NO: 16694 - DNA, 16 bp, Artificial Sequence
  synthetic [barcode part1]
gatcacggaagtcggt

SEQ ID NO: 16695 - DNA, 16 bp, Artificial Sequence
  synthetic [barcode part1]
atccgagtgtcgtcct

SEQ ID NO: 16696 - DNA, 16 bp, Artificial Sequence
  synthetic [barcode part1]
ccagttcacctcttac

SEQ ID NO: 16697 - DNA, 16 bp, Artificial Sequence
  synthetic [barcode part1]
gcagattattgaaggc

SEQ ID NO: 16698 - DNA, 16 bp, Artificial Sequence
  synthetic [barcode part1]
gtctctcagttaggag

SEQ ID NO: 16699 - DNA, 16 bp, Artificial Sequence
  synthetic [barcode part1]
cacgcaatcgccactt

SEQ ID NO: 16700 - DNA, 16 bp, Artificial Sequence
  synthetic [barcode part1]
ccggtaacctacacct

SEQ ID NO: 16701 - DNA, 16 bp, Artificial Sequence
  synthetic [barcode part1]
actcagagtgagtctc

SEQ ID NO: 16702 - DNA, 16 bp, Artificial Sequence
  synthetic [barcode part1]
actatagatccgcctt

SEQ ID NO: 16703 - DNA, 16 bp, Artificial Sequence
  synthetic [barcode part1]
gttcaactgacgactg

SEQ ID NO: 16704 - DNA, 16 bp, Artificial Sequence
  synthetic [barcode part1]
gtggagataacggtcc

SEQ ID NO: 16705 - DNA, 16 bp, Artificial Sequence
  synthetic [barcode part1]
cactctggatatccgc

SEQ ID NO: 16706 - DNA, 16 bp, Artificial Sequence
  synthetic [barcode part1]
ccttagttggcaaggt

SEQ ID NO: 16707 - DNA, 16 bp, Artificial Sequence
  synthetic [barcode part1]
agttggttatacgcgc

SEQ ID NO: 16708 - DNA, 16 bp, Artificial Sequence
  synthetic [barcode part1]
gcctccaactcttgtt

SEQ ID NO: 16709 - DNA, 16 bp, Artificial Sequence
  synthetic [barcode part1]
actaggttgagaacac

SEQ ID NO: 16710 - DNA, 16 bp, Artificial Sequence
  synthetic [barcode part1]
caggattgccaactac

SEQ ID NO: 16711 - DNA, 16 bp, Artificial Sequence
  synthetic [barcode part1]
cagttgaccgaagttc

SEQ ID NO: 16712 - DNA, 16 bp, Artificial Sequence
  synthetic [barcode part1]
ccagttcacggaatac

SEQ ID NO: 16713 - DNA, 16 bp, Artificial Sequence
  synthetic [barcode part1]
gttcctctcagttctg

SEQ ID NO: 16714 - DNA, 16 bp, Artificial Sequence
  synthetic [barcode part1]
tgttgcaaccacagtg

SEQ ID NO: 16715 - DNA, 16 bp, Artificial Sequence
  synthetic [barcode part1]
ttgacacttggtcttg

SEQ ID NO: 16716 - DNA, 16 bp, Artificial Sequence
  synthetic [barcode part1]
tccgtgtattactgac

SEQ ID NO: 16717 - DNA, 16 bp, Artificial Sequence
  synthetic [barcode part1]
cgacaatacgcaaggc

SEQ ID NO: 16718 - DNA, 16 bp, Artificial Sequence
  synthetic [barcode part1]
gttgttcgtaagtcct

SEQ ID NO: 16719 - DNA, 16 bp, Artificial Sequence
  synthetic [barcode part1]
tcacacagtactggtg

SEQ ID NO: 16720 - DNA, 16 bp, Artificial Sequence
  synthetic [barcode part1]
tgatcagttggttggc

SEQ ID NO: 16721 - DNA, 16 bp, Artificial Sequence
  synthetic [barcode part1]
tggcgtaacgtgatct

SEQ ID NO: 16722 - DNA, 16 bp, Artificial Sequence
  synthetic [barcode part1]
agaccacggtaatcct

SEQ ID NO: 16723 - DNA, 16 bp, Artificial Sequence
  synthetic [barcode part1]
caacgatcctccacac

SEQ ID NO: 16724 - DNA, 16 bp, Artificial Sequence
  synthetic [barcode part1]
aacctaaggtcgtcgt

SEQ ID NO: 16725 - DNA, 16 bp, Artificial Sequence
  synthetic [barcode part1]
ataggtcaatccgtgc

SEQ ID NO: 16726 - DNA, 16 bp, Artificial Sequence
  synthetic [barcode part1]
cgaagttgagaaggac

SEQ ID NO: 16727 - DNA, 16 bp, Artificial Sequence
  synthetic [barcode part1]
ttagacgttgccttac

SEQ ID NO: 16728 - DNA, 16 bp, Artificial Sequence
  synthetic [barcode part1]
tcaacctatccgaact

SEQ ID NO: 16729 - DNA, 16 bp, Artificial Sequence
  synthetic [barcode part1]
tgcacaagtaaccgtc

SEQ ID NO: 16730 - DNA, 16 bp, Artificial Sequence
  synthetic [barcode part1]
atctagatccaccact

SEQ ID NO: 16731 - DNA, 16 bp, Artificial Sequence
  synthetic [barcode part1]
cggaacttcaactggt

SEQ ID NO: 16732 - DNA, 16 bp, Artificial Sequence
  synthetic [barcode part1]
aagacctctcacctgc

SEQ ID NO: 16733 - DNA, 16 bp, Artificial Sequence
  synthetic [barcode part1]
ttagttcctcacgaac

SEQ ID NO: 16734 - DNA, 16 bp, Artificial Sequence
  synthetic [barcode part1]
acgccgagtataactc

SEQ ID NO: 16735 - DNA, 16 bp, Artificial Sequence
  synthetic [barcode part1]
tggttgtcaccaacag

SEQ ID NO: 16736 - DNA, 16 bp, Artificial Sequence
  synthetic [barcode part1]
tgccagaacttctact

SEQ ID NO: 16737 - DNA, 16 bp, Artificial Sequence
  synthetic [barcode part1]
ttgtggattgttgtcc

SEQ ID NO: 16738 - DNA, 16 bp, Artificial Sequence
  synthetic [barcode part1]
ttggtcctgttagtac

SEQ ID NO: 16739 - DNA, 16 bp, Artificial Sequence
  synthetic [barcode part1]
tccgatcgtacactgc

SEQ ID NO: 16740 - DNA, 16 bp, Artificial Sequence
  synthetic [barcode part1]
gcaagtgatctatccg

SEQ ID NO: 16741 - DNA, 16 bp, Artificial Sequence
  synthetic [barcode part1]
tagattatacgcctcc

SEQ ID NO: 16742 - DNA, 16 bp, Artificial Sequence
  synthetic [barcode part1]
gttcgaaccacctcac

SEQ ID NO: 16743 - DNA, 16 bp, Artificial Sequence
  synthetic [barcode part1]
ccttgaccaacaagac

SEQ ID NO: 16744 - DNA, 16 bp, Artificial Sequence
  synthetic [barcode part1]
agtgtgttgtgtgacc

SEQ ID NO: 16745 - DNA, 16 bp, Artificial Sequence
  synthetic [barcode part1]
ttgcagttggtgtcag

SEQ ID NO: 16746 - DNA, 16 bp, Artificial Sequence
  synthetic [barcode part1]
atataacggaactggc

SEQ ID NO: 16747 - DNA, 16 bp, Artificial Sequence
  synthetic [barcode part1]
gcactctaatctggcc

SEQ ID NO: 16748 - DNA, 16 bp, Artificial Sequence
  synthetic [barcode part1]
cgtagagtggcagttg

SEQ ID NO: 16749 - DNA, 16 bp, Artificial Sequence
  synthetic [barcode part1]
gactggttcaggatct

SEQ ID NO: 16750 - DNA, 16 bp, Artificial Sequence
  synthetic [barcode part1]
ttcagagtggcactac

SEQ ID NO: 16751 - DNA, 16 bp, Artificial Sequence
  synthetic [barcode part1]
gcagaccgattgtatc

SEQ ID NO: 16752 - DNA, 16 bp, Artificial Sequence
  synthetic [barcode part1]
tgttgcagttggtcag

SEQ ID NO: 16753 - DNA, 16 bp, Artificial Sequence
  synthetic [barcode part1]
agtactagtgcgcgtt

SEQ ID NO: 16754 - DNA, 16 bp, Artificial Sequence
  synthetic [barcode part1]
cctgatccaactacgc

SEQ ID NO: 16755 - DNA, 16 bp, Artificial Sequence
  synthetic [barcode part1]
tggtcaatacacacgc

SEQ ID NO: 16756 - DNA, 16 bp, Artificial Sequence
  synthetic [barcode part1]
gcaaggaattgaactc

SEQ ID NO: 16757 - DNA, 16 bp, Artificial Sequence
  synthetic [barcode part1]
cgaagactacttccag

SEQ ID NO: 16758 - DNA, 16 bp, Artificial Sequence
  synthetic [barcode part1]
ccactacttatctcgc

SEQ ID NO: 16759 - DNA, 16 bp, Artificial Sequence
  synthetic [barcode part1]
caggaactaggtcacg

SEQ ID NO: 16760 - DNA, 16 bp, Artificial Sequence
  synthetic [barcode part1]
acgagttaaggaccgc

SEQ ID NO: 16761 - DNA, 16 bp, Artificial Sequence
  synthetic [barcode part1]
tacgacactgcgatac

SEQ ID NO: 16762 - DNA, 16 bp, Artificial Sequence
  synthetic [barcode part1]
tgttgaggtccagtac

SEQ ID NO: 16763 - DNA, 16 bp, Artificial Sequence
  synthetic [barcode part1]
tcgccgtgtgaatcct

SEQ ID NO: 16764 - DNA, 16 bp, Artificial Sequence
  synthetic [barcode part1]
cgacttctagtcgtgc

SEQ ID NO: 16765 - DNA, 16 bp, Artificial Sequence
  synthetic [barcode part1]
cactactggcgtgtct

SEQ ID NO: 16766 - DNA, 16 bp, Artificial Sequence
  synthetic [barcode part1]
tggtgtgtcttactgt

SEQ ID NO: 16767 - DNA, 16 bp, Artificial Sequence
  synthetic [barcode part1]
cggccttgcgtattgt

SEQ ID NO: 16768 - DNA, 16 bp, Artificial Sequence
  synthetic [barcode part1]
gcaacagataactacg

SEQ ID NO: 16769 - DNA, 16 bp, Artificial Sequence
  synthetic [barcode part1]
gtatctcggtctaact

SEQ ID NO: 16770 - DNA, 16 bp, Artificial Sequence
  synthetic [barcode part1]
cggatagtccagagtg

SEQ ID NO: 16771 - DNA, 16 bp, Artificial Sequence
  synthetic [barcode part1]
atagtccgcctgatag

SEQ ID NO: 16772 - DNA, 16 bp, Artificial Sequence
  synthetic [barcode part1]
gccttaagtacacacg

SEQ ID NO: 16773 - DNA, 16 bp, Artificial Sequence
  synthetic [barcode part1]
gagtgagtatcgtaac

SEQ ID NO: 16774 - DNA, 16 bp, Artificial Sequence
  synthetic [barcode part1]
attccgaccttccttg

SEQ ID NO: 16775 - DNA, 16 bp, Artificial Sequence
  synthetic [barcode part1]
agataaggtctgcctc

SEQ ID NO: 16776 - DNA, 16 bp, Artificial Sequence
  synthetic [barcode part1]
cagatcgagaatacgt

SEQ ID NO: 16777 - DNA, 16 bp, Artificial Sequence
  synthetic [barcode part1]
ccgcacaggttaagag

SEQ ID NO: 16778 - DNA, 16 bp, Artificial Sequence
  synthetic [barcode part1]
ttaacctgttcaggtc

SEQ ID NO: 16779 - DNA, 16 bp, Artificial Sequence
  synthetic [barcode part1]
caccttctgtatcctg

SEQ ID NO: 16780 - DNA, 16 bp, Artificial Sequence
  synthetic [barcode part1]
tcggtgactatactct

SEQ ID NO: 16781 - DNA, 16 bp, Artificial Sequence
  synthetic [barcode part1]
accttagtagttggcg

SEQ ID NO: 16782 - DNA, 16 bp, Artificial Sequence
  synthetic [barcode part1]
tcaggactattgcggt

SEQ ID NO: 16783 - DNA, 16 bp, Artificial Sequence
  synthetic [barcode part1]
aactctccgtggacct

SEQ ID NO: 16784 - DNA, 16 bp, Artificial Sequence
  synthetic [barcode part1]
cgttaaggtaacctgc

SEQ ID NO: 16785 - DNA, 16 bp, Artificial Sequence
  synthetic [barcode part1]
tctaggttggactcag

SEQ ID NO: 16786 - DNA, 16 bp, Artificial Sequence
  synthetic [barcode part1]
agaaccgttagtacag

SEQ ID NO: 16787 - DNA, 16 bp, Artificial Sequence
  synthetic [barcode part1]
aggtgaagacgccact

SEQ ID NO: 16788 - DNA, 16 bp, Artificial Sequence
  synthetic [barcode part1]
gtcctggaacttcaag

SEQ ID NO: 16789 - DNA, 16 bp, Artificial Sequence
  synthetic [barcode part1]
acgcagacagactgtg

SEQ ID NO: 16790 - DNA, 16 bp, Artificial Sequence
  synthetic [barcode part1]
tggatcggacttgact

SEQ ID NO: 16791 - DNA, 16 bp, Artificial Sequence
  synthetic [barcode part1]
gttacaactgtccgtt

SEQ ID NO: 16792 - DNA, 16 bp, Artificial Sequence
  synthetic [barcode part1]
gccaagtcactcctgt

SEQ ID NO: 16793 - DNA, 16 bp, Artificial Sequence
  synthetic [barcode part1]
ttcggttacactggtt

SEQ ID NO: 16794 - DNA, 16 bp, Artificial Sequence
  synthetic [barcode part1]
cgcacttgcctagtac

SEQ ID NO: 16795 - DNA, 16 bp, Artificial Sequence
  synthetic [barcode part1]
acacaaccgcgtaatc

SEQ ID NO: 16796 - DNA, 16 bp, Artificial Sequence
  synthetic [barcode part1]
cgtctctgccaagttg

SEQ ID NO: 16797 - DNA, 16 bp, Artificial Sequence
  synthetic [barcode part1]
acctatcgcaatacct

SEQ ID NO: 16798 - DNA, 16 bp, Artificial Sequence
  synthetic [barcode part1]
acagtgtgtcacagtc

SEQ ID NO: 16799 - DNA, 16 bp, Artificial Sequence
  synthetic [barcode part1]
caacttccttctcggt

SEQ ID NO: 16800 - DNA, 16 bp, Artificial Sequence
  synthetic [barcode part1]
tggagacagtgtagag

SEQ ID NO: 16801 - DNA, 16 bp, Artificial Sequence
  synthetic [barcode part1]
tgtcagagtccagtac

SEQ ID NO: 16802 - DNA, 16 bp, Artificial Sequence
  synthetic [barcode part1]
aagtgcggttactaag

SEQ ID NO: 16803 - DNA, 16 bp, Artificial Sequence
  synthetic [barcode part1]
aggcagttcgagtgtg

SEQ ID NO: 16804 - DNA, 16 bp, Artificial Sequence
  synthetic [barcode part1]
actgtactggtctccg

SEQ ID NO: 16805 - DNA, 16 bp, Artificial Sequence
  synthetic [barcode part1]
tactgcactgaagtcg

SEQ ID NO: 16806 - DNA, 16 bp, Artificial Sequence
  synthetic [barcode part1]
tagtgaacttggacag

SEQ ID NO: 16807 - DNA, 16 bp, Artificial Sequence
  synthetic [barcode part1]
ttctcctaatcggtcc

SEQ ID NO: 16808 - DNA, 16 bp, Artificial Sequence
  synthetic [barcode part1]
tggaatcaaggtcctc

SEQ ID NO: 16809 - DNA, 16 bp, Artificial Sequence
  synthetic [barcode part1]
ccgttaacgtactccg

SEQ ID NO: 16810 - DNA, 16 bp, Artificial Sequence
  synthetic [barcode part1]
gtcttcacgtcgaatt

SEQ ID NO: 16811 - DNA, 16 bp, Artificial Sequence
  synthetic [barcode part1]
cacgacagtccgtctt

SEQ ID NO: 16812 - DNA, 16 bp, Artificial Sequence
  synthetic [barcode part1]
aagtccgtgttctgtt

SEQ ID NO: 16813 - DNA, 16 bp, Artificial Sequence
  synthetic [barcode part1]
cgattgttatcctacg

SEQ ID NO: 16814 - DNA, 16 bp, Artificial Sequence
  synthetic [barcode part1]
ttaatagttcgcgtcc

SEQ ID NO: 16815 - DNA, 16 bp, Artificial Sequence
  synthetic [barcode part1]
gaggaacgcctaagtc

SEQ ID NO: 16816 - DNA, 16 bp, Artificial Sequence
  synthetic [barcode part1]
tgttccgcctggatac

SEQ ID NO: 16817 - DNA, 16 bp, Artificial Sequence
  synthetic [barcode part1]
ccgaacgattctattc

SEQ ID NO: 16818 - DNA, 16 bp, Artificial Sequence
  synthetic [barcode part1]
tgagaggactgacgtc

SEQ ID NO: 16819 - DNA, 16 bp, Artificial Sequence
  synthetic [barcode part1]
agactgcaacgcaggt

SEQ ID NO: 16820 - DNA, 16 bp, Artificial Sequence
  synthetic [barcode part1]
caactccacaccaacc

SEQ ID NO: 16821 - DNA, 16 bp, Artificial Sequence
  synthetic [barcode part1]
tctccgataactacac

SEQ ID NO: 16822 - DNA, 16 bp, Artificial Sequence
  synthetic [barcode part1]
ataccgttctactcag

SEQ ID NO: 16823 - DNA, 16 bp, Artificial Sequence
  synthetic [barcode part1]
caacgttggacagacg

SEQ ID NO: 16824 - DNA, 16 bp, Artificial Sequence
  synthetic [barcode part1]
cgtactattccgattg

SEQ ID NO: 16825 - DNA, 16 bp, Artificial Sequence
  synthetic [barcode part1]
ttcgcctgtagtattg

SEQ ID NO: 16826 - DNA, 16 bp, Artificial Sequence
  synthetic [barcode part1]
caagtggagataggtg

SEQ ID NO: 16827 - DNA, 16 bp, Artificial Sequence
  synthetic [barcode part1]
gcctactggatcctac

SEQ ID NO: 16828 - DNA, 16 bp, Artificial Sequence
  synthetic [barcode part1]
attgcgttctccgacg

SEQ ID NO: 16829 - DNA, 16 bp, Artificial Sequence
  synthetic [barcode part1]
gcgttaattctactgc

SEQ ID NO: 16830 - DNA, 16 bp, Artificial Sequence
  synthetic [barcode part1]
ttgtccgttacgatac

SEQ ID NO: 16831 - DNA, 16 bp, Artificial Sequence
  synthetic [barcode part1]
cagtccgattcagtag

SEQ ID NO: 16832 - DNA, 16 bp, Artificial Sequence
  synthetic [barcode part1]
cgaatctccacaagtg

SEQ ID NO: 16833 - DNA, 16 bp, Artificial Sequence
  synthetic [barcode part1]
taccgaagaacgcgac

SEQ ID NO: 16834 - DNA, 16 bp, Artificial Sequence
  synthetic [barcode part1]
caggatctatacgcgt

SEQ ID NO: 16835 - DNA, 16 bp, Artificial Sequence
  synthetic [barcode part1]
agtgcagacggttcag

SEQ ID NO: 16836 - DNA, 16 bp, Artificial Sequence
  synthetic [barcode part1]
gttgaacacaggaatc

SEQ ID NO: 16837 - DNA, 16 bp, Artificial Sequence
  synthetic [barcode part1]
tacgcgaacggttact

SEQ ID NO: 16838 - DNA, 16 bp, Artificial Sequence
  synthetic [barcode part1]
gagtgagattcacctc

SEQ ID NO: 16839 - DNA, 16 bp, Artificial Sequence
  synthetic [barcode part1]
agtacggtgaactgcg

SEQ ID NO: 16840 - DNA, 16 bp, Artificial Sequence
  synthetic [barcode part1]
ccgagaccttatctgc

SEQ ID NO: 16841 - DNA, 16 bp, Artificial Sequence
  synthetic [barcode part1]
tacttcaggcgttcgc

SEQ ID NO: 16842 - DNA, 16 bp, Artificial Sequence
  synthetic [barcode part1]
ccaacagtggagacgt

SEQ ID NO: 16843 - DNA, 16 bp, Artificial Sequence
  synthetic [barcode part1]
tcaactgccaaggttg

SEQ ID NO: 16844 - DNA, 16 bp, Artificial Sequence
  synthetic [barcode part1]
aactaatcaaccggcc

SEQ ID NO: 16845 - DNA, 16 bp, Artificial Sequence
  synthetic [barcode part1]
gcaagtgcaaggttcg

SEQ ID NO: 16846 - DNA, 16 bp, Artificial Sequence
  synthetic [barcode part1]
cgtctcactgtagacc

SEQ ID NO: 16847 - DNA, 16 bp, Artificial Sequence
  synthetic [barcode part1]
ccagtagagtgactct

SEQ ID NO: 16848 - DNA, 16 bp, Artificial Sequence
  synthetic [barcode part1]
agatcgtcggaggtac

SEQ ID NO: 16849 - DNA, 16 bp, Artificial Sequence
  synthetic [barcode part1]
cctgatacttgcgtcg

SEQ ID NO: 16850 - DNA, 16 bp, Artificial Sequence
  synthetic [barcode part1]
cgccactcttgtaggt

SEQ ID NO: 16851 - DNA, 16 bp, Artificial Sequence
  synthetic [barcode part1]
cctgattgcgtcggtt

SEQ ID NO: 16852 - DNA, 16 bp, Artificial Sequence
  synthetic [barcode part1]
cggaattattacggcc

SEQ ID NO: 16853 - DNA, 16 bp, Artificial Sequence
  synthetic [barcode part1]
aggtcttgaggaagag

SEQ ID NO: 16854 - DNA, 16 bp, Artificial Sequence
  synthetic [barcode part1]
tctcgcgcagtgactt

SEQ ID NO: 16855 - DNA, 16 bp, Artificial Sequence
  synthetic [barcode part1]
gtagtaccacacgtac

SEQ ID NO: 16856 - DNA, 16 bp, Artificial Sequence
  synthetic [barcode part1]
ccacggttagttagtg

SEQ ID NO: 16857 - DNA, 16 bp, Artificial Sequence
  synthetic [barcode part1]
cgactgatacggtgtt

SEQ ID NO: 16858 - DNA, 16 bp, Artificial Sequence
  synthetic [barcode part1]
tcctgaaggacgagtg

SEQ ID NO: 16859 - DNA, 16 bp, Artificial Sequence
  synthetic [barcode part1]
gcgtaattcttccaac

SEQ ID NO: 16860 - DNA, 16 bp, Artificial Sequence
  synthetic [barcode part1]
acggttgtcttaacct

SEQ ID NO: 16861 - DNA, 16 bp, Artificial Sequence
  synthetic [barcode part1]
cgttacttggatctgt

SEQ ID NO: 16862 - DNA, 16 bp, Artificial Sequence
  synthetic [barcode part1]
cacggattatcacctt

SEQ ID NO: 16863 - DNA, 16 bp, Artificial Sequence
  synthetic [barcode part1]
aggttcagtgatcgtc

SEQ ID NO: 16864 - DNA, 16 bp, Artificial Sequence
  synthetic [barcode part1]
cacctgttacctactc

SEQ ID NO: 16865 - DNA, 16 bp, Artificial Sequence
  synthetic [barcode part1]
cactaaggttcagtgc

SEQ ID NO: 16866 - DNA, 16 bp, Artificial Sequence
  synthetic [barcode part1]
aagtggccacgaatcg

SEQ ID NO: 16867 - DNA, 16 bp, Artificial Sequence
  synthetic [barcode part1]
tcgacttacttggact

SEQ ID NO: 16868 - DNA, 16 bp, Artificial Sequence
  synthetic [barcode part1]
gtggactggaggttgt

SEQ ID NO: 16869 - DNA, 16 bp, Artificial Sequence
  synthetic [barcode part1]
aatctaaccagtggcc

SEQ ID NO: 16870 - DNA, 16 bp, Artificial Sequence
  synthetic [barcode part1]
gtgcagtgtcagtgtt

SEQ ID NO: 16871 - DNA, 16 bp, Artificial Sequence
  synthetic [barcode part1]
aacgcgatctgtactg

SEQ ID NO: 16872 - DNA, 16 bp, Artificial Sequence
  synthetic [barcode part1]
acgatacaaggtcctc

SEQ ID NO: 16873 - DNA, 16 bp, Artificial Sequence
  synthetic [barcode part1]
ccacactataggagtc

SEQ ID NO: 16874 - DNA, 16 bp, Artificial Sequence
  synthetic [barcode part1]
gattcctccgagtatt

SEQ ID NO: 16875 - DNA, 16 bp, Artificial Sequence
  synthetic [barcode part1]
agtcgactctcagagt

SEQ ID NO: 16876 - DNA, 16 bp, Artificial Sequence
  synthetic [barcode part1]
gaattgagtcgtgtag

SEQ ID NO: 16877 - DNA, 16 bp, Artificial Sequence
  synthetic [barcode part1]
accgcgaacaatatcc

SEQ ID NO: 16878 - DNA, 16 bp, Artificial Sequence
  synthetic [barcode part1]
tggttgtgagtcggag

SEQ ID NO: 16879 - DNA, 16 bp, Artificial Sequence
  synthetic [barcode part1]
caggtagaacgtcacg

SEQ ID NO: 16880 - DNA, 16 bp, Artificial Sequence
  synthetic [barcode part1]
acttgccagtgtcacc

SEQ ID NO: 16881 - DNA, 16 bp, Artificial Sequence
  synthetic [barcode part1]
agtgcgtgagactggt

SEQ ID NO: 16882 - DNA, 16 bp, Artificial Sequence
  synthetic [barcode part1]
ccaccactgttacctt

SEQ ID NO: 16883 - DNA, 16 bp, Artificial Sequence
  synthetic [barcode part1]
tggtctccacgtagtc

SEQ ID NO: 16884 - DNA, 16 bp, Artificial Sequence
  synthetic [barcode part1]
ttcgagtgcaattgcg

SEQ ID NO: 16885 - DNA, 16 bp, Artificial Sequence
  synthetic [barcode part1]
gataccgcacggtatt

SEQ ID NO: 16886 - DNA, 16 bp, Artificial Sequence
  synthetic [barcode part1]
agtgcgtgtataccgt

SEQ ID NO: 16887 - DNA, 16 bp, Artificial Sequence
  synthetic [barcode part1]
gagtatcgtaggtctc

SEQ ID NO: 16888 - DNA, 16 bp, Artificial Sequence
  synthetic [barcode part1]
aactccaggacgagtg

SEQ ID NO: 16889 - DNA, 16 bp, Artificial Sequence
  synthetic [barcode part1]
gccagaagtaccagtg

SEQ ID NO: 16890 - DNA, 16 bp, Artificial Sequence
  synthetic [barcode part1]
cggatccgttctgttg

SEQ ID NO: 16891 - DNA, 16 bp, Artificial Sequence
  synthetic [barcode part1]
gcctagatagagtagt

SEQ ID NO: 16892 - DNA, 16 bp, Artificial Sequence
  synthetic [barcode part1]
gagactcaagtcctgt

SEQ ID NO: 16893 - DNA, 16 bp, Artificial Sequence
  synthetic [barcode part1]
tcttgtaccagactac

SEQ ID NO: 16894 - DNA, 16 bp, Artificial Sequence
  synthetic [barcode part1]
ttaccgcaacaagacc

SEQ ID NO: 16895 - DNA, 16 bp, Artificial Sequence
  synthetic [barcode part1]
cgtcgacagagtcaag

SEQ ID NO: 16896 - DNA, 16 bp, Artificial Sequence
  synthetic [barcode part1]
tgccagacgaagacgt

SEQ ID NO: 16897 - DNA, 16 bp, Artificial Sequence
  synthetic [barcode part1]
aagagttcacgtagtg

SEQ ID NO: 16898 - DNA, 16 bp, Artificial Sequence
  synthetic [barcode part1]
acagacgatagtgttg

SEQ ID NO: 16899 - DNA, 16 bp, Artificial Sequence
  synthetic [barcode part1]
aagacttcacctacct

SEQ ID NO: 16900 - DNA, 16 bp, Artificial Sequence
  synthetic [barcode part1]
tgtaggcgtcttatct

SEQ ID NO: 16901 - DNA, 16 bp, Artificial Sequence
  synthetic [barcode part1]
gacgaggaagacagtt

SEQ ID NO: 16902 - DNA, 16 bp, Artificial Sequence
  synthetic [barcode part1]
accgtgcagagatcag

SEQ ID NO: 16903 - DNA, 16 bp, Artificial Sequence
  synthetic [barcode part1]
tccgatcacactggtc

SEQ ID NO: 16904 - DNA, 16 bp, Artificial Sequence
  synthetic [barcode part1]
gagacgacttaggtgc

SEQ ID NO: 16905 - DNA, 16 bp, Artificial Sequence
  synthetic [barcode part1]
cgtagtacaggattcc

SEQ ID NO: 16906 - DNA, 16 bp, Artificial Sequence
  synthetic [barcode part1]
aggcctgaatagtaac

SEQ ID NO: 16907 - DNA, 16 bp, Artificial Sequence
  synthetic [barcode part1]
atccagataggcgttc

SEQ ID NO: 16908 - DNA, 16 bp, Artificial Sequence
  synthetic [barcode part1]
gagaacacttggcggt

SEQ ID NO: 16909 - DNA, 16 bp, Artificial Sequence
  synthetic [barcode part1]
ccgatctatcttccac

SEQ ID NO: 16910 - DNA, 16 bp, Artificial Sequence
  synthetic [barcode part1]
actcgttggtgttact

SEQ ID NO: 16911 - DNA, 16 bp, Artificial Sequence
  synthetic [barcode part1]
cgagaacctattagag

SEQ ID NO: 16912 - DNA, 16 bp, Artificial Sequence
  synthetic [barcode part1]
cgtctcgatctgtggt

SEQ ID NO: 16913 - DNA, 16 bp, Artificial Sequence
  synthetic [barcode part1]
actagaacctcgatcg

SEQ ID NO: 16914 - DNA, 16 bp, Artificial Sequence
  synthetic [barcode part1]
acgtacaactacggtc

SEQ ID NO: 16915 - DNA, 16 bp, Artificial Sequence
  synthetic [barcode part1]
agtgcgcacgtattac

SEQ ID NO: 16916 - DNA, 16 bp, Artificial Sequence
  synthetic [barcode part1]
atacgtgattgtggcc

SEQ ID NO: 16917 - DNA, 16 bp, Artificial Sequence
  synthetic [barcode part1]
cgtcggtctaattccg

SEQ ID NO: 16918 - DNA, 16 bp, Artificial Sequence
  synthetic [barcode part1]
cgtctactccagagtc

SEQ ID NO: 16919 - DNA, 16 bp, Artificial Sequence
  synthetic [barcode part1]
gcaacttagaccactg

SEQ ID NO: 16920 - DNA, 16 bp, Artificial Sequence
  synthetic [barcode part1]
tcgttgatctctgtag

SEQ ID NO: 16921 - DNA, 16 bp, Artificial Sequence
  synthetic [barcode part1]
acttgttagtgtcgtc

SEQ ID NO: 16922 - DNA, 16 bp, Artificial Sequence
  synthetic [barcode part1]
aatcgaccgtgtgtac

SEQ ID NO: 16923 - DNA, 16 bp, Artificial Sequence
  synthetic [barcode part1]
taatcagagtcggcct

SEQ ID NO: 16924 - DNA, 16 bp, Artificial Sequence
  synthetic [barcode part1]
ttcgtgcaccgagttc

SEQ ID NO: 16925 - DNA, 16 bp, Artificial Sequence
  synthetic [barcode part1]
cacagacgtgagttct

SEQ ID NO: 16926 - DNA, 16 bp, Artificial Sequence
  synthetic [barcode part1]
taccaagattctcacc

SEQ ID NO: 16927 - DNA, 16 bp, Artificial Sequence
  synthetic [barcode part1]
acgtaataaccgaggt

SEQ ID NO: 16928 - DNA, 16 bp, Artificial Sequence
  synthetic [barcode part1]
atctccgcaccgaatc

SEQ ID NO: 16929 - DNA, 16 bp, Artificial Sequence
  synthetic [barcode part1]
atcttggaacctcgag

SEQ ID NO: 16930 - DNA, 16 bp, Artificial Sequence
  synthetic [barcode part1]
aagtgcgcgacgattg

SEQ ID NO: 16931 - DNA, 16 bp, Artificial Sequence
  synthetic [barcode part1]
tggcaactgactcagt

SEQ ID NO: 16932 - DNA, 16 bp, Artificial Sequence
  synthetic [barcode part1]
cgttacttcgcacggt

SEQ ID NO: 16933 - DNA, 16 bp, Artificial Sequence
  synthetic [barcode part1]
acgtactaggttgaag

SEQ ID NO: 16934 - DNA, 16 bp, Artificial Sequence
  synthetic [barcode part1]
ttctatcagtgaggcg

SEQ ID NO: 16935 - DNA, 16 bp, Artificial Sequence
  synthetic [barcode part1]
cgcacacaaccaattg

SEQ ID NO: 16936 - DNA, 16 bp, Artificial Sequence
  synthetic [barcode part1]
gcagacaagacaagtg

SEQ ID NO: 16937 - DNA, 16 bp, Artificial Sequence
  synthetic [barcode part1]
tcttgcgtgatagttc

SEQ ID NO: 16938 - DNA, 16 bp, Artificial Sequence
  synthetic [barcode part1]
agactctcgcaatacg

SEQ ID NO: 16939 - DNA, 16 bp, Artificial Sequence
  synthetic [barcode part1]
tgacgtatcgaacacc

SEQ ID NO: 16940 - DNA, 16 bp, Artificial Sequence
  synthetic [barcode part1]
tctgtgattgttccag

SEQ ID NO: 16941 - DNA, 16 bp, Artificial Sequence
  synthetic [barcode part1]
caacgataattcggcc

SEQ ID NO: 16942 - DNA, 16 bp, Artificial Sequence
  synthetic [barcode part1]
ccgtgtcagatcacct

SEQ ID NO: 16943 - DNA, 16 bp, Artificial Sequence
  synthetic [barcode part1]
tcacggatctgattct

SEQ ID NO: 16944 - DNA, 16 bp, Artificial Sequence
  synthetic [barcode part1]
gtgtcgactcctaatt

SEQ ID NO: 16945 - DNA, 16 bp, Artificial Sequence
  synthetic [barcode part1]
acttcgccaccagtac

SEQ ID NO: 16946 - DNA, 16 bp, Artificial Sequence
  synthetic [barcode part1]
cctagtctacggtcac

SEQ ID NO: 16947 - DNA, 16 bp, Artificial Sequence
  synthetic [barcode part1]
aggcaacgatctatag

SEQ ID NO: 16948 - DNA, 16 bp, Artificial Sequence
  synthetic [barcode part1]
tcactccactgagaag

SEQ ID NO: 16949 - DNA, 16 bp, Artificial Sequence
  synthetic [barcode part1]
gtgagtgcagaacctg

SEQ ID NO: 16950 - DNA, 16 bp, Artificial Sequence
  synthetic [barcode part1]
agttgtgtcagagaac

SEQ ID NO: 16951 - DNA, 16 bp, Artificial Sequence
  synthetic [barcode part1]
ttcagttagagtcggc

SEQ ID NO: 16952 - DNA, 16 bp, Artificial Sequence
  synthetic [barcode part1]
gtgttacacttacctg

SEQ ID NO: 16953 - DNA, 16 bp, Artificial Sequence
  synthetic [barcode part1]
ataccgtgcggacaag

SEQ ID NO: 16954 - DNA, 16 bp, Artificial Sequence
  synthetic [barcode part1]
agttacgatcgtgcac

SEQ ID NO: 16955 - DNA, 16 bp, Artificial Sequence
  synthetic [barcode part1]
tagtattcgcctgttg

SEQ ID NO: 16956 - DNA, 16 bp, Artificial Sequence
  synthetic [barcode part1]
aagtatctccggacgt

SEQ ID NO: 16957 - DNA, 16 bp, Artificial Sequence
  synthetic [barcode part1]
atacgaaccgtgtctg

SEQ ID NO: 16958 - DNA, 16 bp, Artificial Sequence
  synthetic [barcode part1]
cgagacaataatcgtg

SEQ ID NO: 16959 - DNA, 16 bp, Artificial Sequence
  synthetic [barcode part1]
taccgttcactagtgt

SEQ ID NO: 16960 - DNA, 16 bp, Artificial Sequence
  synthetic [barcode part1]
gacacagtctataccg

SEQ ID NO: 16961 - DNA, 16 bp, Artificial Sequence
  synthetic [barcode part1]
tattggcgagactaag

SEQ ID NO: 16962 - DNA, 16 bp, Artificial Sequence
  synthetic [barcode part1]
ccgtgtcgaatacagt

SEQ ID NO: 16963 - DNA, 16 bp, Artificial Sequence
  synthetic [barcode part1]
cgagttgccaacaact

SEQ ID NO: 16964 - DNA, 16 bp, Artificial Sequence
  synthetic [barcode part1]
ttccaatagttgtgcc

SEQ ID NO: 16965 - DNA, 16 bp, Artificial Sequence
  synthetic [barcode part1]
ccttgtgagaacgtac

SEQ ID NO: 16966 - DNA, 16 bp, Artificial Sequence
  synthetic [barcode part1]
tgaccaacgcgtatac

SEQ ID NO: 16967 - DNA, 16 bp, Artificial Sequence
  synthetic [barcode part1]
agactctatcacgacg

SEQ ID NO: 16968 - DNA, 16 bp, Artificial Sequence
  synthetic [barcode part1]
ttgttcagtccgttcc

SEQ ID NO: 16969 - DNA, 16 bp, Artificial Sequence
  synthetic [barcode part1]
gaggagtataactgtc

SEQ ID NO: 16970 - DNA, 16 bp, Artificial Sequence
  synthetic [barcode part1]
ttgataaggatacggc

SEQ ID NO: 16971 - DNA, 16 bp, Artificial Sequence
  synthetic [barcode part1]
tactccgagtgagatc

SEQ ID NO: 16972 - DNA, 16 bp, Artificial Sequence
  synthetic [barcode part1]
ttgactggtcaaccag

SEQ ID NO: 16973 - DNA, 16 bp, Artificial Sequence
  synthetic [barcode part1]
gtgatacaccgtgatc

SEQ ID NO: 16974 - DNA, 16 bp, Artificial Sequence
  synthetic [barcode part1]
ttctccttcaaggtcc

SEQ ID NO: 16975 - DNA, 16 bp, Artificial Sequence
  synthetic [barcode part1]
aatcggcgtcaactgt

SEQ ID NO: 16976 - DNA, 16 bp, Artificial Sequence
  synthetic [barcode part1]
acaactggtgtcagtc

SEQ ID NO: 16977 - DNA, 16 bp, Artificial Sequence
  synthetic [barcode part1]
tccaacctgtgtaatc

SEQ ID NO: 16978 - DNA, 16 bp, Artificial Sequence
  synthetic [barcode part1]
cctaccaagaacgatc

SEQ ID NO: 16979 - DNA, 16 bp, Artificial Sequence
  synthetic [barcode part1]
gatctaacacggaagt

SEQ ID NO: 16980 - DNA, 16 bp, Artificial Sequence
  synthetic [barcode part1]
tctcgcggatctggtt

SEQ ID NO: 16981 - DNA, 16 bp, Artificial Sequence
  synthetic [barcode part1]
tgaatcaggtccgact

SEQ ID NO: 16982 - DNA, 16 bp, Artificial Sequence
  synthetic [barcode part1]
gtcttacggtacactt

SEQ ID NO: 16983 - DNA, 16 bp, Artificial Sequence
  synthetic [barcode part1]
gaagattacgcactag

SEQ ID NO: 16984 - DNA, 16 bp, Artificial Sequence
  synthetic [barcode part1]
tacggaccgttattct

SEQ ID NO: 16985 - DNA, 16 bp, Artificial Sequence
  synthetic [barcode part1]
ttatctcgaccacgcg

SEQ ID NO: 16986 - DNA, 16 bp, Artificial Sequence
  synthetic [barcode part1]
aatcagtgtgtcgcgt

SEQ ID NO: 16987 - DNA, 16 bp, Artificial Sequence
  synthetic [barcode part1]
cctgacttatacaacc

SEQ ID NO: 16988 - DNA, 16 bp, Artificial Sequence
  synthetic [barcode part1]
tactgcagttgaccag

SEQ ID NO: 16989 - DNA, 16 bp, Artificial Sequence
  synthetic [barcode part1]
tctggagtggttggtt

SEQ ID NO: 16990 - DNA, 16 bp, Artificial Sequence
  synthetic [barcode part1]
ttcgtgtggagacact

SEQ ID NO: 16991 - DNA, 16 bp, Artificial Sequence
  synthetic [barcode part1]
gaattcgatcctctac

SEQ ID NO: 16992 - DNA, 16 bp, Artificial Sequence
  synthetic [barcode part1]
tgtacacagtcaaccg

SEQ ID NO: 16993 - DNA, 16 bp, Artificial Sequence
  synthetic [barcode part1]
ttgtacgatcgcacag

SEQ ID NO: 16994 - DNA, 16 bp, Artificial Sequence
  synthetic [barcode part1]
cggtgaattcgttgtg

SEQ ID NO: 16995 - DNA, 16 bp, Artificial Sequence
  synthetic [barcode part1]
tgaagtacgagagacg

SEQ ID NO: 16996 - DNA, 16 bp, Artificial Sequence
  synthetic [barcode part1]
tccggttaagactgac

SEQ ID NO: 16997 - DNA, 16 bp, Artificial Sequence
  synthetic [barcode part1]
ttgcgatcgattggtg

SEQ ID NO: 16998 - DNA, 16 bp, Artificial Sequence
  synthetic [barcode part1]
tcagtgtacacaccag

SEQ ID NO: 16999 - DNA, 16 bp, Artificial Sequence
  synthetic [barcode part1]
atctaagtctgccact

SEQ ID NO: 17000 - DNA, 16 bp, Artificial Sequence
  synthetic [barcode part1]
gatcacagatcgaggc

SEQ ID NO: 17001 - DNA, 16 bp, Artificial Sequence
  synthetic [barcode part1]
cctcaacttctcgatc

SEQ ID NO: 17002 - DNA, 16 bp, Artificial Sequence
  synthetic [barcode part1]
ttaacgactgcacctt

SEQ ID NO: 17003 - DNA, 16 bp, Artificial Sequence
  synthetic [barcode part1]
ccgttgtcttactacc

SEQ ID NO: 17004 - DNA, 16 bp, Artificial Sequence
  synthetic [barcode part1]
agtctgttcacaggtg

SEQ ID NO: 17005 - DNA, 16 bp, Artificial Sequence
  synthetic [barcode part1]
tgcacttggcgacctt

SEQ ID NO: 17006 - DNA, 16 bp, Artificial Sequence
  synthetic [barcode part1]
acctattctacctgcc

SEQ ID NO: 17007 - DNA, 16 bp, Artificial Sequence
  synthetic [barcode part1]
cgacacgcaatctctc

SEQ ID NO: 17008 - DNA, 16 bp, Artificial Sequence
  synthetic [barcode part1]
cggcagtaattactgc

SEQ ID NO: 17009 - DNA, 16 bp, Artificial Sequence
  synthetic [barcode part1]
gaggcgacctattgtt

SEQ ID NO: 17010 - DNA, 16 bp, Artificial Sequence
  synthetic [barcode part1]
acgagaggttactaac

SEQ ID NO: 17011 - DNA, 16 bp, Artificial Sequence
  synthetic [barcode part1]
gttcgaagagtggcac

SEQ ID NO: 17012 - DNA, 16 bp, Artificial Sequence
  synthetic [barcode part1]
cgactgcacttctcag

SEQ ID NO: 17013 - DNA, 16 bp, Artificial Sequence
  synthetic [barcode part1]
taattctcagtcgcgt

SEQ ID NO: 17014 - DNA, 16 bp, Artificial Sequence
  synthetic [barcode part1]
attctacgcagtcgcc

SEQ ID NO: 17015 - DNA, 16 bp, Artificial Sequence
  synthetic [barcode part1]
aagtctgagattggac

SEQ ID NO: 17016 - DNA, 16 bp, Artificial Sequence
  synthetic [barcode part1]
gatatcgtgtgacacc

SEQ ID NO: 17017 - DNA, 16 bp, Artificial Sequence
  synthetic [barcode part1]
ttgcagtgtacacgtg

SEQ ID NO: 17018 - DNA, 16 bp, Artificial Sequence
  synthetic [barcode part1]
cgtgtctaagtgtgac

SEQ ID NO: 17019 - DNA, 16 bp, Artificial Sequence
  synthetic [barcode part1]
acgagacgtcctattg

SEQ ID NO: 17020 - DNA, 16 bp, Artificial Sequence
  synthetic [barcode part1]
gcaggataggtgatag

SEQ ID NO: 17021 - DNA, 16 bp, Artificial Sequence
  synthetic [barcode part1]
gtggttgtggtacact

SEQ ID NO: 17022 - DNA, 16 bp, Artificial Sequence
  synthetic [barcode part1]
tccacgcagttattgt

SEQ ID NO: 17023 - DNA, 16 bp, Artificial Sequence
  synthetic [barcode part1]
atccttgcggattact

SEQ ID NO: 17024 - DNA, 16 bp, Artificial Sequence
  synthetic [barcode part1]
ccgttacggatctacc

SEQ ID NO: 17025 - DNA, 16 bp, Artificial Sequence
  synthetic [barcode part1]
gccggattgagaacac

SEQ ID NO: 17026 - DNA, 16 bp, Artificial Sequence
  synthetic [barcode part1]
tggatcggactactgt

SEQ ID NO: 17027 - DNA, 16 bp, Artificial Sequence
  synthetic [barcode part1]
agttacgtggttacgc

SEQ ID NO: 17028 - DNA, 16 bp, Artificial Sequence
  synthetic [barcode part1]
taggtgtcctccagtc

SEQ ID NO: 17029 - DNA, 16 bp, Artificial Sequence
  synthetic [barcode part1]
tgtctccttggcaacg

SEQ ID NO: 17030 - DNA, 16 bp, Artificial Sequence
  synthetic [barcode part1]
gcaggttcgatctcct

SEQ ID NO: 17031 - DNA, 16 bp, Artificial Sequence
  synthetic [barcode part1]
ccggtcagtcaattag

SEQ ID NO: 17032 - DNA, 16 bp, Artificial Sequence
  synthetic [barcode part1]
aggcaactcaggtgtg

SEQ ID NO: 17033 - DNA, 16 bp, Artificial Sequence
  synthetic [barcode part1]
ccgcgttctgtcaagt

SEQ ID NO: 17034 - DNA, 16 bp, Artificial Sequence
  synthetic [barcode part1]
cgtacctgtaactcgc

SEQ ID NO: 17035 - DNA, 16 bp, Artificial Sequence
  synthetic [barcode part1]
gcggattagttgcgtt

SEQ ID NO: 17036 - DNA, 16 bp, Artificial Sequence
  synthetic [barcode part1]
aggtatctcgcaagtc

SEQ ID NO: 17037 - DNA, 16 bp, Artificial Sequence
  synthetic [barcode part1]
gttacaccagtcctcg

SEQ ID NO: 17038 - DNA, 16 bp, Artificial Sequence
  synthetic [barcode part1]
cagtactacgaacaag

SEQ ID NO: 17039 - DNA, 16 bp, Artificial Sequence
  synthetic [barcode part1]
ttgtgcagtaccaacg

SEQ ID NO: 17040 - DNA, 16 bp, Artificial Sequence
  synthetic [barcode part1]
tacgtggaagtgtcct

SEQ ID NO: 17041 - DNA, 16 bp, Artificial Sequence
  synthetic [barcode part1]
gcgagattcgtgagtg

SEQ ID NO: 17042 - DNA, 16 bp, Artificial Sequence
  synthetic [barcode part1]
tgtcttggttcgtagt

SEQ ID NO: 17043 - DNA, 16 bp, Artificial Sequence
  synthetic [barcode part1]
taccacaactgcaacg

SEQ ID NO: 17044 - DNA, 16 bp, Artificial Sequence
  synthetic [barcode part1]
acgaaccaacctgtgt

SEQ ID NO: 17045 - DNA, 16 bp, Artificial Sequence
  synthetic [barcode part1]
gaggatctgacacgtg

SEQ ID NO: 17046 - DNA, 16 bp, Artificial Sequence
  synthetic [barcode part1]
aatagttaggacgcac

SEQ ID NO: 17047 - DNA, 16 bp, Artificial Sequence
  synthetic [barcode part1]
gtgcagtacaccagtt

SEQ ID NO: 17048 - DNA, 16 bp, Artificial Sequence
  synthetic [barcode part1]
gcacaattcaactctc

SEQ ID NO: 17049 - DNA, 16 bp, Artificial Sequence
  synthetic [barcode part1]
caccagactatatcct

SEQ ID NO: 17050 - DNA, 16 bp, Artificial Sequence
  synthetic [barcode part1]
cactccttaacgaccg

SEQ ID NO: 17051 - DNA, 16 bp, Artificial Sequence
  synthetic [barcode part1]
gcacgacgaagaatcc

SEQ ID NO: 17052 - DNA, 16 bp, Artificial Sequence
  synthetic [barcode part1]
ttaacctgtctcctgc

SEQ ID NO: 17053 - DNA, 16 bp, Artificial Sequence
  synthetic [barcode part1]
ttccacctgagtgtcg

SEQ ID NO: 17054 - DNA, 16 bp, Artificial Sequence
  synthetic [barcode part1]
cgactagttaaccggt

SEQ ID NO: 17055 - DNA, 16 bp, Artificial Sequence
  synthetic [barcode part1]
cgttgatatactggcg

SEQ ID NO: 17056 - DNA, 16 bp, Artificial Sequence
  synthetic [barcode part1]
acagaggttggcgatc

SEQ ID NO: 17057 - DNA, 16 bp, Artificial Sequence
  synthetic [barcode part1]
gaaggtccgcaactag

SEQ ID NO: 17058 - DNA, 16 bp, Artificial Sequence
  synthetic [barcode part1]
actaagtactcggcgt

SEQ ID NO: 17059 - DNA, 16 bp, Artificial Sequence
  synthetic [barcode part1]
aacctcctcgatacgc

SEQ ID NO: 17060 - DNA, 16 bp, Artificial Sequence
  synthetic [barcode part1]
atcggcagacgtactt

SEQ ID NO: 17061 - DNA, 16 bp, Artificial Sequence
  synthetic [barcode part1]
cactaagtagaggcgc

SEQ ID NO: 17062 - DNA, 16 bp, Artificial Sequence
  synthetic [barcode part1]
tgcgcgaagattaggc

SEQ ID NO: 17063 - DNA, 16 bp, Artificial Sequence
  synthetic [barcode part1]
atatcctcgacaatcc

SEQ ID NO: 17064 - DNA, 16 bp, Artificial Sequence
  synthetic [barcode part1]
agagaacttacacggt

SEQ ID NO: 17065 - DNA, 16 bp, Artificial Sequence
  synthetic [barcode part1]
ttccgtactagatcgt

SEQ ID NO: 17066 - DNA, 16 bp, Artificial Sequence
  synthetic [barcode part1]
actgttcttcgagtgt

SEQ ID NO: 17067 - DNA, 16 bp, Artificial Sequence
  synthetic [barcode part1]
tgcagtagttctggac

SEQ ID NO: 17068 - DNA, 16 bp, Artificial Sequence
  synthetic [barcode part1]
acggcaagagtgtctg

SEQ ID NO: 17069 - DNA, 16 bp, Artificial Sequence
  synthetic [barcode part1]
gtctgatccgagttag

SEQ ID NO: 17070 - DNA, 16 bp, Artificial Sequence
  synthetic [barcode part1]
gccaattatcgcaacg

SEQ ID NO: 17071 - DNA, 16 bp, Artificial Sequence
  synthetic [barcode part1]
tagactcgcgaattcg

SEQ ID NO: 17072 - DNA, 16 bp, Artificial Sequence
  synthetic [barcode part1]
gaaccgacaatacgcg

SEQ ID NO: 17073 - DNA, 16 bp, Artificial Sequence
  synthetic [barcode part1]
gaccttcgttaggaac

SEQ ID NO: 17074 - DNA, 16 bp, Artificial Sequence
  synthetic [barcode part1]
tgccactcgttaatac

SEQ ID NO: 17075 - DNA, 16 bp, Artificial Sequence
  synthetic [barcode part1]
tggaatagagtgttcg

SEQ ID NO: 17076 - DNA, 16 bp, Artificial Sequence
  synthetic [barcode part1]
tcagacaagactcacc

SEQ ID NO: 17077 - DNA, 16 bp, Artificial Sequence
  synthetic [barcode part1]
agactaccggaggtac

SEQ ID NO: 17078 - DNA, 16 bp, Artificial Sequence
  synthetic [barcode part1]
cagttctgttggtgtt

SEQ ID NO: 17079 - DNA, 16 bp, Artificial Sequence
  synthetic [barcode part1]
aagaatctaacgcgtg

SEQ ID NO: 17080 - DNA, 16 bp, Artificial Sequence
  synthetic [barcode part1]
cactctctcaagttag

SEQ ID NO: 17081 - DNA, 16 bp, Artificial Sequence
  synthetic [barcode part1]
agattgcgtctctatc

SEQ ID NO: 17082 - DNA, 16 bp, Artificial Sequence
  synthetic [barcode part1]
agacctggagtcaggt

SEQ ID NO: 17083 - DNA, 16 bp, Artificial Sequence
  synthetic [barcode part1]
aacaactccttgcgtt

SEQ ID NO: 17084 - DNA, 16 bp, Artificial Sequence
  synthetic [barcode part1]
aacgattcacggaagt

SEQ ID NO: 17085 - DNA, 16 bp, Artificial Sequence
  synthetic [barcode part1]
tggtactattcgttcg

SEQ ID NO: 17086 - DNA, 16 bp, Artificial Sequence
  synthetic [barcode part1]
agaagtattcggcaac

SEQ ID NO: 17087 - DNA, 16 bp, Artificial Sequence
  synthetic [barcode part1]
cacggacagatctatc

SEQ ID NO: 17088 - DNA, 16 bp, Artificial Sequence
  synthetic [barcode part1]
tgaacgcagagtagtt

SEQ ID NO: 17089 - DNA, 16 bp, Artificial Sequence
  synthetic [barcode part1]
gcacaagttgtgtctg

SEQ ID NO: 17090 - DNA, 16 bp, Artificial Sequence
  synthetic [barcode part1]
tcgcggttgattaacg

SEQ ID NO: 17091 - DNA, 16 bp, Artificial Sequence
  synthetic [barcode part1]
gccacttagtgagatc

SEQ ID NO: 17092 - DNA, 16 bp, Artificial Sequence
  synthetic [barcode part1]
gtaggacaccttactg

SEQ ID NO: 17093 - DNA, 16 bp, Artificial Sequence
  synthetic [barcode part1]
tcctagtatacctggt

SEQ ID NO: 17094 - DNA, 16 bp, Artificial Sequence
  synthetic [barcode part1]
cgaaccacacacctct

SEQ ID NO: 17095 - DNA, 16 bp, Artificial Sequence
  synthetic [barcode part1]
attgcctcaccgttct

SEQ ID NO: 17096 - DNA, 16 bp, Artificial Sequence
  synthetic [barcode part1]
tctgtccacttgtctg

SEQ ID NO: 17097 - DNA, 16 bp, Artificial Sequence
  synthetic [barcode part1]
gttgtgtgatcacgtg

SEQ ID NO: 17098 - DNA, 16 bp, Artificial Sequence
  synthetic [barcode part1]
cagtgcgccttattgc

SEQ ID NO: 17099 - DNA, 16 bp, Artificial Sequence
  synthetic [barcode part1]
gcagaccaggacaatc

SEQ ID NO: 17100 - DNA, 16 bp, Artificial Sequence
  synthetic [barcode part1]
actattccgtcgtctc

SEQ ID NO: 17101 - DNA, 16 bp, Artificial Sequence
  synthetic [barcode part1]
ttgtcagtgcaagaag

SEQ ID NO: 17102 - DNA, 16 bp, Artificial Sequence
  synthetic [barcode part1]
caggccttggagtaag

SEQ ID NO: 17103 - DNA, 16 bp, Artificial Sequence
  synthetic [barcode part1]
agtaacagtctgtgag

SEQ ID NO: 17104 - DNA, 16 bp, Artificial Sequence
  synthetic [barcode part1]
gccgacgatagttgtt

SEQ ID NO: 17105 - DNA, 16 bp, Artificial Sequence
  synthetic [barcode part1]
acggcgtaactctaac

SEQ ID NO: 17106 - DNA, 16 bp, Artificial Sequence
  synthetic [barcode part1]
tcctattacggcgaag

SEQ ID NO: 17107 - DNA, 16 bp, Artificial Sequence
  synthetic [barcode part1]
aactagtgcacgcact

SEQ ID NO: 17108 - DNA, 16 bp, Artificial Sequence
  synthetic [barcode part1]
acactcaacctacgag

SEQ ID NO: 17109 - DNA, 16 bp, Artificial Sequence
  synthetic [barcode part1]
gttacggtcgtagtgt

SEQ ID NO: 17110 - DNA, 16 bp, Artificial Sequence
  synthetic [barcode part1]
gtcagatacaagagtc

SEQ ID NO: 17111 - DNA, 16 bp, Artificial Sequence
  synthetic [barcode part1]
cctcctctaattgacc

SEQ ID NO: 17112 - DNA, 16 bp, Artificial Sequence
  synthetic [barcode part1]
tccaccgaggatagtt

SEQ ID NO: 17113 - DNA, 16 bp, Artificial Sequence
  synthetic [barcode part1]
ccagatagtggatctc

SEQ ID NO: 17114 - DNA, 16 bp, Artificial Sequence
  synthetic [barcode part1]
tagttctcggccgtac

SEQ ID NO: 17115 - DNA, 16 bp, Artificial Sequence
  synthetic [barcode part1]
cctaccactagacacc

SEQ ID NO: 17116 - DNA, 16 bp, Artificial Sequence
  synthetic [barcode part1]
taacagtgccgagtct

SEQ ID NO: 17117 - DNA, 16 bp, Artificial Sequence
  synthetic [barcode part1]
gaagattataccgacg

SEQ ID NO: 17118 - DNA, 16 bp, Artificial Sequence
  synthetic [barcode part1]
tcttcggcacgtaacc

SEQ ID NO: 17119 - DNA, 16 bp, Artificial Sequence
  synthetic [barcode part1]
ttagttctcacgcggc

SEQ ID NO: 17120 - DNA, 16 bp, Artificial Sequence
  synthetic [barcode part1]
gattcaccgagacgag

SEQ ID NO: 17121 - DNA, 16 bp, Artificial Sequence
  synthetic [barcode part1]
tcagttgcacagtacg

SEQ ID NO: 17122 - DNA, 16 bp, Artificial Sequence
  synthetic [barcode part1]
tcctctgagtagtgag

SEQ ID NO: 17123 - DNA, 16 bp, Artificial Sequence
  synthetic [barcode part1]
tccgttgcgcgaattc

SEQ ID NO: 17124 - DNA, 16 bp, Artificial Sequence
  synthetic [barcode part1]
accaacggtgactgtt

SEQ ID NO: 17125 - DNA, 16 bp, Artificial Sequence
  synthetic [barcode part1]
cggcaatcaatccagt

SEQ ID NO: 17126 - DNA, 16 bp, Artificial Sequence
  synthetic [barcode part1]
cgcctatattctagac

SEQ ID NO: 17127 - DNA, 16 bp, Artificial Sequence
  synthetic [barcode part1]
cacgtaagtggaacgc

SEQ ID NO: 17128 - DNA, 16 bp, Artificial Sequence
  synthetic [barcode part1]
aattgcgccagaaggc

SEQ ID NO: 17129 - DNA, 16 bp, Artificial Sequence
  synthetic [barcode part1]
gagacttctcgaagtc

SEQ ID NO: 17130 - DNA, 16 bp, Artificial Sequence
  synthetic [barcode part1]
ttggcctggattgaac

SEQ ID NO: 17131 - DNA, 16 bp, Artificial Sequence
  synthetic [barcode part1]
tgtagacgagtctacc

SEQ ID NO: 17132 - DNA, 16 bp, Artificial Sequence
  synthetic [barcode part1]
atattcaccacaggcg

SEQ ID NO: 17133 - DNA, 16 bp, Artificial Sequence
  synthetic [barcode part1]
ccagttctctgcagac

SEQ ID NO: 17134 - DNA, 16 bp, Artificial Sequence
  synthetic [barcode part1]
gactggaagacacctg

SEQ ID NO: 17135 - DNA, 16 bp, Artificial Sequence
  synthetic [barcode part1]
gcaatcagagatcggc

SEQ ID NO: 17136 - DNA, 16 bp, Artificial Sequence
  synthetic [barcode part1]
tacgaggacactcttg

SEQ ID NO: 17137 - DNA, 16 bp, Artificial Sequence
  synthetic [barcode part1]
cctgattgagactggt

SEQ ID NO: 17138 - DNA, 16 bp, Artificial Sequence
  synthetic [barcode part1]
tgttagagtctccgtt

SEQ ID NO: 17139 - DNA, 16 bp, Artificial Sequence
  synthetic [barcode part1]
tgtctcgtaggtgtcc

SEQ ID NO: 17140 - DNA, 16 bp, Artificial Sequence
  synthetic [barcode part1]
accagagtaactgtag

SEQ ID NO: 17141 - DNA, 16 bp, Artificial Sequence
  synthetic [barcode part1]
tgcgtcttgtcttcac

SEQ ID NO: 17142 - DNA, 16 bp, Artificial Sequence
  synthetic [barcode part1]
gtgcagtacgtcaact

SEQ ID NO: 17143 - DNA, 16 bp, Artificial Sequence
  synthetic [barcode part1]
ccacttgtcacgacac

SEQ ID NO: 17144 - DNA, 16 bp, Artificial Sequence
  synthetic [barcode part1]
tattcctagagacgcg

SEQ ID NO: 17145 - DNA, 16 bp, Artificial Sequence
  synthetic [barcode part1]
atcttctctccaaccg

SEQ ID NO: 17146 - DNA, 16 bp, Artificial Sequence
  synthetic [barcode part1]
atcagatcctacacct

SEQ ID NO: 17147 - DNA, 16 bp, Artificial Sequence
  synthetic [barcode part1]
acgcgtgatacgtatc

SEQ ID NO: 17148 - DNA, 16 bp, Artificial Sequence
  synthetic [barcode part1]
tcgtatcaggtgtggt

SEQ ID NO: 17149 - DNA, 16 bp, Artificial Sequence
  synthetic [barcode part1]
agtcgttggcaatctg

SEQ ID NO: 17150 - DNA, 16 bp, Artificial Sequence
  synthetic [barcode part1]
gcggttcacaagagtg

SEQ ID NO: 17151 - DNA, 16 bp, Artificial Sequence
  synthetic [barcode part1]
gaggccttatctattc

SEQ ID NO: 17152 - DNA, 16 bp, Artificial Sequence
  synthetic [barcode part1]
acaataggttcgagtg

SEQ ID NO: 17153 - DNA, 16 bp, Artificial Sequence
  synthetic [barcode part1]
atagtcgagagtcggc

SEQ ID NO: 17154 - DNA, 16 bp, Artificial Sequence
  synthetic [barcode part1]
gtcctgtcttgtggac

SEQ ID NO: 17155 - DNA, 16 bp, Artificial Sequence
  synthetic [barcode part1]
gacactgtggttggtt

SEQ ID NO: 17156 - DNA, 16 bp, Artificial Sequence
  synthetic [barcode part1]
tccgtggactctgttg

SEQ ID NO: 17157 - DNA, 16 bp, Artificial Sequence
  synthetic [barcode part1]
actggacctgttgagt

SEQ ID NO: 17158 - DNA, 16 bp, Artificial Sequence
  synthetic [barcode part1]
gagtatcagtgaagtc

SEQ ID NO: 17159 - DNA, 16 bp, Artificial Sequence
  synthetic [barcode part1]
aaccacggagagacct

SEQ ID NO: 17160 - DNA, 16 bp, Artificial Sequence
  synthetic [barcode part1]
ccgatccgcgattact

SEQ ID NO: 17161 - DNA, 16 bp, Artificial Sequence
  synthetic [barcode part1]
cctgaatactcttcag

SEQ ID NO: 17162 - DNA, 16 bp, Artificial Sequence
  synthetic [barcode part1]
tggcgtgatacttgac

SEQ ID NO: 17163 - DNA, 16 bp, Artificial Sequence
  synthetic [barcode part1]
tcctcaggttgtatac

SEQ ID NO: 17164 - DNA, 16 bp, Artificial Sequence
  synthetic [barcode part1]
tggtaggagtgcctag

SEQ ID NO: 17165 - DNA, 16 bp, Artificial Sequence
  synthetic [barcode part1]
actagacagtgcggac

SEQ ID NO: 17166 - DNA, 16 bp, Artificial Sequence
  synthetic [barcode part1]
aggaataacttccgcc

SEQ ID NO: 17167 - DNA, 16 bp, Artificial Sequence
  synthetic [barcode part1]
actgacgttcgcaagt

SEQ ID NO: 17168 - DNA, 16 bp, Artificial Sequence
  synthetic [barcode part1]
gtcctgtaacagtgac

SEQ ID NO: 17169 - DNA, 16 bp, Artificial Sequence
  synthetic [barcode part1]
ttccgtgtagtccgac

SEQ ID NO: 17170 - DNA, 16 bp, Artificial Sequence
  synthetic [barcode part1]
aactaatcaacgccgc

SEQ ID NO: 17171 - DNA, 16 bp, Artificial Sequence
  synthetic [barcode part1]
cggccttgaagaactt

SEQ ID NO: 17172 - DNA, 16 bp, Artificial Sequence
  synthetic [barcode part1]
cactgaaggtgacttc

SEQ ID NO: 17173 - DNA, 16 bp, Artificial Sequence
  synthetic [barcode part1]
agttgcagtcagtacc

SEQ ID NO: 17174 - DNA, 16 bp, Artificial Sequence
  synthetic [barcode part1]
accagtacttgacttc

SEQ ID NO: 17175 - DNA, 16 bp, Artificial Sequence
  synthetic [barcode part1]
tctctagtggttgtgt

SEQ ID NO: 17176 - DNA, 16 bp, Artificial Sequence
  synthetic [barcode part1]
gttgaggtggtcacag

SEQ ID NO: 17177 - DNA, 16 bp, Artificial Sequence
  synthetic [barcode part1]
acaggtccaattctct

SEQ ID NO: 17178 - DNA, 16 bp, Artificial Sequence
  synthetic [barcode part1]
gaagacgtcactaggc

SEQ ID NO: 17179 - DNA, 16 bp, Artificial Sequence
  synthetic [barcode part1]
ttccagagtccgttcg

SEQ ID NO: 17180 - DNA, 16 bp, Artificial Sequence
  synthetic [barcode part1]
tcttaggttcacctag

SEQ ID NO: 17181 - DNA, 16 bp, Artificial Sequence
  synthetic [barcode part1]
cactaccacaattacc

SEQ ID NO: 17182 - DNA, 16 bp, Artificial Sequence
  synthetic [barcode part1]
taccacaagtctcgag

SEQ ID NO: 17183 - DNA, 16 bp, Artificial Sequence
  synthetic [barcode part1]
tcaagactggaacctc

SEQ ID NO: 17184 - DNA, 16 bp, Artificial Sequence
  synthetic [barcode part1]
ccgtgtgtatacaacg

SEQ ID NO: 17185 - DNA, 16 bp, Artificial Sequence
  synthetic [barcode part1]
gtcgaagttccaactg

SEQ ID NO: 17186 - DNA, 16 bp, Artificial Sequence
  synthetic [barcode part1]
ttacgagaggccgaac

SEQ ID NO: 17187 - DNA, 16 bp, Artificial Sequence
  synthetic [barcode part1]
tgacactgacgaatag

SEQ ID NO: 17188 - DNA, 16 bp, Artificial Sequence
  synthetic [barcode part1]
ttgcaggttcggcctt

SEQ ID NO: 17189 - DNA, 16 bp, Artificial Sequence
  synthetic [barcode part1]
ttcggtaggtaatccg

SEQ ID NO: 17190 - DNA, 16 bp, Artificial Sequence
  synthetic [barcode part1]
atagttaccgacttcc

SEQ ID NO: 17191 - DNA, 16 bp, Artificial Sequence
  synthetic [barcode part1]
accgtataggacgacg

SEQ ID NO: 17192 - DNA, 16 bp, Artificial Sequence
  synthetic [barcode part1]
ccagttatcctcttcg

SEQ ID NO: 17193 - DNA, 16 bp, Artificial Sequence
  synthetic [barcode part1]
acacctctcgaaccac

SEQ ID NO: 17194 - DNA, 16 bp, Artificial Sequence
  synthetic [barcode part1]
tcgttaccaagtacct

SEQ ID NO: 17195 - DNA, 16 bp, Artificial Sequence
  synthetic [barcode part1]
gccgcctaatacctac

SEQ ID NO: 17196 - DNA, 16 bp, Artificial Sequence
  synthetic [barcode part1]
cggcaatcacgttcct

SEQ ID NO: 17197 - DNA, 16 bp, Artificial Sequence
  synthetic [barcode part1]
tggtgagagacaacag

SEQ ID NO: 17198 - DNA, 16 bp, Artificial Sequence
  synthetic [barcode part1]
cggtaaggtctacgag

SEQ ID NO: 17199 - DNA, 16 bp, Artificial Sequence
  synthetic [barcode part1]
atataacggtctcctc

SEQ ID NO: 17200 - DNA, 16 bp, Artificial Sequence
  synthetic [barcode part1]
tgcacctcctagtgac

SEQ ID NO: 17201 - DNA, 16 bp, Artificial Sequence
  synthetic [barcode part1]
ttacgactcggaactg

SEQ ID NO: 17202 - DNA, 16 bp, Artificial Sequence
  synthetic [barcode part1]
agtacggcctatatcg

SEQ ID NO: 17203 - DNA, 16 bp, Artificial Sequence
  synthetic [barcode part1]
gttaccagtcagactg

SEQ ID NO: 17204 - DNA, 16 bp, Artificial Sequence
  synthetic [barcode part1]
caatcttacacgttgc

SEQ ID NO: 17205 - DNA, 16 bp, Artificial Sequence
  synthetic [barcode part1]
caacgagtcgtagacg

SEQ ID NO: 17206 - DNA, 16 bp, Artificial Sequence
  synthetic [barcode part1]
tcaacacaagaagtcg

SEQ ID NO: 17207 - DNA, 16 bp, Artificial Sequence
  synthetic [barcode part1]
gcgagtaatagtatcg

SEQ ID NO: 17208 - DNA, 16 bp, Artificial Sequence
  synthetic [barcode part1]
acgattcaatacggag

SEQ ID NO: 17209 - DNA, 16 bp, Artificial Sequence
  synthetic [barcode part1]
cctatattgacagtcc

SEQ ID NO: 17210 - DNA, 16 bp, Artificial Sequence
  synthetic [barcode part1]
tcaagtgtggagtaac

SEQ ID NO: 17211 - DNA, 16 bp, Artificial Sequence
  synthetic [barcode part1]
ccgcaactggtattag

SEQ ID NO: 17212 - DNA, 16 bp, Artificial Sequence
  synthetic [barcode part1]
tgcacctaagtgcaac

SEQ ID NO: 17213 - DNA, 16 bp, Artificial Sequence
  synthetic [barcode part1]
ccgtgttggattgtcc

SEQ ID NO: 17214 - DNA, 16 bp, Artificial Sequence
  synthetic [barcode part1]
ttggtacgaggaaccg

SEQ ID NO: 17215 - DNA, 16 bp, Artificial Sequence
  synthetic [barcode part1]
tgcacaatctggcctc

SEQ ID NO: 17216 - DNA, 16 bp, Artificial Sequence
  synthetic [barcode part1]
atataggcaagttgcg

SEQ ID NO: 17217 - DNA, 16 bp, Artificial Sequence
  synthetic [barcode part1]
tagagttggtctcggt

SEQ ID NO: 17218 - DNA, 16 bp, Artificial Sequence
  synthetic [barcode part1]
tgccgtgtgatatcag

SEQ ID NO: 17219 - DNA, 16 bp, Artificial Sequence
  synthetic [barcode part1]
tcacctgacaggtaac

SEQ ID NO: 17220 - DNA, 16 bp, Artificial Sequence
  synthetic [barcode part1]
aattacgcctcaacct

SEQ ID NO: 17221 - DNA, 16 bp, Artificial Sequence
  synthetic [barcode part1]
agataggataacgcct

SEQ ID NO: 17222 - DNA, 16 bp, Artificial Sequence
  synthetic [barcode part1]
agaaggtccgtcactt

SEQ ID NO: 17223 - DNA, 16 bp, Artificial Sequence
  synthetic [barcode part1]
tattcgtcgttacgac

SEQ ID NO: 17224 - DNA, 16 bp, Artificial Sequence
  synthetic [barcode part1]
gagacacaccagatcg

SEQ ID NO: 17225 - DNA, 16 bp, Artificial Sequence
  synthetic [barcode part1]
tcagaacgaacggacc

SEQ ID NO: 17226 - DNA, 16 bp, Artificial Sequence
  synthetic [barcode part1]
cagtatcgtccacctg

SEQ ID NO: 17227 - DNA, 16 bp, Artificial Sequence
  synthetic [barcode part1]
ccacgacgtattgtag

SEQ ID NO: 17228 - DNA, 16 bp, Artificial Sequence
  synthetic [barcode part1]
ttcacgcggaatacac

SEQ ID NO: 17229 - DNA, 16 bp, Artificial Sequence
  synthetic [barcode part1]
tcaggactaaggcctt

SEQ ID NO: 17230 - DNA, 16 bp, Artificial Sequence
  synthetic [barcode part1]
acgaacgagtgtcgtg

SEQ ID NO: 17231 - DNA, 16 bp, Artificial Sequence
  synthetic [barcode part1]
tctaggtagaccggag

SEQ ID NO: 17232 - DNA, 16 bp, Artificial Sequence
  synthetic [barcode part1]
cagagacagtgactcg

SEQ ID NO: 17233 - DNA, 16 bp, Artificial Sequence
  synthetic [barcode part1]
gcgtagtactacgtgt

SEQ ID NO: 17234 - DNA, 16 bp, Artificial Sequence
  synthetic [barcode part1]
gcgcactatagaatag

SEQ ID NO: 17235 - DNA, 16 bp, Artificial Sequence
  synthetic [barcode part1]
gcctagatagacacct

SEQ ID NO: 17236 - DNA, 16 bp, Artificial Sequence
  synthetic [barcode part1]
gtactgaactgtcttc

SEQ ID NO: 17237 - DNA, 16 bp, Artificial Sequence
  synthetic [barcode part1]
actcttaccgttgaac

SEQ ID NO: 17238 - DNA, 16 bp, Artificial Sequence
  synthetic [barcode part1]
cgcagtacgagattct

SEQ ID NO: 17239 - DNA, 16 bp, Artificial Sequence
  synthetic [barcode part1]
aacctctccaggcact

SEQ ID NO: 17240 - DNA, 16 bp, Artificial Sequence
  synthetic [barcode part1]
accggtcgattaatcg

SEQ ID NO: 17241 - DNA, 16 bp, Artificial Sequence
  synthetic [barcode part1]
atcgtacaacctgcag

SEQ ID NO: 17242 - DNA, 16 bp, Artificial Sequence
  synthetic [barcode part1]
acacgcgttaagatcc

SEQ ID NO: 17243 - DNA, 16 bp, Artificial Sequence
  synthetic [barcode part1]
tgaaccagatcactgc

SEQ ID NO: 17244 - DNA, 16 bp, Artificial Sequence
  synthetic [barcode part1]
ttgtatcacgacttgc

SEQ ID NO: 17245 - DNA, 16 bp, Artificial Sequence
  synthetic [barcode part1]
tcggtgcctaattccg

SEQ ID NO: 17246 - DNA, 16 bp, Artificial Sequence
  synthetic [barcode part1]
gacaacctggtgactt

SEQ ID NO: 17247 - DNA, 16 bp, Artificial Sequence
  synthetic [barcode part1]
taggtctgtctgtgag

SEQ ID NO: 17248 - DNA, 16 bp, Artificial Sequence
  synthetic [barcode part1]
ttcttggtacggttgt

SEQ ID NO: 17249 - DNA, 16 bp, Artificial Sequence
  synthetic [barcode part1]
gcaactgtaatcgcgt

SEQ ID NO: 17250 - DNA, 16 bp, Artificial Sequence
  synthetic [barcode part1]
tgacggatctgaatag

SEQ ID NO: 17251 - DNA, 16 bp, Artificial Sequence
  synthetic [barcode part1]
actcctatcgtgcctt

SEQ ID NO: 17252 - DNA, 16 bp, Artificial Sequence
  synthetic [barcode part1]
gttcttgtcacgcctt

SEQ ID NO: 17253 - DNA, 16 bp, Artificial Sequence
  synthetic [barcode part1]
ttggaacagacaagtc

SEQ ID NO: 17254 - DNA, 16 bp, Artificial Sequence
  synthetic [barcode part1]
tgtcctaagatccgtt

SEQ ID NO: 17255 - DNA, 16 bp, Artificial Sequence
  synthetic [barcode part1]
tacttaccacctgtcc

SEQ ID NO: 17256 - DNA, 16 bp, Artificial Sequence
  synthetic [barcode part1]
ccgattccaccgatac

SEQ ID NO: 17257 - DNA, 16 bp, Artificial Sequence
  synthetic [barcode part1]
tgcgattgaagatcag

SEQ ID NO: 17258 - DNA, 16 bp, Artificial Sequence
  synthetic [barcode part1]
tcttacaccagtagtc

SEQ ID NO: 17259 - DNA, 16 bp, Artificial Sequence
  synthetic [barcode part1]
ttgcgaatcgcgtaac

SEQ ID NO: 17260 - DNA, 16 bp, Artificial Sequence
  synthetic [barcode part1]
atcttgtgtgaggcac

SEQ ID NO: 17261 - DNA, 16 bp, Artificial Sequence
  synthetic [barcode part1]
tgttgttcgtcggcac

SEQ ID NO: 17262 - DNA, 16 bp, Artificial Sequence
  synthetic [barcode part1]
agtctcctgacagaac

SEQ ID NO: 17263 - DNA, 16 bp, Artificial Sequence
  synthetic [barcode part1]
tgaaccagtgtcctcc

SEQ ID NO: 17264 - DNA, 16 bp, Artificial Sequence
  synthetic [barcode part1]
ttgtcgccttatcacc

SEQ ID NO: 17265 - DNA, 16 bp, Artificial Sequence
  synthetic [barcode part1]
agttcctcgcaccagt

SEQ ID NO: 17266 - DNA, 16 bp, Artificial Sequence
  synthetic [barcode part1]
cagtgtggatctgtgt

SEQ ID NO: 17267 - DNA, 16 bp, Artificial Sequence
  synthetic [barcode part1]
cacgtcgtgtaatcag

SEQ ID NO: 17268 - DNA, 16 bp, Artificial Sequence
  synthetic [barcode part1]
gtatctgtcactctag

SEQ ID NO: 17269 - DNA, 16 bp, Artificial Sequence
  synthetic [barcode part1]
acctagagacggaacc

SEQ ID NO: 17270 - DNA, 16 bp, Artificial Sequence
  synthetic [barcode part1]
gtgttgaggaatagtc

SEQ ID NO: 17271 - DNA, 16 bp, Artificial Sequence
  synthetic [barcode part1]
cggaagtagattatcg

SEQ ID NO: 17272 - DNA, 16 bp, Artificial Sequence
  synthetic [barcode part1]
tgactacacctaggtg

SEQ ID NO: 17273 - DNA, 16 bp, Artificial Sequence
  synthetic [barcode part1]
agacctgcgaatctgt

SEQ ID NO: 17274 - DNA, 16 bp, Artificial Sequence
  synthetic [barcode part1]
tgcgtcggaagtcaag

SEQ ID NO: 17275 - DNA, 16 bp, Artificial Sequence
  synthetic [barcode part1]
cgtagtacactcgtcc

SEQ ID NO: 17276 - DNA, 16 bp, Artificial Sequence
  synthetic [barcode part1]
gtagagagaaggcgtt

SEQ ID NO: 17277 - DNA, 16 bp, Artificial Sequence
  synthetic [barcode part1]
caagtctggtgtctag

SEQ ID NO: 17278 - DNA, 16 bp, Artificial Sequence
  synthetic [barcode part1]
gtgcagtaagattggt

SEQ ID NO: 17279 - DNA, 16 bp, Artificial Sequence
  synthetic [barcode part1]
gcctattgacgagtgt

SEQ ID NO: 17280 - DNA, 16 bp, Artificial Sequence
  synthetic [barcode part1]
aagtggaacttcgagt

SEQ ID NO: 17281 - DNA, 16 bp, Artificial Sequence
  synthetic [barcode part1]
aagtagtccaggtgcg

SEQ ID NO: 17282 - DNA, 16 bp, Artificial Sequence
  synthetic [barcode part1]
acggaaccagacgttg

SEQ ID NO: 17283 - DNA, 16 bp, Artificial Sequence
  synthetic [barcode part1]
ttgttacacaggttcc

SEQ ID NO: 17284 - DNA, 16 bp, Artificial Sequence
  synthetic [barcode part1]
gagtcgagttgcgtag

SEQ ID NO: 17285 - DNA, 16 bp, Artificial Sequence
  synthetic [barcode part1]
ttggtagagtgtgaac

SEQ ID NO: 17286 - DNA, 16 bp, Artificial Sequence
  synthetic [barcode part1]
atagaagtggcctaac

SEQ ID NO: 17287 - DNA, 16 bp, Artificial Sequence
  synthetic [barcode part1]
tgagttggatcactgc

SEQ ID NO: 17288 - DNA, 16 bp, Artificial Sequence
  synthetic [barcode part1]
gtatacgactgcaacc

SEQ ID NO: 17289 - DNA, 16 bp, Artificial Sequence
  synthetic [barcode part1]
tgagtacagaagtcac

SEQ ID NO: 17290 - DNA, 16 bp, Artificial Sequence
  synthetic [barcode part1]
gcacaccgacaacaag

SEQ ID NO: 17291 - DNA, 16 bp, Artificial Sequence
  synthetic [barcode part1]
tccacgcaatctgatt

SEQ ID NO: 17292 - DNA, 16 bp, Artificial Sequence
  synthetic [barcode part1]
tctacgccggtctaac

SEQ ID NO: 17293 - DNA, 16 bp, Artificial Sequence
  synthetic [barcode part1]
attattggtgcgagag

SEQ ID NO: 17294 - DNA, 16 bp, Artificial Sequence
  synthetic [barcode part1]
ccaatcttgttggtgt

SEQ ID NO: 17295 - DNA, 16 bp, Artificial Sequence
  synthetic [barcode part1]
ttctgtatcggatcac

SEQ ID NO: 17296 - DNA, 16 bp, Artificial Sequence
  synthetic [barcode part1]
taggcagacctattcg

SEQ ID NO: 17297 - DNA, 16 bp, Artificial Sequence
  synthetic [barcode part1]
acagtcgaggattagt

SEQ ID NO: 17298 - DNA, 16 bp, Artificial Sequence
  synthetic [barcode part1]
gaatccgcaccttatt

SEQ ID NO: 17299 - DNA, 16 bp, Artificial Sequence
  synthetic [barcode part1]
gtagactgaggaccac

SEQ ID NO: 17300 - DNA, 16 bp, Artificial Sequence
  synthetic [barcode part1]
gcgttcttacgtcttc

SEQ ID NO: 17301 - DNA, 16 bp, Artificial Sequence
  synthetic [barcode part1]
aacgccggttgattac

SEQ ID NO: 17302 - DNA, 16 bp, Artificial Sequence
  synthetic [barcode part1]
tactaggcagactgtc

SEQ ID NO: 17303 - DNA, 16 bp, Artificial Sequence
  synthetic [barcode part1]
ttcggttgtcagtact

SEQ ID NO: 17304 - DNA, 16 bp, Artificial Sequence
  synthetic [barcode part1]
tcacggagtctgaact

SEQ ID NO: 17305 - DNA, 16 bp, Artificial Sequence
  synthetic [barcode part1]
taggatcaaccttggc

SEQ ID NO: 17306 - DNA, 16 bp, Artificial Sequence
  synthetic [barcode part1]
acactacgtaacaccg

SEQ ID NO: 17307 - DNA, 16 bp, Artificial Sequence
  synthetic [barcode part1]
tggactgcgatagtct

SEQ ID NO: 17308 - DNA, 16 bp, Artificial Sequence
  synthetic [barcode part1]
cctacacttggatcgc

SEQ ID NO: 17309 - DNA, 16 bp, Artificial Sequence
  synthetic [barcode part1]
ttacgagtcgtacgac

SEQ ID NO: 17310 - DNA, 16 bp, Artificial Sequence
  synthetic [barcode part1]
acggatctcagtacgt

SEQ ID NO: 17311 - DNA, 16 bp, Artificial Sequence
  synthetic [barcode part1]
agtcacagtgtcagtc

SEQ ID NO: 17312 - DNA, 16 bp, Artificial Sequence
  synthetic [barcode part1]
ttgcgagacctagact

SEQ ID NO: 17313 - DNA, 16 bp, Artificial Sequence
  synthetic [barcode part1]
ccgaataagactcacc

SEQ ID NO: 17314 - DNA, 16 bp, Artificial Sequence
  synthetic [barcode part1]
caacgactgtatctct

SEQ ID NO: 17315 - DNA, 16 bp, Artificial Sequence
  synthetic [barcode part1]
ttaccgactcttgtag

SEQ ID NO: 17316 - DNA, 16 bp, Artificial Sequence
  synthetic [barcode part1]
acgagttgacctacac

SEQ ID NO: 17317 - DNA, 16 bp, Artificial Sequence
  synthetic [barcode part1]
gagtcagatcgacgtg

SEQ ID NO: 17318 - DNA, 16 bp, Artificial Sequence
  synthetic [barcode part1]
ttacggtgattccgag

SEQ ID NO: 17319 - DNA, 16 bp, Artificial Sequence
  synthetic [barcode part1]
atccgttagtaggcgt

SEQ ID NO: 17320 - DNA, 16 bp, Artificial Sequence
  synthetic [barcode part1]
aagtgtaggtcactag

SEQ ID NO: 17321 - DNA, 16 bp, Artificial Sequence
  synthetic [barcode part1]
agtcttgagtatcgcg

SEQ ID NO: 17322 - DNA, 16 bp, Artificial Sequence
  synthetic [barcode part1]
attcactggcaccgtc

SEQ ID NO: 17323 - DNA, 16 bp, Artificial Sequence
  synthetic [barcode part1]
cggattgtacaagagt

SEQ ID NO: 17324 - DNA, 16 bp, Artificial Sequence
  synthetic [barcode part1]
gcgaagatcttgtacc

SEQ ID NO: 17325 - DNA, 16 bp, Artificial Sequence
  synthetic [barcode part1]
ttcttagtgcgcaatc

SEQ ID NO: 17326 - DNA, 16 bp, Artificial Sequence
  synthetic [barcode part1]
actctaggtcaaccag

SEQ ID NO: 17327 - DNA, 16 bp, Artificial Sequence
  synthetic [barcode part1]
acacgatccaattctc

SEQ ID NO: 17328 - DNA, 16 bp, Artificial Sequence
  synthetic [barcode part1]
gaagtcttctgtctac

SEQ ID NO: 17329 - DNA, 16 bp, Artificial Sequence
  synthetic [barcode part1]
attggcactactactc

SEQ ID NO: 17330 - DNA, 16 bp, Artificial Sequence
  synthetic [barcode part1]
atccaccacttgtctc

SEQ ID NO: 17331 - DNA, 16 bp, Artificial Sequence
  synthetic [barcode part1]
atcctgcgtgattgcc

SEQ ID NO: 17332 - DNA, 16 bp, Artificial Sequence
  synthetic [barcode part1]
ccttcaggccgatatc

SEQ ID NO: 17333 - DNA, 16 bp, Artificial Sequence
  synthetic [barcode part1]
cctggaactaaggtct

SEQ ID NO: 17334 - DNA, 16 bp, Artificial Sequence
  synthetic [barcode part1]
gcgttggtatactgac

SEQ ID NO: 17335 - DNA, 16 bp, Artificial Sequence
  synthetic [barcode part1]
tacggcagaattccgt

SEQ ID NO: 17336 - DNA, 16 bp, Artificial Sequence
  synthetic [barcode part1]
tgttcgtggcaccgtt

SEQ ID NO: 17337 - DNA, 16 bp, Artificial Sequence
  synthetic [barcode part1]
tccacctgttccagag

SEQ ID NO: 17338 - DNA, 16 bp, Artificial Sequence
  synthetic [barcode part1]
tactgaggagtgtggc

SEQ ID NO: 17339 - DNA, 16 bp, Artificial Sequence
  synthetic [barcode part1]
aatcgcaattgacgcc

SEQ ID NO: 17340 - DNA, 16 bp, Artificial Sequence
  synthetic [barcode part1]
tcagacgcctaccact

SEQ ID NO: 17341 - DNA, 16 bp, Artificial Sequence
  synthetic [barcode part1]
gccaatatccgtgaac

SEQ ID NO: 17342 - DNA, 16 bp, Artificial Sequence
  synthetic [barcode part1]
cactgttgtgagacgt

SEQ ID NO: 17343 - DNA, 16 bp, Artificial Sequence
  synthetic [barcode part1]
accttccaatcggaag

SEQ ID NO: 17344 - DNA, 16 bp, Artificial Sequence
  synthetic [barcode part1]
tacctgtcactacagt

SEQ ID NO: 17345 - DNA, 16 bp, Artificial Sequence
  synthetic [barcode part1]
agagataagatcgtcc

SEQ ID NO: 17346 - DNA, 16 bp, Artificial Sequence
  synthetic [barcode part1]
tattgaatccacgtcc

SEQ ID NO: 17347 - DNA, 16 bp, Artificial Sequence
  synthetic [barcode part1]
gaataagtccacctgc

SEQ ID NO: 17348 - DNA, 16 bp, Artificial Sequence
  synthetic [barcode part1]
tcctagttcaacgtgt

SEQ ID NO: 17349 - DNA, 16 bp, Artificial Sequence
  synthetic [barcode part1]
tccggttgtgtatcgc

SEQ ID NO: 17350 - DNA, 16 bp, Artificial Sequence
  synthetic [barcode part1]
cgttgccttcagtctt

SEQ ID NO: 17351 - DNA, 16 bp, Artificial Sequence
  synthetic [barcode part1]
aacacaatctggtgag

SEQ ID NO: 17352 - DNA, 16 bp, Artificial Sequence
  synthetic [barcode part1]
caactacacaatcgcg

SEQ ID NO: 17353 - DNA, 16 bp, Artificial Sequence
  synthetic [barcode part1]
cgttggacttacgcct

SEQ ID NO: 17354 - DNA, 16 bp, Artificial Sequence
  synthetic [barcode part1]
agacgcagtatccttg

SEQ ID NO: 17355 - DNA, 16 bp, Artificial Sequence
  synthetic [barcode part1]
gcacacaaccacaact

SEQ ID NO: 17356 - DNA, 16 bp, Artificial Sequence
  synthetic [barcode part1]
tctagtcactgcgcgt

SEQ ID NO: 17357 - DNA, 16 bp, Artificial Sequence
  synthetic [barcode part1]
gtcctacgcagttgtc

SEQ ID NO: 17358 - DNA, 16 bp, Artificial Sequence
  synthetic [barcode part1]
aactgacgtgtgtgtc

SEQ ID NO: 17359 - DNA, 16 bp, Artificial Sequence
  synthetic [barcode part1]
ttcttggaagaggcct

SEQ ID NO: 17360 - DNA, 16 bp, Artificial Sequence
  synthetic [barcode part1]
ccagaattgaacgaac

SEQ ID NO: 17361 - DNA, 16 bp, Artificial Sequence
  synthetic [barcode part1]
tctcagaacagtgtcg

SEQ ID NO: 17362 - DNA, 16 bp, Artificial Sequence
  synthetic [barcode part1]
gaatcaccgaggacac

SEQ ID NO: 17363 - DNA, 16 bp, Artificial Sequence
  synthetic [barcode part1]
tgcgttcgttcttacc

SEQ ID NO: 17364 - DNA, 16 bp, Artificial Sequence
  synthetic [barcode part1]
tactgagtgaggatac

SEQ ID NO: 17365 - DNA, 16 bp, Artificial Sequence
  synthetic [barcode part1]
gacaccggtattacac

SEQ ID NO: 17366 - DNA, 16 bp, Artificial Sequence
  synthetic [barcode part1]
tgtacgacagattcgc

SEQ ID NO: 17367 - DNA, 16 bp, Artificial Sequence
  synthetic [barcode part1]
tacactgcctcctgag

SEQ ID NO: 17368 - DNA, 16 bp, Artificial Sequence
  synthetic [barcode part1]
acacggtcgtgtagtt

SEQ ID NO: 17369 - DNA, 16 bp, Artificial Sequence
  synthetic [barcode part1]
ttgtcttcggcaagag

SEQ ID NO: 17370 - DNA, 16 bp, Artificial Sequence
  synthetic [barcode part1]
gactctcgtgcctaac

SEQ ID NO: 17371 - DNA, 16 bp, Artificial Sequence
  synthetic [barcode part1]
cctctctcggttgatt

SEQ ID NO: 17372 - DNA, 16 bp, Artificial Sequence
  synthetic [barcode part1]
gtaggacactctatcg

SEQ ID NO: 17373 - DNA, 16 bp, Artificial Sequence
  synthetic [barcode part1]
cgactgaagaacctct

SEQ ID NO: 17374 - DNA, 16 bp, Artificial Sequence
  synthetic [barcode part1]
cgtactcacctctatc

SEQ ID NO: 17375 - DNA, 16 bp, Artificial Sequence
  synthetic [barcode part1]
taggactcacacacac

SEQ ID NO: 17376 - DNA, 16 bp, Artificial Sequence
  synthetic [barcode part1]
agtcctcagtctatac

SEQ ID NO: 17377 - DNA, 16 bp, Artificial Sequence
  synthetic [barcode part1]
ttgagtgcgtctagac

SEQ ID NO: 17378 - DNA, 16 bp, Artificial Sequence
  synthetic [barcode part1]
agtccagtagtggtct

SEQ ID NO: 17379 - DNA, 16 bp, Artificial Sequence
  synthetic [barcode part1]
acacacacaaccagtc

SEQ ID NO: 17380 - DNA, 16 bp, Artificial Sequence
  synthetic [barcode part1]
tgttaccacctgaact

SEQ ID NO: 17381 - DNA, 16 bp, Artificial Sequence
  synthetic [barcode part1]
gtgcctctcgagttgt

SEQ ID NO: 17382 - DNA, 16 bp, Artificial Sequence
  synthetic [barcode part1]
aatcttcaaggcgacc

SEQ ID NO: 17383 - DNA, 16 bp, Artificial Sequence
  synthetic [barcode part1]
taacgcgagtcgtgtt

SEQ ID NO: 17384 - DNA, 16 bp, Artificial Sequence
  synthetic [barcode part1]
aacctacctcagacag

SEQ ID NO: 17385 - DNA, 16 bp, Artificial Sequence
  synthetic [barcode part1]
tgacgtacgtattggc

SEQ ID NO: 17386 - DNA, 16 bp, Artificial Sequence
  synthetic [barcode part1]
cgttgtcacaactgcc

SEQ ID NO: 17387 - DNA, 16 bp, Artificial Sequence
  synthetic [barcode part1]
gcctgagtctactacc

SEQ ID NO: 17388 - DNA, 16 bp, Artificial Sequence
  synthetic [barcode part1]
cgagtatcaatctctc

SEQ ID NO: 17389 - DNA, 16 bp, Artificial Sequence
  synthetic [barcode part1]
tatcgaggttcaacgc

SEQ ID NO: 17390 - DNA, 16 bp, Artificial Sequence
  synthetic [barcode part1]
gtgagtgagtgaacag

SEQ ID NO: 17391 - DNA, 16 bp, Artificial Sequence
  synthetic [barcode part1]
tcgttccgtgcctaag

SEQ ID NO: 17392 - DNA, 16 bp, Artificial Sequence
  synthetic [barcode part1]
ttcacttggataggcg

SEQ ID NO: 17393 - DNA, 16 bp, Artificial Sequence
  synthetic [barcode part1]
gtgtgcgaacttcaac

SEQ ID NO: 17394 - DNA, 16 bp, Artificial Sequence
  synthetic [barcode part1]
ccaagacagaccttgt

SEQ ID NO: 17395 - DNA, 16 bp, Artificial Sequence
  synthetic [barcode part1]
gtgactaccgaaggac

SEQ ID NO: 17396 - DNA, 16 bp, Artificial Sequence
  synthetic [barcode part1]
gtcctcaatagaggtc

SEQ ID NO: 17397 - DNA, 16 bp, Artificial Sequence
  synthetic [barcode part1]
taccaccgaacactcc

SEQ ID NO: 17398 - DNA, 16 bp, Artificial Sequence
  synthetic [barcode part1]
tgttccgtccgaacac

SEQ ID NO: 17399 - DNA, 16 bp, Artificial Sequence
  synthetic [barcode part1]
gcgtaacgaagttagt

SEQ ID NO: 17400 - DNA, 16 bp, Artificial Sequence
  synthetic [barcode part1]
gagataagtccgtggc

SEQ ID NO: 17401 - DNA, 16 bp, Artificial Sequence
  synthetic [barcode part1]
tgagacgacggaatag

SEQ ID NO: 17402 - DNA, 16 bp, Artificial Sequence
  synthetic [barcode part1]
cctcctcttaagactc

SEQ ID NO: 17403 - DNA, 16 bp, Artificial Sequence
  synthetic [barcode part1]
aacactctctgtggag

SEQ ID NO: 17404 - DNA, 16 bp, Artificial Sequence
  synthetic [barcode part1]
agtcgtacaaccgtac

SEQ ID NO: 17405 - DNA, 16 bp, Artificial Sequence
  synthetic [barcode part1]
ttggtgagaactgtcc

SEQ ID NO: 17406 - DNA, 16 bp, Artificial Sequence
  synthetic [barcode part1]
gaaggtcaatcctctg

SEQ ID NO: 17407 - DNA, 16 bp, Artificial Sequence
  synthetic [barcode part1]
tccttcttcgattggc

SEQ ID NO: 17408 - DNA, 16 bp, Artificial Sequence
  synthetic [barcode part1]
ttggacttacgagaag

SEQ ID NO: 17409 - DNA, 16 bp, Artificial Sequence
  synthetic [barcode part1]
gcgccttccagtaact

SEQ ID NO: 17410 - DNA, 16 bp, Artificial Sequence
  synthetic [barcode part1]
aggttctcgattgacg

SEQ ID NO: 17411 - DNA, 16 bp, Artificial Sequence
  synthetic [barcode part1]
tctacgcactattgac

SEQ ID NO: 17412 - DNA, 16 bp, Artificial Sequence
  synthetic [barcode part1]
gcgtctgcctattacg

SEQ ID NO: 17413 - DNA, 16 bp, Artificial Sequence
  synthetic [barcode part1]
tatccacaacgtcact

SEQ ID NO: 17414 - DNA, 16 bp, Artificial Sequence
  synthetic [barcode part1]
agacagacgaagtctt

SEQ ID NO: 17415 - DNA, 16 bp, Artificial Sequence
  synthetic [barcode part1]
tctggtccttcaactc

SEQ ID NO: 17416 - DNA, 16 bp, Artificial Sequence
  synthetic [barcode part1]
gtagagaaccgtcggt

SEQ ID NO: 17417 - DNA, 16 bp, Artificial Sequence
  synthetic [barcode part1]
ttaccgtcgtcgtctt

SEQ ID NO: 17418 - DNA, 16 bp, Artificial Sequence
  synthetic [barcode part1]
gcactgacaacttctt

SEQ ID NO: 17419 - DNA, 16 bp, Artificial Sequence
  synthetic [barcode part1]
actccacagactagac

SEQ ID NO: 17420 - DNA, 16 bp, Artificial Sequence
  synthetic [barcode part1]
agtatcagtgccacgt

SEQ ID NO: 17421 - DNA, 16 bp, Artificial Sequence
  synthetic [barcode part1]
ttgaacgatctcactc

SEQ ID NO: 17422 - DNA, 16 bp, Artificial Sequence
  synthetic [barcode part1]
tgtgccggatcagaag

SEQ ID NO: 17423 - DNA, 16 bp, Artificial Sequence
  synthetic [barcode part1]
aatccagaggaatacc

SEQ ID NO: 17424 - DNA, 16 bp, Artificial Sequence
  synthetic [barcode part1]
tggtcgaagtctcagt

SEQ ID NO: 17425 - DNA, 16 bp, Artificial Sequence
  synthetic [barcode part1]
tgttgacctagagaag

SEQ ID NO: 17426 - DNA, 16 bp, Artificial Sequence
  synthetic [barcode part1]
tgatagacgttcagag

SEQ ID NO: 17427 - DNA, 16 bp, Artificial Sequence
  synthetic [barcode part1]
ccaagtagacgttcac

SEQ ID NO: 17428 - DNA, 16 bp, Artificial Sequence
  synthetic [barcode part1]
ttactctaatccgcag

SEQ ID NO: 17429 - DNA, 16 bp, Artificial Sequence
  synthetic [barcode part1]
agttgatcgacgtcgt

SEQ ID NO: 17430 - DNA, 16 bp, Artificial Sequence
  synthetic [barcode part1]
tcacagtagaactccg

SEQ ID NO: 17431 - DNA, 16 bp, Artificial Sequence
  synthetic [barcode part1]
tctgatccgcgcaact

SEQ ID NO: 17432 - DNA, 16 bp, Artificial Sequence
  synthetic [barcode part1]
aagtcggttgatcctg

SEQ ID NO: 17433 - DNA, 16 bp, Artificial Sequence
  synthetic [barcode part1]
tggcgacctcttgtac

SEQ ID NO: 17434 - DNA, 16 bp, Artificial Sequence
  synthetic [barcode part1]
tgtgtcactagttctg

SEQ ID NO: 17435 - DNA, 16 bp, Artificial Sequence
  synthetic [barcode part1]
tcggtggtacctctac

SEQ ID NO: 17436 - DNA, 16 bp, Artificial Sequence
  synthetic [barcode part1]
gataccaccaattggc

SEQ ID NO: 17437 - DNA, 16 bp, Artificial Sequence
  synthetic [barcode part1]
aaggtaatagacgtcc

SEQ ID NO: 17438 - DNA, 16 bp, Artificial Sequence
  synthetic [barcode part1]
tctccaacgtaactgt

SEQ ID NO: 17439 - DNA, 16 bp, Artificial Sequence
  synthetic [barcode part1]
caagaccgagactctt

SEQ ID NO: 17440 - DNA, 16 bp, Artificial Sequence
  synthetic [barcode part1]
acttctgcgccagact

SEQ ID NO: 17441 - DNA, 16 bp, Artificial Sequence
  synthetic [barcode part1]
acacgtacgtaacgtc

SEQ ID NO: 17442 - DNA, 16 bp, Artificial Sequence
  synthetic [barcode part1]
agacagacctgttcgt

SEQ ID NO: 17443 - DNA, 16 bp, Artificial Sequence
  synthetic [barcode part1]
cctgcgtatacagagt

SEQ ID NO: 17444 - DNA, 16 bp, Artificial Sequence
  synthetic [barcode part1]
cgagtatacgcctaac

SEQ ID NO: 17445 - DNA, 16 bp, Artificial Sequence
  synthetic [barcode part1]
cacgagacggtaatcg

SEQ ID NO: 17446 - DNA, 16 bp, Artificial Sequence
  synthetic [barcode part1]
cgccttaggtacctac

SEQ ID NO: 17447 - DNA, 16 bp, Artificial Sequence
  synthetic [barcode part1]
ttactgtgacggaacc

SEQ ID NO: 17448 - DNA, 16 bp, Artificial Sequence
  synthetic [barcode part1]
ttaggcgaggtctact

SEQ ID NO: 17449 - DNA, 16 bp, Artificial Sequence
  synthetic [barcode part1]
cgtagtactacctatc

SEQ ID NO: 17450 - DNA, 16 bp, Artificial Sequence
  synthetic [barcode part1]
acggttgtcgaggagt

SEQ ID NO: 17451 - DNA, 16 bp, Artificial Sequence
  synthetic [barcode part1]
cctaaggcggttgatt

SEQ ID NO: 17452 - DNA, 16 bp, Artificial Sequence
  synthetic [barcode part1]
cacaaggccttatacg

SEQ ID NO: 17453 - DNA, 16 bp, Artificial Sequence
  synthetic [barcode part1]
ttgtatctgagtcacc

SEQ ID NO: 17454 - DNA, 16 bp, Artificial Sequence
  synthetic [barcode part1]
aggacaagacggagtt

SEQ ID NO: 17455 - DNA, 16 bp, Artificial Sequence
  synthetic [barcode part1]
cgtgatataccgtgac

SEQ ID NO: 17456 - DNA, 16 bp, Artificial Sequence
  synthetic [barcode part1]
gtgaccagtcaacgtt

SEQ ID NO: 17457 - DNA, 16 bp, Artificial Sequence
  synthetic [barcode part1]
ttaggtcgtatccttg

SEQ ID NO: 17458 - DNA, 16 bp, Artificial Sequence
  synthetic [barcode part1]
tatcggtgagaagttg

SEQ ID NO: 17459 - DNA, 16 bp, Artificial Sequence
  synthetic [barcode part1]
tgtagaacagttcgag

SEQ ID NO: 17460 - DNA, 16 bp, Artificial Sequence
  synthetic [barcode part1]
ccgatctagacacctc

SEQ ID NO: 17461 - DNA, 16 bp, Artificial Sequence
  synthetic [barcode part1]
cctctaattccgacct

SEQ ID NO: 17462 - DNA, 16 bp, Artificial Sequence
  synthetic [barcode part1]
cgtgtccaatacgagt

SEQ ID NO: 17463 - DNA, 16 bp, Artificial Sequence
  synthetic [barcode part1]
acactcctgacttggc

SEQ ID NO: 17464 - DNA, 16 bp, Artificial Sequence
  synthetic [barcode part1]
gcagtcagaggaacct

SEQ ID NO: 17465 - DNA, 16 bp, Artificial Sequence
  synthetic [barcode part1]
attggcgtactgacgt

SEQ ID NO: 17466 - DNA, 16 bp, Artificial Sequence
  synthetic [barcode part1]
cgtatagactcaggtc

SEQ ID NO: 17467 - DNA, 16 bp, Artificial Sequence
  synthetic [barcode part1]
attgcgaggtgaatac

SEQ ID NO: 17468 - DNA, 16 bp, Artificial Sequence
  synthetic [barcode part1]
gtactaccgagtggag

SEQ ID NO: 17469 - DNA, 16 bp, Artificial Sequence
  synthetic [barcode part1]
tggtcaaggaacttcc

SEQ ID NO: 17470 - DNA, 16 bp, Artificial Sequence
  synthetic [barcode part1]
gccttacttacacaac

SEQ ID NO: 17471 - DNA, 16 bp, Artificial Sequence
  synthetic [barcode part1]
tgatcacagattggag

SEQ ID NO: 17472 - DNA, 16 bp, Artificial Sequence
  synthetic [barcode part1]
atacttcgaagacgcc

SEQ ID NO: 17473 - DNA, 16 bp, Artificial Sequence
  synthetic [barcode part1]
gtgcacgtgattaacc

SEQ ID NO: 17474 - DNA, 16 bp, Artificial Sequence
  synthetic [barcode part1]
gccaattaaccggttg

SEQ ID NO: 17475 - DNA, 16 bp, Artificial Sequence
  synthetic [barcode part1]
aggtctgtattccgtt

SEQ ID NO: 17476 - DNA, 16 bp, Artificial Sequence
  synthetic [barcode part1]
agataacgtcgaggag

SEQ ID NO: 17477 - DNA, 16 bp, Artificial Sequence
  synthetic [barcode part1]
caggtatagttcgcac

SEQ ID NO: 17478 - DNA, 16 bp, Artificial Sequence
  synthetic [barcode part1]
acggatcactgcctct

SEQ ID NO: 17479 - DNA, 16 bp, Artificial Sequence
  synthetic [barcode part1]
tccagaagtgttgtgc

SEQ ID NO: 17480 - DNA, 16 bp, Artificial Sequence
  synthetic [barcode part1]
cgaaggtagacgtaag

SEQ ID NO: 17481 - DNA, 16 bp, Artificial Sequence
  synthetic [barcode part1]
gcagagagagagtatc

SEQ ID NO: 17482 - DNA, 16 bp, Artificial Sequence
  synthetic [barcode part1]
aagataaccgtggact

SEQ ID NO: 17483 - DNA, 16 bp, Artificial Sequence
  synthetic [barcode part1]
actgaactcgcactcc

SEQ ID NO: 17484 - DNA, 16 bp, Artificial Sequence
  synthetic [barcode part1]
gccgtgttaataagag

SEQ ID NO: 17485 - DNA, 16 bp, Artificial Sequence
  synthetic [barcode part1]
cgatactggtaagtag

SEQ ID NO: 17486 - DNA, 16 bp, Artificial Sequence
  synthetic [barcode part1]
atctgtgcgatagaag

SEQ ID NO: 17487 - DNA, 16 bp, Artificial Sequence
  synthetic [barcode part1]
agtgaggtgtgaattc

SEQ ID NO: 17488 - DNA, 16 bp, Artificial Sequence
  synthetic [barcode part1]
tcctcctcgtgatact

SEQ ID NO: 17489 - DNA, 16 bp, Artificial Sequence
  synthetic [barcode part1]
tgttgttccactgtcc

SEQ ID NO: 17490 - DNA, 16 bp, Artificial Sequence
  synthetic [barcode part1]
ttgagaacacaggttg

SEQ ID NO: 17491 - DNA, 16 bp, Artificial Sequence
  synthetic [barcode part1]
cctgatctcagtcttc

SEQ ID NO: 17492 - DNA, 16 bp, Artificial Sequence
  synthetic [barcode part1]
ttgagtctcttacgtg

SEQ ID NO: 17493 - DNA, 16 bp, Artificial Sequence
  synthetic [barcode part1]
ccacagaccgttgtct

SEQ ID NO: 17494 - DNA, 16 bp, Artificial Sequence
  synthetic [barcode part1]
caccgtcacttggact

SEQ ID NO: 17495 - DNA, 16 bp, Artificial Sequence
  synthetic [barcode part1]
acggtgtatcgactgt

SEQ ID NO: 17496 - DNA, 16 bp, Artificial Sequence
  synthetic [barcode part1]
acacctcctagtggtc

SEQ ID NO: 17497 - DNA, 16 bp, Artificial Sequence
  synthetic [barcode part1]
aacaagactagtacgc

SEQ ID NO: 17498 - DNA, 16 bp, Artificial Sequence
  synthetic [barcode part1]
cactgtagaccgattg

SEQ ID NO: 17499 - DNA, 16 bp, Artificial Sequence
  synthetic [barcode part1]
aggaccacacaggttg

SEQ ID NO: 17500 - DNA, 16 bp, Artificial Sequence
  synthetic [barcode part1]
gtggcgtagttctaac

SEQ ID NO: 17501 - DNA, 16 bp, Artificial Sequence
  synthetic [barcode part1]
aaggacacgtcggact

SEQ ID NO: 17502 - DNA, 16 bp, Artificial Sequence
  synthetic [barcode part1]
tgcctatcagacaggt

SEQ ID NO: 17503 - DNA, 16 bp, Artificial Sequence
  synthetic [barcode part1]
accgaacacttgacgt

SEQ ID NO: 17504 - DNA, 16 bp, Artificial Sequence
  synthetic [barcode part1]
aacgtctgcagttgtg

SEQ ID NO: 17505 - DNA, 16 bp, Artificial Sequence
  synthetic [barcode part1]
acctgatccgataacg

SEQ ID NO: 17506 - DNA, 16 bp, Artificial Sequence
  synthetic [barcode part1]
tagtccttagtcgtgt

SEQ ID NO: 17507 - DNA, 16 bp, Artificial Sequence
  synthetic [barcode part1]
tgttgtccgccagtgt

SEQ ID NO: 17508 - DNA, 16 bp, Artificial Sequence
  synthetic [barcode part1]
tatactcaggcacgac

SEQ ID NO: 17509 - DNA, 16 bp, Artificial Sequence
  synthetic [barcode part1]
cctgcactaacgacct

SEQ ID NO: 17510 - DNA, 16 bp, Artificial Sequence
  synthetic [barcode part1]
gatctagttggcgatc

SEQ ID NO: 17511 - DNA, 16 bp, Artificial Sequence
  synthetic [barcode part1]
atcgcagaccttgagt

SEQ ID NO: 17512 - DNA, 16 bp, Artificial Sequence
  synthetic [barcode part1]
acgcaacgactcctct

SEQ ID NO: 17513 - DNA, 16 bp, Artificial Sequence
  synthetic [barcode part1]
agtcctctcttgtcac

SEQ ID NO: 17514 - DNA, 16 bp, Artificial Sequence
  synthetic [barcode part1]
tccacacaagatacgc

SEQ ID NO: 17515 - DNA, 16 bp, Artificial Sequence
  synthetic [barcode part1]
cacggtgtacctatcc

SEQ ID NO: 17516 - DNA, 16 bp, Artificial Sequence
  synthetic [barcode part1]
gcgatcaggtcaaggt

SEQ ID NO: 17517 - DNA, 16 bp, Artificial Sequence
  synthetic [barcode part1]
acaattgcacggtcgt

SEQ ID NO: 17518 - DNA, 16 bp, Artificial Sequence
  synthetic [barcode part1]
ttatcggccttacgcg

SEQ ID NO: 17519 - DNA, 16 bp, Artificial Sequence
  synthetic [barcode part1]
ttcaataccacactcg

SEQ ID NO: 17520 - DNA, 16 bp, Artificial Sequence
  synthetic [barcode part1]
gtccgtccaagatcct

SEQ ID NO: 17521 - DNA, 16 bp, Artificial Sequence
  synthetic [barcode part1]
gtgaactaccgtctcc

SEQ ID NO: 17522 - DNA, 16 bp, Artificial Sequence
  synthetic [barcode part1]
agaccacagactgtct

SEQ ID NO: 17523 - DNA, 16 bp, Artificial Sequence
  synthetic [barcode part1]
caggattctaaggtcc

SEQ ID NO: 17524 - DNA, 16 bp, Artificial Sequence
  synthetic [barcode part1]
taccgagacctagtgt

SEQ ID NO: 17525 - DNA, 16 bp, Artificial Sequence
  synthetic [barcode part1]
gatatatctccgatcc

SEQ ID NO: 17526 - DNA, 16 bp, Artificial Sequence
  synthetic [barcode part1]
gtcctaagaccagttg

SEQ ID NO: 17527 - DNA, 16 bp, Artificial Sequence
  synthetic [barcode part1]
tccttccgcacgtatt

SEQ ID NO: 17528 - DNA, 16 bp, Artificial Sequence
  synthetic [barcode part1]
aacctcaacctgtccg

SEQ ID NO: 17529 - DNA, 16 bp, Artificial Sequence
  synthetic [barcode part1]
gcgccgagttacttct

SEQ ID NO: 17530 - DNA, 16 bp, Artificial Sequence
  synthetic [barcode part1]
acagttgcagtacgtc

SEQ ID NO: 17531 - DNA, 16 bp, Artificial Sequence
  synthetic [barcode part1]
actcgtcaataggcac

SEQ ID NO: 17532 - DNA, 16 bp, Artificial Sequence
  synthetic [barcode part1]
gcgcaataatcttcct

SEQ ID NO: 17533 - DNA, 16 bp, Artificial Sequence
  synthetic [barcode part1]
tggtggttcagactgt

SEQ ID NO: 17534 - DNA, 16 bp, Artificial Sequence
  synthetic [barcode part1]
tctatcagaaggccac

SEQ ID NO: 17535 - DNA, 16 bp, Artificial Sequence
  synthetic [barcode part1]
gaacgagttgcctatc

SEQ ID NO: 17536 - DNA, 16 bp, Artificial Sequence
  synthetic [barcode part1]
tattcctgtgcaggag

SEQ ID NO: 17537 - DNA, 16 bp, Artificial Sequence
  synthetic [barcode part1]
atccttgcggaagtgt

SEQ ID NO: 17538 - DNA, 16 bp, Artificial Sequence
  synthetic [barcode part1]
tggcgtctgagtagag

SEQ ID NO: 17539 - DNA, 16 bp, Artificial Sequence
  synthetic [barcode part1]
gcctgagtactgtctc

SEQ ID NO: 17540 - DNA, 16 bp, Artificial Sequence
  synthetic [barcode part1]
aatcacgcacgtgatc

SEQ ID NO: 17541 - DNA, 16 bp, Artificial Sequence
  synthetic [barcode part1]
cctgcgtatcagacct

SEQ ID NO: 17542 - DNA, 16 bp, Artificial Sequence
  synthetic [barcode part1]
ttcctggaatctctcc

SEQ ID NO: 17543 - DNA, 16 bp, Artificial Sequence
  synthetic [barcode part1]
agtgtgtggttagaac

SEQ ID NO: 17544 - DNA, 16 bp, Artificial Sequence
  synthetic [barcode part1]
aggagtctgactatag

SEQ ID NO: 17545 - DNA, 16 bp, Artificial Sequence
  synthetic [barcode part1]
cctgtcacctctaatc

SEQ ID NO: 17546 - DNA, 16 bp, Artificial Sequence
  synthetic [barcode part1]
tacttctaacctggtg

SEQ ID NO: 17547 - DNA, 16 bp, Artificial Sequence
  synthetic [barcode part1]
gcctgttacgatattc

SEQ ID NO: 17548 - DNA, 16 bp, Artificial Sequence
  synthetic [barcode part1]
tctcacacgcgttctt

SEQ ID NO: 17549 - DNA, 16 bp, Artificial Sequence
  synthetic [barcode part1]
cgaggtcgttaactac

SEQ ID NO: 17550 - DNA, 16 bp, Artificial Sequence
  synthetic [barcode part1]
actaggtaacgtgaac

SEQ ID NO: 17551 - DNA, 16 bp, Artificial Sequence
  synthetic [barcode part1]
cctatcgcacagactc

SEQ ID NO: 17552 - DNA, 16 bp, Artificial Sequence
  synthetic [barcode part1]
acgccttaccgaactc

SEQ ID NO: 17553 - DNA, 16 bp, Artificial Sequence
  synthetic [barcode part1]
gatcttgagtaccgtg

SEQ ID NO: 17554 - DNA, 16 bp, Artificial Sequence
  synthetic [barcode part1]
tgtagtaaggcgaact

SEQ ID NO: 17555 - DNA, 16 bp, Artificial Sequence
  synthetic [barcode part1]
ttgcagatcgccgttc

SEQ ID NO: 17556 - DNA, 16 bp, Artificial Sequence
  synthetic [barcode part1]
tctggtagagtacaag

SEQ ID NO: 17557 - DNA, 16 bp, Artificial Sequence
  synthetic [barcode part1]
acactggaggataact

SEQ ID NO: 17558 - DNA, 16 bp, Artificial Sequence
  synthetic [barcode part1]
gacgcacttagtctcc

SEQ ID NO: 17559 - DNA, 16 bp, Artificial Sequence
  synthetic [barcode part1]
gtgactggtaccaact

SEQ ID NO: 17560 - DNA, 16 bp, Artificial Sequence
  synthetic [barcode part1]
agaagagttccttccg

SEQ ID NO: 17561 - DNA, 16 bp, Artificial Sequence
  synthetic [barcode part1]
tcctacactaacggtt

SEQ ID NO: 17562 - DNA, 16 bp, Artificial Sequence
  synthetic [barcode part1]
tgcacttgcggagatt

SEQ ID NO: 17563 - DNA, 16 bp, Artificial Sequence
  synthetic [barcode part1]
tcctccagatagtgag

SEQ ID NO: 17564 - DNA, 16 bp, Artificial Sequence
  synthetic [barcode part1]
tgttgaggagtgtaac

SEQ ID NO: 17565 - DNA, 16 bp, Artificial Sequence
  synthetic [barcode part1]
atcttcgacggagact

SEQ ID NO: 17566 - DNA, 16 bp, Artificial Sequence
  synthetic [barcode part1]
agttgtgtgtggttgc

SEQ ID NO: 17567 - DNA, 16 bp, Artificial Sequence
  synthetic [barcode part1]
ccaacctgatatactc

SEQ ID NO: 17568 - DNA, 16 bp, Artificial Sequence
  synthetic [barcode part1]
cacacctctcagtgac

SEQ ID NO: 17569 - DNA, 16 bp, Artificial Sequence
  synthetic [barcode part1]
gacggagtgtggatct

SEQ ID NO: 17570 - DNA, 16 bp, Artificial Sequence
  synthetic [barcode part1]
gtgtacaatcacggtc

SEQ ID NO: 17571 - DNA, 16 bp, Artificial Sequence
  synthetic [barcode part1]
accgatactcaacttc

SEQ ID NO: 17572 - DNA, 16 bp, Artificial Sequence
  synthetic [barcode part1]
tgtgccttatcttcgc

SEQ ID NO: 17573 - DNA, 16 bp, Artificial Sequence
  synthetic [barcode part1]
cgaactgcgattcagt

SEQ ID NO: 17574 - DNA, 16 bp, Artificial Sequence
  synthetic [barcode part1]
ttcggtacaaggatag

SEQ ID NO: 17575 - DNA, 16 bp, Artificial Sequence
  synthetic [barcode part1]
gatatcagtgccgtgt

SEQ ID NO: 17576 - DNA, 16 bp, Artificial Sequence
  synthetic [barcode part1]
gaacactacaataggc

SEQ ID NO: 17577 - DNA, 16 bp, Artificial Sequence
  synthetic [barcode part1]
taaccaggtcgtgatc

SEQ ID NO: 17578 - DNA, 16 bp, Artificial Sequence
  synthetic [barcode part1]
tgcagttaccgtcctg

SEQ ID NO: 17579 - DNA, 16 bp, Artificial Sequence
  synthetic [barcode part1]
gtgttacttgtctgtg

SEQ ID NO: 17580 - DNA, 16 bp, Artificial Sequence
  synthetic [barcode part1]
acgacttaggtcgttg

SEQ ID NO: 17581 - DNA, 16 bp, Artificial Sequence
  synthetic [barcode part1]
tcctgacgtacgatcc

SEQ ID NO: 17582 - DNA, 16 bp, Artificial Sequence
  synthetic [barcode part1]
aacgtatcacgcgact

SEQ ID NO: 17583 - DNA, 16 bp, Artificial Sequence
  synthetic [barcode part1]
gcggtattcctgaagt

SEQ ID NO: 17584 - DNA, 16 bp, Artificial Sequence
  synthetic [barcode part1]
atctgtccaggatctt

SEQ ID NO: 17585 - DNA, 16 bp, Artificial Sequence
  synthetic [barcode part1]
caaccaagatcgatcc

SEQ ID NO: 17586 - DNA, 16 bp, Artificial Sequence
  synthetic [barcode part1]
caagtaatagagtccg

SEQ ID NO: 17587 - DNA, 16 bp, Artificial Sequence
  synthetic [barcode part1]
atagaacgcctcactg

SEQ ID NO: 17588 - DNA, 16 bp, Artificial Sequence
  synthetic [barcode part1]
ttgcaccggatcgttc

SEQ ID NO: 17589 - DNA, 16 bp, Artificial Sequence
  synthetic [barcode part1]
acttgcagtacctgag

SEQ ID NO: 17590 - DNA, 16 bp, Artificial Sequence
  synthetic [barcode part1]
tggttggcaaccgatt

SEQ ID NO: 17591 - DNA, 16 bp, Artificial Sequence
  synthetic [barcode part1]
ttgagaaggttgtacg

SEQ ID NO: 17592 - DNA, 16 bp, Artificial Sequence
  synthetic [barcode part1]
tctcaaccgcggatct

SEQ ID NO: 17593 - DNA, 16 bp, Artificial Sequence
  synthetic [barcode part1]
accagattaccgaacc

SEQ ID NO: 17594 - DNA, 16 bp, Artificial Sequence
  synthetic [barcode part1]
gagacacaccaccaag

SEQ ID NO: 17595 - DNA, 16 bp, Artificial Sequence
  synthetic [barcode part1]
ttacttcgtcggagag

SEQ ID NO: 17596 - DNA, 16 bp, Artificial Sequence
  synthetic [barcode part1]
tacaccaacaccaacg

SEQ ID NO: 17597 - DNA, 16 bp, Artificial Sequence
  synthetic [barcode part1]
gtattcttggtagtcc

SEQ ID NO: 17598 - DNA, 16 bp, Artificial Sequence
  synthetic [barcode part1]
tcaagtgtgttacctc

SEQ ID NO: 17599 - DNA, 16 bp, Artificial Sequence
  synthetic [barcode part1]
gacaggacttctagtc

SEQ ID NO: 17600 - DNA, 16 bp, Artificial Sequence
  synthetic [barcode part1]
aatccactctactgtg

SEQ ID NO: 17601 - DNA, 16 bp, Artificial Sequence
  synthetic [barcode part1]
taacacgtctcgccac

SEQ ID NO: 17602 - DNA, 16 bp, Artificial Sequence
  synthetic [barcode part1]
aattcctcgactctcc

SEQ ID NO: 17603 - DNA, 16 bp, Artificial Sequence
  synthetic [barcode part1]
agaatctccacggtgt

SEQ ID NO: 17604 - DNA, 16 bp, Artificial Sequence
  synthetic [barcode part1]
tgtaacctgacttctg

SEQ ID NO: 17605 - DNA, 16 bp, Artificial Sequence
  synthetic [barcode part1]
gaaggtaccacactct

SEQ ID NO: 17606 - DNA, 16 bp, Artificial Sequence
  synthetic [barcode part1]
tgatacacgactctct

SEQ ID NO: 17607 - DNA, 16 bp, Artificial Sequence
  synthetic [barcode part1]
agtggttgaggacacc

SEQ ID NO: 17608 - DNA, 16 bp, Artificial Sequence
  synthetic [barcode part1]
atcactccacttaggt

SEQ ID NO: 17609 - DNA, 16 bp, Artificial Sequence
  synthetic [barcode part1]
agagaacaggtactct

SEQ ID NO: 17610 - DNA, 16 bp, Artificial Sequence
  synthetic [barcode part1]
gagtaatcggcagaag

SEQ ID NO: 17611 - DNA, 16 bp, Artificial Sequence
  synthetic [barcode part1]
taattgaccagtcggc

SEQ ID NO: 17612 - DNA, 16 bp, Artificial Sequence
  synthetic [barcode part1]
tacgtcagtcaacacg

SEQ ID NO: 17613 - DNA, 16 bp, Artificial Sequence
  synthetic [barcode part1]
ttgaccagatcaaccg

SEQ ID NO: 17614 - DNA, 16 bp, Artificial Sequence
  synthetic [barcode part1]
tgttccacctaggcgt

SEQ ID NO: 17615 - DNA, 16 bp, Artificial Sequence
  synthetic [barcode part1]
cctccgaccttaactt

SEQ ID NO: 17616 - DNA, 16 bp, Artificial Sequence
  synthetic [barcode part1]
tgcgcgaagtatatcc

SEQ ID NO: 17617 - DNA, 16 bp, Artificial Sequence
  synthetic [barcode part1]
aactctgcggacgaag

SEQ ID NO: 17618 - DNA, 16 bp, Artificial Sequence
  synthetic [barcode part1]
tgtactccgttagact

SEQ ID NO: 17619 - DNA, 16 bp, Artificial Sequence
  synthetic [barcode part1]
gatctactaagacgag

SEQ ID NO: 17620 - DNA, 16 bp, Artificial Sequence
  synthetic [barcode part1]
ttgcaaggcaactacc

SEQ ID NO: 17621 - DNA, 16 bp, Artificial Sequence
  synthetic [barcode part1]
gatcgatactggtcac

SEQ ID NO: 17622 - DNA, 16 bp, Artificial Sequence
  synthetic [barcode part1]
cagaacggtgactacg

SEQ ID NO: 17623 - DNA, 16 bp, Artificial Sequence
  synthetic [barcode part1]
cggattacacacctcc

SEQ ID NO: 17624 - DNA, 16 bp, Artificial Sequence
  synthetic [barcode part1]
gattgaccgtaacacc

SEQ ID NO: 17625 - DNA, 16 bp, Artificial Sequence
  synthetic [barcode part1]
tcgaaggccagtgtag

SEQ ID NO: 17626 - DNA, 16 bp, Artificial Sequence
  synthetic [barcode part1]
gcacacagacttcagt

SEQ ID NO: 17627 - DNA, 16 bp, Artificial Sequence
  synthetic [barcode part1]
aatcacgcgtgatcac

SEQ ID NO: 17628 - DNA, 16 bp, Artificial Sequence
  synthetic [barcode part1]
aggcgatcacagatcg

SEQ ID NO: 17629 - DNA, 16 bp, Artificial Sequence
  synthetic [barcode part1]
gcacgatcacaatcgt

SEQ ID NO: 17630 - DNA, 16 bp, Artificial Sequence
  synthetic [barcode part1]
agttcttgcgcaattc

SEQ ID NO: 17631 - DNA, 16 bp, Artificial Sequence
  synthetic [barcode part1]
gaagacacttaacggt

SEQ ID NO: 17632 - DNA, 16 bp, Artificial Sequence
  synthetic [barcode part1]
gcggaataacaaggtg

SEQ ID NO: 17633 - DNA, 16 bp, Artificial Sequence
  synthetic [barcode part1]
aggattatacgaaccg

SEQ ID NO: 17634 - DNA, 16 bp, Artificial Sequence
  synthetic [barcode part1]
aacgagactaacgtgt

SEQ ID NO: 17635 - DNA, 16 bp, Artificial Sequence
  synthetic [barcode part1]
gtgtggaccgttgaag

SEQ ID NO: 17636 - DNA, 16 bp, Artificial Sequence
  synthetic [barcode part1]
tctaggtaacggtaag

SEQ ID NO: 17637 - DNA, 16 bp, Artificial Sequence
  synthetic [barcode part1]
gtccacgtaactctcg

SEQ ID NO: 17638 - DNA, 16 bp, Artificial Sequence
  synthetic [barcode part1]
tggatcttccgtcacg

SEQ ID NO: 17639 - DNA, 16 bp, Artificial Sequence
  synthetic [barcode part1]
aactcgacgtatcttc

SEQ ID NO: 17640 - DNA, 16 bp, Artificial Sequence
  synthetic [barcode part1]
gcgacaacttgcgaag

SEQ ID NO: 17641 - DNA, 16 bp, Artificial Sequence
  synthetic [barcode part1]
tagtcagactgcgatc

SEQ ID NO: 17642 - DNA, 16 bp, Artificial Sequence
  synthetic [barcode part1]
agtctctgaccgcact

SEQ ID NO: 17643 - DNA, 16 bp, Artificial Sequence
  synthetic [barcode part1]
gcgatagtctgcagag

SEQ ID NO: 17644 - DNA, 16 bp, Artificial Sequence
  synthetic [barcode part1]
acttgaatcacctcgt

SEQ ID NO: 17645 - DNA, 16 bp, Artificial Sequence
  synthetic [barcode part1]
atcacttgagttcgtc

SEQ ID NO: 17646 - DNA, 16 bp, Artificial Sequence
  synthetic [barcode part1]
aaggtggtccagacac

SEQ ID NO: 17647 - DNA, 16 bp, Artificial Sequence
  synthetic [barcode part1]
accgtccaataggact

SEQ ID NO: 17648 - DNA, 16 bp, Artificial Sequence
  synthetic [barcode part1]
agtgtgtgtacgtcac

SEQ ID NO: 17649 - DNA, 16 bp, Artificial Sequence
  synthetic [barcode part1]
taagaaggcgttagtc

SEQ ID NO: 17650 - DNA, 16 bp, Artificial Sequence
  synthetic [barcode part1]
ccaagaggcactcaag

SEQ ID NO: 17651 - DNA, 16 bp, Artificial Sequence
  synthetic [barcode part1]
taataacctggtggcc

SEQ ID NO: 17652 - DNA, 16 bp, Artificial Sequence
  synthetic [barcode part1]
gaggtggtcgtagact

SEQ ID NO: 17653 - DNA, 16 bp, Artificial Sequence
  synthetic [barcode part1]
tgcctcttggcgattg

SEQ ID NO: 17654 - DNA, 16 bp, Artificial Sequence
  synthetic [barcode part1]
cacttcctagtggtcg

SEQ ID NO: 17655 - DNA, 16 bp, Artificial Sequence
  synthetic [barcode part1]
ccacgtgtctcagttg

SEQ ID NO: 17656 - DNA, 16 bp, Artificial Sequence
  synthetic [barcode part1]
acctgagtggaatagt

SEQ ID NO: 17657 - DNA, 16 bp, Artificial Sequence
  synthetic [barcode part1]
gaactaccgttgaacc

SEQ ID NO: 17658 - DNA, 16 bp, Artificial Sequence
  synthetic [barcode part1]
gaatcgttcgttggac

SEQ ID NO: 17659 - DNA, 16 bp, Artificial Sequence
  synthetic [barcode part1]
tgccgcaagttagttg

SEQ ID NO: 17660 - DNA, 16 bp, Artificial Sequence
  synthetic [barcode part1]
cgcacttcagactgtc

SEQ ID NO: 17661 - DNA, 16 bp, Artificial Sequence
  synthetic [barcode part1]
tgttgccgacagtaac

SEQ ID NO: 17662 - DNA, 16 bp, Artificial Sequence
  synthetic [barcode part1]
tagaaggacgcaccgt

SEQ ID NO: 17663 - DNA, 16 bp, Artificial Sequence
  synthetic [barcode part1]
tcggttctccacgaac

SEQ ID NO: 17664 - DNA, 16 bp, Artificial Sequence
  synthetic [barcode part1]
gtggcaatatcagtag

SEQ ID NO: 17665 - DNA, 16 bp, Artificial Sequence
  synthetic [barcode part1]
gcgtatactgagatcc

SEQ ID NO: 17666 - DNA, 16 bp, Artificial Sequence
  synthetic [barcode part1]
tgttgtgaaccgatcg

SEQ ID NO: 17667 - DNA, 16 bp, Artificial Sequence
  synthetic [barcode part1]
tacgcaacgaacctac

SEQ ID NO: 17668 - DNA, 16 bp, Artificial Sequence
  synthetic [barcode part1]
atccagttacgagaag

SEQ ID NO: 17669 - DNA, 16 bp, Artificial Sequence
  synthetic [barcode part1]
cgcgtagtatcttgcc

SEQ ID NO: 17670 - DNA, 16 bp, Artificial Sequence
  synthetic [barcode part1]
tgtaacgatctcaggc

SEQ ID NO: 17671 - DNA, 16 bp, Artificial Sequence
  synthetic [barcode part1]
caaccttgcaccggtt

SEQ ID NO: 17672 - DNA, 16 bp, Artificial Sequence
  synthetic [barcode part1]
ccgtatcgtaggaatc

SEQ ID NO: 17673 - DNA, 16 bp, Artificial Sequence
  synthetic [barcode part1]
tgtggatataacaggc

SEQ ID NO: 17674 - DNA, 16 bp, Artificial Sequence
  synthetic [barcode part1]
gatcttccgaccttct

SEQ ID NO: 17675 - DNA, 16 bp, Artificial Sequence
  synthetic [barcode part1]
gcagaccggaatagtc

SEQ ID NO: 17676 - DNA, 16 bp, Artificial Sequence
  synthetic [barcode part1]
gcagtgttgtggtact

SEQ ID NO: 17677 - DNA, 16 bp, Artificial Sequence
  synthetic [barcode part1]
tagttctgtcagtgtc

SEQ ID NO: 17678 - DNA, 16 bp, Artificial Sequence
  synthetic [barcode part1]
gccggttattaaccag

SEQ ID NO: 17679 - DNA, 16 bp, Artificial Sequence
  synthetic [barcode part1]
ttgcacaaccaacacg

SEQ ID NO: 17680 - DNA, 16 bp, Artificial Sequence
  synthetic [barcode part1]
tcagtgacgaactacc

SEQ ID NO: 17681 - DNA, 16 bp, Artificial Sequence
  synthetic [barcode part1]
atccaaggagtctgtc

SEQ ID NO: 17682 - DNA, 16 bp, Artificial Sequence
  synthetic [barcode part1]
agaaggcgcagttgtc

SEQ ID NO: 17683 - DNA, 16 bp, Artificial Sequence
  synthetic [barcode part1]
gcaacactatacgcgt

SEQ ID NO: 17684 - DNA, 16 bp, Artificial Sequence
  synthetic [barcode part1]
tatcgcagagagagag

SEQ ID NO: 17685 - DNA, 16 bp, Artificial Sequence
  synthetic [barcode part1]
caatcagacgtcacac

SEQ ID NO: 17686 - DNA, 16 bp, Artificial Sequence
  synthetic [barcode part1]
tcgtgagtaggttcgt

SEQ ID NO: 17687 - DNA, 16 bp, Artificial Sequence
  synthetic [barcode part1]
cgaaccagtcagactt

SEQ ID NO: 17688 - DNA, 16 bp, Artificial Sequence
  synthetic [barcode part1]
taggcagataggtgag

SEQ ID NO: 17689 - DNA, 16 bp, Artificial Sequence
  synthetic [barcode part1]
tacgacaaggtggacc

SEQ ID NO: 17690 - DNA, 16 bp, Artificial Sequence
  synthetic [barcode part1]
taacggtgagacgtgc

SEQ ID NO: 17691 - DNA, 16 bp, Artificial Sequence
  synthetic [barcode part1]
attcaagtcgccttgt

SEQ ID NO: 17692 - DNA, 16 bp, Artificial Sequence
  synthetic [barcode part1]
cagagtgagactgaag

SEQ ID NO: 17693 - DNA, 16 bp, Artificial Sequence
  synthetic [barcode part1]
tggagaacgcgcaact

SEQ ID NO: 17694 - DNA, 16 bp, Artificial Sequence
  synthetic [barcode part1]
aaccgtaatcgcacac

SEQ ID NO: 17695 - DNA, 16 bp, Artificial Sequence
  synthetic [barcode part1]
cacacttagaccactt

SEQ ID NO: 17696 - DNA, 16 bp, Artificial Sequence
  synthetic [barcode part1]
caagaccagttctggt

SEQ ID NO: 17697 - DNA, 16 bp, Artificial Sequence
  synthetic [barcode part1]
tctcacaacacctcct

SEQ ID NO: 17698 - DNA, 16 bp, Artificial Sequence
  synthetic [barcode part1]
actgtctatcctgcct

SEQ ID NO: 17699 - DNA, 16 bp, Artificial Sequence
  synthetic [barcode part1]
tgaacacgccgaagac

SEQ ID NO: 17700 - DNA, 16 bp, Artificial Sequence
  synthetic [barcode part1]
cctgtctatagtgttg

SEQ ID NO: 17701 - DNA, 16 bp, Artificial Sequence
  synthetic [barcode part1]
tcgaccttgtcagtgc

SEQ ID NO: 17702 - DNA, 16 bp, Artificial Sequence
  synthetic [barcode part1]
ttcctaggtgtgttgt

SEQ ID NO: 17703 - DNA, 16 bp, Artificial Sequence
  synthetic [barcode part1]
aagtaggcaccacggt

SEQ ID NO: 17704 - DNA, 16 bp, Artificial Sequence
  synthetic [barcode part1]
tagagaagttgtgtgc

SEQ ID NO: 17705 - DNA, 16 bp, Artificial Sequence
  synthetic [barcode part1]
aggacgaacagactcc

SEQ ID NO: 17706 - DNA, 16 bp, Artificial Sequence
  synthetic [barcode part1]
caaggactaccgagtg

SEQ ID NO: 17707 - DNA, 16 bp, Artificial Sequence
  synthetic [barcode part1]
ccggatagttcgtagt

SEQ ID NO: 17708 - DNA, 16 bp, Artificial Sequence
  synthetic [barcode part1]
gattcttctgagtacc

SEQ ID NO: 17709 - DNA, 16 bp, Artificial Sequence
  synthetic [barcode part1]
tgcctcactgtcttac

SEQ ID NO: 17710 - DNA, 16 bp, Artificial Sequence
  synthetic [barcode part1]
cagttgttggacctag

SEQ ID NO: 17711 - DNA, 16 bp, Artificial Sequence
  synthetic [barcode part1]
gcagttacgtgcaatc

SEQ ID NO: 17712 - DNA, 16 bp, Artificial Sequence
  synthetic [barcode part1]
actagaccgaagatac

SEQ ID NO: 17713 - DNA, 16 bp, Artificial Sequence
  synthetic [barcode part1]
cggtcaatagtgtcgt

SEQ ID NO: 17714 - DNA, 16 bp, Artificial Sequence
  synthetic [barcode part1]
acgaatccgtgtcaac

SEQ ID NO: 17715 - DNA, 16 bp, Artificial Sequence
  synthetic [barcode part1]
atacagtcggcgtgtt

SEQ ID NO: 17716 - DNA, 16 bp, Artificial Sequence
  synthetic [barcode part1]
tggtgcctgttcactg

SEQ ID NO: 17717 - DNA, 16 bp, Artificial Sequence
  synthetic [barcode part1]
taagtgaggcgagtag

SEQ ID NO: 17718 - DNA, 16 bp, Artificial Sequence
  synthetic [barcode part1]
acttgtctgtccgtct

SEQ ID NO: 17719 - DNA, 16 bp, Artificial Sequence
  synthetic [barcode part1]
ttgaacgattcgtggc

SEQ ID NO: 17720 - DNA, 16 bp, Artificial Sequence
  synthetic [barcode part1]
atcacgaggatagatc

SEQ ID NO: 17721 - DNA, 16 bp, Artificial Sequence
  synthetic [barcode part1]
accagttggaacttcg

SEQ ID NO: 17722 - DNA, 16 bp, Artificial Sequence
  synthetic [barcode part1]
ccagtatagttccttg

SEQ ID NO: 17723 - DNA, 16 bp, Artificial Sequence
  synthetic [barcode part1]
gtgaatcggaagtcgc

SEQ ID NO: 17724 - DNA, 16 bp, Artificial Sequence
  synthetic [barcode part1]
acttgcaggagtgacg

SEQ ID NO: 17725 - DNA, 16 bp, Artificial Sequence
  synthetic [barcode part1]
attgcgtattgtcctg

SEQ ID NO: 17726 - DNA, 16 bp, Artificial Sequence
  synthetic [barcode part1]
acggatcgtgtgactt

SEQ ID NO: 17727 - DNA, 16 bp, Artificial Sequence
  synthetic [barcode part1]
cagtgtatagtccttc

SEQ ID NO: 17728 - DNA, 16 bp, Artificial Sequence
  synthetic [barcode part1]
gcgagtcctgaatatc

SEQ ID NO: 17729 - DNA, 16 bp, Artificial Sequence
  synthetic [barcode part1]
cgtacgaccgtcactt

SEQ ID NO: 17730 - DNA, 16 bp, Artificial Sequence
  synthetic [barcode part1]
aaccgcacggtatact

SEQ ID NO: 17731 - DNA, 16 bp, Artificial Sequence
  synthetic [barcode part1]
aatctcgagtgtcgtg

SEQ ID NO: 17732 - DNA, 16 bp, Artificial Sequence
  synthetic [barcode part1]
atccagttcgacagtg

SEQ ID NO: 17733 - DNA, 16 bp, Artificial Sequence
  synthetic [barcode part1]
ttctcctgtcgtagtc

SEQ ID NO: 17734 - DNA, 16 bp, Artificial Sequence
  synthetic [barcode part1]
tcgtaactacaacgcg

SEQ ID NO: 17735 - DNA, 16 bp, Artificial Sequence
  synthetic [barcode part1]
cagtggtgactgttgt

SEQ ID NO: 17736 - DNA, 16 bp, Artificial Sequence
  synthetic [barcode part1]
tcttcaggaggaacct

SEQ ID NO: 17737 - DNA, 16 bp, Artificial Sequence
  synthetic [barcode part1]
gatactacgaccgact

SEQ ID NO: 17738 - DNA, 16 bp, Artificial Sequence
  synthetic [barcode part1]
tggaggtgcctagtag

SEQ ID NO: 17739 - DNA, 16 bp, Artificial Sequence
  synthetic [barcode part1]
agattgcagtacgaac

SEQ ID NO: 17740 - DNA, 16 bp, Artificial Sequence
  synthetic [barcode part1]
ttagtccaacgacggt

SEQ ID NO: 17741 - DNA, 16 bp, Artificial Sequence
  synthetic [barcode part1]
cctaagtcggattcag

SEQ ID NO: 17742 - DNA, 16 bp, Artificial Sequence
  synthetic [barcode part1]
ccaaggataaccttcg

SEQ ID NO: 17743 - DNA, 16 bp, Artificial Sequence
  synthetic [barcode part1]
aggtaccaggcaacgt

SEQ ID NO: 17744 - DNA, 16 bp, Artificial Sequence
  synthetic [barcode part1]
gaagacaacagtctgt

SEQ ID NO: 17745 - DNA, 16 bp, Artificial Sequence
  synthetic [barcode part1]
cactgaggacagtctt

SEQ ID NO: 17746 - DNA, 16 bp, Artificial Sequence
  synthetic [barcode part1]
gccttaactgaagtcg

SEQ ID NO: 17747 - DNA, 16 bp, Artificial Sequence
  synthetic [barcode part1]
tgttcagaagacggcg

SEQ ID NO: 17748 - DNA, 16 bp, Artificial Sequence
  synthetic [barcode part1]
acttatcctgcaacac

SEQ ID NO: 17749 - DNA, 16 bp, Artificial Sequence
  synthetic [barcode part1]
cgagttgtgtggaggt

SEQ ID NO: 17750 - DNA, 16 bp, Artificial Sequence
  synthetic [barcode part1]
cgccttaagtgaagtc

SEQ ID NO: 17751 - DNA, 16 bp, Artificial Sequence
  synthetic [barcode part1]
gactgtactaatcctc

SEQ ID NO: 17752 - DNA, 16 bp, Artificial Sequence
  synthetic [barcode part1]
tcaattcctcggttcc

SEQ ID NO: 17753 - DNA, 16 bp, Artificial Sequence
  synthetic [barcode part1]
acttctagaactgtcc

SEQ ID NO: 17754 - DNA, 16 bp, Artificial Sequence
  synthetic [barcode part1]
aaggtaactgtaggtc

SEQ ID NO: 17755 - DNA, 16 bp, Artificial Sequence
  synthetic [barcode part1]
actcgtcagtgagtac

SEQ ID NO: 17756 - DNA, 16 bp, Artificial Sequence
  synthetic [barcode part1]
cctctgttaccgaacg

SEQ ID NO: 17757 - DNA, 16 bp, Artificial Sequence
  synthetic [barcode part1]
aacgtgccggtgtatt

SEQ ID NO: 17758 - DNA, 16 bp, Artificial Sequence
  synthetic [barcode part1]
tacttcacaccacctc

SEQ ID NO: 17759 - DNA, 16 bp, Artificial Sequence
  synthetic [barcode part1]
gaacgacaatcacgcg

SEQ ID NO: 17760 - DNA, 16 bp, Artificial Sequence
  synthetic [barcode part1]
cgcgtgatatcagtac

SEQ ID NO: 17761 - DNA, 16 bp, Artificial Sequence
  synthetic [barcode part1]
agatcctctggttgag

SEQ ID NO: 17762 - DNA, 16 bp, Artificial Sequence
  synthetic [barcode part1]
caattcgtagaggtag

SEQ ID NO: 17763 - DNA, 16 bp, Artificial Sequence
  synthetic [barcode part1]
ccacactgtctggtac

SEQ ID NO: 17764 - DNA, 16 bp, Artificial Sequence
  synthetic [barcode part1]
aaggatagttctcgcc

SEQ ID NO: 17765 - DNA, 16 bp, Artificial Sequence
  synthetic [barcode part1]
tgcctcgtcgcagatt

SEQ ID NO: 17766 - DNA, 16 bp, Artificial Sequence
  synthetic [barcode part1]
gaagtcgaaggtagtg

SEQ ID NO: 17767 - DNA, 16 bp, Artificial Sequence
  synthetic [barcode part1]
aatccgagtatctctc

SEQ ID NO: 17768 - DNA, 16 bp, Artificial Sequence
  synthetic [barcode part1]
agaggtgacctagtgc

SEQ ID NO: 17769 - DNA, 16 bp, Artificial Sequence
  synthetic [barcode part1]
acgtgtgttggttggt

SEQ ID NO: 17770 - DNA, 16 bp, Artificial Sequence
  synthetic [barcode part1]
agagattccttgaccg

SEQ ID NO: 17771 - DNA, 16 bp, Artificial Sequence
  synthetic [barcode part1]
gacttaaggccactgt

SEQ ID NO: 17772 - DNA, 16 bp, Artificial Sequence
  synthetic [barcode part1]
caactctgaccagagt

SEQ ID NO: 17773 - DNA, 16 bp, Artificial Sequence
  synthetic [barcode part1]
atatcgagtcaggagt

SEQ ID NO: 17774 - DNA, 16 bp, Artificial Sequence
  synthetic [barcode part1]
aagtgaggcggtgtct

SEQ ID NO: 17775 - DNA, 16 bp, Artificial Sequence
  synthetic [barcode part1]
atcgtgacagaacctc

SEQ ID NO: 17776 - DNA, 16 bp, Artificial Sequence
  synthetic [barcode part1]
cagaaggcgtgatcac

SEQ ID NO: 17777 - DNA, 16 bp, Artificial Sequence
  synthetic [barcode part1]
ttgactcgcgaagtgt

SEQ ID NO: 17778 - DNA, 16 bp, Artificial Sequence
  synthetic [barcode part1]
caatctgaagtacgag

SEQ ID NO: 17779 - DNA, 16 bp, Artificial Sequence
  synthetic [barcode part1]
gacttcttcagacgtt

SEQ ID NO: 17780 - DNA, 16 bp, Artificial Sequence
  synthetic [barcode part1]
gaccaacgttgcagtt

SEQ ID NO: 17781 - DNA, 16 bp, Artificial Sequence
  synthetic [barcode part1]
gtatcctgcaccttct

SEQ ID NO: 17782 - DNA, 16 bp, Artificial Sequence
  synthetic [barcode part1]
atactgcggcggatag

SEQ ID NO: 17783 - DNA, 16 bp, Artificial Sequence
  synthetic [barcode part1]
tgaacgcaggacggtt

SEQ ID NO: 17784 - DNA, 16 bp, Artificial Sequence
  synthetic [barcode part1]
agaagacggatatcct

SEQ ID NO: 17785 - DNA, 16 bp, Artificial Sequence
  synthetic [barcode part1]
agtattggacctcggt

SEQ ID NO: 17786 - DNA, 16 bp, Artificial Sequence
  synthetic [barcode part1]
gtctaggatctgtggt

SEQ ID NO: 17787 - DNA, 16 bp, Artificial Sequence
  synthetic [barcode part1]
cgtcactacaactgcc

SEQ ID NO: 17788 - DNA, 16 bp, Artificial Sequence
  synthetic [barcode part1]
gactgcacctcaacct

SEQ ID NO: 17789 - DNA, 16 bp, Artificial Sequence
  synthetic [barcode part1]
aagatcaccaggtgcg

SEQ ID NO: 17790 - DNA, 16 bp, Artificial Sequence
  synthetic [barcode part1]
acctacttgagacctt

SEQ ID NO: 17791 - DNA, 16 bp, Artificial Sequence
  synthetic [barcode part1]
actgtaggagttccac

SEQ ID NO: 17792 - DNA, 16 bp, Artificial Sequence
  synthetic [barcode part1]
atcgacagaaccggac

SEQ ID NO: 17793 - DNA, 16 bp, Artificial Sequence
  synthetic [barcode part1]
tcaactggtactgcag

SEQ ID NO: 17794 - DNA, 16 bp, Artificial Sequence
  synthetic [barcode part1]
tgacgatctgaaccac

SEQ ID NO: 17795 - DNA, 16 bp, Artificial Sequence
  synthetic [barcode part1]
tatcggtctctaactg

SEQ ID NO: 17796 - DNA, 16 bp, Artificial Sequence
  synthetic [barcode part1]
tcacagttcgagatcg

SEQ ID NO: 17797 - DNA, 16 bp, Artificial Sequence
  synthetic [barcode part1]
ttctacgcgatctagt

SEQ ID NO: 17798 - DNA, 16 bp, Artificial Sequence
  synthetic [barcode part1]
cctgacctcaagaagt

SEQ ID NO: 17799 - DNA, 16 bp, Artificial Sequence
  synthetic [barcode part1]
aaccagtgtactgtgc

SEQ ID NO: 17800 - DNA, 16 bp, Artificial Sequence
  synthetic [barcode part1]
cgactagtacgacgtt

SEQ ID NO: 17801 - DNA, 16 bp, Artificial Sequence
  synthetic [barcode part1]
gtacagtgatcagaac

SEQ ID NO: 17802 - DNA, 16 bp, Artificial Sequence
  synthetic [barcode part1]
gagtaggttgtctacc

SEQ ID NO: 17803 - DNA, 16 bp, Artificial Sequence
  synthetic [barcode part1]
gcaggatatctcactg

SEQ ID NO: 17804 - DNA, 16 bp, Artificial Sequence
  synthetic [barcode part1]
cggcactctgtaatag

SEQ ID NO: 17805 - DNA, 16 bp, Artificial Sequence
  synthetic [barcode part1]
aataatccggttcggc

SEQ ID NO: 17806 - DNA, 16 bp, Artificial Sequence
  synthetic [barcode part1]
aggttcaagactagac

SEQ ID NO: 17807 - DNA, 16 bp, Artificial Sequence
  synthetic [barcode part1]
tgcaagtatccacgac

SEQ ID NO: 17808 - DNA, 16 bp, Artificial Sequence
  synthetic [barcode part1]
taggtactggtcctcc

SEQ ID NO: 17809 - DNA, 16 bp, Artificial Sequence
  synthetic [barcode part1]
ccgtgttgtagaagtc

SEQ ID NO: 17810 - DNA, 16 bp, Artificial Sequence
  synthetic [barcode part1]
gcgaaggtagtaactt

SEQ ID NO: 17811 - DNA, 16 bp, Artificial Sequence
  synthetic [barcode part1]
tgtgcaatcgccactc

SEQ ID NO: 17812 - DNA, 16 bp, Artificial Sequence
  synthetic [barcode part1]
gtactaccgttcaccg

SEQ ID NO: 17813 - DNA, 16 bp, Artificial Sequence
  synthetic [barcode part1]
atcacttccactccac

SEQ ID NO: 17814 - DNA, 16 bp, Artificial Sequence
  synthetic [barcode part1]
cactgcgtagtgttag

SEQ ID NO: 17815 - DNA, 16 bp, Artificial Sequence
  synthetic [barcode part1]
gcagtataccgtaacc

SEQ ID NO: 17816 - DNA, 16 bp, Artificial Sequence
  synthetic [barcode part1]
aagacggtaaggcaac

SEQ ID NO: 17817 - DNA, 16 bp, Artificial Sequence
  synthetic [barcode part1]
tcgactagacctcaag

SEQ ID NO: 17818 - DNA, 16 bp, Artificial Sequence
  synthetic [barcode part1]
aacgacttcaggttgc

SEQ ID NO: 17819 - DNA, 16 bp, Artificial Sequence
  synthetic [barcode part1]
attggcgacttcttgt

SEQ ID NO: 17820 - DNA, 16 bp, Artificial Sequence
  synthetic [barcode part1]
actgacgtctgattct

SEQ ID NO: 17821 - DNA, 16 bp, Artificial Sequence
  synthetic [barcode part1]
acagatcacgtctgac

SEQ ID NO: 17822 - DNA, 16 bp, Artificial Sequence
  synthetic [barcode part1]
acttgttggcgttgcc

SEQ ID NO: 17823 - DNA, 16 bp, Artificial Sequence
  synthetic [barcode part1]
gtaggaggccgttaac

SEQ ID NO: 17824 - DNA, 16 bp, Artificial Sequence
  synthetic [barcode part1]
aatagaggtattcggc

SEQ ID NO: 17825 - DNA, 16 bp, Artificial Sequence
  synthetic [barcode part1]
gaactggtgtatagtg

SEQ ID NO: 17826 - DNA, 16 bp, Artificial Sequence
  synthetic [barcode part1]
agttagaacaaccgtg

SEQ ID NO: 17827 - DNA, 16 bp, Artificial Sequence
  synthetic [barcode part1]
tctgttagtgcgattc

SEQ ID NO: 17828 - DNA, 16 bp, Artificial Sequence
  synthetic [barcode part1]
gcagttgaccaacgtt

SEQ ID NO: 17829 - DNA, 16 bp, Artificial Sequence
  synthetic [barcode part1]
gtgtgataaggaatcc

SEQ ID NO: 17830 - DNA, 16 bp, Artificial Sequence
  synthetic [barcode part1]
cgaattcaataaggcg

SEQ ID NO: 17831 - DNA, 16 bp, Artificial Sequence
  synthetic [barcode part1]
cacgagtctgcgaatt

SEQ ID NO: 17832 - DNA, 16 bp, Artificial Sequence
  synthetic [barcode part1]
ttcgtgtaaccgttgt

SEQ ID NO: 17833 - DNA, 16 bp, Artificial Sequence
  synthetic [barcode part1]
atcttgcaagtgcctt

SEQ ID NO: 17834 - DNA, 16 bp, Artificial Sequence
  synthetic [barcode part1]
tctgcctgtgatattg

SEQ ID NO: 17835 - DNA, 16 bp, Artificial Sequence
  synthetic [barcode part1]
tagataggtaacgtcg

SEQ ID NO: 17836 - DNA, 16 bp, Artificial Sequence
  synthetic [barcode part1]
atcagaacagtgcgcg

SEQ ID NO: 17837 - DNA, 16 bp, Artificial Sequence
  synthetic [barcode part1]
cgagactggttgactt

SEQ ID NO: 17838 - DNA, 16 bp, Artificial Sequence
  synthetic [barcode part1]
tacgtgagtagttgcc

SEQ ID NO: 17839 - DNA, 16 bp, Artificial Sequence
  synthetic [barcode part1]
gcaactacgtgactac

SEQ ID NO: 17840 - DNA, 16 bp, Artificial Sequence
  synthetic [barcode part1]
gaattcgttcgcagac

SEQ ID NO: 17841 - DNA, 16 bp, Artificial Sequence
  synthetic [barcode part1]
ttgtcttcacagactg

SEQ ID NO: 17842 - DNA, 16 bp, Artificial Sequence
  synthetic [barcode part1]
gatcaacggttggttc

SEQ ID NO: 17843 - DNA, 16 bp, Artificial Sequence
  synthetic [barcode part1]
gtctctcgcgtgttag

SEQ ID NO: 17844 - DNA, 16 bp, Artificial Sequence
  synthetic [barcode part1]
gaagtggagtaagacc

SEQ ID NO: 17845 - DNA, 16 bp, Artificial Sequence
  synthetic [barcode part1]
atctactcgaacaggc

SEQ ID NO: 17846 - DNA, 16 bp, Artificial Sequence
  synthetic [barcode part1]
acggacctccttgatc

SEQ ID NO: 17847 - DNA, 16 bp, Artificial Sequence
  synthetic [barcode part1]
aagatcttcgcgacgt

SEQ ID NO: 17848 - DNA, 16 bp, Artificial Sequence
  synthetic [barcode part1]
gaccgtattggcctct

SEQ ID NO: 17849 - DNA, 16 bp, Artificial Sequence
  synthetic [barcode part1]
gtctctcagaggattg

SEQ ID NO: 17850 - DNA, 16 bp, Artificial Sequence
  synthetic [barcode part1]
cgtgttattgaaggag

SEQ ID NO: 17851 - DNA, 16 bp, Artificial Sequence
  synthetic [barcode part1]
aatatctcctgacctg

SEQ ID NO: 17852 - DNA, 16 bp, Artificial Sequence
  synthetic [barcode part1]
gcaccacagtgaacag

SEQ ID NO: 17853 - DNA, 16 bp, Artificial Sequence
  synthetic [barcode part1]
agtctcagataggtag

SEQ ID NO: 17854 - DNA, 16 bp, Artificial Sequence
  synthetic [barcode part1]
attcggtcgactcaag

SEQ ID NO: 17855 - DNA, 16 bp, Artificial Sequence
  synthetic [barcode part1]
tctgttgcaacctcct

SEQ ID NO: 17856 - DNA, 16 bp, Artificial Sequence
  synthetic [barcode part1]
gagtgagtactgtggc

SEQ ID NO: 17857 - DNA, 16 bp, Artificial Sequence
  synthetic [barcode part1]
ccgagtcttaacagtg

SEQ ID NO: 17858 - DNA, 16 bp, Artificial Sequence
  synthetic [barcode part1]
cgtgtcgaaggtcaag

SEQ ID NO: 17859 - DNA, 16 bp, Artificial Sequence
  synthetic [barcode part1]
tgcgtaacaggttcac

SEQ ID NO: 17860 - DNA, 16 bp, Artificial Sequence
  synthetic [barcode part1]
ttacttctgcgccgag

SEQ ID NO: 17861 - DNA, 16 bp, Artificial Sequence
  synthetic [barcode part1]
taagtcctactcggag

SEQ ID NO: 17862 - DNA, 16 bp, Artificial Sequence
  synthetic [barcode part1]
gaccgcgttctagtct

SEQ ID NO: 17863 - DNA, 16 bp, Artificial Sequence
  synthetic [barcode part1]
gcaacttcgaactacg

SEQ ID NO: 17864 - DNA, 16 bp, Artificial Sequence
  synthetic [barcode part1]
aaggtatccttgcgtg

SEQ ID NO: 17865 - DNA, 16 bp, Artificial Sequence
  synthetic [barcode part1]
aataccggtattgcgc

SEQ ID NO: 17866 - DNA, 16 bp, Artificial Sequence
  synthetic [barcode part1]
tacctaccgcctatct

SEQ ID NO: 17867 - DNA, 16 bp, Artificial Sequence
  synthetic [barcode part1]
cgcacagataagatac

SEQ ID NO: 17868 - DNA, 16 bp, Artificial Sequence
  synthetic [barcode part1]
gaagaccaccgtgtag

SEQ ID NO: 17869 - DNA, 16 bp, Artificial Sequence
  synthetic [barcode part1]
atccttaacagttcgc

SEQ ID NO: 17870 - DNA, 16 bp, Artificial Sequence
  synthetic [barcode part1]
caatacagtcgtctct

SEQ ID NO: 17871 - DNA, 16 bp, Artificial Sequence
  synthetic [barcode part1]
agtaattcctctgtgc

SEQ ID NO: 17872 - DNA, 16 bp, Artificial Sequence
  synthetic [barcode part1]
ccttctgcactggtag

SEQ ID NO: 17873 - DNA, 16 bp, Artificial Sequence
  synthetic [barcode part1]
attctctaccggtgcg

SEQ ID NO: 17874 - DNA, 16 bp, Artificial Sequence
  synthetic [barcode part1]
cctcgttgtcttgttg

SEQ ID NO: 17875 - DNA, 16 bp, Artificial Sequence
  synthetic [barcode part1]
tggacgacctgaagtg

SEQ ID NO: 17876 - DNA, 16 bp, Artificial Sequence
  synthetic [barcode part1]
gatatccttgccgtcg

SEQ ID NO: 17877 - DNA, 16 bp, Artificial Sequence
  synthetic [barcode part1]
caggcgttagtctctc

SEQ ID NO: 17878 - DNA, 16 bp, Artificial Sequence
  synthetic [barcode part1]
gcgtggtagaaccaac

SEQ ID NO: 17879 - DNA, 16 bp, Artificial Sequence
  synthetic [barcode part1]
cgtaactactatcctg

SEQ ID NO: 17880 - DNA, 16 bp, Artificial Sequence
  synthetic [barcode part1]
tacgtacacacgtgtg

SEQ ID NO: 17881 - DNA, 16 bp, Artificial Sequence
  synthetic [barcode part1]
ttcgtcggtgcgattc

SEQ ID NO: 17882 - DNA, 16 bp, Artificial Sequence
  synthetic [barcode part1]
cactcgtactcacttc

SEQ ID NO: 17883 - DNA, 16 bp, Artificial Sequence
  synthetic [barcode part1]
tggtaggattcacaag

SEQ ID NO: 17884 - DNA, 16 bp, Artificial Sequence
  synthetic [barcode part1]
agattcagagtcaggt

SEQ ID NO: 17885 - DNA, 16 bp, Artificial Sequence
  synthetic [barcode part1]
aagtggccttcgttag

SEQ ID NO: 17886 - DNA, 16 bp, Artificial Sequence
  synthetic [barcode part1]
tggttctacgtatcgt

SEQ ID NO: 17887 - DNA, 16 bp, Artificial Sequence
  synthetic [barcode part1]
gtgagtgcaagtgaag

SEQ ID NO: 17888 - DNA, 16 bp, Artificial Sequence
  synthetic [barcode part1]
attgtgccaatctctg

SEQ ID NO: 17889 - DNA, 16 bp, Artificial Sequence
  synthetic [barcode part1]
aagtgcggtattcctg

SEQ ID NO: 17890 - DNA, 16 bp, Artificial Sequence
  synthetic [barcode part1]
ttataagaccttccgc

SEQ ID NO: 17891 - DNA, 16 bp, Artificial Sequence
  synthetic [barcode part1]
gacgccttgttaacag

SEQ ID NO: 17892 - DNA, 16 bp, Artificial Sequence
  synthetic [barcode part1]
agagtcggtataatcg

SEQ ID NO: 17893 - DNA, 16 bp, Artificial Sequence
  synthetic [barcode part1]
tgaccagtcctctctt

SEQ ID NO: 17894 - DNA, 16 bp, Artificial Sequence
  synthetic [barcode part1]
tacactggtcagtgtg

SEQ ID NO: 17895 - DNA, 16 bp, Artificial Sequence
  synthetic [barcode part1]
tccactcaagtagacg

SEQ ID NO: 17896 - DNA, 16 bp, Artificial Sequence
  synthetic [barcode part1]
gcaaggacgactcaac

SEQ ID NO: 17897 - DNA, 16 bp, Artificial Sequence
  synthetic [barcode part1]
ataggtaggcgagtag

SEQ ID NO: 17898 - DNA, 16 bp, Artificial Sequence
  synthetic [barcode part1]
gtctcgttaagttcac

SEQ ID NO: 17899 - DNA, 16 bp, Artificial Sequence
  synthetic [barcode part1]
ttatcactgtcgcctc

SEQ ID NO: 17900 - DNA, 16 bp, Artificial Sequence
  synthetic [barcode part1]
cgtggtctcctactag

SEQ ID NO: 17901 - DNA, 16 bp, Artificial Sequence
  synthetic [barcode part1]
gtggttgagtcctcct

SEQ ID NO: 17902 - DNA, 16 bp, Artificial Sequence
  synthetic [barcode part1]
tcttgcaatcggactt

SEQ ID NO: 17903 - DNA, 16 bp, Artificial Sequence
  synthetic [barcode part1]
tgtggacgtggcaagt

SEQ ID NO: 17904 - DNA, 16 bp, Artificial Sequence
  synthetic [barcode part1]
aaccggtcttcgaagt

SEQ ID NO: 17905 - DNA, 16 bp, Artificial Sequence
  synthetic [barcode part1]
taacggtccttatacc

SEQ ID NO: 17906 - DNA, 16 bp, Artificial Sequence
  synthetic [barcode part1]
aactgtacacgcgact

SEQ ID NO: 17907 - DNA, 16 bp, Artificial Sequence
  synthetic [barcode part1]
tccgttgtgcaccaac

SEQ ID NO: 17908 - DNA, 16 bp, Artificial Sequence
  synthetic [barcode part1]
cgacgattcagactgt

SEQ ID NO: 17909 - DNA, 16 bp, Artificial Sequence
  synthetic [barcode part1]
ccgacgactatactcc

SEQ ID NO: 17910 - DNA, 16 bp, Artificial Sequence
  synthetic [barcode part1]
atcacgtgtcactccg

SEQ ID NO: 17911 - DNA, 16 bp, Artificial Sequence
  synthetic [barcode part1]
gtactaaccgacacgt

SEQ ID NO: 17912 - DNA, 16 bp, Artificial Sequence
  synthetic [barcode part1]
caccttgtcgtaggtc

SEQ ID NO: 17913 - DNA, 16 bp, Artificial Sequence
  synthetic [barcode part1]
agtacgtggccttctc

SEQ ID NO: 17914 - DNA, 16 bp, Artificial Sequence
  synthetic [barcode part1]
ttccttaggcgtaccg

SEQ ID NO: 17915 - DNA, 16 bp, Artificial Sequence
  synthetic [barcode part1]
gacagtgacttacaag

SEQ ID NO: 17916 - DNA, 16 bp, Artificial Sequence
  synthetic [barcode part1]
cctcaatcgacctctt

SEQ ID NO: 17917 - DNA, 16 bp, Artificial Sequence
  synthetic [barcode part1]
gttgtagtcgcaacac

SEQ ID NO: 17918 - DNA, 16 bp, Artificial Sequence
  synthetic [barcode part1]
gactactgcaacctag

SEQ ID NO: 17919 - DNA, 16 bp, Artificial Sequence
  synthetic [barcode part1]
ccaggtaacgaatcct

SEQ ID NO: 17920 - DNA, 16 bp, Artificial Sequence
  synthetic [barcode part1]
ataccagaatcgtgcc

SEQ ID NO: 17921 - DNA, 16 bp, Artificial Sequence
  synthetic [barcode part1]
cagttaggaagaggac

SEQ ID NO: 17922 - DNA, 16 bp, Artificial Sequence
  synthetic [barcode part1]
tccagtatccacaccg

SEQ ID NO: 17923 - DNA, 16 bp, Artificial Sequence
  synthetic [barcode part1]
tggatatcagtcctct

SEQ ID NO: 17924 - DNA, 16 bp, Artificial Sequence
  synthetic [barcode part1]
gacgtagttacacctg

SEQ ID NO: 17925 - DNA, 16 bp, Artificial Sequence
  synthetic [barcode part1]
gccttgcagtacgtct

SEQ ID NO: 17926 - DNA, 16 bp, Artificial Sequence
  synthetic [barcode part1]
tcgcgttgtaacttac

SEQ ID NO: 17927 - DNA, 16 bp, Artificial Sequence
  synthetic [barcode part1]
ccgacttggatacctc

SEQ ID NO: 17928 - DNA, 16 bp, Artificial Sequence
  synthetic [barcode part1]
tactcgttccagagtt

SEQ ID NO: 17929 - DNA, 16 bp, Artificial Sequence
  synthetic [barcode part1]
aagaggagtatcgcag

SEQ ID NO: 17930 - DNA, 16 bp, Artificial Sequence
  synthetic [barcode part1]
tcacactaggccgtct

SEQ ID NO: 17931 - DNA, 16 bp, Artificial Sequence
  synthetic [barcode part1]
cgactcctggtatatt

SEQ ID NO: 17932 - DNA, 16 bp, Artificial Sequence
  synthetic [barcode part1]
cgtattcgaaccgcct

SEQ ID NO: 17933 - DNA, 16 bp, Artificial Sequence
  synthetic [barcode part1]
aagtaagaagtctcgc

SEQ ID NO: 17934 - DNA, 16 bp, Artificial Sequence
  synthetic [barcode part1]
gtctagactacgaacc

SEQ ID NO: 17935 - DNA, 16 bp, Artificial Sequence
  synthetic [barcode part1]
ccttagttacagacct

SEQ ID NO: 17936 - DNA, 16 bp, Artificial Sequence
  synthetic [barcode part1]
cgccttaacttgtaac

SEQ ID NO: 17937 - DNA, 16 bp, Artificial Sequence
  synthetic [barcode part1]
aacgacctgcggaagt

SEQ ID NO: 17938 - DNA, 16 bp, Artificial Sequence
  synthetic [barcode part1]
agaccgtgagtgtggt

SEQ ID NO: 17939 - DNA, 16 bp, Artificial Sequence
  synthetic [barcode part1]
cgaagtcagtcctagt

SEQ ID NO: 17940 - DNA, 16 bp, Artificial Sequence
  synthetic [barcode part1]
agtgtcaccggaattc

SEQ ID NO: 17941 - DNA, 16 bp, Artificial Sequence
  synthetic [barcode part1]
cacgcaacgaagaatt

SEQ ID NO: 17942 - DNA, 16 bp, Artificial Sequence
  synthetic [barcode part1]
tgaggtcttgatcggt

SEQ ID NO: 17943 - DNA, 16 bp, Artificial Sequence
  synthetic [barcode part1]
gagattatacgagtcg

SEQ ID NO: 17944 - DNA, 16 bp, Artificial Sequence
  synthetic [barcode part1]
ttccacgatcaggtcc

SEQ ID NO: 17945 - DNA, 16 bp, Artificial Sequence
  synthetic [barcode part1]
gtaacgtcgatcaacc

SEQ ID NO: 17946 - DNA, 16 bp, Artificial Sequence
  synthetic [barcode part1]
ataaggaattgccgac

SEQ ID NO: 17947 - DNA, 16 bp, Artificial Sequence
  synthetic [barcode part1]
caccaatatcagtgcg

SEQ ID NO: 17948 - DNA, 16 bp, Artificial Sequence
  synthetic [barcode part1]
acttgacgtgtctccg

SEQ ID NO: 17949 - DNA, 16 bp, Artificial Sequence
  synthetic [barcode part1]
cggttgaaggatcctt

SEQ ID NO: 17950 - DNA, 16 bp, Artificial Sequence
  synthetic [barcode part1]
atctatcacgacgttc

SEQ ID NO: 17951 - DNA, 16 bp, Artificial Sequence
  synthetic [barcode part1]
atacaataccgacgcc

SEQ ID NO: 17952 - DNA, 16 bp, Artificial Sequence
  synthetic [barcode part1]
agaatccgataagtgc

SEQ ID NO: 17953 - DNA, 16 bp, Artificial Sequence
  synthetic [barcode part1]
gcaacaccagtgttgt

SEQ ID NO: 17954 - DNA, 16 bp, Artificial Sequence
  synthetic [barcode part1]
ttataagaggcgcctc

SEQ ID NO: 17955 - DNA, 16 bp, Artificial Sequence
  synthetic [barcode part1]
cggcgtgaggatagtt

SEQ ID NO: 17956 - DNA, 16 bp, Artificial Sequence
  synthetic [barcode part1]
cgatataggcctgtgt

SEQ ID NO: 17957 - DNA, 16 bp, Artificial Sequence
  synthetic [barcode part1]
tctcctgcgaacctag

SEQ ID NO: 17958 - DNA, 16 bp, Artificial Sequence
  synthetic [barcode part1]
acgtatctactctgtg

SEQ ID NO: 17959 - DNA, 16 bp, Artificial Sequence
  synthetic [barcode part1]
gtgtaggtctaacaag

SEQ ID NO: 17960 - DNA, 16 bp, Artificial Sequence
  synthetic [barcode part1]
gataccgccttcttct

SEQ ID NO: 17961 - DNA, 16 bp, Artificial Sequence
  synthetic [barcode part1]
cagagagagttccttc

SEQ ID NO: 17962 - DNA, 16 bp, Artificial Sequence
  synthetic [barcode part1]
cacagtgcctgaagtt

SEQ ID NO: 17963 - DNA, 16 bp, Artificial Sequence
  synthetic [barcode part1]
actgagtccactagac

SEQ ID NO: 17964 - DNA, 16 bp, Artificial Sequence
  synthetic [barcode part1]
tcagaaccagagttcc

SEQ ID NO: 17965 - DNA, 16 bp, Artificial Sequence
  synthetic [barcode part1]
taggtctggcaagacg

SEQ ID NO: 17966 - DNA, 16 bp, Artificial Sequence
  synthetic [barcode part1]
gcgactcaacacgaag

SEQ ID NO: 17967 - DNA, 16 bp, Artificial Sequence
  synthetic [barcode part1]
tcggcacgtatatcag

SEQ ID NO: 17968 - DNA, 16 bp, Artificial Sequence
  synthetic [barcode part1]
gcacttccgacgattc

SEQ ID NO: 17969 - DNA, 16 bp, Artificial Sequence
  synthetic [barcode part1]
gttccgcacctggatt

SEQ ID NO: 17970 - DNA, 16 bp, Artificial Sequence
  synthetic [barcode part1]
tcaagtccagtctgag

SEQ ID NO: 17971 - DNA, 16 bp, Artificial Sequence
  synthetic [barcode part1]
tctgtcctctacctag

SEQ ID NO: 17972 - DNA, 16 bp, Artificial Sequence
  synthetic [barcode part1]
aagttagtgcgtaacg

SEQ ID NO: 17973 - DNA, 16 bp, Artificial Sequence
  synthetic [barcode part1]
agtcaactgtgacgtc

SEQ ID NO: 17974 - DNA, 16 bp, Artificial Sequence
  synthetic [barcode part1]
tagtgtgcctcgttgc

SEQ ID NO: 17975 - DNA, 16 bp, Artificial Sequence
  synthetic [barcode part1]
accttcacgtccttgt

SEQ ID NO: 17976 - DNA, 16 bp, Artificial Sequence
  synthetic [barcode part1]
agattattgtctccgc

SEQ ID NO: 17977 - DNA, 16 bp, Artificial Sequence
  synthetic [barcode part1]
atccgatatcgtcgag

SEQ ID NO: 17978 - DNA, 16 bp, Artificial Sequence
  synthetic [barcode part1]
tgcaggtggtacttgt

SEQ ID NO: 17979 - DNA, 16 bp, Artificial Sequence
  synthetic [barcode part1]
atctcgtgcagttact

SEQ ID NO: 17980 - DNA, 16 bp, Artificial Sequence
  synthetic [barcode part1]
attcgtgaccgaggag

SEQ ID NO: 17981 - DNA, 16 bp, Artificial Sequence
  synthetic [barcode part1]
gagaatatctaacggc

SEQ ID NO: 17982 - DNA, 16 bp, Artificial Sequence
  synthetic [barcode part1]
taggtacgactacgtc

SEQ ID NO: 17983 - DNA, 16 bp, Artificial Sequence
  synthetic [barcode part1]
taatcgcgaactgaag

SEQ ID NO: 17984 - DNA, 16 bp, Artificial Sequence
  synthetic [barcode part1]
ccggtcttcgttactt

SEQ ID NO: 17985 - DNA, 16 bp, Artificial Sequence
  synthetic [barcode part1]
atccgcgcaacttctg

SEQ ID NO: 17986 - DNA, 16 bp, Artificial Sequence
  synthetic [barcode part1]
ccaacttgcctaagtt

SEQ ID NO: 17987 - DNA, 16 bp, Artificial Sequence
  synthetic [barcode part1]
cagactgactggactt

SEQ ID NO: 17988 - DNA, 16 bp, Artificial Sequence
  synthetic [barcode part1]
tgcactagaagtcaag

SEQ ID NO: 17989 - DNA, 16 bp, Artificial Sequence
  synthetic [barcode part1]
tgttcgtggacagact

SEQ ID NO: 17990 - DNA, 16 bp, Artificial Sequence
  synthetic [barcode part1]
acaccggaagacaacc

SEQ ID NO: 17991 - DNA, 16 bp, Artificial Sequence
  synthetic [barcode part1]
tagaccgatacagagt

SEQ ID NO: 17992 - DNA, 16 bp, Artificial Sequence
  synthetic [barcode part1]
gcgactggtgttaatc

SEQ ID NO: 17993 - DNA, 16 bp, Artificial Sequence
  synthetic [barcode part1]
gtaactcggcacgaag

SEQ ID NO: 17994 - DNA, 16 bp, Artificial Sequence
  synthetic [barcode part1]
cagacttagacagtag

SEQ ID NO: 17995 - DNA, 16 bp, Artificial Sequence
  synthetic [barcode part1]
gagtggtgtacttaag

SEQ ID NO: 17996 - DNA, 16 bp, Artificial Sequence
  synthetic [barcode part1]
acgtgcacagtatcgt

SEQ ID NO: 17997 - DNA, 16 bp, Artificial Sequence
  synthetic [barcode part1]
gtcagacacagaagtt

SEQ ID NO: 17998 - DNA, 16 bp, Artificial Sequence
  synthetic [barcode part1]
acttaccgttcgtcct

SEQ ID NO: 17999 - DNA, 16 bp, Artificial Sequence
  synthetic [barcode part1]
ttcagacctcgacctg

SEQ ID NO: 18000 - DNA, 16 bp, Artificial Sequence
  synthetic [barcode part1]
tgttatctcgccactc

SEQ ID NO: 18001 - DNA, 16 bp, Artificial Sequence
  synthetic [barcode part1]
gttacggcctatccgt

SEQ ID NO: 18002 - DNA, 16 bp, Artificial Sequence
  synthetic [barcode part1]
ttcgcgttaacttgac

SEQ ID NO: 18003 - DNA, 16 bp, Artificial Sequence
  synthetic [barcode part1]
aggatagacctgtagt

SEQ ID NO: 18004 - DNA, 16 bp, Artificial Sequence
  synthetic [barcode part1]
gcactggaggaatcac

SEQ ID NO: 18005 - DNA, 16 bp, Artificial Sequence
  synthetic [barcode part1]
gattcgactcctgcac

SEQ ID NO: 18006 - DNA, 16 bp, Artificial Sequence
  synthetic [barcode part1]
gacacacgactggagt

SEQ ID NO: 18007 - DNA, 16 bp, Artificial Sequence
  synthetic [barcode part1]
accacgaatctacctt

SEQ ID NO: 18008 - DNA, 16 bp, Artificial Sequence
  synthetic [barcode part1]
aaccaactcaggactc

SEQ ID NO: 18009 - DNA, 16 bp, Artificial Sequence
  synthetic [barcode part1]
gtcctatagacgttct

SEQ ID NO: 18010 - DNA, 16 bp, Artificial Sequence
  synthetic [barcode part1]
ttctggaccgtctgtg

SEQ ID NO: 18011 - DNA, 16 bp, Artificial Sequence
  synthetic [barcode part1]
agttcggtcctgtatt

SEQ ID NO: 18012 - DNA, 16 bp, Artificial Sequence
  synthetic [barcode part1]
acgcgaaggattattg

SEQ ID NO: 18013 - DNA, 16 bp, Artificial Sequence
  synthetic [barcode part1]
tagtgtgtcgacgtac

SEQ ID NO: 18014 - DNA, 16 bp, Artificial Sequence
  synthetic [barcode part1]
cgtggtcaggaatcag

SEQ ID NO: 18015 - DNA, 16 bp, Artificial Sequence
  synthetic [barcode part1]
gacactgacgtacact

SEQ ID NO: 18016 - DNA, 16 bp, Artificial Sequence
  synthetic [barcode part1]
cgaccttactacgcac

SEQ ID NO: 18017 - DNA, 16 bp, Artificial Sequence
  synthetic [barcode part1]
tcctctcttgaggtct

SEQ ID NO: 18018 - DNA, 16 bp, Artificial Sequence
  synthetic [barcode part1]
tgcaatctgcgttgag

SEQ ID NO: 18019 - DNA, 16 bp, Artificial Sequence
  synthetic [barcode part1]
aagacgaggtatctgt

SEQ ID NO: 18020 - DNA, 16 bp, Artificial Sequence
  synthetic [barcode part1]
tctgacactgcactcg

SEQ ID NO: 18021 - DNA, 16 bp, Artificial Sequence
  synthetic [barcode part1]
aacaacacactgtccg

SEQ ID NO: 18022 - DNA, 16 bp, Artificial Sequence
  synthetic [barcode part1]
actcaccacttgttcc

SEQ ID NO: 18023 - DNA, 16 bp, Artificial Sequence
  synthetic [barcode part1]
ccgtgaagtggttgtt

SEQ ID NO: 18024 - DNA, 16 bp, Artificial Sequence
  synthetic [barcode part1]
agtaacagtggcagag

SEQ ID NO: 18025 - DNA, 16 bp, Artificial Sequence
  synthetic [barcode part1]
gttgatactgtcacct

SEQ ID NO: 18026 - DNA, 16 bp, Artificial Sequence
  synthetic [barcode part1]
taagagtcgtcaggcg

SEQ ID NO: 18027 - DNA, 16 bp, Artificial Sequence
  synthetic [barcode part1]
tggaccggaagtgtac

SEQ ID NO: 18028 - DNA, 16 bp, Artificial Sequence
  synthetic [barcode part1]
tgttcagaccacctcg

SEQ ID NO: 18029 - DNA, 16 bp, Artificial Sequence
  synthetic [barcode part1]
tggattgtacaaggac

SEQ ID NO: 18030 - DNA, 16 bp, Artificial Sequence
  synthetic [barcode part1]
ccttgtccgagtgttg

SEQ ID NO: 18031 - DNA, 16 bp, Artificial Sequence
  synthetic [barcode part1]
gtcgagtacagtctgt

SEQ ID NO: 18032 - DNA, 16 bp, Artificial Sequence
  synthetic [barcode part1]
aggcgagtacctatct

SEQ ID NO: 18033 - DNA, 16 bp, Artificial Sequence
  synthetic [barcode part1]
gcactggaggatagtc

SEQ ID NO: 18034 - DNA, 16 bp, Artificial Sequence
  synthetic [barcode part1]
agatcgcgaactacct

SEQ ID NO: 18035 - DNA, 16 bp, Artificial Sequence
  synthetic [barcode part1]
cgatctcagagaatcc

SEQ ID NO: 18036 - DNA, 16 bp, Artificial Sequence
  synthetic [barcode part1]
taggtacgactgtacc

SEQ ID NO: 18037 - DNA, 16 bp, Artificial Sequence
  synthetic [barcode part1]
gtcctgcgaacgttct

SEQ ID NO: 18038 - DNA, 16 bp, Artificial Sequence
  synthetic [barcode part1]
gaccacacacacaact

SEQ ID NO: 18039 - DNA, 16 bp, Artificial Sequence
  synthetic [barcode part1]
ccgagacaatactgtc

SEQ ID NO: 18040 - DNA, 16 bp, Artificial Sequence
  synthetic [barcode part1]
ccacgttcttggcaac

SEQ ID NO: 18041 - DNA, 16 bp, Artificial Sequence
  synthetic [barcode part1]
aacacaccacagttgc

SEQ ID NO: 18042 - DNA, 16 bp, Artificial Sequence
  synthetic [barcode part1]
ttcagtcggttctcct

SEQ ID NO: 18043 - DNA, 16 bp, Artificial Sequence
  synthetic [barcode part1]
accttgaactacgacg

SEQ ID NO: 18044 - DNA, 16 bp, Artificial Sequence
  synthetic [barcode part1]
cgcaagtagtaaggtt

SEQ ID NO: 18045 - DNA, 16 bp, Artificial Sequence
  synthetic [barcode part1]
gtccttgaacaacttc

SEQ ID NO: 18046 - DNA, 16 bp, Artificial Sequence
  synthetic [barcode part1]
acgttaggtcgtcctc

SEQ ID NO: 18047 - DNA, 16 bp, Artificial Sequence
  synthetic [barcode part1]
cgtaggcagatagtgc

SEQ ID NO: 18048 - DNA, 16 bp, Artificial Sequence
  synthetic [barcode part1]
acgatcttccgtaccg

SEQ ID NO: 18049 - DNA, 16 bp, Artificial Sequence
  synthetic [barcode part1]
aaccaggagtacgtcg

SEQ ID NO: 18050 - DNA, 16 bp, Artificial Sequence
  synthetic [barcode part1]
actcggatctgagtgt

SEQ ID NO: 18051 - DNA, 16 bp, Artificial Sequence
  synthetic [barcode part1]
atagaggcaacttggt

SEQ ID NO: 18052 - DNA, 16 bp, Artificial Sequence
  synthetic [barcode part1]
aagattcacagacggt

SEQ ID NO: 18053 - DNA, 16 bp, Artificial Sequence
  synthetic [barcode part1]
gaattgagttagtgcg

SEQ ID NO: 18054 - DNA, 16 bp, Artificial Sequence
  synthetic [barcode part1]
actgtgtactgtcttg

SEQ ID NO: 18055 - DNA, 16 bp, Artificial Sequence
  synthetic [barcode part1]
tctagttgttacacgc

SEQ ID NO: 18056 - DNA, 16 bp, Artificial Sequence
  synthetic [barcode part1]
cagttgattccaggac

SEQ ID NO: 18057 - DNA, 16 bp, Artificial Sequence
  synthetic [barcode part1]
gttcgatcagtctgag

SEQ ID NO: 18058 - DNA, 16 bp, Artificial Sequence
  synthetic [barcode part1]
tatctctgagagtgcg

SEQ ID NO: 18059 - DNA, 16 bp, Artificial Sequence
  synthetic [barcode part1]
tcaggcgtctactacc

SEQ ID NO: 18060 - DNA, 16 bp, Artificial Sequence
  synthetic [barcode part1]
taagtcgtctccgcac

SEQ ID NO: 18061 - DNA, 16 bp, Artificial Sequence
  synthetic [barcode part1]
gttaacctgtgcgtag

SEQ ID NO: 18062 - DNA, 16 bp, Artificial Sequence
  synthetic [barcode part1]
ccgtaggatcttccac

SEQ ID NO: 18063 - DNA, 16 bp, Artificial Sequence
  synthetic [barcode part1]
caagtcaagaacgtac

SEQ ID NO: 18064 - DNA, 16 bp, Artificial Sequence
  synthetic [barcode part1]
tcctgtgagaagtgtc

SEQ ID NO: 18065 - DNA, 16 bp, Artificial Sequence
  synthetic [barcode part1]
gatatccacctcttag

SEQ ID NO: 18066 - DNA, 16 bp, Artificial Sequence
  synthetic [barcode part1]
atacgcgtcaggatct

SEQ ID NO: 18067 - DNA, 16 bp, Artificial Sequence
  synthetic [barcode part1]
tgcgtatcttcaggag

SEQ ID NO: 18068 - DNA, 16 bp, Artificial Sequence
  synthetic [barcode part1]
ttcgccgtcagtacgt

SEQ ID NO: 18069 - DNA, 16 bp, Artificial Sequence
  synthetic [barcode part1]
acaatccgatacagag

SEQ ID NO: 18070 - DNA, 16 bp, Artificial Sequence
  synthetic [barcode part1]
cctctcacactggtag

SEQ ID NO: 18071 - DNA, 16 bp, Artificial Sequence
  synthetic [barcode part1]
acgaccaatcgtgtgt

SEQ ID NO: 18072 - DNA, 16 bp, Artificial Sequence
  synthetic [barcode part1]
tctcggcagtcgtact

SEQ ID NO: 18073 - DNA, 16 bp, Artificial Sequence
  synthetic [barcode part1]
tctgtaccagttcagt

SEQ ID NO: 18074 - DNA, 16 bp, Artificial Sequence
  synthetic [barcode part1]
cggttcttgactatac

SEQ ID NO: 18075 - DNA, 16 bp, Artificial Sequence
  synthetic [barcode part1]
atacacgccttctctc

SEQ ID NO: 18076 - DNA, 16 bp, Artificial Sequence
  synthetic [barcode part1]
tgcagttcgtgttgag

SEQ ID NO: 18077 - DNA, 16 bp, Artificial Sequence
  synthetic [barcode part1]
tcgtagtgttacggtg

SEQ ID NO: 18078 - DNA, 16 bp, Artificial Sequence
  synthetic [barcode part1]
tcactagtatactccg

SEQ ID NO: 18079 - DNA, 16 bp, Artificial Sequence
  synthetic [barcode part1]
gagataacaagacggc

SEQ ID NO: 18080 - DNA, 16 bp, Artificial Sequence
  synthetic [barcode part1]
agtataccggtcgtgt

SEQ ID NO: 18081 - DNA, 16 bp, Artificial Sequence
  synthetic [barcode part1]
aggtcgtaacacaagt

SEQ ID NO: 18082 - DNA, 16 bp, Artificial Sequence
  synthetic [barcode part1]
gatagtaatccgcaag

SEQ ID NO: 18083 - DNA, 16 bp, Artificial Sequence
  synthetic [barcode part1]
cactgaatccagtgac

SEQ ID NO: 18084 - DNA, 16 bp, Artificial Sequence
  synthetic [barcode part1]
gttcgttcgttgtagt

SEQ ID NO: 18085 - DNA, 16 bp, Artificial Sequence
  synthetic [barcode part1]
aacctcacggacgaag

SEQ ID NO: 18086 - DNA, 16 bp, Artificial Sequence
  synthetic [barcode part1]
cgaccagattgcaatc

SEQ ID NO: 18087 - DNA, 16 bp, Artificial Sequence
  synthetic [barcode part1]
tggtacgtgcaagtct

SEQ ID NO: 18088 - DNA, 16 bp, Artificial Sequence
  synthetic [barcode part1]
tggtacgcctctgact

SEQ ID NO: 18089 - DNA, 16 bp, Artificial Sequence
  synthetic [barcode part1]
agtgtctcttgtggag

SEQ ID NO: 18090 - DNA, 16 bp, Artificial Sequence
  synthetic [barcode part1]
gacgtcgattggttac

SEQ ID NO: 18091 - DNA, 16 bp, Artificial Sequence
  synthetic [barcode part1]
agaatagaggcagtgc

SEQ ID NO: 18092 - DNA, 16 bp, Artificial Sequence
  synthetic [barcode part1]
cggactctgaatatcg

SEQ ID NO: 18093 - DNA, 16 bp, Artificial Sequence
  synthetic [barcode part1]
cgcgagttgagtattc

SEQ ID NO: 18094 - DNA, 16 bp, Artificial Sequence
  synthetic [barcode part1]
ttgatccgtaaccgtt

SEQ ID NO: 18095 - DNA, 16 bp, Artificial Sequence
  synthetic [barcode part1]
accagtatagaaggtc

SEQ ID NO: 18096 - DNA, 16 bp, Artificial Sequence
  synthetic [barcode part1]
cgaggcctataacgtt

SEQ ID NO: 18097 - DNA, 16 bp, Artificial Sequence
  synthetic [barcode part1]
gactactgacacggag

SEQ ID NO: 18098 - DNA, 16 bp, Artificial Sequence
  synthetic [barcode part1]
cgtccaggaaggttag

SEQ ID NO: 18099 - DNA, 16 bp, Artificial Sequence
  synthetic [barcode part1]
acgaggtggtactcag

SEQ ID NO: 18100 - DNA, 16 bp, Artificial Sequence
  synthetic [barcode part1]
gccttctaagaagtcg

SEQ ID NO: 18101 - DNA, 16 bp, Artificial Sequence
  synthetic [barcode part1]
acaacacaccaaccac

SEQ ID NO: 18102 - DNA, 16 bp, Artificial Sequence
  synthetic [barcode part1]
gacttctatcgcctct

SEQ ID NO: 18103 - DNA, 16 bp, Artificial Sequence
  synthetic [barcode part1]
attaaggaccggtgcg

SEQ ID NO: 18104 - DNA, 16 bp, Artificial Sequence
  synthetic [barcode part1]
ataacgactgcgtaag

SEQ ID NO: 18105 - DNA, 16 bp, Artificial Sequence
  synthetic [barcode part1]
ttatcgcgagtggtgt

SEQ ID NO: 18106 - DNA, 16 bp, Artificial Sequence
  synthetic [barcode part1]
tacgttgtggtacacg

SEQ ID NO: 18107 - DNA, 16 bp, Artificial Sequence
  synthetic [barcode part1]
tctcaaggtccgttcg

SEQ ID NO: 18108 - DNA, 16 bp, Artificial Sequence
  synthetic [barcode part1]
aacggtgcgttcgaag

SEQ ID NO: 18109 - DNA, 16 bp, Artificial Sequence
  synthetic [barcode part1]
tcgtacaccgaaggag

SEQ ID NO: 18110 - DNA, 16 bp, Artificial Sequence
  synthetic [barcode part1]
atataacgtcgcgcac

SEQ ID NO: 18111 - DNA, 16 bp, Artificial Sequence
  synthetic [barcode part1]
tcgtaccagattatcc

SEQ ID NO: 18112 - DNA, 16 bp, Artificial Sequence
  synthetic [barcode part1]
actctgacagtcagtg

SEQ ID NO: 18113 - DNA, 16 bp, Artificial Sequence
  synthetic [barcode part1]
ccacaatccagagttg

SEQ ID NO: 18114 - DNA, 16 bp, Artificial Sequence
  synthetic [barcode part1]
atcagtgtcgcacaac

SEQ ID NO: 18115 - DNA, 16 bp, Artificial Sequence
  synthetic [barcode part1]
accggtacgtcttatt

SEQ ID NO: 18116 - DNA, 16 bp, Artificial Sequence
  synthetic [barcode part1]
ccactattaggtgtct

SEQ ID NO: 18117 - DNA, 16 bp, Artificial Sequence
  synthetic [barcode part1]
caggtgttaatctcct

SEQ ID NO: 18118 - DNA, 16 bp, Artificial Sequence
  synthetic [barcode part1]
tggtcgcctattattg

SEQ ID NO: 18119 - DNA, 16 bp, Artificial Sequence
  synthetic [barcode part1]
gcaccgtacttactcg

SEQ ID NO: 18120 - DNA, 16 bp, Artificial Sequence
  synthetic [barcode part1]
ttccaatccgagtgcc

SEQ ID NO: 18121 - DNA, 16 bp, Artificial Sequence
  synthetic [barcode part1]
tactcacttgcaacgt

SEQ ID NO: 18122 - DNA, 16 bp, Artificial Sequence
  synthetic [barcode part1]
tcgtctgtgaacgaac

SEQ ID NO: 18123 - DNA, 16 bp, Artificial Sequence
  synthetic [barcode part1]
tgtgactaaccgtgtg

SEQ ID NO: 18124 - DNA, 16 bp, Artificial Sequence
  synthetic [barcode part1]
tccgtaacggaataag

SEQ ID NO: 18125 - DNA, 16 bp, Artificial Sequence
  synthetic [barcode part1]
acaaccgatcacacgt

SEQ ID NO: 18126 - DNA, 16 bp, Artificial Sequence
  synthetic [barcode part1]
tactcacggacagact

SEQ ID NO: 18127 - DNA, 16 bp, Artificial Sequence
  synthetic [barcode part1]
tattcgcgacactact

SEQ ID NO: 18128 - DNA, 16 bp, Artificial Sequence
  synthetic [barcode part1]
agtagtctcgaaccac

SEQ ID NO: 18129 - DNA, 16 bp, Artificial Sequence
  synthetic [barcode part1]
tagacgtgacttgtgc

SEQ ID NO: 18130 - DNA, 16 bp, Artificial Sequence
  synthetic [barcode part1]
ttggtgatactcttgc

SEQ ID NO: 18131 - DNA, 16 bp, Artificial Sequence
  synthetic [barcode part1]
attgcggtctattcgt

SEQ ID NO: 18132 - DNA, 16 bp, Artificial Sequence
  synthetic [barcode part1]
gacttaggaagacgcc

SEQ ID NO: 18133 - DNA, 16 bp, Artificial Sequence
  synthetic [barcode part1]
tcaaggttaggcggac

SEQ ID NO: 18134 - DNA, 16 bp, Artificial Sequence
  synthetic [barcode part1]
aagaaggtcctccttg

SEQ ID NO: 18135 - DNA, 16 bp, Artificial Sequence
  synthetic [barcode part1]
tggccagatcaattgc

SEQ ID NO: 18136 - DNA, 16 bp, Artificial Sequence
  synthetic [barcode part1]
gaattccggtcgattg

SEQ ID NO: 18137 - DNA, 16 bp, Artificial Sequence
  synthetic [barcode part1]
cctgcgtaacttgatt

SEQ ID NO: 18138 - DNA, 16 bp, Artificial Sequence
  synthetic [barcode part1]
aacgtcacagtcaacc

SEQ ID NO: 18139 - DNA, 16 bp, Artificial Sequence
  synthetic [barcode part1]
tcgtagtagaggagag

SEQ ID NO: 18140 - DNA, 16 bp, Artificial Sequence
  synthetic [barcode part1]
tctgaacaacgcactg

SEQ ID NO: 18141 - DNA, 16 bp, Artificial Sequence
  synthetic [barcode part1]
tgtcaacgttggtacg

SEQ ID NO: 18142 - DNA, 16 bp, Artificial Sequence
  synthetic [barcode part1]
cgattgaaccgtaacc

SEQ ID NO: 18143 - DNA, 16 bp, Artificial Sequence
  synthetic [barcode part1]
ttagaatctgtccgtc

SEQ ID NO: 18144 - DNA, 16 bp, Artificial Sequence
  synthetic [barcode part1]
tcgtgatcgactagtg

SEQ ID NO: 18145 - DNA, 16 bp, Artificial Sequence
  synthetic [barcode part1]
tccggactagatctag

SEQ ID NO: 18146 - DNA, 16 bp, Artificial Sequence
  synthetic [barcode part1]
cacgaattgtcgcctc

SEQ ID NO: 18147 - DNA, 16 bp, Artificial Sequence
  synthetic [barcode part1]
gtaactcttcgtgccg

SEQ ID NO: 18148 - DNA, 16 bp, Artificial Sequence
  synthetic [barcode part1]
gatagtactacaggtg

SEQ ID NO: 18149 - DNA, 16 bp, Artificial Sequence
  synthetic [barcode part1]
agtgtaatccaacgag

SEQ ID NO: 18150 - DNA, 16 bp, Artificial Sequence
  synthetic [barcode part1]
ttactcaggtgtcgcc

SEQ ID NO: 18151 - DNA, 16 bp, Artificial Sequence
  synthetic [barcode part1]
ccacagaagtgacggt

SEQ ID NO: 18152 - DNA, 16 bp, Artificial Sequence
  synthetic [barcode part1]
accgtaacttgttcac

SEQ ID NO: 18153 - DNA, 16 bp, Artificial Sequence
  synthetic [barcode part1]
gagaccagttgagaag

SEQ ID NO: 18154 - DNA, 16 bp, Artificial Sequence
  synthetic [barcode part1]
caccaaggaactgtct

SEQ ID NO: 18155 - DNA, 16 bp, Artificial Sequence
  synthetic [barcode part1]
actgcaatatcacggc

SEQ ID NO: 18156 - DNA, 16 bp, Artificial Sequence
  synthetic [barcode part1]
taggtgtacacgactc

SEQ ID NO: 18157 - DNA, 16 bp, Artificial Sequence
  synthetic [barcode part1]
cgagaacagacgtaag

SEQ ID NO: 18158 - DNA, 16 bp, Artificial Sequence
  synthetic [barcode part1]
cgtacagtggagaatt

SEQ ID NO: 18159 - DNA, 16 bp, Artificial Sequence
  synthetic [barcode part1]
gaaggtgcctatatcc

SEQ ID NO: 18160 - DNA, 16 bp, Artificial Sequence
  synthetic [barcode part1]
agtggacgttctggag

SEQ ID NO: 18161 - DNA, 16 bp, Artificial Sequence
  synthetic [barcode part1]
ccttgcggttagacct

SEQ ID NO: 18162 - DNA, 16 bp, Artificial Sequence
  synthetic [barcode part1]
agtccgataactcggt

SEQ ID NO: 18163 - DNA, 16 bp, Artificial Sequence
  synthetic [barcode part1]
gtaccttccgaattgt

SEQ ID NO: 18164 - DNA, 16 bp, Artificial Sequence
  synthetic [barcode part1]
gtccgaggttctgttc

SEQ ID NO: 18165 - DNA, 16 bp, Artificial Sequence
  synthetic [barcode part1]
cgtgtcttagaccacc

SEQ ID NO: 18166 - DNA, 16 bp, Artificial Sequence
  synthetic [barcode part1]
agtatccgtaaccacg

SEQ ID NO: 18167 - DNA, 16 bp, Artificial Sequence
  synthetic [barcode part1]
tctccaacggcgtgtt

SEQ ID NO: 18168 - DNA, 16 bp, Artificial Sequence
  synthetic [barcode part1]
cgttcaattaggcacg

SEQ ID NO: 18169 - DNA, 16 bp, Artificial Sequence
  synthetic [barcode part1]
ttcgacaacgaggacg

SEQ ID NO: 18170 - DNA, 16 bp, Artificial Sequence
  synthetic [barcode part1]
gtctcctcacgtagtg

SEQ ID NO: 18171 - DNA, 16 bp, Artificial Sequence
  synthetic [barcode part1]
gcgtatatcgagactc

SEQ ID NO: 18172 - DNA, 16 bp, Artificial Sequence
  synthetic [barcode part1]
aggccacaacgtgaac

SEQ ID NO: 18173 - DNA, 16 bp, Artificial Sequence
  synthetic [barcode part1]
gtgttagatcacttcc

SEQ ID NO: 18174 - DNA, 16 bp, Artificial Sequence
  synthetic [barcode part1]
tggactacggtaatcc

SEQ ID NO: 18175 - DNA, 16 bp, Artificial Sequence
  synthetic [barcode part1]
tatctaccgagtggac

SEQ ID NO: 18176 - DNA, 16 bp, Artificial Sequence
  synthetic [barcode part1]
cgtgaacacgagtctt

SEQ ID NO: 18177 - DNA, 16 bp, Artificial Sequence
  synthetic [barcode part1]
gaaggaattccgagag

SEQ ID NO: 18178 - DNA, 16 bp, Artificial Sequence
  synthetic [barcode part1]
ttgaggtagacctcac

SEQ ID NO: 18179 - DNA, 16 bp, Artificial Sequence
  synthetic [barcode part1]
ataacgccaataccgc

SEQ ID NO: 18180 - DNA, 16 bp, Artificial Sequence
  synthetic [barcode part1]
tgaacacgatcgtgtc

SEQ ID NO: 18181 - DNA, 16 bp, Artificial Sequence
  synthetic [barcode part1]
attatcctcgtggatc

SEQ ID NO: 18182 - DNA, 16 bp, Artificial Sequence
  synthetic [barcode part1]
gccgtctcctactatt

SEQ ID NO: 18183 - DNA, 16 bp, Artificial Sequence
  synthetic [barcode part1]
aagaggtaacgcgcct

SEQ ID NO: 18184 - DNA, 16 bp, Artificial Sequence
  synthetic [barcode part1]
actggcgttacacaac

SEQ ID NO: 18185 - DNA, 16 bp, Artificial Sequence
  synthetic [barcode part1]
tctgtgtcagtctagt

SEQ ID NO: 18186 - DNA, 16 bp, Artificial Sequence
  synthetic [barcode part1]
cggccaagtgtatatc

SEQ ID NO: 18187 - DNA, 16 bp, Artificial Sequence
  synthetic [barcode part1]
ttccgtgtgtactctc

SEQ ID NO: 18188 - DNA, 16 bp, Artificial Sequence
  synthetic [barcode part1]
tagacgtaccaagaac

SEQ ID NO: 18189 - DNA, 16 bp, Artificial Sequence
  synthetic [barcode part1]
aatcgcacggtgtatc

SEQ ID NO: 18190 - DNA, 16 bp, Artificial Sequence
  synthetic [barcode part1]
cgaagtggagtgttcg

SEQ ID NO: 18191 - DNA, 16 bp, Artificial Sequence
  synthetic [barcode part1]
cgttctctccttgtag

SEQ ID NO: 18192 - DNA, 16 bp, Artificial Sequence
  synthetic [barcode part1]
attcgtgcggtcttcg

SEQ ID NO: 18193 - DNA, 16 bp, Artificial Sequence
  synthetic [barcode part1]
gaccaacggttagtct

SEQ ID NO: 18194 - DNA, 16 bp, Artificial Sequence
  synthetic [barcode part1]
gtggtagtggacctag

SEQ ID NO: 18195 - DNA, 16 bp, Artificial Sequence
  synthetic [barcode part1]
gcgcggtaatcctctt

SEQ ID NO: 18196 - DNA, 16 bp, Artificial Sequence
  synthetic [barcode part1]
cctaagacacaacgtc

SEQ ID NO: 18197 - DNA, 16 bp, Artificial Sequence
  synthetic [barcode part1]
gagtaggaacgttgcc

SEQ ID NO: 18198 - DNA, 16 bp, Artificial Sequence
  synthetic [barcode part1]
tgcctctatacggaag

SEQ ID NO: 18199 - DNA, 16 bp, Artificial Sequence
  synthetic [barcode part1]
ccttacgttctacgtc

SEQ ID NO: 18200 - DNA, 16 bp, Artificial Sequence
  synthetic [barcode part1]
ttactaaccagtggcg

SEQ ID NO: 18201 - DNA, 16 bp, Artificial Sequence
  synthetic [barcode part1]
acttagaaggcaacgt

SEQ ID NO: 18202 - DNA, 16 bp, Artificial Sequence
  synthetic [barcode part1]
acgtgtaaggaggaac

SEQ ID NO: 18203 - DNA, 16 bp, Artificial Sequence
  synthetic [barcode part1]
gcactaacaatcttcc

SEQ ID NO: 18204 - DNA, 16 bp, Artificial Sequence
  synthetic [barcode part1]
tctggtcgcacactac

SEQ ID NO: 18205 - DNA, 16 bp, Artificial Sequence
  synthetic [barcode part1]
cgcgtctactcttgtt

SEQ ID NO: 18206 - DNA, 16 bp, Artificial Sequence
  synthetic [barcode part1]
gccttggcgatattag

SEQ ID NO: 18207 - DNA, 16 bp, Artificial Sequence
  synthetic [barcode part1]
agtcggttcctagagt

SEQ ID NO: 18208 - DNA, 16 bp, Artificial Sequence
  synthetic [barcode part1]
caattccgacctctct

SEQ ID NO: 18209 - DNA, 16 bp, Artificial Sequence
  synthetic [barcode part1]
agtgtacaccacacac

SEQ ID NO: 18210 - DNA, 16 bp, Artificial Sequence
  synthetic [barcode part1]
taccagattgtgtctc

SEQ ID NO: 18211 - DNA, 16 bp, Artificial Sequence
  synthetic [barcode part1]
ttctcagtgtggttgt

SEQ ID NO: 18212 - DNA, 16 bp, Artificial Sequence
  synthetic [barcode part1]
ccaggatcctggaatt

SEQ ID NO: 18213 - DNA, 16 bp, Artificial Sequence
  synthetic [barcode part1]
actaagacctcctgag

SEQ ID NO: 18214 - DNA, 16 bp, Artificial Sequence
  synthetic [barcode part1]
aggttaacaacgcgcg

SEQ ID NO: 18215 - DNA, 16 bp, Artificial Sequence
  synthetic [barcode part1]
ccactacagtatctac

SEQ ID NO: 18216 - DNA, 16 bp, Artificial Sequence
  synthetic [barcode part1]
atacaccgaaccggag

SEQ ID NO: 18217 - DNA, 16 bp, Artificial Sequence
  synthetic [barcode part1]
gcaccttgtatccttc

SEQ ID NO: 18218 - DNA, 16 bp, Artificial Sequence
  synthetic [barcode part1]
accgaacgcggaagtt

SEQ ID NO: 18219 - DNA, 16 bp, Artificial Sequence
  synthetic [barcode part1]
cgttacctattggcgc

SEQ ID NO: 18220 - DNA, 16 bp, Artificial Sequence
  synthetic [barcode part1]
agtaagaacacgactc

SEQ ID NO: 18221 - DNA, 16 bp, Artificial Sequence
  synthetic [barcode part1]
attcgcctcgtctatc

SEQ ID NO: 18222 - DNA, 16 bp, Artificial Sequence
  synthetic [barcode part1]
tcggatagacgtctac

SEQ ID NO: 18223 - DNA, 16 bp, Artificial Sequence
  synthetic [barcode part1]
ccgacgtagtcttctg

SEQ ID NO: 18224 - DNA, 16 bp, Artificial Sequence
  synthetic [barcode part1]
tgtggtaccacttatc

SEQ ID NO: 18225 - DNA, 16 bp, Artificial Sequence
  synthetic [barcode part1]
ttgatatcctcagtcg

SEQ ID NO: 18226 - DNA, 16 bp, Artificial Sequence
  synthetic [barcode part1]
tgttcgcctatctgtc

SEQ ID NO: 18227 - DNA, 16 bp, Artificial Sequence
  synthetic [barcode part1]
cctagagattgcgact

SEQ ID NO: 18228 - DNA, 16 bp, Artificial Sequence
  synthetic [barcode part1]
taccgtctctaacctc

SEQ ID NO: 18229 - DNA, 16 bp, Artificial Sequence
  synthetic [barcode part1]
caacagtggttactgc

SEQ ID NO: 18230 - DNA, 16 bp, Artificial Sequence
  synthetic [barcode part1]
cagatctaggtggcag

SEQ ID NO: 18231 - DNA, 16 bp, Artificial Sequence
  synthetic [barcode part1]
ccttgtacacgagagt

SEQ ID NO: 18232 - DNA, 16 bp, Artificial Sequence
  synthetic [barcode part1]
cgcgagtcagatattc

SEQ ID NO: 18233 - DNA, 16 bp, Artificial Sequence
  synthetic [barcode part1]
actcctgacgatccac

SEQ ID NO: 18234 - DNA, 16 bp, Artificial Sequence
  synthetic [barcode part1]
gtaccaagtgtgactc

SEQ ID NO: 18235 - DNA, 16 bp, Artificial Sequence
  synthetic [barcode part1]
cacgattggaacggtg

SEQ ID NO: 18236 - DNA, 16 bp, Artificial Sequence
  synthetic [barcode part1]
ttctggttcagtgtgt

SEQ ID NO: 18237 - DNA, 16 bp, Artificial Sequence
  synthetic [barcode part1]
actcgtcgaacagatc

SEQ ID NO: 18238 - DNA, 16 bp, Artificial Sequence
  synthetic [barcode part1]
ttccgcgagaagtgtt

SEQ ID NO: 18239 - DNA, 16 bp, Artificial Sequence
  synthetic [barcode part1]
ttattgccgaggcaac

SEQ ID NO: 18240 - DNA, 16 bp, Artificial Sequence
  synthetic [barcode part1]
atcgatcaaccggttg

SEQ ID NO: 18241 - DNA, 16 bp, Artificial Sequence
  synthetic [barcode part1]
tcacaccttgttgaac

SEQ ID NO: 18242 - DNA, 16 bp, Artificial Sequence
  synthetic [barcode part1]
cacaagtcaggtgttc

SEQ ID NO: 18243 - DNA, 16 bp, Artificial Sequence
  synthetic [barcode part1]
caagaccttgatcggt

SEQ ID NO: 18244 - DNA, 16 bp, Artificial Sequence
  synthetic [barcode part1]
tgagacgtcgtgtgag

SEQ ID NO: 18245 - DNA, 16 bp, Artificial Sequence
  synthetic [barcode part1]
tacgactctaggtacg

SEQ ID NO: 18246 - DNA, 16 bp, Artificial Sequence
  synthetic [barcode part1]
tacctaggatctgcag

SEQ ID NO: 18247 - DNA, 16 bp, Artificial Sequence
  synthetic [barcode part1]
gttggagatcgacacg

SEQ ID NO: 18248 - DNA, 16 bp, Artificial Sequence
  synthetic [barcode part1]
accacctgatacttac

SEQ ID NO: 18249 - DNA, 16 bp, Artificial Sequence
  synthetic [barcode part1]
ttcctaacgacacgcc

SEQ ID NO: 18250 - DNA, 16 bp, Artificial Sequence
  synthetic [barcode part1]
taacggccgtaggagt

SEQ ID NO: 18251 - DNA, 16 bp, Artificial Sequence
  synthetic [barcode part1]
acgccgaccttattgc

SEQ ID NO: 18252 - DNA, 16 bp, Artificial Sequence
  synthetic [barcode part1]
gatccaatcttcgtac

SEQ ID NO: 18253 - DNA, 16 bp, Artificial Sequence
  synthetic [barcode part1]
gatcttggcgaacgag

SEQ ID NO: 18254 - DNA, 16 bp, Artificial Sequence
  synthetic [barcode part1]
tgagtacttggtgtgc

SEQ ID NO: 18255 - DNA, 16 bp, Artificial Sequence
  synthetic [barcode part1]
tacaggcctcactatt

SEQ ID NO: 18256 - DNA, 16 bp, Artificial Sequence
  synthetic [barcode part1]
cacttagactaccttg

SEQ ID NO: 18257 - DNA, 16 bp, Artificial Sequence
  synthetic [barcode part1]
acagttgacacgttgc

SEQ ID NO: 18258 - DNA, 16 bp, Artificial Sequence
  synthetic [barcode part1]
tcaacctcgttagtgt

SEQ ID NO: 18259 - DNA, 16 bp, Artificial Sequence
  synthetic [barcode part1]
aatctctccagtgcgc

SEQ ID NO: 18260 - DNA, 16 bp, Artificial Sequence
  synthetic [barcode part1]
cgtcttggtcttgttc

SEQ ID NO: 18261 - DNA, 16 bp, Artificial Sequence
  synthetic [barcode part1]
tcgtaccgaatcgtcc

SEQ ID NO: 18262 - DNA, 16 bp, Artificial Sequence
  synthetic [barcode part1]
actagtggagtcggac

SEQ ID NO: 18263 - DNA, 16 bp, Artificial Sequence
  synthetic [barcode part1]
tgtgtgaagtggtaac

SEQ ID NO: 18264 - DNA, 16 bp, Artificial Sequence
  synthetic [barcode part1]
tctctgagtgtcaact

SEQ ID NO: 18265 - DNA, 16 bp, Artificial Sequence
  synthetic [barcode part1]
gagtctaggtaacaac

SEQ ID NO: 18266 - DNA, 16 bp, Artificial Sequence
  synthetic [barcode part1]
tcgtagactacgtgac

SEQ ID NO: 18267 - DNA, 16 bp, Artificial Sequence
  synthetic [barcode part1]
acggcgtactataacc

SEQ ID NO: 18268 - DNA, 16 bp, Artificial Sequence
  synthetic [barcode part1]
gtgtggttacgatcgt

SEQ ID NO: 18269 - DNA, 16 bp, Artificial Sequence
  synthetic [barcode part1]
ccacttcgattatacg

SEQ ID NO: 18270 - DNA, 16 bp, Artificial Sequence
  synthetic [barcode part1]
ccaacgcgaaggattg

SEQ ID NO: 18271 - DNA, 16 bp, Artificial Sequence
  synthetic [barcode part1]
acgttcaacttcgccg

SEQ ID NO: 18272 - DNA, 16 bp, Artificial Sequence
  synthetic [barcode part1]
tggtcagactggttgt

SEQ ID NO: 18273 - DNA, 16 bp, Artificial Sequence
  synthetic [barcode part1]
agtatcgtgaccgatc

SEQ ID NO: 18274 - DNA, 16 bp, Artificial Sequence
  synthetic [barcode part1]
ccgcactgtctagtgt

SEQ ID NO: 18275 - DNA, 16 bp, Artificial Sequence
  synthetic [barcode part1]
taacacctacttaccg

SEQ ID NO: 18276 - DNA, 16 bp, Artificial Sequence
  synthetic [barcode part1]
accacggtgtctgttc

SEQ ID NO: 18277 - DNA, 16 bp, Artificial Sequence
  synthetic [barcode part1]
cgaacttgtgatagag

SEQ ID NO: 18278 - DNA, 16 bp, Artificial Sequence
  synthetic [barcode part1]
gcaccaataatcctct

SEQ ID NO: 18279 - DNA, 16 bp, Artificial Sequence
  synthetic [barcode part1]
tcggccttgaggaatt

SEQ ID NO: 18280 - DNA, 16 bp, Artificial Sequence
  synthetic [barcode part1]
tacaagatcgacggcg

SEQ ID NO: 18281 - DNA, 16 bp, Artificial Sequence
  synthetic [barcode part1]
acacgactagtgcact

SEQ ID NO: 18282 - DNA, 16 bp, Artificial Sequence
  synthetic [barcode part1]
tcgtcaatcctcgcag

SEQ ID NO: 18283 - DNA, 16 bp, Artificial Sequence
  synthetic [barcode part1]
gacttagttgagtcgc

SEQ ID NO: 18284 - DNA, 16 bp, Artificial Sequence
  synthetic [barcode part1]
atcgtgtcaacctccg

SEQ ID NO: 18285 - DNA, 16 bp, Artificial Sequence
  synthetic [barcode part1]
tgtcggagtaagaact

SEQ ID NO: 18286 - DNA, 16 bp, Artificial Sequence
  synthetic [barcode part1]
agtccaactgacaacc

SEQ ID NO: 18287 - DNA, 16 bp, Artificial Sequence
  synthetic [barcode part1]
agagatatctgacgac

SEQ ID NO: 18288 - DNA, 16 bp, Artificial Sequence
  synthetic [barcode part1]
gacctctcgtgttgac

SEQ ID NO: 18289 - DNA, 16 bp, Artificial Sequence
  synthetic [barcode part1]
agtccaagactcgatc

SEQ ID NO: 18290 - DNA, 16 bp, Artificial Sequence
  synthetic [barcode part1]
ttgccacgtgagtctc

SEQ ID NO: 18291 - DNA, 16 bp, Artificial Sequence
  synthetic [barcode part1]
cctcaacctagacacc

SEQ ID NO: 18292 - DNA, 16 bp, Artificial Sequence
  synthetic [barcode part1]
aggacaaccgcgagtt

SEQ ID NO: 18293 - DNA, 16 bp, Artificial Sequence
  synthetic [barcode part1]
actgaggatatcaacg

SEQ ID NO: 18294 - DNA, 16 bp, Artificial Sequence
  synthetic [barcode part1]
cacgtaataaggaacc

SEQ ID NO: 18295 - DNA, 16 bp, Artificial Sequence
  synthetic [barcode part1]
agagttacgacaggag

SEQ ID NO: 18296 - DNA, 16 bp, Artificial Sequence
  synthetic [barcode part1]
tcagtgtcctctcgag

SEQ ID NO: 18297 - DNA, 16 bp, Artificial Sequence
  synthetic [barcode part1]
ttgactccgagaggtt

SEQ ID NO: 18298 - DNA, 16 bp, Artificial Sequence
  synthetic [barcode part1]
aggcgtcctatcttgc

SEQ ID NO: 18299 - DNA, 16 bp, Artificial Sequence
  synthetic [barcode part1]
gtcacagtaggcgagt

SEQ ID NO: 18300 - DNA, 16 bp, Artificial Sequence
  synthetic [barcode part1]
gaggagttatctcgtc

SEQ ID NO: 18301 - DNA, 16 bp, Artificial Sequence
  synthetic [barcode part1]
aggtctgtagacctgt

SEQ ID NO: 18302 - DNA, 16 bp, Artificial Sequence
  synthetic [barcode part1]
tacttggatcgttctg

SEQ ID NO: 18303 - DNA, 16 bp, Artificial Sequence
  synthetic [barcode part1]
gtgcacaacacgtgtt

SEQ ID NO: 18304 - DNA, 16 bp, Artificial Sequence
  synthetic [barcode part1]
ccaactctagagaacc

SEQ ID NO: 18305 - DNA, 16 bp, Artificial Sequence
  synthetic [barcode part1]
gtgccgatagttcctc

SEQ ID NO: 18306 - DNA, 16 bp, Artificial Sequence
  synthetic [barcode part1]
ccaggtgttgccttac

SEQ ID NO: 18307 - DNA, 16 bp, Artificial Sequence
  synthetic [barcode part1]
aggtagaggcaccgtt

SEQ ID NO: 18308 - DNA, 16 bp, Artificial Sequence
  synthetic [barcode part1]
tgagtggcacttgttg

SEQ ID NO: 18309 - DNA, 16 bp, Artificial Sequence
  synthetic [barcode part1]
atccgtagatccacag

SEQ ID NO: 18310 - DNA, 16 bp, Artificial Sequence
  synthetic [barcode part1]
cacctaacttcgttag

SEQ ID NO: 18311 - DNA, 16 bp, Artificial Sequence
  synthetic [barcode part1]
tggcgcaactatcctc

SEQ ID NO: 18312 - DNA, 16 bp, Artificial Sequence
  synthetic [barcode part1]
agactcgaataacggt

SEQ ID NO: 18313 - DNA, 16 bp, Artificial Sequence
  synthetic [barcode part1]
agtactcgatacgtcg

SEQ ID NO: 18314 - DNA, 16 bp, Artificial Sequence
  synthetic [barcode part1]
acacagtgtgtactgc

SEQ ID NO: 18315 - DNA, 16 bp, Artificial Sequence
  synthetic [barcode part1]
tatagtaccgcaacgc

SEQ ID NO: 18316 - DNA, 16 bp, Artificial Sequence
  synthetic [barcode part1]
tgtagacgtccgtaac

SEQ ID NO: 18317 - DNA, 16 bp, Artificial Sequence
  synthetic [barcode part1]
cgccacacagtattag

SEQ ID NO: 18318 - DNA, 16 bp, Artificial Sequence
  synthetic [barcode part1]
acgcagattgttagag

SEQ ID NO: 18319 - DNA, 16 bp, Artificial Sequence
  synthetic [barcode part1]
ataatacacgccgcac

SEQ ID NO: 18320 - DNA, 16 bp, Artificial Sequence
  synthetic [barcode part1]
tgacgttcactgcaag

SEQ ID NO: 18321 - DNA, 16 bp, Artificial Sequence
  synthetic [barcode part1]
taatcgacggccgatt

SEQ ID NO: 18322 - DNA, 16 bp, Artificial Sequence
  synthetic [barcode part1]
ccgaataattcgcgac

SEQ ID NO: 18323 - DNA, 16 bp, Artificial Sequence
  synthetic [barcode part1]
gttcactcactcacct

SEQ ID NO: 18324 - DNA, 16 bp, Artificial Sequence
  synthetic [barcode part1]
atctccactgtgtcct

SEQ ID NO: 18325 - DNA, 16 bp, Artificial Sequence
  synthetic [barcode part1]
tgatagtgcactcctt

SEQ ID NO: 18326 - DNA, 16 bp, Artificial Sequence
  synthetic [barcode part1]
cggtcctcgcacaatt

SEQ ID NO: 18327 - DNA, 16 bp, Artificial Sequence
  synthetic [barcode part1]
gacgtgtggaggactt

SEQ ID NO: 18328 - DNA, 16 bp, Artificial Sequence
  synthetic [barcode part1]
cgtggtaattccaggt

SEQ ID NO: 18329 - DNA, 16 bp, Artificial Sequence
  synthetic [barcode part1]
tagagaggtcggcact

SEQ ID NO: 18330 - DNA, 16 bp, Artificial Sequence
  synthetic [barcode part1]
gttagacttcagtggc

SEQ ID NO: 18331 - DNA, 16 bp, Artificial Sequence
  synthetic [barcode part1]
aagtacaacgcgagag

SEQ ID NO: 18332 - DNA, 16 bp, Artificial Sequence
  synthetic [barcode part1]
gaaccgtgaactacct

SEQ ID NO: 18333 - DNA, 16 bp, Artificial Sequence
  synthetic [barcode part1]
tattcaccgttgtgac

SEQ ID NO: 18334 - DNA, 16 bp, Artificial Sequence
  synthetic [barcode part1]
aataccgccttggaac

SEQ ID NO: 18335 - DNA, 16 bp, Artificial Sequence
  synthetic [barcode part1]
ttccttacgtcggcag

SEQ ID NO: 18336 - DNA, 16 bp, Artificial Sequence
  synthetic [barcode part1]
aagttgcaccttcgcc

SEQ ID NO: 18337 - DNA, 16 bp, Artificial Sequence
  synthetic [barcode part1]
atattgactggtgcgc

SEQ ID NO: 18338 - DNA, 16 bp, Artificial Sequence
  synthetic [barcode part1]
tcggtgaccactaagt

SEQ ID NO: 18339 - DNA, 16 bp, Artificial Sequence
  synthetic [barcode part1]
acaactacggtcacgt

SEQ ID NO: 18340 - DNA, 16 bp, Artificial Sequence
  synthetic [barcode part1]
tactcgccttactcac

SEQ ID NO: 18341 - DNA, 16 bp, Artificial Sequence
  synthetic [barcode part1]
tgagtaatccaaggtg

SEQ ID NO: 18342 - DNA, 16 bp, Artificial Sequence
  synthetic [barcode part1]
ttggacttcagtggtg

SEQ ID NO: 18343 - DNA, 16 bp, Artificial Sequence
  synthetic [barcode part1]
tccgccactctattgt

SEQ ID NO: 18344 - DNA, 16 bp, Artificial Sequence
  synthetic [barcode part1]
gataagacctccgatc

SEQ ID NO: 18345 - DNA, 16 bp, Artificial Sequence
  synthetic [barcode part1]
tgcggcgtgttcactt

SEQ ID NO: 18346 - DNA, 16 bp, Artificial Sequence
  synthetic [barcode part1]
aacgatcttggatcgc

SEQ ID NO: 18347 - DNA, 16 bp, Artificial Sequence
  synthetic [barcode part1]
accagtaacctggatc

SEQ ID NO: 18348 - DNA, 16 bp, Artificial Sequence
  synthetic [barcode part1]
tgtacttagaccactc

SEQ ID NO: 18349 - DNA, 16 bp, Artificial Sequence
  synthetic [barcode part1]
cgttgatcttcctaag

SEQ ID NO: 18350 - DNA, 16 bp, Artificial Sequence
  synthetic [barcode part1]
gcaatctcaccaagtg

SEQ ID NO: 18351 - DNA, 16 bp, Artificial Sequence
  synthetic [barcode part1]
acgattgattggtgcc

SEQ ID NO: 18352 - DNA, 16 bp, Artificial Sequence
  synthetic [barcode part1]
accttatactctccgc

SEQ ID NO: 18353 - DNA, 16 bp, Artificial Sequence
  synthetic [barcode part1]
ttacgttgcgattcac

SEQ ID NO: 18354 - DNA, 16 bp, Artificial Sequence
  synthetic [barcode part1]
actaagtgcgagaact

SEQ ID NO: 18355 - DNA, 16 bp, Artificial Sequence
  synthetic [barcode part1]
tacttggatcgagaag

SEQ ID NO: 18356 - DNA, 16 bp, Artificial Sequence
  synthetic [barcode part1]
cgaacgcactatcctc

SEQ ID NO: 18357 - DNA, 16 bp, Artificial Sequence
  synthetic [barcode part1]
gtgttgatcctattgc

SEQ ID NO: 18358 - DNA, 16 bp, Artificial Sequence
  synthetic [barcode part1]
cgtattgtgatacgcg

SEQ ID NO: 18359 - DNA, 16 bp, Artificial Sequence
  synthetic [barcode part1]
acgccgagagataacc

SEQ ID NO: 18360 - DNA, 16 bp, Artificial Sequence
  synthetic [barcode part1]
aacgtacacgtcagtc

SEQ ID NO: 18361 - DNA, 16 bp, Artificial Sequence
  synthetic [barcode part1]
agtactgacaccacac

SEQ ID NO: 18362 - DNA, 16 bp, Artificial Sequence
  synthetic [barcode part1]
cggtcttactgtgcac

SEQ ID NO: 18363 - DNA, 16 bp, Artificial Sequence
  synthetic [barcode part1]
gagactcggcaagtgt

SEQ ID NO: 18364 - DNA, 16 bp, Artificial Sequence
  synthetic [barcode part1]
gcagtcgccttagttc

SEQ ID NO: 18365 - DNA, 16 bp, Artificial Sequence
  synthetic [barcode part1]
ccacttgtcacttacc

SEQ ID NO: 18366 - DNA, 16 bp, Artificial Sequence
  synthetic [barcode part1]
gcgatacgattgacct

SEQ ID NO: 18367 - DNA, 16 bp, Artificial Sequence
  synthetic [barcode part1]
ttgtacctctggcggt

SEQ ID NO: 18368 - DNA, 16 bp, Artificial Sequence
  synthetic [barcode part1]
cgtctcactacaggtc

SEQ ID NO: 18369 - DNA, 16 bp, Artificial Sequence
  synthetic [barcode part1]
gttctgacctcagaag

SEQ ID NO: 18370 - DNA, 16 bp, Artificial Sequence
  synthetic [barcode part1]
tgatctcaggactggt

SEQ ID NO: 18371 - DNA, 16 bp, Artificial Sequence
  synthetic [barcode part1]
acaacgtgactggttc

SEQ ID NO: 18372 - DNA, 16 bp, Artificial Sequence
  synthetic [barcode part1]
tcgtcggaacttaacg

SEQ ID NO: 18373 - DNA, 16 bp, Artificial Sequence
  synthetic [barcode part1]
aatcttcgattcacgc

SEQ ID NO: 18374 - DNA, 16 bp, Artificial Sequence
  synthetic [barcode part1]
actgaggtacgaccag

SEQ ID NO: 18375 - DNA, 16 bp, Artificial Sequence
  synthetic [barcode part1]
gtagagaactactggt

SEQ ID NO: 18376 - DNA, 16 bp, Artificial Sequence
  synthetic [barcode part1]
cagacttcacctagag

SEQ ID NO: 18377 - DNA, 16 bp, Artificial Sequence
  synthetic [barcode part1]
tctagtccaactacgt

SEQ ID NO: 18378 - DNA, 16 bp, Artificial Sequence
  synthetic [barcode part1]
gtcctaactctcttcg

SEQ ID NO: 18379 - DNA, 16 bp, Artificial Sequence
  synthetic [barcode part1]
aacctcaggacgaacg

SEQ ID NO: 18380 - DNA, 16 bp, Artificial Sequence
  synthetic [barcode part1]
taggtgttcttatcgc

SEQ ID NO: 18381 - DNA, 16 bp, Artificial Sequence
  synthetic [barcode part1]
gtactcctggttcgac

SEQ ID NO: 18382 - DNA, 16 bp, Artificial Sequence
  synthetic [barcode part1]
gcagacagtagacaag

SEQ ID NO: 18383 - DNA, 16 bp, Artificial Sequence
  synthetic [barcode part1]
tcaaggtccacctgtc

SEQ ID NO: 18384 - DNA, 16 bp, Artificial Sequence
  synthetic [barcode part1]
tcacgtcgtgatctgc

SEQ ID NO: 18385 - DNA, 16 bp, Artificial Sequence
  synthetic [barcode part1]
cgtgtcgttccgattg

SEQ ID NO: 18386 - DNA, 16 bp, Artificial Sequence
  synthetic [barcode part1]
gttcgtcgcaatattc

SEQ ID NO: 18387 - DNA, 16 bp, Artificial Sequence
  synthetic [barcode part1]
tactggtacaccaacg

SEQ ID NO: 18388 - DNA, 16 bp, Artificial Sequence
  synthetic [barcode part1]
agtactgtgtggtgtc

SEQ ID NO: 18389 - DNA, 16 bp, Artificial Sequence
  synthetic [barcode part1]
acgaactgcgtctaac

SEQ ID NO: 18390 - DNA, 16 bp, Artificial Sequence
  synthetic [barcode part1]
cgaccaacaacgttgt

SEQ ID NO: 18391 - DNA, 16 bp, Artificial Sequence
  synthetic [barcode part1]
cacgtgatccgatcct

SEQ ID NO: 18392 - DNA, 16 bp, Artificial Sequence
  synthetic [barcode part1]
cctgtacggttgtcac

SEQ ID NO: 18393 - DNA, 16 bp, Artificial Sequence
  synthetic [barcode part1]
gactagtgagatctcc

SEQ ID NO: 18394 - DNA, 16 bp, Artificial Sequence
  synthetic [barcode part1]
cgaagaatcaggaggt

SEQ ID NO: 18395 - DNA, 16 bp, Artificial Sequence
  synthetic [barcode part1]
actgagtacagaagtc

SEQ ID NO: 18396 - DNA, 16 bp, Artificial Sequence
  synthetic [barcode part1]
aactgtcgcgagagtg

SEQ ID NO: 18397 - DNA, 16 bp, Artificial Sequence
  synthetic [barcode part1]
aattgagatctaggcg

SEQ ID NO: 18398 - DNA, 16 bp, Artificial Sequence
  synthetic [barcode part1]
gattcaggcgcagaac

SEQ ID NO: 18399 - DNA, 16 bp, Artificial Sequence
  synthetic [barcode part1]
caagtgcaaggattgt

SEQ ID NO: 18400 - DNA, 16 bp, Artificial Sequence
  synthetic [barcode part1]
gaacgtgtggcaactg

SEQ ID NO: 18401 - DNA, 16 bp, Artificial Sequence
  synthetic [barcode part1]
actacgtcaacaagag

SEQ ID NO: 18402 - DNA, 16 bp, Artificial Sequence
  synthetic [barcode part1]
aatatctgcctctcag

SEQ ID NO: 18403 - DNA, 16 bp, Artificial Sequence
  synthetic [barcode part1]
atccggcctcctatag

SEQ ID NO: 18404 - DNA, 16 bp, Artificial Sequence
  synthetic [barcode part1]
cagacagtggatagag

SEQ ID NO: 18405 - DNA, 16 bp, Artificial Sequence
  synthetic [barcode part1]
agttacgcaactacgc

SEQ ID NO: 18406 - DNA, 16 bp, Artificial Sequence
  synthetic [barcode part1]
tatccgaactatcctg

SEQ ID NO: 18407 - DNA, 16 bp, Artificial Sequence
  synthetic [barcode part1]
aagtctgtccaatctc

SEQ ID NO: 18408 - DNA, 16 bp, Artificial Sequence
  synthetic [barcode part1]
aacactaccgagacct

SEQ ID NO: 18409 - DNA, 16 bp, Artificial Sequence
  synthetic [barcode part1]
tagtcgatacgtgtgc

SEQ ID NO: 18410 - DNA, 16 bp, Artificial Sequence
  synthetic [barcode part1]
cctaagacgcgtatac

SEQ ID NO: 18411 - DNA, 16 bp, Artificial Sequence
  synthetic [barcode part1]
caactcttgcgattgt

SEQ ID NO: 18412 - DNA, 16 bp, Artificial Sequence
  synthetic [barcode part1]
gcgcgatatatcgatc

SEQ ID NO: 18413 - DNA, 16 bp, Artificial Sequence
  synthetic [barcode part1]
ccaacggtgtctctac

SEQ ID NO: 18414 - DNA, 16 bp, Artificial Sequence
  synthetic [barcode part1]
atactatctcgcctag

SEQ ID NO: 18415 - DNA, 16 bp, Artificial Sequence
  synthetic [barcode part1]
cctgtgtctgacagtc

SEQ ID NO: 18416 - DNA, 16 bp, Artificial Sequence
  synthetic [barcode part1]
agtcgactcaagacct

SEQ ID NO: 18417 - DNA, 16 bp, Artificial Sequence
  synthetic [barcode part1]
tataggacgacagttg

SEQ ID NO: 18418 - DNA, 16 bp, Artificial Sequence
  synthetic [barcode part1]
aggtaaggtaacacct

SEQ ID NO: 18419 - DNA, 16 bp, Artificial Sequence
  synthetic [barcode part1]
gtctccgtctaatagt

SEQ ID NO: 18420 - DNA, 16 bp, Artificial Sequence
  synthetic [barcode part1]
gcgtgattacacgact

SEQ ID NO: 18421 - DNA, 16 bp, Artificial Sequence
  synthetic [barcode part1]
gcacaaccaacacgtt

SEQ ID NO: 18422 - DNA, 16 bp, Artificial Sequence
  synthetic [barcode part1]
ttaggcggaacggtgt

SEQ ID NO: 18423 - DNA, 16 bp, Artificial Sequence
  synthetic [barcode part1]
tctaagacctcggagt

SEQ ID NO: 18424 - DNA, 16 bp, Artificial Sequence
  synthetic [barcode part1]
agttgacggttgatcc

SEQ ID NO: 18425 - DNA, 16 bp, Artificial Sequence
  synthetic [barcode part1]
gccaagaagtcttctg

SEQ ID NO: 18426 - DNA, 16 bp, Artificial Sequence
  synthetic [barcode part1]
atcaagacacacagtg

SEQ ID NO: 18427 - DNA, 16 bp, Artificial Sequence
  synthetic [barcode part1]
agaccttgaccgattg

SEQ ID NO: 18428 - DNA, 16 bp, Artificial Sequence
  synthetic [barcode part1]
gatcgtgaatcctctt

SEQ ID NO: 18429 - DNA, 16 bp, Artificial Sequence
  synthetic [barcode part1]
agaacaaggtggagtc

SEQ ID NO: 18430 - DNA, 16 bp, Artificial Sequence
  synthetic [barcode part1]
tcaacacgtacgtcag

SEQ ID NO: 18431 - DNA, 16 bp, Artificial Sequence
  synthetic [barcode part1]
tggtgacgactcgatt

SEQ ID NO: 18432 - DNA, 16 bp, Artificial Sequence
  synthetic [barcode part1]
aggttgcctgtattct

SEQ ID NO: 18433 - DNA, 16 bp, Artificial Sequence
  synthetic [barcode part1]
gaggtaacgttgcctt

SEQ ID NO: 18434 - DNA, 16 bp, Artificial Sequence
  synthetic [barcode part1]
acctaacctctatacg

SEQ ID NO: 18435 - DNA, 16 bp, Artificial Sequence
  synthetic [barcode part1]
gattctgtgtctatcg

SEQ ID NO: 18436 - DNA, 16 bp, Artificial Sequence
  synthetic [barcode part1]
cagattgtctcgcacc

SEQ ID NO: 18437 - DNA, 16 bp, Artificial Sequence
  synthetic [barcode part1]
taccaagttaccaggc

SEQ ID NO: 18438 - DNA, 16 bp, Artificial Sequence
  synthetic [barcode part1]
tacgccttatcaggcc

SEQ ID NO: 18439 - DNA, 16 bp, Artificial Sequence
  synthetic [barcode part1]
cctaggattcctctct

SEQ ID NO: 18440 - DNA, 16 bp, Artificial Sequence
  synthetic [barcode part1]
tgtgaaccttagacgc

SEQ ID NO: 18441 - DNA, 16 bp, Artificial Sequence
  synthetic [barcode part1]
agagttctcgtccgtc

SEQ ID NO: 18442 - DNA, 16 bp, Artificial Sequence
  synthetic [barcode part1]
aagtacctgtccgaac

SEQ ID NO: 18443 - DNA, 16 bp, Artificial Sequence
  synthetic [barcode part1]
actcggaggcaaggtt

SEQ ID NO: 18444 - DNA, 16 bp, Artificial Sequence
  synthetic [barcode part1]
tgttccgcagatattc

SEQ ID NO: 18445 - DNA, 16 bp, Artificial Sequence
  synthetic [barcode part1]
cacaacgcaagtaagt

SEQ ID NO: 18446 - DNA, 16 bp, Artificial Sequence
  synthetic [barcode part1]
tggttggcgatcaact

SEQ ID NO: 18447 - DNA, 16 bp, Artificial Sequence
  synthetic [barcode part1]
tctggcgtgttcctag

SEQ ID NO: 18448 - DNA, 16 bp, Artificial Sequence
  synthetic [barcode part1]
accaagtggacgcaac

SEQ ID NO: 18449 - DNA, 16 bp, Artificial Sequence
  synthetic [barcode part1]
tgacggatattcagag

SEQ ID NO: 18450 - DNA, 16 bp, Artificial Sequence
  synthetic [barcode part1]
ccgtaaggtctctcgt

SEQ ID NO: 18451 - DNA, 16 bp, Artificial Sequence
  synthetic [barcode part1]
gcagttacttcctaac

SEQ ID NO: 18452 - DNA, 16 bp, Artificial Sequence
  synthetic [barcode part1]
tcactgtgcagattct

SEQ ID NO: 18453 - DNA, 16 bp, Artificial Sequence
  synthetic [barcode part1]
gttggcgacagaacac

SEQ ID NO: 18454 - DNA, 16 bp, Artificial Sequence
  synthetic [barcode part1]
ccaggaacaatctctg

SEQ ID NO: 18455 - DNA, 16 bp, Artificial Sequence
  synthetic [barcode part1]
aagatagttgcgaacc

SEQ ID NO: 18456 - DNA, 16 bp, Artificial Sequence
  synthetic [barcode part1]
gttcaggtcgtgaact

SEQ ID NO: 18457 - DNA, 16 bp, Artificial Sequence
  synthetic [barcode part1]
tggcaacctgacagtt

SEQ ID NO: 18458 - DNA, 16 bp, Artificial Sequence
  synthetic [barcode part1]
ttcaataccacgtctg

SEQ ID NO: 18459 - DNA, 16 bp, Artificial Sequence
  synthetic [barcode part1]
gatagtctgcaagaac

SEQ ID NO: 18460 - DNA, 16 bp, Artificial Sequence
  synthetic [barcode part1]
cctcgtaagtctgacc

SEQ ID NO: 18461 - DNA, 16 bp, Artificial Sequence
  synthetic [barcode part1]
gacggaatcaacacgc

SEQ ID NO: 18462 - DNA, 16 bp, Artificial Sequence
  synthetic [barcode part1]
acgttagtcctgtcgc

SEQ ID NO: 18463 - DNA, 16 bp, Artificial Sequence
  synthetic [barcode part1]
gcggatccaacagaac

SEQ ID NO: 18464 - DNA, 16 bp, Artificial Sequence
  synthetic [barcode part1]
ccttctcctaaggtct

SEQ ID NO: 18465 - DNA, 16 bp, Artificial Sequence
  synthetic [barcode part1]
cagacgtggagatcgt

SEQ ID NO: 18466 - DNA, 16 bp, Artificial Sequence
  synthetic [barcode part1]
attgacaacaggacgt

SEQ ID NO: 18467 - DNA, 16 bp, Artificial Sequence
  synthetic [barcode part1]
caacacgtgtaccagt

SEQ ID NO: 18468 - DNA, 16 bp, Artificial Sequence
  synthetic [barcode part1]
aggaccttctgtccgt

SEQ ID NO: 18469 - DNA, 16 bp, Artificial Sequence
  synthetic [barcode part1]
tcgccgtggatctgtt

SEQ ID NO: 18470 - DNA, 16 bp, Artificial Sequence
  synthetic [barcode part1]
gtgtggtcgcgtaatt

SEQ ID NO: 18471 - DNA, 16 bp, Artificial Sequence
  synthetic [barcode part1]
gcagaggattattggt

SEQ ID NO: 18472 - DNA, 16 bp, Artificial Sequence
  synthetic [barcode part1]
gacagtcaccactagt

SEQ ID NO: 18473 - DNA, 16 bp, Artificial Sequence
  synthetic [barcode part1]
ttcgcgcgtacttctt

SEQ ID NO: 18474 - DNA, 16 bp, Artificial Sequence
  synthetic [barcode part1]
tctccacggatcactg

SEQ ID NO: 18475 - DNA, 16 bp, Artificial Sequence
  synthetic [barcode part1]
gccgagtcagaagtac

SEQ ID NO: 18476 - DNA, 16 bp, Artificial Sequence
  synthetic [barcode part1]
ttacagacacctcgtt

SEQ ID NO: 18477 - DNA, 16 bp, Artificial Sequence
  synthetic [barcode part1]
gtccggtgagaatacg

SEQ ID NO: 18478 - DNA, 16 bp, Artificial Sequence
  synthetic [barcode part1]
accacctcgagataac

SEQ ID NO: 18479 - DNA, 16 bp, Artificial Sequence
  synthetic [barcode part1]
gagtaaggtctgcctt

SEQ ID NO: 18480 - DNA, 16 bp, Artificial Sequence
  synthetic [barcode part1]
tgaatcctcgttctag

SEQ ID NO: 18481 - DNA, 16 bp, Artificial Sequence
  synthetic [barcode part1]
tggcagaacagacctg

SEQ ID NO: 18482 - DNA, 16 bp, Artificial Sequence
  synthetic [barcode part1]
gcaacagacagttgcg

SEQ ID NO: 18483 - DNA, 16 bp, Artificial Sequence
  synthetic [barcode part1]
actcagaaggtggtgc

SEQ ID NO: 18484 - DNA, 16 bp, Artificial Sequence
  synthetic [barcode part1]
gagtgttctcgtcacc

SEQ ID NO: 18485 - DNA, 16 bp, Artificial Sequence
  synthetic [barcode part1]
gtcgattggaaccttg

SEQ ID NO: 18486 - DNA, 16 bp, Artificial Sequence
  synthetic [barcode part1]
gttccgtacgattatc

SEQ ID NO: 18487 - DNA, 16 bp, Artificial Sequence
  synthetic [barcode part1]
aagatcacttccgacg

SEQ ID NO: 18488 - DNA, 16 bp, Artificial Sequence
  synthetic [barcode part1]
cgtatcagattctctg

SEQ ID NO: 18489 - DNA, 16 bp, Artificial Sequence
  synthetic [barcode part1]
tgcgttctctgtatcc

SEQ ID NO: 18490 - DNA, 16 bp, Artificial Sequence
  synthetic [barcode part1]
ttaactcactcaggtc

SEQ ID NO: 18491 - DNA, 16 bp, Artificial Sequence
  synthetic [barcode part1]
tctgcggataagttcg

SEQ ID NO: 18492 - DNA, 16 bp, Artificial Sequence
  synthetic [barcode part1]
aggtgagtgccgtaac

SEQ ID NO: 18493 - DNA, 16 bp, Artificial Sequence
  synthetic [barcode part1]
taggtcacctcacacc

SEQ ID NO: 18494 - DNA, 16 bp, Artificial Sequence
  synthetic [barcode part1]
gactgccaacgtagag

SEQ ID NO: 18495 - DNA, 16 bp, Artificial Sequence
  synthetic [barcode part1]
ttactgtgtggatctc

SEQ ID NO: 18496 - DNA, 16 bp, Artificial Sequence
  synthetic [barcode part1]
gtacgcaaccgattgt

SEQ ID NO: 18497 - DNA, 16 bp, Artificial Sequence
  synthetic [barcode part1]
tatctacctgtggcgc

SEQ ID NO: 18498 - DNA, 16 bp, Artificial Sequence
  synthetic [barcode part1]
agaacctaagtgaacc

SEQ ID NO: 18499 - DNA, 16 bp, Artificial Sequence
  synthetic [barcode part1]
gtaccgataacttcct

SEQ ID NO: 18500 - DNA, 16 bp, Artificial Sequence
  synthetic [barcode part1]
ttcgcaatccgtcgtg

SEQ ID NO: 18501 - DNA, 16 bp, Artificial Sequence
  synthetic [barcode part1]
tacgcgacttgatctt

SEQ ID NO: 18502 - DNA, 16 bp, Artificial Sequence
  synthetic [barcode part1]
tccggtggaatacgag

SEQ ID NO: 18503 - DNA, 16 bp, Artificial Sequence
  synthetic [barcode part1]
gtccagagacacttgt

SEQ ID NO: 18504 - DNA, 16 bp, Artificial Sequence
  synthetic [barcode part1]
tcagttcctgttgcct

SEQ ID NO: 18505 - DNA, 16 bp, Artificial Sequence
  synthetic [barcode part1]
ttgcgcgagaagatcg

SEQ ID NO: 18506 - DNA, 16 bp, Artificial Sequence
  synthetic [barcode part1]
gagacacagtccagtg

SEQ ID NO: 18507 - DNA, 16 bp, Artificial Sequence
  synthetic [barcode part1]
gcggcagttattactg

SEQ ID NO: 18508 - DNA, 16 bp, Artificial Sequence
  synthetic [barcode part1]
ttcttccgtatacgcc

SEQ ID NO: 18509 - DNA, 16 bp, Artificial Sequence
  synthetic [barcode part1]
gcgagagaccgaatct

SEQ ID NO: 18510 - DNA, 16 bp, Artificial Sequence
  synthetic [barcode part1]
gaagattccgatctcg

SEQ ID NO: 18511 - DNA, 16 bp, Artificial Sequence
  synthetic [barcode part1]
tgacgccacaatatcg

SEQ ID NO: 18512 - DNA, 16 bp, Artificial Sequence
  synthetic [barcode part1]
ataccgagagaatcac

SEQ ID NO: 18513 - DNA, 16 bp, Artificial Sequence
  synthetic [barcode part1]
tcctctccgactagtt

SEQ ID NO: 18514 - DNA, 16 bp, Artificial Sequence
  synthetic [barcode part1]
gtctacctaagatctc

SEQ ID NO: 18515 - DNA, 16 bp, Artificial Sequence
  synthetic [barcode part1]
ccggtaagtctccgtt

SEQ ID NO: 18516 - DNA, 16 bp, Artificial Sequence
  synthetic [barcode part1]
taacgtgaggatagtc

SEQ ID NO: 18517 - DNA, 16 bp, Artificial Sequence
  synthetic [barcode part1]
tatctcttctccgcag

SEQ ID NO: 18518 - DNA, 16 bp, Artificial Sequence
  synthetic [barcode part1]
gccttgcaagtcaagt

SEQ ID NO: 18519 - DNA, 16 bp, Artificial Sequence
  synthetic [barcode part1]
gaattgtacgaggact

SEQ ID NO: 18520 - DNA, 16 bp, Artificial Sequence
  synthetic [barcode part1]
acactgtgtaagtgag

SEQ ID NO: 18521 - DNA, 16 bp, Artificial Sequence
  synthetic [barcode part1]
gattattactctcgcg

SEQ ID NO: 18522 - DNA, 16 bp, Artificial Sequence
  synthetic [barcode part1]
acacggtggaagacct

SEQ ID NO: 18523 - DNA, 16 bp, Artificial Sequence
  synthetic [barcode part1]
taaggagacactgact

SEQ ID NO: 18524 - DNA, 16 bp, Artificial Sequence
  synthetic [barcode part1]
ttaacgcactaacgcg

SEQ ID NO: 18525 - DNA, 16 bp, Artificial Sequence
  synthetic [barcode part1]
ttgattcttgtgcgac

SEQ ID NO: 18526 - DNA, 16 bp, Artificial Sequence
  synthetic [barcode part1]
tgtcagttggtgtgtg

SEQ ID NO: 18527 - DNA, 16 bp, Artificial Sequence
  synthetic [barcode part1]
tccgatacctacgtcg

SEQ ID NO: 18528 - DNA, 16 bp, Artificial Sequence
  synthetic [barcode part1]
actagtgtactccgcc

SEQ ID NO: 18529 - DNA, 16 bp, Artificial Sequence
  synthetic [barcode part1]
ttcacacctagtggtt

SEQ ID NO: 18530 - DNA, 16 bp, Artificial Sequence
  synthetic [barcode part1]
actaacgacgaagtac

SEQ ID NO: 18531 - DNA, 16 bp, Artificial Sequence
  synthetic [barcode part1]
gagtgttgaacagtac

SEQ ID NO: 18532 - DNA, 16 bp, Artificial Sequence
  synthetic [barcode part1]
tcactcgataagtggc

SEQ ID NO: 18533 - DNA, 16 bp, Artificial Sequence
  synthetic [barcode part1]
acgaattcagtggagt

SEQ ID NO: 18534 - DNA, 16 bp, Artificial Sequence
  synthetic [barcode part1]
ccgtccaagatagact

SEQ ID NO: 18535 - DNA, 16 bp, Artificial Sequence
  synthetic [barcode part1]
ataggatcaccgtctg

SEQ ID NO: 18536 - DNA, 16 bp, Artificial Sequence
  synthetic [barcode part1]
cctcgttgtaagtccg

SEQ ID NO: 18537 - DNA, 16 bp, Artificial Sequence
  synthetic [barcode part1]
agaaggtctgcgcagt

SEQ ID NO: 18538 - DNA, 16 bp, Artificial Sequence
  synthetic [barcode part1]
aacgtacacgttgacc

SEQ ID NO: 18539 - DNA, 16 bp, Artificial Sequence
  synthetic [barcode part1]
tggcgactaacgattc

SEQ ID NO: 18540 - DNA, 16 bp, Artificial Sequence
  synthetic [barcode part1]
gccacggtattcgtct

SEQ ID NO: 18541 - DNA, 16 bp, Artificial Sequence
  synthetic [barcode part1]
tctctaacgacgtgcc

SEQ ID NO: 18542 - DNA, 16 bp, Artificial Sequence
  synthetic [barcode part1]
tggactgactgaacct

SEQ ID NO: 18543 - DNA, 16 bp, Artificial Sequence
  synthetic [barcode part1]
agttggcaatcctggt

SEQ ID NO: 18544 - DNA, 16 bp, Artificial Sequence
  synthetic [barcode part1]
tgtacacactgcaacg

SEQ ID NO: 18545 - DNA, 16 bp, Artificial Sequence
  synthetic [barcode part1]
tctctctgattccgac

SEQ ID NO: 18546 - DNA, 16 bp, Artificial Sequence
  synthetic [barcode part1]
cactaacacgcgttag

SEQ ID NO: 18547 - DNA, 16 bp, Artificial Sequence
  synthetic [barcode part1]
tgatcgaagaagaggc

SEQ ID NO: 18548 - DNA, 16 bp, Artificial Sequence
  synthetic [barcode part1]
gtagacttcttgccgc

SEQ ID NO: 18549 - DNA, 16 bp, Artificial Sequence
  synthetic [barcode part1]
aggttctgatcgactg

SEQ ID NO: 18550 - DNA, 16 bp, Artificial Sequence
  synthetic [barcode part1]
gagttgtcctggtaac

SEQ ID NO: 18551 - DNA, 16 bp, Artificial Sequence
  synthetic [barcode part1]
agtcgtgtagtgcact

SEQ ID NO: 18552 - DNA, 16 bp, Artificial Sequence
  synthetic [barcode part1]
acttacgtggtcctcg

SEQ ID NO: 18553 - DNA, 16 bp, Artificial Sequence
  synthetic [barcode part1]
gttactgttcttgcag

SEQ ID NO: 18554 - DNA, 16 bp, Artificial Sequence
  synthetic [barcode part1]
cgccttgttcgagtgt

SEQ ID NO: 18555 - DNA, 16 bp, Artificial Sequence
  synthetic [barcode part1]
ccgttcttacgtcgag

SEQ ID NO: 18556 - DNA, 16 bp, Artificial Sequence
  synthetic [barcode part1]
taaccttgcgtgccac

SEQ ID NO: 18557 - DNA, 16 bp, Artificial Sequence
  synthetic [barcode part1]
ttgcggagtaaccact

SEQ ID NO: 18558 - DNA, 16 bp, Artificial Sequence
  synthetic [barcode part1]
ttatcggttccacgcg

SEQ ID NO: 18559 - DNA, 16 bp, Artificial Sequence
  synthetic [barcode part1]
acggtcagtgtcgatt

SEQ ID NO: 18560 - DNA, 16 bp, Artificial Sequence
  synthetic [barcode part1]
gtcgtctcaggtatcc

SEQ ID NO: 18561 - DNA, 16 bp, Artificial Sequence
  synthetic [barcode part1]
tatcgttacctctcgc

SEQ ID NO: 18562 - DNA, 16 bp, Artificial Sequence
  synthetic [barcode part1]
taaccgatcctgagac

SEQ ID NO: 18563 - DNA, 16 bp, Artificial Sequence
  synthetic [barcode part1]
atctcgtcgaggagtt

SEQ ID NO: 18564 - DNA, 16 bp, Artificial Sequence
  synthetic [barcode part1]
gtggtagtatcctgtg

SEQ ID NO: 18565 - DNA, 16 bp, Artificial Sequence
  synthetic [barcode part1]
ccagtccttaccactt

SEQ ID NO: 18566 - DNA, 16 bp, Artificial Sequence
  synthetic [barcode part1]
accgcagtcacctatc

SEQ ID NO: 18567 - DNA, 16 bp, Artificial Sequence
  synthetic [barcode part1]
aagtcgtaagtgcggc

SEQ ID NO: 18568 - DNA, 16 bp, Artificial Sequence
  synthetic [barcode part1]
aggattagaggcaacg

SEQ ID NO: 18569 - DNA, 16 bp, Artificial Sequence
  synthetic [barcode part1]
actcagtaacctggtg

SEQ ID NO: 18570 - DNA, 16 bp, Artificial Sequence
  synthetic [barcode part1]
tatatacgtgccgcag

SEQ ID NO: 18571 - DNA, 16 bp, Artificial Sequence
  synthetic [barcode part1]
tactgttgaacgtctc

SEQ ID NO: 18572 - DNA, 16 bp, Artificial Sequence
  synthetic [barcode part1]
ataccagtgcgtcaac

SEQ ID NO: 18573 - DNA, 16 bp, Artificial Sequence
  synthetic [barcode part1]
accacagtgttgcagt

SEQ ID NO: 18574 - DNA, 16 bp, Artificial Sequence
  synthetic [barcode part1]
ttcgattgttaacgcc

SEQ ID NO: 18575 - DNA, 16 bp, Artificial Sequence
  synthetic [barcode part1]
tcctcaacgcaattgt

SEQ ID NO: 18576 - DNA, 16 bp, Artificial Sequence
  synthetic [barcode part1]
gtcacaaggcaggtac

SEQ ID NO: 18577 - DNA, 16 bp, Artificial Sequence
  synthetic [barcode part1]
gcaatctggattgtcg

SEQ ID NO: 18578 - DNA, 16 bp, Artificial Sequence
  synthetic [barcode part1]
agattacgaacacggt

SEQ ID NO: 18579 - DNA, 16 bp, Artificial Sequence
  synthetic [barcode part1]
aagacgccggtgattg

SEQ ID NO: 18580 - DNA, 16 bp, Artificial Sequence
  synthetic [barcode part1]
ccttaatagtcacacc

SEQ ID NO: 18581 - DNA, 16 bp, Artificial Sequence
  synthetic [barcode part1]
tggatactcctcaatc

SEQ ID NO: 18582 - DNA, 16 bp, Artificial Sequence
  synthetic [barcode part1]
gtaacgttacgcacac

SEQ ID NO: 18583 - DNA, 16 bp, Artificial Sequence
  synthetic [barcode part1]
acgtgtaactaaccgc

SEQ ID NO: 18584 - DNA, 16 bp, Artificial Sequence
  synthetic [barcode part1]
cgtcactgaatcgaac

SEQ ID NO: 18585 - DNA, 16 bp, Artificial Sequence
  synthetic [barcode part1]
gtcaaggtctcaatcg

SEQ ID NO: 18586 - DNA, 16 bp, Artificial Sequence
  synthetic [barcode part1]
aagttgatagtgtgcg

SEQ ID NO: 18587 - DNA, 16 bp, Artificial Sequence
  synthetic [barcode part1]
cgaattgaactcgacc

SEQ ID NO: 18588 - DNA, 16 bp, Artificial Sequence
  synthetic [barcode part1]
tattccgccgtaagtt

SEQ ID NO: 18589 - DNA, 16 bp, Artificial Sequence
  synthetic [barcode part1]
actaagaacgtaccag

SEQ ID NO: 18590 - DNA, 16 bp, Artificial Sequence
  synthetic [barcode part1]
tgcaggacttctgtag

SEQ ID NO: 18591 - DNA, 16 bp, Artificial Sequence
  synthetic [barcode part1]
tatccgccttgagacc

SEQ ID NO: 18592 - DNA, 16 bp, Artificial Sequence
  synthetic [barcode part1]
aggaggttgttaacac

SEQ ID NO: 18593 - DNA, 16 bp, Artificial Sequence
  synthetic [barcode part1]
tgcacttcagaggtgt

SEQ ID NO: 18594 - DNA, 16 bp, Artificial Sequence
  synthetic [barcode part1]
actctgcagacgtctc

SEQ ID NO: 18595 - DNA, 16 bp, Artificial Sequence
  synthetic [barcode part1]
acacgtagactgactc

SEQ ID NO: 18596 - DNA, 16 bp, Artificial Sequence
  synthetic [barcode part1]
cgcaatagtaggtggc

SEQ ID NO: 18597 - DNA, 16 bp, Artificial Sequence
  synthetic [barcode part1]
tcagttcctacgtagt

SEQ ID NO: 18598 - DNA, 16 bp, Artificial Sequence
  synthetic [barcode part1]
acagttgaccaacacc

SEQ ID NO: 18599 - DNA, 16 bp, Artificial Sequence
  synthetic [barcode part1]
ccgagacctatctacc

SEQ ID NO: 18600 - DNA, 16 bp, Artificial Sequence
  synthetic [barcode part1]
tgcaatcgttaccttg

SEQ ID NO: 18601 - DNA, 16 bp, Artificial Sequence
  synthetic [barcode part1]
atccaagaacgaggcc

SEQ ID NO: 18602 - DNA, 16 bp, Artificial Sequence
  synthetic [barcode part1]
tggatcgttggcaact

SEQ ID NO: 18603 - DNA, 16 bp, Artificial Sequence
  synthetic [barcode part1]
caacctctaatacacc

SEQ ID NO: 18604 - DNA, 16 bp, Artificial Sequence
  synthetic [barcode part1]
gagttctaccaaccag

SEQ ID NO: 18605 - DNA, 16 bp, Artificial Sequence
  synthetic [barcode part1]
tgccttacaccgttct

SEQ ID NO: 18606 - DNA, 16 bp, Artificial Sequence
  synthetic [barcode part1]
tcagtggtcaccaagt

SEQ ID NO: 18607 - DNA, 16 bp, Artificial Sequence
  synthetic [barcode part1]
caattgcacaaccacg

SEQ ID NO: 18608 - DNA, 16 bp, Artificial Sequence
  synthetic [barcode part1]
tattctccgcaggaag

SEQ ID NO: 18609 - DNA, 16 bp, Artificial Sequence
  synthetic [barcode part1]
taagtaccgtaccggt

SEQ ID NO: 18610 - DNA, 16 bp, Artificial Sequence
  synthetic [barcode part1]
caaggtgtattgacag

SEQ ID NO: 18611 - DNA, 16 bp, Artificial Sequence
  synthetic [barcode part1]
gttactgtgcacctcg

SEQ ID NO: 18612 - DNA, 16 bp, Artificial Sequence
  synthetic [barcode part1]
agtccaagaggtacgc

SEQ ID NO: 18613 - DNA, 16 bp, Artificial Sequence
  synthetic [barcode part1]
ccacggaatagaatac

SEQ ID NO: 18614 - DNA, 16 bp, Artificial Sequence
  synthetic [barcode part1]
tcaacgaccgtacctc

SEQ ID NO: 18615 - DNA, 16 bp, Artificial Sequence
  synthetic [barcode part1]
tgagacggatatactg

SEQ ID NO: 18616 - DNA, 16 bp, Artificial Sequence
  synthetic [barcode part1]
gcgtaatctccgatcc

SEQ ID NO: 18617 - DNA, 16 bp, Artificial Sequence
  synthetic [barcode part1]
agattatcgccttcac

SEQ ID NO: 18618 - DNA, 16 bp, Artificial Sequence
  synthetic [barcode part1]
ataatcggaggaacct

SEQ ID NO: 18619 - DNA, 16 bp, Artificial Sequence
  synthetic [barcode part1]
agttgtaccagttcct

SEQ ID NO: 18620 - DNA, 16 bp, Artificial Sequence
  synthetic [barcode part1]
taagaggtacggttgt

SEQ ID NO: 18621 - DNA, 16 bp, Artificial Sequence
  synthetic [barcode part1]
gtatcgtgtaacgtcg

SEQ ID NO: 18622 - DNA, 16 bp, Artificial Sequence
  synthetic [barcode part1]
gaccaatcacgtacac

SEQ ID NO: 18623 - DNA, 16 bp, Artificial Sequence
  synthetic [barcode part1]
ataccttgcacaggac

SEQ ID NO: 18624 - DNA, 16 bp, Artificial Sequence
  synthetic [barcode part1]
atcgcagtcgtccgtt

SEQ ID NO: 18625 - DNA, 16 bp, Artificial Sequence
  synthetic [barcode part1]
gacaatccacgtctcc

SEQ ID NO: 18626 - DNA, 16 bp, Artificial Sequence
  synthetic [barcode part1]
tgtctgcggtactacc

SEQ ID NO: 18627 - DNA, 16 bp, Artificial Sequence
  synthetic [barcode part1]
cgtattgccgactctg

SEQ ID NO: 18628 - DNA, 16 bp, Artificial Sequence
  synthetic [barcode part1]
tcgtctaagactctgt

SEQ ID NO: 18629 - DNA, 16 bp, Artificial Sequence
  synthetic [barcode part1]
cagactaccagattgc

SEQ ID NO: 18630 - DNA, 16 bp, Artificial Sequence
  synthetic [barcode part1]
cgaacagtctaggacg

SEQ ID NO: 18631 - DNA, 16 bp, Artificial Sequence
  synthetic [barcode part1]
atcgcaatcgcaacac

SEQ ID NO: 18632 - DNA, 16 bp, Artificial Sequence
  synthetic [barcode part1]
gtcgaacctgcgttct

SEQ ID NO: 18633 - DNA, 16 bp, Artificial Sequence
  synthetic [barcode part1]
acctgccaacgtcact

SEQ ID NO: 18634 - DNA, 16 bp, Artificial Sequence
  synthetic [barcode part1]
acctcggaatcgattg

SEQ ID NO: 18635 - DNA, 16 bp, Artificial Sequence
  synthetic [barcode part1]
cctcgcaaggaatact

SEQ ID NO: 18636 - DNA, 16 bp, Artificial Sequence
  synthetic [barcode part1]
ccttgtacggtaatct

SEQ ID NO: 18637 - DNA, 16 bp, Artificial Sequence
  synthetic [barcode part1]
tggattggccaagttc

SEQ ID NO: 18638 - DNA, 16 bp, Artificial Sequence
  synthetic [barcode part1]
tacgcaggtggttact

SEQ ID NO: 18639 - DNA, 16 bp, Artificial Sequence
  synthetic [barcode part1]
cagtgacaccagatct

SEQ ID NO: 18640 - DNA, 16 bp, Artificial Sequence
  synthetic [barcode part1]
tcctagatacctgccg

SEQ ID NO: 18641 - DNA, 16 bp, Artificial Sequence
  synthetic [barcode part1]
ttccgcggatccagtt

SEQ ID NO: 18642 - DNA, 16 bp, Artificial Sequence
  synthetic [barcode part1]
cctctagtgtgcagtc

SEQ ID NO: 18643 - DNA, 16 bp, Artificial Sequence
  synthetic [barcode part1]
gacagacttgtctacg

SEQ ID NO: 18644 - DNA, 16 bp, Artificial Sequence
  synthetic [barcode part1]
gtgtactggatacctg

SEQ ID NO: 18645 - DNA, 16 bp, Artificial Sequence
  synthetic [barcode part1]
atcagacctcggtaac

SEQ ID NO: 18646 - DNA, 16 bp, Artificial Sequence
  synthetic [barcode part1]
tgaaccagtcagatcc

SEQ ID NO: 18647 - DNA, 16 bp, Artificial Sequence
  synthetic [barcode part1]
agaacctcctacttac

SEQ ID NO: 18648 - DNA, 16 bp, Artificial Sequence
  synthetic [barcode part1]
gccttctgtaccagtg

SEQ ID NO: 18649 - DNA, 16 bp, Artificial Sequence
  synthetic [barcode part1]
gtcaagtgcgagaacc

SEQ ID NO: 18650 - DNA, 16 bp, Artificial Sequence
  synthetic [barcode part1]
agttgcgaatctcctt

SEQ ID NO: 18651 - DNA, 16 bp, Artificial Sequence
  synthetic [barcode part1]
ttgttacctgcaggcc

SEQ ID NO: 18652 - DNA, 16 bp, Artificial Sequence
  synthetic [barcode part1]
ttcagttatcacgtgc

SEQ ID NO: 18653 - DNA, 16 bp, Artificial Sequence
  synthetic [barcode part1]
gcctgaactgtgaact

SEQ ID NO: 18654 - DNA, 16 bp, Artificial Sequence
  synthetic [barcode part1]
cacgtattctcctctg

SEQ ID NO: 18655 - DNA, 16 bp, Artificial Sequence
  synthetic [barcode part1]
cctctcacttgcagag

SEQ ID NO: 18656 - DNA, 16 bp, Artificial Sequence
  synthetic [barcode part1]
ttcgcgtaatcgttac

SEQ ID NO: 18657 - DNA, 16 bp, Artificial Sequence
  synthetic [barcode part1]
tgattctaagaccggc

SEQ ID NO: 18658 - DNA, 16 bp, Artificial Sequence
  synthetic [barcode part1]
atccttgtgaaggcgt

SEQ ID NO: 18659 - DNA, 16 bp, Artificial Sequence
  synthetic [barcode part1]
tgtaccagttgcacag

SEQ ID NO: 18660 - DNA, 16 bp, Artificial Sequence
  synthetic [barcode part1]
cgtggtcgtatctaag

SEQ ID NO: 18661 - DNA, 16 bp, Artificial Sequence
  synthetic [barcode part1]
atctgaggagttcgtc

SEQ ID NO: 18662 - DNA, 16 bp, Artificial Sequence
  synthetic [barcode part1]
gagacaggaacgatac

SEQ ID NO: 18663 - DNA, 16 bp, Artificial Sequence
  synthetic [barcode part1]
gtgagttctcttaacc

SEQ ID NO: 18664 - DNA, 16 bp, Artificial Sequence
  synthetic [barcode part1]
ttgacgtagtcctccg

SEQ ID NO: 18665 - DNA, 16 bp, Artificial Sequence
  synthetic [barcode part1]
gagttctactgtgacg

SEQ ID NO: 18666 - DNA, 16 bp, Artificial Sequence
  synthetic [barcode part1]
aactacgaagaggttc

SEQ ID NO: 18667 - DNA, 16 bp, Artificial Sequence
  synthetic [barcode part1]
cgtgtcctgttgaatt

SEQ ID NO: 18668 - DNA, 16 bp, Artificial Sequence
  synthetic [barcode part1]
accagtaaggccgaac

SEQ ID NO: 18669 - DNA, 16 bp, Artificial Sequence
  synthetic [barcode part1]
aaccgttggcaattcg

SEQ ID NO: 18670 - DNA, 16 bp, Artificial Sequence
  synthetic [barcode part1]
tacgaacaacgttcgc

SEQ ID NO: 18671 - DNA, 16 bp, Artificial Sequence
  synthetic [barcode part1]
cgttagataagtcgcc

SEQ ID NO: 18672 - DNA, 16 bp, Artificial Sequence
  synthetic [barcode part1]
aactggtacgttgcac

SEQ ID NO: 18673 - DNA, 16 bp, Artificial Sequence
  synthetic [barcode part1]
ttcttgtccgtcggag

SEQ ID NO: 18674 - DNA, 16 bp, Artificial Sequence
  synthetic [barcode part1]
agtgacggatattcag

SEQ ID NO: 18675 - DNA, 16 bp, Artificial Sequence
  synthetic [barcode part1]
aagatctcacctgtct

SEQ ID NO: 18676 - DNA, 16 bp, Artificial Sequence
  synthetic [barcode part1]
gttggattccgcactc

SEQ ID NO: 18677 - DNA, 16 bp, Artificial Sequence
  synthetic [barcode part1]
ttgcacaggagttaag

SEQ ID NO: 18678 - DNA, 16 bp, Artificial Sequence
  synthetic [barcode part1]
agtgtcagtgtacgtc

SEQ ID NO: 18679 - DNA, 16 bp, Artificial Sequence
  synthetic [barcode part1]
atctcactcgtcacct

SEQ ID NO: 18680 - DNA, 16 bp, Artificial Sequence
  synthetic [barcode part1]
aacgagacgcactggt

SEQ ID NO: 18681 - DNA, 16 bp, Artificial Sequence
  synthetic [barcode part1]
tacgtgtctccagaag

SEQ ID NO: 18682 - DNA, 16 bp, Artificial Sequence
  synthetic [barcode part1]
gattgtaccagtctct

SEQ ID NO: 18683 - DNA, 16 bp, Artificial Sequence
  synthetic [barcode part1]
ttatctgaggcagacc

SEQ ID NO: 18684 - DNA, 16 bp, Artificial Sequence
  synthetic [barcode part1]
gttaggcgtaactcgt

SEQ ID NO: 18685 - DNA, 16 bp, Artificial Sequence
  synthetic [barcode part1]
tacggagaccagactg

SEQ ID NO: 18686 - DNA, 16 bp, Artificial Sequence
  synthetic [barcode part1]
tgtaagaagtcgtcag

SEQ ID NO: 18687 - DNA, 16 bp, Artificial Sequence
  synthetic [barcode part1]
ccaaggtggatagatt

SEQ ID NO: 18688 - DNA, 16 bp, Artificial Sequence
  synthetic [barcode part1]
acgtgatattgcgtgc

SEQ ID NO: 18689 - DNA, 16 bp, Artificial Sequence
  synthetic [barcode part1]
gttagtcggttagtcg

SEQ ID NO: 18690 - DNA, 16 bp, Artificial Sequence
  synthetic [barcode part1]
aactcctccagatact

SEQ ID NO: 18691 - DNA, 16 bp, Artificial Sequence
  synthetic [barcode part1]
gaggtggcctactatt

SEQ ID NO: 18692 - DNA, 16 bp, Artificial Sequence
  synthetic [barcode part1]
aaggcagtcgtcttac

SEQ ID NO: 18693 - DNA, 16 bp, Artificial Sequence
  synthetic [barcode part1]
gccgttctctgttgtt

SEQ ID NO: 18694 - DNA, 16 bp, Artificial Sequence
  synthetic [barcode part1]
tcctaattgtgtcgac

SEQ ID NO: 18695 - DNA, 16 bp, Artificial Sequence
  synthetic [barcode part1]
aagtgttcgtcactct

SEQ ID NO: 18696 - DNA, 16 bp, Artificial Sequence
  synthetic [barcode part1]
aacagaggtcggaagt

SEQ ID NO: 18697 - DNA, 16 bp, Artificial Sequence
  synthetic [barcode part1]
atatccgagacctgtg

SEQ ID NO: 18698 - DNA, 16 bp, Artificial Sequence
  synthetic [barcode part1]
ttggtcactgagatcg

SEQ ID NO: 18699 - DNA, 16 bp, Artificial Sequence
  synthetic [barcode part1]
tatcttcgtcgccgag

SEQ ID NO: 18700 - DNA, 16 bp, Artificial Sequence
  synthetic [barcode part1]
acttggagtagtgaac

SEQ ID NO: 18701 - DNA, 16 bp, Artificial Sequence
  synthetic [barcode part1]
ttctggtcacaggcct

SEQ ID NO: 18702 - DNA, 16 bp, Artificial Sequence
  synthetic [barcode part1]
ccactacggtgttcac

SEQ ID NO: 18703 - DNA, 16 bp, Artificial Sequence
  synthetic [barcode part1]
gaggagtacagttatc

SEQ ID NO: 18704 - DNA, 16 bp, Artificial Sequence
  synthetic [barcode part1]
actggattggagacgc

SEQ ID NO: 18705 - DNA, 16 bp, Artificial Sequence
  synthetic [barcode part1]
ttcttgaacgcgttac

SEQ ID NO: 18706 - DNA, 16 bp, Artificial Sequence
  synthetic [barcode part1]
acgttgtggataagtg

SEQ ID NO: 18707 - DNA, 16 bp, Artificial Sequence
  synthetic [barcode part1]
tgtccactgccacaac

SEQ ID NO: 18708 - DNA, 16 bp, Artificial Sequence
  synthetic [barcode part1]
gtgaggttacttagag

SEQ ID NO: 18709 - DNA, 16 bp, Artificial Sequence
  synthetic [barcode part1]
gtgaattgtgtccggt

SEQ ID NO: 18710 - DNA, 16 bp, Artificial Sequence
  synthetic [barcode part1]
tactcgtataggcggt

SEQ ID NO: 18711 - DNA, 16 bp, Artificial Sequence
  synthetic [barcode part1]
gtagaggcaacagtcc

SEQ ID NO: 18712 - DNA, 16 bp, Artificial Sequence
  synthetic [barcode part1]
acgtgatccagaaggc

SEQ ID NO: 18713 - DNA, 16 bp, Artificial Sequence
  synthetic [barcode part1]
cacggcagttcacttc

SEQ ID NO: 18714 - DNA, 16 bp, Artificial Sequence
  synthetic [barcode part1]
cggcggtccttatact

SEQ ID NO: 18715 - DNA, 16 bp, Artificial Sequence
  synthetic [barcode part1]
gatcacagatcttctc

SEQ ID NO: 18716 - DNA, 16 bp, Artificial Sequence
  synthetic [barcode part1]
gcaactggactggagt

SEQ ID NO: 18717 - DNA, 16 bp, Artificial Sequence
  synthetic [barcode part1]
tactgttagtgacggc

SEQ ID NO: 18718 - DNA, 16 bp, Artificial Sequence
  synthetic [barcode part1]
ttgtgagtatctcacc

SEQ ID NO: 18719 - DNA, 16 bp, Artificial Sequence
  synthetic [barcode part1]
cgtcgacttgatctcg

SEQ ID NO: 18720 - DNA, 16 bp, Artificial Sequence
  synthetic [barcode part1]
aacgcgaacggttcag

SEQ ID NO: 18721 - DNA, 16 bp, Artificial Sequence
  synthetic [barcode part1]
tcgagacaataggtgt

SEQ ID NO: 18722 - DNA, 16 bp, Artificial Sequence
  synthetic [barcode part1]
tatcaaggaaccgcct

SEQ ID NO: 18723 - DNA, 16 bp, Artificial Sequence
  synthetic [barcode part1]
tggcacgagagactac

SEQ ID NO: 18724 - DNA, 16 bp, Artificial Sequence
  synthetic [barcode part1]
ccgaggtggataagtc

SEQ ID NO: 18725 - DNA, 16 bp, Artificial Sequence
  synthetic [barcode part1]
agtctccactgagaac

SEQ ID NO: 18726 - DNA, 16 bp, Artificial Sequence
  synthetic [barcode part1]
tccagaggccacaatt

SEQ ID NO: 18727 - DNA, 16 bp, Artificial Sequence
  synthetic [barcode part1]
cctacctgtggataag

SEQ ID NO: 18728 - DNA, 16 bp, Artificial Sequence
  synthetic [barcode part1]
agtcgcggactagaac

SEQ ID NO: 18729 - DNA, 16 bp, Artificial Sequence
  synthetic [barcode part1]
accttaggaaggagag

SEQ ID NO: 18730 - DNA, 16 bp, Artificial Sequence
  synthetic [barcode part1]
cagagaacaacacact

SEQ ID NO: 18731 - DNA, 16 bp, Artificial Sequence
  synthetic [barcode part1]
atacctgcagacgttg

SEQ ID NO: 18732 - DNA, 16 bp, Artificial Sequence
  synthetic [barcode part1]
gtgccgtgcaatattg

SEQ ID NO: 18733 - DNA, 16 bp, Artificial Sequence
  synthetic [barcode part1]
ccgcctactcaaggtt

SEQ ID NO: 18734 - DNA, 16 bp, Artificial Sequence
  synthetic [barcode part1]
acgaattggccgtact

SEQ ID NO: 18735 - DNA, 16 bp, Artificial Sequence
  synthetic [barcode part1]
gtgtctcaatcactac

SEQ ID NO: 18736 - DNA, 16 bp, Artificial Sequence
  synthetic [barcode part1]
atcgaatcttgcgtct

SEQ ID NO: 18737 - DNA, 16 bp, Artificial Sequence
  synthetic [barcode part1]
tgaatatctcctgacc

SEQ ID NO: 18738 - DNA, 16 bp, Artificial Sequence
  synthetic [barcode part1]
ccttcagtggtgtacc

SEQ ID NO: 18739 - DNA, 16 bp, Artificial Sequence
  synthetic [barcode part1]
gttcggcgtactcttg

SEQ ID NO: 18740 - DNA, 16 bp, Artificial Sequence
  synthetic [barcode part1]
gttgaggcaacacgtg

SEQ ID NO: 18741 - DNA, 16 bp, Artificial Sequence
  synthetic [barcode part1]
gagagacgtgattatc

SEQ ID NO: 18742 - DNA, 16 bp, Artificial Sequence
  synthetic [barcode part1]
tagtcggttgactggt

SEQ ID NO: 18743 - DNA, 16 bp, Artificial Sequence
  synthetic [barcode part1]
gtaacaagttcaggtg

SEQ ID NO: 18744 - DNA, 16 bp, Artificial Sequence
  synthetic [barcode part1]
gacagttcttcgcgtc

SEQ ID NO: 18745 - DNA, 16 bp, Artificial Sequence
  synthetic [barcode part1]
agtaccgtaacgtcgt

SEQ ID NO: 18746 - DNA, 16 bp, Artificial Sequence
  synthetic [barcode part1]
gagtatcacttacggc

SEQ ID NO: 18747 - DNA, 16 bp, Artificial Sequence
  synthetic [barcode part1]
acaaccactagttctc

SEQ ID NO: 18748 - DNA, 16 bp, Artificial Sequence
  synthetic [barcode part1]
gagtactgtaggttcc

SEQ ID NO: 18749 - DNA, 16 bp, Artificial Sequence
  synthetic [barcode part1]
gccactgcacaagaag

SEQ ID NO: 18750 - DNA, 16 bp, Artificial Sequence
  synthetic [barcode part1]
ttgtgtgttcttcgag

SEQ ID NO: 18751 - DNA, 16 bp, Artificial Sequence
  synthetic [barcode part1]
gagacttgcaagtaac

SEQ ID NO: 18752 - DNA, 16 bp, Artificial Sequence
  synthetic [barcode part1]
tggtgtgcgtagatct

SEQ ID NO: 18753 - DNA, 16 bp, Artificial Sequence
  synthetic [barcode part1]
attgttctctgccacc

SEQ ID NO: 18754 - DNA, 16 bp, Artificial Sequence
  synthetic [barcode part1]
gcgcctaagtatctag

SEQ ID NO: 18755 - DNA, 16 bp, Artificial Sequence
  synthetic [barcode part1]
tgactacgttcgaacg

SEQ ID NO: 18756 - DNA, 16 bp, Artificial Sequence
  synthetic [barcode part1]
atcaccactagtggtg

SEQ ID NO: 18757 - DNA, 16 bp, Artificial Sequence
  synthetic [barcode part1]
cacctcacactacttc

SEQ ID NO: 18758 - DNA, 16 bp, Artificial Sequence
  synthetic [barcode part1]
cgcacctggtgatctt

SEQ ID NO: 18759 - DNA, 16 bp, Artificial Sequence
  synthetic [barcode part1]
acgcctggtgatagag

SEQ ID NO: 18760 - DNA, 16 bp, Artificial Sequence
  synthetic [barcode part1]
acactactcgtgacag

SEQ ID NO: 18761 - DNA, 16 bp, Artificial Sequence
  synthetic [barcode part1]
gacggtctccttgtac

SEQ ID NO: 18762 - DNA, 16 bp, Artificial Sequence
  synthetic [barcode part1]
ttcgtgcctaataacc

SEQ ID NO: 18763 - DNA, 16 bp, Artificial Sequence
  synthetic [barcode part1]
acgaacggtaggtaag

SEQ ID NO: 18764 - DNA, 16 bp, Artificial Sequence
  synthetic [barcode part1]
cggagttgagatcctt

SEQ ID NO: 18765 - DNA, 16 bp, Artificial Sequence
  synthetic [barcode part1]
gtggcgtcaatactac

SEQ ID NO: 18766 - DNA, 16 bp, Artificial Sequence
  synthetic [barcode part1]
tgaagaggagagacct

SEQ ID NO: 18767 - DNA, 16 bp, Artificial Sequence
  synthetic [barcode part1]
ttagagttgccgcagt

SEQ ID NO: 18768 - DNA, 16 bp, Artificial Sequence
  synthetic [barcode part1]
cacgttatcggtcctg

SEQ ID NO: 18769 - DNA, 16 bp, Artificial Sequence
  synthetic [barcode part1]
cgttacttgcctcact

SEQ ID NO: 18770 - DNA, 16 bp, Artificial Sequence
  synthetic [barcode part1]
gaggtcaacacgactg

SEQ ID NO: 18771 - DNA, 16 bp, Artificial Sequence
  synthetic [barcode part1]
accggtcaatcgattg

SEQ ID NO: 18772 - DNA, 16 bp, Artificial Sequence
  synthetic [barcode part1]
tgagtgtcgtatcgac

SEQ ID NO: 18773 - DNA, 16 bp, Artificial Sequence
  synthetic [barcode part1]
tcgaggaccgatacag

SEQ ID NO: 18774 - DNA, 16 bp, Artificial Sequence
  synthetic [barcode part1]
agaacaatcacgaacc

SEQ ID NO: 18775 - DNA, 16 bp, Artificial Sequence
  synthetic [barcode part1]
aatatctctgccgccg

SEQ ID NO: 18776 - DNA, 16 bp, Artificial Sequence
  synthetic [barcode part1]
acctattagatcctgc

SEQ ID NO: 18777 - DNA, 16 bp, Artificial Sequence
  synthetic [barcode part1]
ccttggcgtatccagt

SEQ ID NO: 18778 - DNA, 16 bp, Artificial Sequence
  synthetic [barcode part1]
cctgtcgaaggtaact

SEQ ID NO: 18779 - DNA, 16 bp, Artificial Sequence
  synthetic [barcode part1]
tcgtatcgacacaggt

SEQ ID NO: 18780 - DNA, 16 bp, Artificial Sequence
  synthetic [barcode part1]
gtcctctagttaggag

SEQ ID NO: 18781 - DNA, 16 bp, Artificial Sequence
  synthetic [barcode part1]
tcttggtccggtacgt

SEQ ID NO: 18782 - DNA, 16 bp, Artificial Sequence
  synthetic [barcode part1]
tgacctcttctggttc

SEQ ID NO: 18783 - DNA, 16 bp, Artificial Sequence
  synthetic [barcode part1]
agaccactctatacct

SEQ ID NO: 18784 - DNA, 16 bp, Artificial Sequence
  synthetic [barcode part1]
accggtcaactagttg

SEQ ID NO: 18785 - DNA, 16 bp, Artificial Sequence
  synthetic [barcode part1]
gcctcactagatccgt

SEQ ID NO: 18786 - DNA, 16 bp, Artificial Sequence
  synthetic [barcode part1]
taggatatcgtgtgag

SEQ ID NO: 18787 - DNA, 16 bp, Artificial Sequence
  synthetic [barcode part1]
gacttcttgacctcct

SEQ ID NO: 18788 - DNA, 16 bp, Artificial Sequence
  synthetic [barcode part1]
acggagttgttcggag

SEQ ID NO: 18789 - DNA, 16 bp, Artificial Sequence
  synthetic [barcode part1]
aacgtgtccaatcttc

SEQ ID NO: 18790 - DNA, 16 bp, Artificial Sequence
  synthetic [barcode part1]
gaccttcctaagtatc

SEQ ID NO: 18791 - DNA, 16 bp, Artificial Sequence
  synthetic [barcode part1]
aatccactccgaacag

SEQ ID NO: 18792 - DNA, 16 bp, Artificial Sequence
  synthetic [barcode part1]
gtccaggacaataggc

SEQ ID NO: 18793 - DNA, 16 bp, Artificial Sequence
  synthetic [barcode part1]
gtccagagtagacctt

SEQ ID NO: 18794 - DNA, 16 bp, Artificial Sequence
  synthetic [barcode part1]
attgtccacgacgagt

SEQ ID NO: 18795 - DNA, 16 bp, Artificial Sequence
  synthetic [barcode part1]
gagtacgatcgccaag

SEQ ID NO: 18796 - DNA, 16 bp, Artificial Sequence
  synthetic [barcode part1]
cgaattgcgtgtctcc

SEQ ID NO: 18797 - DNA, 16 bp, Artificial Sequence
  synthetic [barcode part1]
gcacagttcgacctct

SEQ ID NO: 18798 - DNA, 16 bp, Artificial Sequence
  synthetic [barcode part1]
agtctcctcagatatc

SEQ ID NO: 18799 - DNA, 16 bp, Artificial Sequence
  synthetic [barcode part1]
cagagttaccgtaacc

SEQ ID NO: 18800 - DNA, 16 bp, Artificial Sequence
  synthetic [barcode part1]
tcgtctcacgcgattg

SEQ ID NO: 18801 - DNA, 16 bp, Artificial Sequence
  synthetic [barcode part1]
ttacgcctaccaggtc

SEQ ID NO: 18802 - DNA, 16 bp, Artificial Sequence
  synthetic [barcode part1]
tgtcaagtgccttcgc

SEQ ID NO: 18803 - DNA, 16 bp, Artificial Sequence
  synthetic [barcode part1]
caatctctcggtctct

SEQ ID NO: 18804 - DNA, 16 bp, Artificial Sequence
  synthetic [barcode part1]
aggttaacgtacaacg

SEQ ID NO: 18805 - DNA, 16 bp, Artificial Sequence
  synthetic [barcode part1]
acaacacacactgtgc

SEQ ID NO: 18806 - DNA, 16 bp, Artificial Sequence
  synthetic [barcode part1]
cagtgacctagatcgt

SEQ ID NO: 18807 - DNA, 16 bp, Artificial Sequence
  synthetic [barcode part1]
aatcgcggttgacgtt

SEQ ID NO: 18808 - DNA, 16 bp, Artificial Sequence
  synthetic [barcode part1]
atatctcttccacgcc

SEQ ID NO: 18809 - DNA, 16 bp, Artificial Sequence
  synthetic [barcode part1]
ttcgcggagacagtag

SEQ ID NO: 18810 - DNA, 16 bp, Artificial Sequence
  synthetic [barcode part1]
cagtatcgaacctcag

SEQ ID NO: 18811 - DNA, 16 bp, Artificial Sequence
  synthetic [barcode part1]
gtagtcttctgtatcg

SEQ ID NO: 18812 - DNA, 16 bp, Artificial Sequence
  synthetic [barcode part1]
taacagaagacctgtg

SEQ ID NO: 18813 - DNA, 16 bp, Artificial Sequence
  synthetic [barcode part1]
gtgcagttgtggttgt

SEQ ID NO: 18814 - DNA, 16 bp, Artificial Sequence
  synthetic [barcode part1]
atattaggagacgacc

SEQ ID NO: 18815 - DNA, 16 bp, Artificial Sequence
  synthetic [barcode part1]
agttgtaccagagagt

SEQ ID NO: 18816 - DNA, 16 bp, Artificial Sequence
  synthetic [barcode part1]
caagtgtacacctgac

SEQ ID NO: 18817 - DNA, 16 bp, Artificial Sequence
  synthetic [barcode part1]
attgtgccacgaactg

SEQ ID NO: 18818 - DNA, 16 bp, Artificial Sequence
  synthetic [barcode part1]
gaattcgcaggttcac

SEQ ID NO: 18819 - DNA, 16 bp, Artificial Sequence
  synthetic [barcode part1]
taatctcacgcgccac

SEQ ID NO: 18820 - DNA, 16 bp, Artificial Sequence
  synthetic [barcode part1]
ttactctagagtggcg

SEQ ID NO: 18821 - DNA, 16 bp, Artificial Sequence
  synthetic [barcode part1]
cacctgtcacttgttc

SEQ ID NO: 18822 - DNA, 16 bp, Artificial Sequence
  synthetic [barcode part1]
ttaggaattcctggcg

SEQ ID NO: 18823 - DNA, 16 bp, Artificial Sequence
  synthetic [barcode part1]
cgttctaccacttcgt

SEQ ID NO: 18824 - DNA, 16 bp, Artificial Sequence
  synthetic [barcode part1]
acagtaatctgtggag

SEQ ID NO: 18825 - DNA, 16 bp, Artificial Sequence
  synthetic [barcode part1]
caattaagtgtgcgcc

SEQ ID NO: 18826 - DNA, 16 bp, Artificial Sequence
  synthetic [barcode part1]
aaccgagaacacgtcg

SEQ ID NO: 18827 - DNA, 16 bp, Artificial Sequence
  synthetic [barcode part1]
ttatctgacggcgtcc

SEQ ID NO: 18828 - DNA, 16 bp, Artificial Sequence
  synthetic [barcode part1]
tactcacacggacagt

SEQ ID NO: 18829 - DNA, 16 bp, Artificial Sequence
  synthetic [barcode part1]
actccgttctaacctc

SEQ ID NO: 18830 - DNA, 16 bp, Artificial Sequence
  synthetic [barcode part1]
acacgactcaattcct

SEQ ID NO: 18831 - DNA, 16 bp, Artificial Sequence
  synthetic [barcode part1]
tccgttgttctgttgc

SEQ ID NO: 18832 - DNA, 16 bp, Artificial Sequence
  synthetic [barcode part1]
ttgcctcaaccgtacg

SEQ ID NO: 18833 - DNA, 16 bp, Artificial Sequence
  synthetic [barcode part1]
tccgtcggattcgtgt

SEQ ID NO: 18834 - DNA, 16 bp, Artificial Sequence
  synthetic [barcode part1]
agagtcgagagatcag

SEQ ID NO: 18835 - DNA, 16 bp, Artificial Sequence
  synthetic [barcode part1]
tagacctctcaccgtg

SEQ ID NO: 18836 - DNA, 16 bp, Artificial Sequence
  synthetic [barcode part1]
ttgccaacaactcgag

SEQ ID NO: 18837 - DNA, 16 bp, Artificial Sequence
  synthetic [barcode part1]
tcgtgttctgccaggt

SEQ ID NO: 18838 - DNA, 16 bp, Artificial Sequence
  synthetic [barcode part1]
tgtgacgacctgcctt

SEQ ID NO: 18839 - DNA, 16 bp, Artificial Sequence
  synthetic [barcode part1]
gtctgaagtggatctc

SEQ ID NO: 18840 - DNA, 16 bp, Artificial Sequence
  synthetic [barcode part1]
gcggaccaggaattgt

SEQ ID NO: 18841 - DNA, 16 bp, Artificial Sequence
  synthetic [barcode part1]
ttgtctgtcgtccgtt

SEQ ID NO: 18842 - DNA, 16 bp, Artificial Sequence
  synthetic [barcode part1]
agaccgacgtggttag

SEQ ID NO: 18843 - DNA, 16 bp, Artificial Sequence
  synthetic [barcode part1]
aggacacaaccgtcag

SEQ ID NO: 18844 - DNA, 16 bp, Artificial Sequence
  synthetic [barcode part1]
gccgtgacaagtagac

SEQ ID NO: 18845 - DNA, 16 bp, Artificial Sequence
  synthetic [barcode part1]
gccaatacttaactcc

SEQ ID NO: 18846 - DNA, 16 bp, Artificial Sequence
  synthetic [barcode part1]
tggcgtagatcacgtt

SEQ ID NO: 18847 - DNA, 16 bp, Artificial Sequence
  synthetic [barcode part1]
cgtgaacgtcctgtct

SEQ ID NO: 18848 - DNA, 16 bp, Artificial Sequence
  synthetic [barcode part1]
tccgcgcgacttaatc

SEQ ID NO: 18849 - DNA, 16 bp, Artificial Sequence
  synthetic [barcode part1]
cacacggtattagtgc

SEQ ID NO: 18850 - DNA, 16 bp, Artificial Sequence
  synthetic [barcode part1]
tatctcgcctgtcact

SEQ ID NO: 18851 - DNA, 16 bp, Artificial Sequence
  synthetic [barcode part1]
aacactcctactgttg

SEQ ID NO: 18852 - DNA, 16 bp, Artificial Sequence
  synthetic [barcode part1]
cacaatcgcacttgag

SEQ ID NO: 18853 - DNA, 16 bp, Artificial Sequence
  synthetic [barcode part1]
cctcgcaccgataact

SEQ ID NO: 18854 - DNA, 16 bp, Artificial Sequence
  synthetic [barcode part1]
cgtgaccactaaggag

SEQ ID NO: 18855 - DNA, 16 bp, Artificial Sequence
  synthetic [barcode part1]
tgagtggtgtctgttg

SEQ ID NO: 18856 - DNA, 16 bp, Artificial Sequence
  synthetic [barcode part1]
acgacactacggtgtt

SEQ ID NO: 18857 - DNA, 16 bp, Artificial Sequence
  synthetic [barcode part1]
acacctagacgaggtg

SEQ ID NO: 18858 - DNA, 16 bp, Artificial Sequence
  synthetic [barcode part1]
cagactactctacgcc

SEQ ID NO: 18859 - DNA, 16 bp, Artificial Sequence
  synthetic [barcode part1]
gataggcacctacttg

SEQ ID NO: 18860 - DNA, 16 bp, Artificial Sequence
  synthetic [barcode part1]
accaatcctggagttg

SEQ ID NO: 18861 - DNA, 16 bp, Artificial Sequence
  synthetic [barcode part1]
gtgcgtgtacaatacc

SEQ ID NO: 18862 - DNA, 16 bp, Artificial Sequence
  synthetic [barcode part1]
agttgactggtaccac

SEQ ID NO: 18863 - DNA, 16 bp, Artificial Sequence
  synthetic [barcode part1]
gcaggtctgattctcc

SEQ ID NO: 18864 - DNA, 16 bp, Artificial Sequence
  synthetic [barcode part1]
agactggcgactacag

SEQ ID NO: 18865 - DNA, 16 bp, Artificial Sequence
  synthetic [barcode part1]
gcaggagtgacgactt

SEQ ID NO: 18866 - DNA, 16 bp, Artificial Sequence
  synthetic [barcode part1]
tggtgccaggtaagtg

SEQ ID NO: 18867 - DNA, 16 bp, Artificial Sequence
  synthetic [barcode part1]
acgcacctgttctacg

SEQ ID NO: 18868 - DNA, 16 bp, Artificial Sequence
  synthetic [barcode part1]
acgagtcaccacctct

SEQ ID NO: 18869 - DNA, 16 bp, Artificial Sequence
  synthetic [barcode part1]
ccttctggtaaggtag

SEQ ID NO: 18870 - DNA, 16 bp, Artificial Sequence
  synthetic [barcode part1]
ttcacttcaagactcg

SEQ ID NO: 18871 - DNA, 16 bp, Artificial Sequence
  synthetic [barcode part1]
tggtatccaagtagag

SEQ ID NO: 18872 - DNA, 16 bp, Artificial Sequence
  synthetic [barcode part1]
acgacgatatcgatag

SEQ ID NO: 18873 - DNA, 16 bp, Artificial Sequence
  synthetic [barcode part1]
gtgatcgaagaggcct

SEQ ID NO: 18874 - DNA, 16 bp, Artificial Sequence
  synthetic [barcode part1]
gtctggagtagactct

SEQ ID NO: 18875 - DNA, 16 bp, Artificial Sequence
  synthetic [barcode part1]
gatcacgccgacttct

SEQ ID NO: 18876 - DNA, 16 bp, Artificial Sequence
  synthetic [barcode part1]
aatcgtggaaggattc

SEQ ID NO: 18877 - DNA, 16 bp, Artificial Sequence
  synthetic [barcode part1]
tgagaggtggttgcac

SEQ ID NO: 18878 - DNA, 16 bp, Artificial Sequence
  synthetic [barcode part1]
aagtcactacctccgc

SEQ ID NO: 18879 - DNA, 16 bp, Artificial Sequence
  synthetic [barcode part1]
tgttgcctggaagatc

SEQ ID NO: 18880 - DNA, 16 bp, Artificial Sequence
  synthetic [barcode part1]
acttgacgtcactgag

SEQ ID NO: 18881 - DNA, 16 bp, Artificial Sequence
  synthetic [barcode part1]
aaggatacgttaggtc

SEQ ID NO: 18882 - DNA, 16 bp, Artificial Sequence
  synthetic [barcode part1]
tgttgcacgcgtatag

SEQ ID NO: 18883 - DNA, 16 bp, Artificial Sequence
  synthetic [barcode part1]
tggaatcagagaggac

SEQ ID NO: 18884 - DNA, 16 bp, Artificial Sequence
  synthetic [barcode part1]
tatcggatagaagtgc

SEQ ID NO: 18885 - DNA, 16 bp, Artificial Sequence
  synthetic [barcode part1]
caggatccaactgact

SEQ ID NO: 18886 - DNA, 16 bp, Artificial Sequence
  synthetic [barcode part1]
acggcaacctgtgaag

SEQ ID NO: 18887 - DNA, 16 bp, Artificial Sequence
  synthetic [barcode part1]
cgcgtgaggattgaac

SEQ ID NO: 18888 - DNA, 16 bp, Artificial Sequence
  synthetic [barcode part1]
taacttccgcagttac

SEQ ID NO: 18889 - DNA, 16 bp, Artificial Sequence
  synthetic [barcode part1]
tgccggtgttatacag

SEQ ID NO: 18890 - DNA, 16 bp, Artificial Sequence
  synthetic [barcode part1]
tataccgaactgagag

SEQ ID NO: 18891 - DNA, 16 bp, Artificial Sequence
  synthetic [barcode part1]
cgaaccaactggactt

SEQ ID NO: 18892 - DNA, 16 bp, Artificial Sequence
  synthetic [barcode part1]
gtcacttatctcgcct

SEQ ID NO: 18893 - DNA, 16 bp, Artificial Sequence
  synthetic [barcode part1]
tgccagaggtaactct

SEQ ID NO: 18894 - DNA, 16 bp, Artificial Sequence
  synthetic [barcode part1]
aaccgacgcgtatact

SEQ ID NO: 18895 - DNA, 16 bp, Artificial Sequence
  synthetic [barcode part1]
tcaagatacctgcctt

SEQ ID NO: 18896 - DNA, 16 bp, Artificial Sequence
  synthetic [barcode part1]
tgtatctccgttagac

SEQ ID NO: 18897 - DNA, 16 bp, Artificial Sequence
  synthetic [barcode part1]
gtatccaggtgtctag

SEQ ID NO: 18898 - DNA, 16 bp, Artificial Sequence
  synthetic [barcode part1]
tgacactagtactgcg

SEQ ID NO: 18899 - DNA, 16 bp, Artificial Sequence
  synthetic [barcode part1]
gtgccagttgagtatc

SEQ ID NO: 18900 - DNA, 16 bp, Artificial Sequence
  synthetic [barcode part1]
gcagatcggaggttgt

SEQ ID NO: 18901 - DNA, 16 bp, Artificial Sequence
  synthetic [barcode part1]
gttcaccgagtgaatc

SEQ ID NO: 18902 - DNA, 16 bp, Artificial Sequence
  synthetic [barcode part1]
taccagacctgacaac

SEQ ID NO: 18903 - DNA, 16 bp, Artificial Sequence
  synthetic [barcode part1]
aattggacgtcttgcg

SEQ ID NO: 18904 - DNA, 16 bp, Artificial Sequence
  synthetic [barcode part1]
agtcgatagaacctcc

SEQ ID NO: 18905 - DNA, 16 bp, Artificial Sequence
  synthetic [barcode part1]
ttgacttgacaacggc

SEQ ID NO: 18906 - DNA, 16 bp, Artificial Sequence
  synthetic [barcode part1]
tgtcaacttctggccg

SEQ ID NO: 18907 - DNA, 16 bp, Artificial Sequence
  synthetic [barcode part1]
tcggtgactgcgttct

SEQ ID NO: 18908 - DNA, 16 bp, Artificial Sequence
  synthetic [barcode part1]
actggcgcaaggaatc

SEQ ID NO: 18909 - DNA, 16 bp, Artificial Sequence
  synthetic [barcode part1]
acttgccggatcctac

SEQ ID NO: 18910 - DNA, 16 bp, Artificial Sequence
  synthetic [barcode part1]
tgtgacaccgttcacc

SEQ ID NO: 18911 - DNA, 16 bp, Artificial Sequence
  synthetic [barcode part1]
ttcgcctgacagatag

SEQ ID NO: 18912 - DNA, 16 bp, Artificial Sequence
  synthetic [barcode part1]
gccacgagaacgaatc

SEQ ID NO: 18913 - DNA, 16 bp, Artificial Sequence
  synthetic [barcode part1]
atcgttgacacctccg

SEQ ID NO: 18914 - DNA, 16 bp, Artificial Sequence
  synthetic [barcode part1]
tctcctcagtcttggt

SEQ ID NO: 18915 - DNA, 16 bp, Artificial Sequence
  synthetic [barcode part1]
tattccagaatccacc

SEQ ID NO: 18916 - DNA, 16 bp, Artificial Sequence
  synthetic [barcode part1]
tggtcctcacgattgc

SEQ ID NO: 18917 - DNA, 16 bp, Artificial Sequence
  synthetic [barcode part1]
gcaattaggagtcagt

SEQ ID NO: 18918 - DNA, 16 bp, Artificial Sequence
  synthetic [barcode part1]
aacgactaagagtacc

SEQ ID NO: 18919 - DNA, 16 bp, Artificial Sequence
  synthetic [barcode part1]
ttagaagtccttggcg

SEQ ID NO: 18920 - DNA, 16 bp, Artificial Sequence
  synthetic [barcode part1]
cgagtattctctggcc

SEQ ID NO: 18921 - DNA, 16 bp, Artificial Sequence
  synthetic [barcode part1]
acgaacgcagagttcg

SEQ ID NO: 18922 - DNA, 16 bp, Artificial Sequence
  synthetic [barcode part1]
gtattcggaattcgcg

SEQ ID NO: 18923 - DNA, 16 bp, Artificial Sequence
  synthetic [barcode part1]
cgtatctgtgatctgt

SEQ ID NO: 18924 - DNA, 16 bp, Artificial Sequence
  synthetic [barcode part1]
gcaacttgacaactcg

SEQ ID NO: 18925 - DNA, 16 bp, Artificial Sequence
  synthetic [barcode part1]
tacggtgaggcggatt

SEQ ID NO: 18926 - DNA, 16 bp, Artificial Sequence
  synthetic [barcode part1]
tcactacgttccacct

SEQ ID NO: 18927 - DNA, 16 bp, Artificial Sequence
  synthetic [barcode part1]
aaggatactgtcagac

SEQ ID NO: 18928 - DNA, 16 bp, Artificial Sequence
  synthetic [barcode part1]
tcggttccgccaatac

SEQ ID NO: 18929 - DNA, 16 bp, Artificial Sequence
  synthetic [barcode part1]
aacggtgtagatactg

SEQ ID NO: 18930 - DNA, 16 bp, Artificial Sequence
  synthetic [barcode part1]
agtctcctataggttc

SEQ ID NO: 18931 - DNA, 16 bp, Artificial Sequence
  synthetic [barcode part1]
agataacagagtggcg

SEQ ID NO: 18932 - DNA, 16 bp, Artificial Sequence
  synthetic [barcode part1]
tctctgatacgcgatt

SEQ ID NO: 18933 - DNA, 16 bp, Artificial Sequence
  synthetic [barcode part1]
aatcgcaattgcacgc

SEQ ID NO: 18934 - DNA, 16 bp, Artificial Sequence
  synthetic [barcode part1]
ttcagtgttgtcggag

SEQ ID NO: 18935 - DNA, 16 bp, Artificial Sequence
  synthetic [barcode part1]
gcgactaataccgact

SEQ ID NO: 18936 - DNA, 16 bp, Artificial Sequence
  synthetic [barcode part1]
atcacaactgtggcgt

SEQ ID NO: 18937 - DNA, 16 bp, Artificial Sequence
  synthetic [barcode part1]
actctactcacacagt

SEQ ID NO: 18938 - DNA, 16 bp, Artificial Sequence
  synthetic [barcode part1]
cagatcgcagtctagt

SEQ ID NO: 18939 - DNA, 16 bp, Artificial Sequence
  synthetic [barcode part1]
cactccaagatctgcc

SEQ ID NO: 18940 - DNA, 16 bp, Artificial Sequence
  synthetic [barcode part1]
taaggcgtaggaagtg

SEQ ID NO: 18941 - DNA, 16 bp, Artificial Sequence
  synthetic [barcode part1]
tctgtcactccactgt

SEQ ID NO: 18942 - DNA, 16 bp, Artificial Sequence
  synthetic [barcode part1]
caccgcagttaactag

SEQ ID NO: 18943 - DNA, 16 bp, Artificial Sequence
  synthetic [barcode part1]
cgtcacggttaatcag

SEQ ID NO: 18944 - DNA, 16 bp, Artificial Sequence
  synthetic [barcode part1]
cgcctcctaatagtcg

SEQ ID NO: 18945 - DNA, 16 bp, Artificial Sequence
  synthetic [barcode part1]
aattagttggccgacc

SEQ ID NO: 18946 - DNA, 16 bp, Artificial Sequence
  synthetic [barcode part1]
cgaagttccgaagttc

SEQ ID NO: 18947 - DNA, 16 bp, Artificial Sequence
  synthetic [barcode part1]
cgagtcctatcactcg

SEQ ID NO: 18948 - DNA, 16 bp, Artificial Sequence
  synthetic [barcode part1]
tgaaccagtgtagaac

SEQ ID NO: 18949 - DNA, 16 bp, Artificial Sequence
  synthetic [barcode part1]
aacgtggtattagacg

SEQ ID NO: 18950 - DNA, 16 bp, Artificial Sequence
  synthetic [barcode part1]
ttaggactacctgttc

SEQ ID NO: 18951 - DNA, 16 bp, Artificial Sequence
  synthetic [barcode part1]
gttacgacttaggacc

SEQ ID NO: 18952 - DNA, 16 bp, Artificial Sequence
  synthetic [barcode part1]
gtcgaacaacggtctt

SEQ ID NO: 18953 - DNA, 16 bp, Artificial Sequence
  synthetic [barcode part1]
cagatatcgatcctct

SEQ ID NO: 18954 - DNA, 16 bp, Artificial Sequence
  synthetic [barcode part1]
tggttccgcactaacc

SEQ ID NO: 18955 - DNA, 16 bp, Artificial Sequence
  synthetic [barcode part1]
attccacgaaccaggt

SEQ ID NO: 18956 - DNA, 16 bp, Artificial Sequence
  synthetic [barcode part1]
tatctcgtgaggtggt

SEQ ID NO: 18957 - DNA, 16 bp, Artificial Sequence
  synthetic [barcode part1]
tccactcgtctacttg

SEQ ID NO: 18958 - DNA, 16 bp, Artificial Sequence
  synthetic [barcode part1]
cctatcgacgtgactc

SEQ ID NO: 18959 - DNA, 16 bp, Artificial Sequence
  synthetic [barcode part1]
agttgaactacgtgag

SEQ ID NO: 18960 - DNA, 16 bp, Artificial Sequence
  synthetic [barcode part1]
cagttccgcgttgatc

SEQ ID NO: 18961 - DNA, 16 bp, Artificial Sequence
  synthetic [barcode part1]
tctggtattgtgtctg

SEQ ID NO: 18962 - DNA, 16 bp, Artificial Sequence
  synthetic [barcode part1]
ttcctctaccgatcac

SEQ ID NO: 18963 - DNA, 16 bp, Artificial Sequence
  synthetic [barcode part1]
attcggttctcgcacg

SEQ ID NO: 18964 - DNA, 16 bp, Artificial Sequence
  synthetic [barcode part1]
caccactcctataggc

SEQ ID NO: 18965 - DNA, 16 bp, Artificial Sequence
  synthetic [barcode part1]
tcctacagattgtcgt

SEQ ID NO: 18966 - DNA, 16 bp, Artificial Sequence
  synthetic [barcode part1]
cagttgtgtgattgcg

SEQ ID NO: 18967 - DNA, 16 bp, Artificial Sequence
  synthetic [barcode part1]
acttgtgttctcggcg

SEQ ID NO: 18968 - DNA, 16 bp, Artificial Sequence
  synthetic [barcode part1]
gcgtgaagtaattcag

SEQ ID NO: 18969 - DNA, 16 bp, Artificial Sequence
  synthetic [barcode part1]
tgacggtacgcgaagt

SEQ ID NO: 18970 - DNA, 16 bp, Artificial Sequence
  synthetic [barcode part1]
tcagtctcgccagtgt

SEQ ID NO: 18971 - DNA, 16 bp, Artificial Sequence
  synthetic [barcode part1]
tcctacaagagtgcgt

SEQ ID NO: 18972 - DNA, 16 bp, Artificial Sequence
  synthetic [barcode part1]
gttggtgcaggaggtt

SEQ ID NO: 18973 - DNA, 16 bp, Artificial Sequence
  synthetic [barcode part1]
cgttcactctgttcac

SEQ ID NO: 18974 - DNA, 16 bp, Artificial Sequence
  synthetic [barcode part1]
tctcggcaacctacgt

SEQ ID NO: 18975 - DNA, 16 bp, Artificial Sequence
  synthetic [barcode part1]
gtgaatccttctggcc

SEQ ID NO: 18976 - DNA, 16 bp, Artificial Sequence
  synthetic [barcode part1]
acctaactacaggaag

SEQ ID NO: 18977 - DNA, 16 bp, Artificial Sequence
  synthetic [barcode part1]
tgttctagtccgcgac

SEQ ID NO: 18978 - DNA, 16 bp, Artificial Sequence
  synthetic [barcode part1]
acgtaatctaggaggt

SEQ ID NO: 18979 - DNA, 16 bp, Artificial Sequence
  synthetic [barcode part1]
cggtgaccagtaattc

SEQ ID NO: 18980 - DNA, 16 bp, Artificial Sequence
  synthetic [barcode part1]
tgtacgttgaccagtg

SEQ ID NO: 18981 - DNA, 16 bp, Artificial Sequence
  synthetic [barcode part1]
gagactcttgcctatt

SEQ ID NO: 18982 - DNA, 16 bp, Artificial Sequence
  synthetic [barcode part1]
cagttgtagtgtgtcg

SEQ ID NO: 18983 - DNA, 16 bp, Artificial Sequence
  synthetic [barcode part1]
tgtaacggagtagatc

SEQ ID NO: 18984 - DNA, 16 bp, Artificial Sequence
  synthetic [barcode part1]
agacttggtaagacac

SEQ ID NO: 18985 - DNA, 16 bp, Artificial Sequence
  synthetic [barcode part1]
tctagaggagatctcc

SEQ ID NO: 18986 - DNA, 16 bp, Artificial Sequence
  synthetic [barcode part1]
tgtaggtctataggcc

SEQ ID NO: 18987 - DNA, 16 bp, Artificial Sequence
  synthetic [barcode part1]
tctgcgcaccaagtct

SEQ ID NO: 18988 - DNA, 16 bp, Artificial Sequence
  synthetic [barcode part1]
caaccgaagttctggt

SEQ ID NO: 18989 - DNA, 16 bp, Artificial Sequence
  synthetic [barcode part1]
agactgcgtagtctgt

SEQ ID NO: 18990 - DNA, 16 bp, Artificial Sequence
  synthetic [barcode part1]
gaatcgcgaacacggt

SEQ ID NO: 18991 - DNA, 16 bp, Artificial Sequence
  synthetic [barcode part1]
cgtgacagaactctgt

SEQ ID NO: 18992 - DNA, 16 bp, Artificial Sequence
  synthetic [barcode part1]
aacgtctgacgtactg

SEQ ID NO: 18993 - DNA, 16 bp, Artificial Sequence
  synthetic [barcode part1]
acctgagtggatacct

SEQ ID NO: 18994 - DNA, 16 bp, Artificial Sequence
  synthetic [barcode part1]
tatctggcaataggag

SEQ ID NO: 18995 - DNA, 16 bp, Artificial Sequence
  synthetic [barcode part1]
aactcagtggtgactc

SEQ ID NO: 18996 - DNA, 16 bp, Artificial Sequence
  synthetic [barcode part1]
gatctccggttgtgtc

SEQ ID NO: 18997 - DNA, 16 bp, Artificial Sequence
  synthetic [barcode part1]
tacgcgaatagaacgt

SEQ ID NO: 18998 - DNA, 16 bp, Artificial Sequence
  synthetic [barcode part1]
actgcgagaatctcgt

SEQ ID NO: 18999 - DNA, 16 bp, Artificial Sequence
  synthetic [barcode part1]
aacactcaagttggag

SEQ ID NO: 19000 - DNA, 16 bp, Artificial Sequence
  synthetic [barcode part1]
gcactatctatctgtg

SEQ ID NO: 19001 - DNA, 16 bp, Artificial Sequence
  synthetic [barcode part1]
cacggatctattctgt

SEQ ID NO: 19002 - DNA, 16 bp, Artificial Sequence
  synthetic [barcode part1]
gtacgcagattgacct

SEQ ID NO: 19003 - DNA, 16 bp, Artificial Sequence
  synthetic [barcode part1]
tctggaatcctcttcc

SEQ ID NO: 19004 - DNA, 16 bp, Artificial Sequence
  synthetic [barcode part1]
cacgtcttagattacc

SEQ ID NO: 19005 - DNA, 16 bp, Artificial Sequence
  synthetic [barcode part1]
tctatcactctgtcgc

SEQ ID NO: 19006 - DNA, 16 bp, Artificial Sequence
  synthetic [barcode part1]
tctgagattccggaac

SEQ ID NO: 19007 - DNA, 16 bp, Artificial Sequence
  synthetic [barcode part1]
cggtagtactactggt

SEQ ID NO: 19008 - DNA, 16 bp, Artificial Sequence
  synthetic [barcode part1]
cgtgagtggtagaatt

SEQ ID NO: 19009 - DNA, 16 bp, Artificial Sequence
  synthetic [barcode part1]
tctctcggagttgaag

SEQ ID NO: 19010 - DNA, 16 bp, Artificial Sequence
  synthetic [barcode part1]
aacagaagtgtctgac

SEQ ID NO: 19011 - DNA, 16 bp, Artificial Sequence
  synthetic [barcode part1]
gagtgcctggatattc

SEQ ID NO: 19012 - DNA, 16 bp, Artificial Sequence
  synthetic [barcode part1]
ccactgcacttgcagt

SEQ ID NO: 19013 - DNA, 16 bp, Artificial Sequence
  synthetic [barcode part1]
tatacgccttcgagag

SEQ ID NO: 19014 - DNA, 16 bp, Artificial Sequence
  synthetic [barcode part1]
gtctccttgtacgacg

SEQ ID NO: 19015 - DNA, 16 bp, Artificial Sequence
  synthetic [barcode part1]
tcgtccgattccgagt

SEQ ID NO: 19016 - DNA, 16 bp, Artificial Sequence
  synthetic [barcode part1]
ttcgagatacacgtgc

SEQ ID NO: 19017 - DNA, 16 bp, Artificial Sequence
  synthetic [barcode part1]
tacggtgccgcctatt

SEQ ID NO: 19018 - DNA, 16 bp, Artificial Sequence
  synthetic [barcode part1]
gtgtgcggattagttc

SEQ ID NO: 19019 - DNA, 16 bp, Artificial Sequence
  synthetic [barcode part1]
gcaggatcaagtattg

SEQ ID NO: 19020 - DNA, 16 bp, Artificial Sequence
  synthetic [barcode part1]
ccgataaggtatagac

SEQ ID NO: 19021 - DNA, 16 bp, Artificial Sequence
  synthetic [barcode part1]
aggttcgtcaccgtct

SEQ ID NO: 19022 - DNA, 16 bp, Artificial Sequence
  synthetic [barcode part1]
cgattgtacttcctag

SEQ ID NO: 19023 - DNA, 16 bp, Artificial Sequence
  synthetic [barcode part1]
actgactaaccggttg

SEQ ID NO: 19024 - DNA, 16 bp, Artificial Sequence
  synthetic [barcode part1]
tgtcaaggaaccactc

SEQ ID NO: 19025 - DNA, 16 bp, Artificial Sequence
  synthetic [barcode part1]
gttacaggaacaggcc

SEQ ID NO: 19026 - DNA, 16 bp, Artificial Sequence
  synthetic [barcode part1]
tccgatcagtctcttc

SEQ ID NO: 19027 - DNA, 16 bp, Artificial Sequence
  synthetic [barcode part1]
agtacacgccgtatac

SEQ ID NO: 19028 - DNA, 16 bp, Artificial Sequence
  synthetic [barcode part1]
gaaggatagacgtctt

SEQ ID NO: 19029 - DNA, 16 bp, Artificial Sequence
  synthetic [barcode part1]
cacgcctgcaattcgt

SEQ ID NO: 19030 - DNA, 16 bp, Artificial Sequence
  synthetic [barcode part1]
gcaattacggcacgtt

SEQ ID NO: 19031 - DNA, 16 bp, Artificial Sequence
  synthetic [barcode part1]
ttccacacagtaacct

SEQ ID NO: 19032 - DNA, 16 bp, Artificial Sequence
  synthetic [barcode part1]
actgcagaagtgagtt

SEQ ID NO: 19033 - DNA, 16 bp, Artificial Sequence
  synthetic [barcode part1]
atccaagtgccactcc

SEQ ID NO: 19034 - DNA, 16 bp, Artificial Sequence
  synthetic [barcode part1]
tgttatctccgtgaac

SEQ ID NO: 19035 - DNA, 16 bp, Artificial Sequence
  synthetic [barcode part1]
gttcaggacctgtagt

SEQ ID NO: 19036 - DNA, 16 bp, Artificial Sequence
  synthetic [barcode part1]
acggaagtacaccttc

SEQ ID NO: 19037 - DNA, 16 bp, Artificial Sequence
  synthetic [barcode part1]
acagtggcctacgaag

SEQ ID NO: 19038 - DNA, 16 bp, Artificial Sequence
  synthetic [barcode part1]
tgatatactcctggtc

SEQ ID NO: 19039 - DNA, 16 bp, Artificial Sequence
  synthetic [barcode part1]
cagagagaactaaggc

SEQ ID NO: 19040 - DNA, 16 bp, Artificial Sequence
  synthetic [barcode part1]
tatatcctaccaggtc

SEQ ID NO: 19041 - DNA, 16 bp, Artificial Sequence
  synthetic [barcode part1]
ataaccgttcctcaac

SEQ ID NO: 19042 - DNA, 16 bp, Artificial Sequence
  synthetic [barcode part1]
gttggagttggagaag

SEQ ID NO: 19043 - DNA, 16 bp, Artificial Sequence
  synthetic [barcode part1]
tgagacttgtggtgtc

SEQ ID NO: 19044 - DNA, 16 bp, Artificial Sequence
  synthetic [barcode part1]
ttgtgcacaacacgtg

SEQ ID NO: 19045 - DNA, 16 bp, Artificial Sequence
  synthetic [barcode part1]
gtaggcctcttcagtc

SEQ ID NO: 19046 - DNA, 16 bp, Artificial Sequence
  synthetic [barcode part1]
cggtacagttactctt

SEQ ID NO: 19047 - DNA, 16 bp, Artificial Sequence
  synthetic [barcode part1]
cctagaacaaccgatc

SEQ ID NO: 19048 - DNA, 16 bp, Artificial Sequence
  synthetic [barcode part1]
agtaaggtgcgaactt

SEQ ID NO: 19049 - DNA, 16 bp, Artificial Sequence
  synthetic [barcode part1]
cgaggatcgaattgcg

SEQ ID NO: 19050 - DNA, 16 bp, Artificial Sequence
  synthetic [barcode part1]
agattcgcgccttacc

SEQ ID NO: 19051 - DNA, 16 bp, Artificial Sequence
  synthetic [barcode part1]
cgaccacttgtcactg

SEQ ID NO: 19052 - DNA, 16 bp, Artificial Sequence
  synthetic [barcode part1]
cggcaaccaacaattc

SEQ ID NO: 19053 - DNA, 16 bp, Artificial Sequence
  synthetic [barcode part1]
tcggtccgcaattatt

SEQ ID NO: 19054 - DNA, 16 bp, Artificial Sequence
  synthetic [barcode part1]
atccgtaacgtccaag

SEQ ID NO: 19055 - DNA, 16 bp, Artificial Sequence
  synthetic [barcode part1]
tccagtctcagttctc

SEQ ID NO: 19056 - DNA, 16 bp, Artificial Sequence
  synthetic [barcode part1]
tgaacactcgatacgc

SEQ ID NO: 19057 - DNA, 16 bp, Artificial Sequence
  synthetic [barcode part1]
gcgttggaccaagaac

SEQ ID NO: 19058 - DNA, 16 bp, Artificial Sequence
  synthetic [barcode part1]
ccactcgtctacttgt

SEQ ID NO: 19059 - DNA, 16 bp, Artificial Sequence
  synthetic [barcode part1]
accgttcctgtgaacc

SEQ ID NO: 19060 - DNA, 16 bp, Artificial Sequence
  synthetic [barcode part1]
gacaggtgccttagag

SEQ ID NO: 19061 - DNA, 16 bp, Artificial Sequence
  synthetic [barcode part1]
ccaagtactcactatc

SEQ ID NO: 19062 - DNA, 16 bp, Artificial Sequence
  synthetic [barcode part1]
gaagaatactcaggtc

SEQ ID NO: 19063 - DNA, 16 bp, Artificial Sequence
  synthetic [barcode part1]
tgcctcggtagactct

SEQ ID NO: 19064 - DNA, 16 bp, Artificial Sequence
  synthetic [barcode part1]
tgactacggcaataag

SEQ ID NO: 19065 - DNA, 16 bp, Artificial Sequence
  synthetic [barcode part1]
tcagatacctaccgtt

SEQ ID NO: 19066 - DNA, 16 bp, Artificial Sequence
  synthetic [barcode part1]
tgaactaacgcaaggt

SEQ ID NO: 19067 - DNA, 16 bp, Artificial Sequence
  synthetic [barcode part1]
atattacgcctacctg

SEQ ID NO: 19068 - DNA, 16 bp, Artificial Sequence
  synthetic [barcode part1]
gtggtccttgtgtctg

SEQ ID NO: 19069 - DNA, 16 bp, Artificial Sequence
  synthetic [barcode part1]
atatctcaccggattc

SEQ ID NO: 19070 - DNA, 16 bp, Artificial Sequence
  synthetic [barcode part1]
atcgaataggccacct

SEQ ID NO: 19071 - DNA, 16 bp, Artificial Sequence
  synthetic [barcode part1]
atctacgttcttgacg

SEQ ID NO: 19072 - DNA, 16 bp, Artificial Sequence
  synthetic [barcode part1]
tcgcggatccaacttc

SEQ ID NO: 19073 - DNA, 16 bp, Artificial Sequence
  synthetic [barcode part1]
ttgtaccggtgatctt

SEQ ID NO: 19074 - DNA, 16 bp, Artificial Sequence
  synthetic [barcode part1]
gcctaatctgagtcag

SEQ ID NO: 19075 - DNA, 16 bp, Artificial Sequence
  synthetic [barcode part1]
tgtacgacgaaggacc

SEQ ID NO: 19076 - DNA, 16 bp, Artificial Sequence
  synthetic [barcode part1]
aaccacactaggaggc

SEQ ID NO: 19077 - DNA, 16 bp, Artificial Sequence
  synthetic [barcode part1]
tcaacttcagacctac

SEQ ID NO: 19078 - DNA, 16 bp, Artificial Sequence
  synthetic [barcode part1]
atccaagaggtggtgc

SEQ ID NO: 19079 - DNA, 16 bp, Artificial Sequence
  synthetic [barcode part1]
agatctctcctaggag

SEQ ID NO: 19080 - DNA, 16 bp, Artificial Sequence
  synthetic [barcode part1]
agacaggcctatctac

SEQ ID NO: 19081 - DNA, 16 bp, Artificial Sequence
  synthetic [barcode part1]
acttgtgaagaaccag

SEQ ID NO: 19082 - DNA, 16 bp, Artificial Sequence
  synthetic [barcode part1]
gtcaatacctgactct

SEQ ID NO: 19083 - DNA, 16 bp, Artificial Sequence
  synthetic [barcode part1]
ttagaatcctactcgc

SEQ ID NO: 19084 - DNA, 16 bp, Artificial Sequence
  synthetic [barcode part1]
gatatcacgtgtgcgt

SEQ ID NO: 19085 - DNA, 16 bp, Artificial Sequence
  synthetic [barcode part1]
ccgcagacaagaagtc

SEQ ID NO: 19086 - DNA, 16 bp, Artificial Sequence
  synthetic [barcode part1]
gtgtctaggtatccag

SEQ ID NO: 19087 - DNA, 16 bp, Artificial Sequence
  synthetic [barcode part1]
gattaacggtctcggt

SEQ ID NO: 19088 - DNA, 16 bp, Artificial Sequence
  synthetic [barcode part1]
caatcgagtactgcac

SEQ ID NO: 19089 - DNA, 16 bp, Artificial Sequence
  synthetic [barcode part1]
ttacgagatagagtgc

SEQ ID NO: 19090 - DNA, 16 bp, Artificial Sequence
  synthetic [barcode part1]
tccgcgcaattactgc

SEQ ID NO: 19091 - DNA, 16 bp, Artificial Sequence
  synthetic [barcode part1]
gcggccaataccaatt

SEQ ID NO: 19092 - DNA, 16 bp, Artificial Sequence
  synthetic [barcode part1]
tgttggtgtgttgacg

SEQ ID NO: 19093 - DNA, 16 bp, Artificial Sequence
  synthetic [barcode part1]
acgcgtatcagttggt

SEQ ID NO: 19094 - DNA, 16 bp, Artificial Sequence
  synthetic [barcode part1]
taacgaactgcggacg

SEQ ID NO: 19095 - DNA, 16 bp, Artificial Sequence
  synthetic [barcode part1]
tagacacgacttgcac

SEQ ID NO: 19096 - DNA, 16 bp, Artificial Sequence
  synthetic [barcode part1]
cacttgtccgtggtgt

SEQ ID NO: 19097 - DNA, 16 bp, Artificial Sequence
  synthetic [barcode part1]
tagagtcgtgtgtgtc

SEQ ID NO: 19098 - DNA, 16 bp, Artificial Sequence
  synthetic [barcode part1]
gtgcctctaatccggt

SEQ ID NO: 19099 - DNA, 16 bp, Artificial Sequence
  synthetic [barcode part1]
gttgaatcgttcctgt

SEQ ID NO: 19100 - DNA, 16 bp, Artificial Sequence
  synthetic [barcode part1]
cctcgtgccagattgt

SEQ ID NO: 19101 - DNA, 16 bp, Artificial Sequence
  synthetic [barcode part1]
tacgaacacgacaggc

SEQ ID NO: 19102 - DNA, 16 bp, Artificial Sequence
  synthetic [barcode part1]
ccacctagttccgaac

SEQ ID NO: 19103 - DNA, 16 bp, Artificial Sequence
  synthetic [barcode part1]
acaacgcaatcctggt

SEQ ID NO: 19104 - DNA, 16 bp, Artificial Sequence
  synthetic [barcode part1]
agtcggatcactatcg

SEQ ID NO: 19105 - DNA, 16 bp, Artificial Sequence
  synthetic [barcode part1]
tccgtcagacttgcac

SEQ ID NO: 19106 - DNA, 16 bp, Artificial Sequence
  synthetic [barcode part1]
tcactgttcacaggtt

SEQ ID NO: 19107 - DNA, 16 bp, Artificial Sequence
  synthetic [barcode part1]
ccaatcacgtgtacag

SEQ ID NO: 19108 - DNA, 16 bp, Artificial Sequence
  synthetic [barcode part1]
gttggcgtgttctgtc

SEQ ID NO: 19109 - DNA, 16 bp, Artificial Sequence
  synthetic [barcode part1]
gaactataggtacggt

SEQ ID NO: 19110 - DNA, 16 bp, Artificial Sequence
  synthetic [barcode part1]
taggattgcaccacgt

SEQ ID NO: 19111 - DNA, 16 bp, Artificial Sequence
  synthetic [barcode part1]
cgtgtagttacacggt

SEQ ID NO: 19112 - DNA, 16 bp, Artificial Sequence
  synthetic [barcode part1]
acctgaacacttggac

SEQ ID NO: 19113 - DNA, 16 bp, Artificial Sequence
  synthetic [barcode part1]
ttctggattacggcag

SEQ ID NO: 19114 - DNA, 16 bp, Artificial Sequence
  synthetic [barcode part1]
tgccgtggattagttg

SEQ ID NO: 19115 - DNA, 16 bp, Artificial Sequence
  synthetic [barcode part1]
cgagattcgcagtatc

SEQ ID NO: 19116 - DNA, 16 bp, Artificial Sequence
  synthetic [barcode part1]
aggtatcacttgcgac

SEQ ID NO: 19117 - DNA, 16 bp, Artificial Sequence
  synthetic [barcode part1]
acacaggcaggaatag

SEQ ID NO: 19118 - DNA, 16 bp, Artificial Sequence
  synthetic [barcode part1]
tacctcagttccacct

SEQ ID NO: 19119 - DNA, 16 bp, Artificial Sequence
  synthetic [barcode part1]
ccgtgcacacaattag

SEQ ID NO: 19120 - DNA, 16 bp, Artificial Sequence
  synthetic [barcode part1]
tagtaacgtgcgaagt

SEQ ID NO: 19121 - DNA, 16 bp, Artificial Sequence
  synthetic [barcode part1]
cggtcacagatatctg

SEQ ID NO: 19122 - DNA, 16 bp, Artificial Sequence
  synthetic [barcode part1]
taagtgcgcgtaatcc

SEQ ID NO: 19123 - DNA, 16 bp, Artificial Sequence
  synthetic [barcode part1]
tctgacttgcacgatt

SEQ ID NO: 19124 - DNA, 16 bp, Artificial Sequence
  synthetic [barcode part1]
caccaggttattaggc

SEQ ID NO: 19125 - DNA, 16 bp, Artificial Sequence
  synthetic [barcode part1]
tagtacctcacctgcg

SEQ ID NO: 19126 - DNA, 16 bp, Artificial Sequence
  synthetic [barcode part1]
caccgacctaattccg

SEQ ID NO: 19127 - DNA, 16 bp, Artificial Sequence
  synthetic [barcode part1]
tcgtacttccgtacct

SEQ ID NO: 19128 - DNA, 16 bp, Artificial Sequence
  synthetic [barcode part1]
tgccaatatacgccag

SEQ ID NO: 19129 - DNA, 16 bp, Artificial Sequence
  synthetic [barcode part1]
cgtgattcttctaacg

SEQ ID NO: 19130 - DNA, 16 bp, Artificial Sequence
  synthetic [barcode part1]
taccgcgtatacacag

SEQ ID NO: 19131 - DNA, 16 bp, Artificial Sequence
  synthetic [barcode part1]
cgatcaaccagaactc

SEQ ID NO: 19132 - DNA, 16 bp, Artificial Sequence
  synthetic [barcode part1]
gattgtcaagtgcaag

SEQ ID NO: 19133 - DNA, 16 bp, Artificial Sequence
  synthetic [barcode part1]
ttgtgacggttagtcg

SEQ ID NO: 19134 - DNA, 16 bp, Artificial Sequence
  synthetic [barcode part1]
aataccgcaattggcc

SEQ ID NO: 19135 - DNA, 16 bp, Artificial Sequence
  synthetic [barcode part1]
tccttgagtatcgact

SEQ ID NO: 19136 - DNA, 16 bp, Artificial Sequence
  synthetic [barcode part1]
taattcctgcggtcgc

SEQ ID NO: 19137 - DNA, 16 bp, Artificial Sequence
  synthetic [barcode part1]
gcgtaataccaacgtc

SEQ ID NO: 19138 - DNA, 16 bp, Artificial Sequence
  synthetic [barcode part1]
gcgtacgaattagtcc

SEQ ID NO: 19139 - DNA, 16 bp, Artificial Sequence
  synthetic [barcode part1]
ttcgtagaacgcctag

SEQ ID NO: 19140 - DNA, 16 bp, Artificial Sequence
  synthetic [barcode part1]
gaattgccactgagtc

SEQ ID NO: 19141 - DNA, 16 bp, Artificial Sequence
  synthetic [barcode part1]
ccgtagataccagtgt

SEQ ID NO: 19142 - DNA, 16 bp, Artificial Sequence
  synthetic [barcode part1]
tctgagttccggttcg

SEQ ID NO: 19143 - DNA, 16 bp, Artificial Sequence
  synthetic [barcode part1]
tcggcaagagtcactt

SEQ ID NO: 19144 - DNA, 16 bp, Artificial Sequence
  synthetic [barcode part1]
tggtccgttgttgaag

SEQ ID NO: 19145 - DNA, 16 bp, Artificial Sequence
  synthetic [barcode part1]
cgatcctcacgtgatc

SEQ ID NO: 19146 - DNA, 16 bp, Artificial Sequence
  synthetic [barcode part1]
ttgaggcgtctatctt

SEQ ID NO: 19147 - DNA, 16 bp, Artificial Sequence
  synthetic [barcode part1]
cggcgttagtaggtag

SEQ ID NO: 19148 - DNA, 16 bp, Artificial Sequence
  synthetic [barcode part1]
ccagtaacgttagacc

SEQ ID NO: 19149 - DNA, 16 bp, Artificial Sequence
  synthetic [barcode part1]
tgagttaacgccttct

SEQ ID NO: 19150 - DNA, 16 bp, Artificial Sequence
  synthetic [barcode part1]
tcgtaacaccgtagtg

SEQ ID NO: 19151 - DNA, 16 bp, Artificial Sequence
  synthetic [barcode part1]
accgaacttcaacggt

SEQ ID NO: 19152 - DNA, 16 bp, Artificial Sequence
  synthetic [barcode part1]
gtggttgtcttgactt

SEQ ID NO: 19153 - DNA, 16 bp, Artificial Sequence
  synthetic [barcode part1]
tcgtgaatcaccgtcc

SEQ ID NO: 19154 - DNA, 16 bp, Artificial Sequence
  synthetic [barcode part1]
gaaccgtgtcctcact

SEQ ID NO: 19155 - DNA, 16 bp, Artificial Sequence
  synthetic [barcode part1]
gccactcaacacctgt

SEQ ID NO: 19156 - DNA, 16 bp, Artificial Sequence
  synthetic [barcode part1]
gatctagatcgttggc

SEQ ID NO: 19157 - DNA, 16 bp, Artificial Sequence
  synthetic [barcode part1]
atccagtatcgagtcg

SEQ ID NO: 19158 - DNA, 16 bp, Artificial Sequence
  synthetic [barcode part1]
gttcgtagtgtctgag

SEQ ID NO: 19159 - DNA, 16 bp, Artificial Sequence
  synthetic [barcode part1]
ccttgtgatcgttaac

SEQ ID NO: 19160 - DNA, 16 bp, Artificial Sequence
  synthetic [barcode part1]
ttgacacgtcagtgtg

SEQ ID NO: 19161 - DNA, 16 bp, Artificial Sequence
  synthetic [barcode part1]
gagaacgttgttagac

SEQ ID NO: 19162 - DNA, 16 bp, Artificial Sequence
  synthetic [barcode part1]
ttcactaagagtggcc

SEQ ID NO: 19163 - DNA, 16 bp, Artificial Sequence
  synthetic [barcode part1]
attagtgcctgcaggt

SEQ ID NO: 19164 - DNA, 16 bp, Artificial Sequence
  synthetic [barcode part1]
cggagaatcagtcttc

SEQ ID NO: 19165 - DNA, 16 bp, Artificial Sequence
  synthetic [barcode part1]
ttaggtaccgtggact

SEQ ID NO: 19166 - DNA, 16 bp, Artificial Sequence
  synthetic [barcode part1]
atccaagttactccac

SEQ ID NO: 19167 - DNA, 16 bp, Artificial Sequence
  synthetic [barcode part1]
aaccacgttccttagt

SEQ ID NO: 19168 - DNA, 16 bp, Artificial Sequence
  synthetic [barcode part1]
cactagttcctgattg

SEQ ID NO: 19169 - DNA, 16 bp, Artificial Sequence
  synthetic [barcode part1]
atcaacctgcagtacg

SEQ ID NO: 19170 - DNA, 16 bp, Artificial Sequence
  synthetic [barcode part1]
tacttcgaggcagtgt

SEQ ID NO: 19171 - DNA, 16 bp, Artificial Sequence
  synthetic [barcode part1]
cgaattccagacactg

SEQ ID NO: 19172 - DNA, 16 bp, Artificial Sequence
  synthetic [barcode part1]
cggagtagttcttcag

SEQ ID NO: 19173 - DNA, 16 bp, Artificial Sequence
  synthetic [barcode part1]
agatagttgcgccgag

SEQ ID NO: 19174 - DNA, 16 bp, Artificial Sequence
  synthetic [barcode part1]
gagtggaaggtcctac

SEQ ID NO: 19175 - DNA, 16 bp, Artificial Sequence
  synthetic [barcode part1]
gtcgtgattactcact

SEQ ID NO: 19176 - DNA, 16 bp, Artificial Sequence
  synthetic [barcode part1]
cgaactactggtgatc

SEQ ID NO: 19177 - DNA, 16 bp, Artificial Sequence
  synthetic [barcode part1]
ttcaggaccttctctc

SEQ ID NO: 19178 - DNA, 16 bp, Artificial Sequence
  synthetic [barcode part1]
ttcactgtgtgaacct

SEQ ID NO: 19179 - DNA, 16 bp, Artificial Sequence
  synthetic [barcode part1]
gttgtgtcctcgtcag

SEQ ID NO: 19180 - DNA, 16 bp, Artificial Sequence
  synthetic [barcode part1]
gtcactctctgaatac

SEQ ID NO: 19181 - DNA, 16 bp, Artificial Sequence
  synthetic [barcode part1]
cagtcttagtcgaggt

SEQ ID NO: 19182 - DNA, 16 bp, Artificial Sequence
  synthetic [barcode part1]
cacttatcgagacttc

SEQ ID NO: 19183 - DNA, 16 bp, Artificial Sequence
  synthetic [barcode part1]
tgaactcgtaacagag

SEQ ID NO: 19184 - DNA, 16 bp, Artificial Sequence
  synthetic [barcode part1]
tctcaatccgagtatc

SEQ ID NO: 19185 - DNA, 16 bp, Artificial Sequence
  synthetic [barcode part1]
agaggaattgaggtcg

SEQ ID NO: 19186 - DNA, 16 bp, Artificial Sequence
  synthetic [barcode part1]
cctgactatcggtacc

SEQ ID NO: 19187 - DNA, 16 bp, Artificial Sequence
  synthetic [barcode part1]
tacaggttgttactcc

SEQ ID NO: 19188 - DNA, 16 bp, Artificial Sequence
  synthetic [barcode part1]
gaattcctcaaccgag

SEQ ID NO: 19189 - DNA, 16 bp, Artificial Sequence
  synthetic [barcode part1]
gcacgcgatatacgtt

SEQ ID NO: 19190 - DNA, 16 bp, Artificial Sequence
  synthetic [barcode part1]
gccacagattctgaac

SEQ ID NO: 19191 - DNA, 16 bp, Artificial Sequence
  synthetic [barcode part1]
tggagaacgtacagtt

SEQ ID NO: 19192 - DNA, 16 bp, Artificial Sequence
  synthetic [barcode part1]
gcgagagaacttgatt

SEQ ID NO: 19193 - DNA, 16 bp, Artificial Sequence
  synthetic [barcode part1]
acaactcctcagtgag

SEQ ID NO: 19194 - DNA, 16 bp, Artificial Sequence
  synthetic [barcode part1]
accagtgttactgtct

SEQ ID NO: 19195 - DNA, 16 bp, Artificial Sequence
  synthetic [barcode part1]
cggtccaacaacttag

SEQ ID NO: 19196 - DNA, 16 bp, Artificial Sequence
  synthetic [barcode part1]
cggaacagaatatctg

SEQ ID NO: 19197 - DNA, 16 bp, Artificial Sequence
  synthetic [barcode part1]
ttcactgcgcggatct

SEQ ID NO: 19198 - DNA, 16 bp, Artificial Sequence
  synthetic [barcode part1]
tacttgtacgagtggc

SEQ ID NO: 19199 - DNA, 16 bp, Artificial Sequence
  synthetic [barcode part1]
gacggttagtcgttgt

SEQ ID NO: 19200 - DNA, 16 bp, Artificial Sequence
  synthetic [barcode part1]
ccgacgataggagtac

SEQ ID NO: 19201 - DNA, 16 bp, Artificial Sequence
  synthetic [barcode part1]
actaaccaccacagtg

SEQ ID NO: 19202 - DNA, 16 bp, Artificial Sequence
  synthetic [barcode part1]
acagtggcctaatctg

SEQ ID NO: 19203 - DNA, 16 bp, Artificial Sequence
  synthetic [barcode part1]
gaggtacagtccaacg

SEQ ID NO: 19204 - DNA, 16 bp, Artificial Sequence
  synthetic [barcode part1]
aattgtggaggccggt

SEQ ID NO: 19205 - DNA, 16 bp, Artificial Sequence
  synthetic [barcode part1]
cctgacttatagttgc

SEQ ID NO: 19206 - DNA, 16 bp, Artificial Sequence
  synthetic [barcode part1]
ttactgcaggtggtgt

SEQ ID NO: 19207 - DNA, 16 bp, Artificial Sequence
  synthetic [barcode part1]
tgccttaacgaacctt

SEQ ID NO: 19208 - DNA, 16 bp, Artificial Sequence
  synthetic [barcode part1]
gttggcctaatcaacg

SEQ ID NO: 19209 - DNA, 16 bp, Artificial Sequence
  synthetic [barcode part1]
tgcaatctggcgagag

SEQ ID NO: 19210 - DNA, 16 bp, Artificial Sequence
  synthetic [barcode part1]
cagaggacacgattgc

SEQ ID NO: 19211 - DNA, 16 bp, Artificial Sequence
  synthetic [barcode part1]
cagaattgactccggt

SEQ ID NO: 19212 - DNA, 16 bp, Artificial Sequence
  synthetic [barcode part1]
gtaacacctccaagac

SEQ ID NO: 19213 - DNA, 16 bp, Artificial Sequence
  synthetic [barcode part1]
agacttgacctagacc

SEQ ID NO: 19214 - DNA, 16 bp, Artificial Sequence
  synthetic [barcode part1]
tgccttgagtagaacc

SEQ ID NO: 19215 - DNA, 16 bp, Artificial Sequence
  synthetic [barcode part1]
ccaatctacgaggtgt

SEQ ID NO: 19216 - DNA, 16 bp, Artificial Sequence
  synthetic [barcode part1]
cgccgttatccgaact

SEQ ID NO: 19217 - DNA, 16 bp, Artificial Sequence
  synthetic [barcode part1]
gcaggtctaacaggac

SEQ ID NO: 19218 - DNA, 16 bp, Artificial Sequence
  synthetic [barcode part1]
cgatagtcgactcaac

SEQ ID NO: 19219 - DNA, 16 bp, Artificial Sequence
  synthetic [barcode part1]
gtgtaacgtcggtatc

SEQ ID NO: 19220 - DNA, 16 bp, Artificial Sequence
  synthetic [barcode part1]
gttctcgattcgacgc

SEQ ID NO: 19221 - DNA, 16 bp, Artificial Sequence
  synthetic [barcode part1]
ttacttcggtcgcacg

SEQ ID NO: 19222 - DNA, 16 bp, Artificial Sequence
  synthetic [barcode part1]
tccacaacactacttg

SEQ ID NO: 19223 - DNA, 16 bp, Artificial Sequence
  synthetic [barcode part1]
gcctaccagatcctgt

SEQ ID NO: 19224 - DNA, 16 bp, Artificial Sequence
  synthetic [barcode part1]
cgttgtacttcctctg

SEQ ID NO: 19225 - DNA, 16 bp, Artificial Sequence
  synthetic [barcode part1]
agttgtactctctggt

SEQ ID NO: 19226 - DNA, 16 bp, Artificial Sequence
  synthetic [barcode part1]
ttgcagagtgagatac

SEQ ID NO: 19227 - DNA, 16 bp, Artificial Sequence
  synthetic [barcode part1]
gcacagtacactggtt

SEQ ID NO: 19228 - DNA, 16 bp, Artificial Sequence
  synthetic [barcode part1]
cagtataccaacgcgt

SEQ ID NO: 19229 - DNA, 16 bp, Artificial Sequence
  synthetic [barcode part1]
gcggtattctcagagt

SEQ ID NO: 19230 - DNA, 16 bp, Artificial Sequence
  synthetic [barcode part1]
cactctctagtagttg

SEQ ID NO: 19231 - DNA, 16 bp, Artificial Sequence
  synthetic [barcode part1]
tcaatcgcgtagtgtg

SEQ ID NO: 19232 - DNA, 16 bp, Artificial Sequence
  synthetic [barcode part1]
gttgaacgacagtctc

SEQ ID NO: 19233 - DNA, 16 bp, Artificial Sequence
  synthetic [barcode part1]
gcacgtatcttggagt

SEQ ID NO: 19234 - DNA, 16 bp, Artificial Sequence
  synthetic [barcode part1]
accagagtaacacgcg

SEQ ID NO: 19235 - DNA, 16 bp, Artificial Sequence
  synthetic [barcode part1]
tgtgttcgacggcctt

SEQ ID NO: 19236 - DNA, 16 bp, Artificial Sequence
  synthetic [barcode part1]
acgcacgatcaattgc

SEQ ID NO: 19237 - DNA, 16 bp, Artificial Sequence
  synthetic [barcode part1]
ttgtactcgtcagatc

SEQ ID NO: 19238 - DNA, 16 bp, Artificial Sequence
  synthetic [barcode part1]
caaccgaatcacgact

SEQ ID NO: 19239 - DNA, 16 bp, Artificial Sequence
  synthetic [barcode part1]
agtgaggagaacgatc

SEQ ID NO: 19240 - DNA, 16 bp, Artificial Sequence
  synthetic [barcode part1]
ataacgcagttctggc

SEQ ID NO: 19241 - DNA, 16 bp, Artificial Sequence
  synthetic [barcode part1]
tgagaatctgtgtccg

SEQ ID NO: 19242 - DNA, 16 bp, Artificial Sequence
  synthetic [barcode part1]
gatcacgacgccaatt

SEQ ID NO: 19243 - DNA, 16 bp, Artificial Sequence
  synthetic [barcode part1]
tcgtccgaggtaagtt

SEQ ID NO: 19244 - DNA, 16 bp, Artificial Sequence
  synthetic [barcode part1]
gagtcgtacctagtgt

SEQ ID NO: 19245 - DNA, 16 bp, Artificial Sequence
  synthetic [barcode part1]
tacaattcctcgtcag

SEQ ID NO: 19246 - DNA, 16 bp, Artificial Sequence
  synthetic [barcode part1]
aacgccgatattgcac

SEQ ID NO: 19247 - DNA, 16 bp, Artificial Sequence
  synthetic [barcode part1]
tctgtcgtgtattgac

SEQ ID NO: 19248 - DNA, 16 bp, Artificial Sequence
  synthetic [barcode part1]
tcgatcagagaccttg

SEQ ID NO: 19249 - DNA, 16 bp, Artificial Sequence
  synthetic [barcode part1]
ttaatcctcacgtgac

SEQ ID NO: 19250 - DNA, 16 bp, Artificial Sequence
  synthetic [barcode part1]
tacacacaccaaccag

SEQ ID NO: 19251 - DNA, 16 bp, Artificial Sequence
  synthetic [barcode part1]
acctcgcgcctagatt

SEQ ID NO: 19252 - DNA, 16 bp, Artificial Sequence
  synthetic [barcode part1]
ataaggaactactggc

SEQ ID NO: 19253 - DNA, 16 bp, Artificial Sequence
  synthetic [barcode part1]
tgaaggagaccgaagt

SEQ ID NO: 19254 - DNA, 16 bp, Artificial Sequence
  synthetic [barcode part1]
gtagtgcgtcgtgatt

SEQ ID NO: 19255 - DNA, 16 bp, Artificial Sequence
  synthetic [barcode part1]
tgcagacttacttcgt

SEQ ID NO: 19256 - DNA, 16 bp, Artificial Sequence
  synthetic [barcode part1]
tgacgtagtgtggttc

SEQ ID NO: 19257 - DNA, 16 bp, Artificial Sequence
  synthetic [barcode part1]
taggtcgtcaagtcgt

SEQ ID NO: 19258 - DNA, 16 bp, Artificial Sequence
  synthetic [barcode part1]
tgtgagtgagtctacc

SEQ ID NO: 19259 - DNA, 16 bp, Artificial Sequence
  synthetic [barcode part1]
agttaagtctggcctg

SEQ ID NO: 19260 - DNA, 16 bp, Artificial Sequence
  synthetic [barcode part1]
cagtcgacgatactgt

SEQ ID NO: 19261 - DNA, 16 bp, Artificial Sequence
  synthetic [barcode part1]
ttaccgttgagtacct

SEQ ID NO: 19262 - DNA, 16 bp, Artificial Sequence
  synthetic [barcode part1]
cctaccgaaggtagtt

SEQ ID NO: 19263 - DNA, 16 bp, Artificial Sequence
  synthetic [barcode part1]
gagtacgcctctatag

SEQ ID NO: 19264 - DNA, 16 bp, Artificial Sequence
  synthetic [barcode part1]
tcttggcacgcagttc

SEQ ID NO: 19265 - DNA, 16 bp, Artificial Sequence
  synthetic [barcode part1]
tctagtggaactaccg

SEQ ID NO: 19266 - DNA, 16 bp, Artificial Sequence
  synthetic [barcode part1]
tgattaatacgcgcgc

SEQ ID NO: 19267 - DNA, 16 bp, Artificial Sequence
  synthetic [barcode part1]
ttgcctagttctaggt

SEQ ID NO: 19268 - DNA, 16 bp, Artificial Sequence
  synthetic [barcode part1]
ccgtctgagtaccgtt

SEQ ID NO: 19269 - DNA, 16 bp, Artificial Sequence
  synthetic [barcode part1]
gaatagacactgtgac

SEQ ID NO: 19270 - DNA, 16 bp, Artificial Sequence
  synthetic [barcode part1]
cgatatagtacggcct

SEQ ID NO: 19271 - DNA, 16 bp, Artificial Sequence
  synthetic [barcode part1]
gatcctcttggcacac

SEQ ID NO: 19272 - DNA, 16 bp, Artificial Sequence
  synthetic [barcode part1]
aggacgattactccac

SEQ ID NO: 19273 - DNA, 16 bp, Artificial Sequence
  synthetic [barcode part1]
tggcaagttcaggcag

SEQ ID NO: 19274 - DNA, 16 bp, Artificial Sequence
  synthetic [barcode part1]
cggtctgcctatatcg

SEQ ID NO: 19275 - DNA, 16 bp, Artificial Sequence
  synthetic [barcode part1]
gtcttataagtgcctc

SEQ ID NO: 19276 - DNA, 16 bp, Artificial Sequence
  synthetic [barcode part1]
atagtcctactcctag

SEQ ID NO: 19277 - DNA, 16 bp, Artificial Sequence
  synthetic [barcode part1]
tccttgcgacgatctg

SEQ ID NO: 19278 - DNA, 16 bp, Artificial Sequence
  synthetic [barcode part1]
caattggcgataccac

SEQ ID NO: 19279 - DNA, 16 bp, Artificial Sequence
  synthetic [barcode part1]
caaggcagtaaggtag

SEQ ID NO: 19280 - DNA, 16 bp, Artificial Sequence
  synthetic [barcode part1]
tcgacctagtaacgac

SEQ ID NO: 19281 - DNA, 16 bp, Artificial Sequence
  synthetic [barcode part1]
acacttctgcgtcctt

SEQ ID NO: 19282 - DNA, 16 bp, Artificial Sequence
  synthetic [barcode part1]
acaccttaactcggtt

SEQ ID NO: 19283 - DNA, 16 bp, Artificial Sequence
  synthetic [barcode part1]
gaagtctctcaggatc

SEQ ID NO: 19284 - DNA, 16 bp, Artificial Sequence
  synthetic [barcode part1]
gcgttcttggtgatcc

SEQ ID NO: 19285 - DNA, 16 bp, Artificial Sequence
  synthetic [barcode part1]
tcactgttgaacacct

SEQ ID NO: 19286 - DNA, 16 bp, Artificial Sequence
  synthetic [barcode part1]
gttcctaacaactcgt

SEQ ID NO: 19287 - DNA, 16 bp, Artificial Sequence
  synthetic [barcode part1]
cggaatcaccgattgt

SEQ ID NO: 19288 - DNA, 16 bp, Artificial Sequence
  synthetic [barcode part1]
atcagaacctcagtcg

SEQ ID NO: 19289 - DNA, 16 bp, Artificial Sequence
  synthetic [barcode part1]
tacgataacctgcctt

SEQ ID NO: 19290 - DNA, 16 bp, Artificial Sequence
  synthetic [barcode part1]
agtcggtacgcgtatt

SEQ ID NO: 19291 - DNA, 16 bp, Artificial Sequence
  synthetic [barcode part1]
ccagtcttctgtggac

SEQ ID NO: 19292 - DNA, 16 bp, Artificial Sequence
  synthetic [barcode part1]
atcaatagacaacggc

SEQ ID NO: 19293 - DNA, 16 bp, Artificial Sequence
  synthetic [barcode part1]
agttaatcgcgacacc

SEQ ID NO: 19294 - DNA, 16 bp, Artificial Sequence
  synthetic [barcode part1]
caccaagagtggttct

SEQ ID NO: 19295 - DNA, 16 bp, Artificial Sequence
  synthetic [barcode part1]
cctaccttaagtggag

SEQ ID NO: 19296 - DNA, 16 bp, Artificial Sequence
  synthetic [barcode part1]
tggtcgaagaaggagt

SEQ ID NO: 19297 - DNA, 16 bp, Artificial Sequence
  synthetic [barcode part1]
accgtgcgagaatcag

SEQ ID NO: 19298 - DNA, 16 bp, Artificial Sequence
  synthetic [barcode part1]
gtggactccggatatt

SEQ ID NO: 19299 - DNA, 16 bp, Artificial Sequence
  synthetic [barcode part1]
gacaactgttaggtcc

SEQ ID NO: 19300 - DNA, 16 bp, Artificial Sequence
  synthetic [barcode part1]
gaagaatacctagacc

SEQ ID NO: 19301 - DNA, 16 bp, Artificial Sequence
  synthetic [barcode part1]
agaggtaacagtctgt

SEQ ID NO: 19302 - DNA, 16 bp, Artificial Sequence
  synthetic [barcode part1]
tgcctatcgaacgagt

SEQ ID NO: 19303 - DNA, 16 bp, Artificial Sequence
  synthetic [barcode part1]
aatcgacctaaggtcc

SEQ ID NO: 19304 - DNA, 16 bp, Artificial Sequence
  synthetic [barcode part1]
ccaccgttctagacgt

SEQ ID NO: 19305 - DNA, 16 bp, Artificial Sequence
  synthetic [barcode part1]
caggcgtcttctaacc

SEQ ID NO: 19306 - DNA, 16 bp, Artificial Sequence
  synthetic [barcode part1]
aggtggaataacgttc

SEQ ID NO: 19307 - DNA, 16 bp, Artificial Sequence
  synthetic [barcode part1]
cgtcagaccacgtctt

SEQ ID NO: 19308 - DNA, 16 bp, Artificial Sequence
  synthetic [barcode part1]
attgcgttgcgagttg

SEQ ID NO: 19309 - DNA, 16 bp, Artificial Sequence
  synthetic [barcode part1]
gccgagtcaaggatac

SEQ ID NO: 19310 - DNA, 16 bp, Artificial Sequence
  synthetic [barcode part1]
tacctgagtcacctcg

SEQ ID NO: 19311 - DNA, 16 bp, Artificial Sequence
  synthetic [barcode part1]
tcaacctcggagagtt

SEQ ID NO: 19312 - DNA, 16 bp, Artificial Sequence
  synthetic [barcode part1]
cgagttgcgtaggagt

SEQ ID NO: 19313 - DNA, 16 bp, Artificial Sequence
  synthetic [barcode part1]
gacagagttgagtatc

SEQ ID NO: 19314 - DNA, 16 bp, Artificial Sequence
  synthetic [barcode part1]
acaacaactgtcaccg

SEQ ID NO: 19315 - DNA, 16 bp, Artificial Sequence
  synthetic [barcode part1]
atatacaaccggccac

SEQ ID NO: 19316 - DNA, 16 bp, Artificial Sequence
  synthetic [barcode part1]
ccactgtatagattcc

SEQ ID NO: 19317 - DNA, 16 bp, Artificial Sequence
  synthetic [barcode part1]
agatctccgcaatacg

SEQ ID NO: 19318 - DNA, 16 bp, Artificial Sequence
  synthetic [barcode part1]
accagtacctaattcc

SEQ ID NO: 19319 - DNA, 16 bp, Artificial Sequence
  synthetic [barcode part1]
tgcaaggagttactag

SEQ ID NO: 19320 - DNA, 16 bp, Artificial Sequence
  synthetic [barcode part1]
acacacagactggttc

SEQ ID NO: 19321 - DNA, 16 bp, Artificial Sequence
  synthetic [barcode part1]
ttcgtagacaggttcg

SEQ ID NO: 19322 - DNA, 16 bp, Artificial Sequence
  synthetic [barcode part1]
tcgttattctgccacc

SEQ ID NO: 19323 - DNA, 16 bp, Artificial Sequence
  synthetic [barcode part1]
ttctggagtccgtctg

SEQ ID NO: 19324 - DNA, 16 bp, Artificial Sequence
  synthetic [barcode part1]
cactagttctcagttg

SEQ ID NO: 19325 - DNA, 16 bp, Artificial Sequence
  synthetic [barcode part1]
ccgtataaccacacag

SEQ ID NO: 19326 - DNA, 16 bp, Artificial Sequence
  synthetic [barcode part1]
caacggtagttcggtt

SEQ ID NO: 19327 - DNA, 16 bp, Artificial Sequence
  synthetic [barcode part1]
aagtccagtaaccacc

SEQ ID NO: 19328 - DNA, 16 bp, Artificial Sequence
  synthetic [barcode part1]
acactcacttgccgtg

SEQ ID NO: 19329 - DNA, 16 bp, Artificial Sequence
  synthetic [barcode part1]
ataaccgaggatcggc

SEQ ID NO: 19330 - DNA, 16 bp, Artificial Sequence
  synthetic [barcode part1]
aaggttctctgagacc

SEQ ID NO: 19331 - DNA, 16 bp, Artificial Sequence
  synthetic [barcode part1]
acagatacaggatctg

SEQ ID NO: 19332 - DNA, 16 bp, Artificial Sequence
  synthetic [barcode part1]
acaacacgtactgcac

SEQ ID NO: 19333 - DNA, 16 bp, Artificial Sequence
  synthetic [barcode part1]
tacaagtgcagtaggt

SEQ ID NO: 19334 - DNA, 16 bp, Artificial Sequence
  synthetic [barcode part1]
cgttaggtcgcacctt

SEQ ID NO: 19335 - DNA, 16 bp, Artificial Sequence
  synthetic [barcode part1]
tatatccgtctggcgc

SEQ ID NO: 19336 - DNA, 16 bp, Artificial Sequence
  synthetic [barcode part1]
tcttacagttaggtcc

SEQ ID NO: 19337 - DNA, 16 bp, Artificial Sequence
  synthetic [barcode part1]
tctcaattcaacgcac

SEQ ID NO: 19338 - DNA, 16 bp, Artificial Sequence
  synthetic [barcode part1]
gtccacttgtctactc

SEQ ID NO: 19339 - DNA, 16 bp, Artificial Sequence
  synthetic [barcode part1]
taatctctcggtcctc

SEQ ID NO: 19340 - DNA, 16 bp, Artificial Sequence
  synthetic [barcode part1]
aatcaacttggccggt

SEQ ID NO: 19341 - DNA, 16 bp, Artificial Sequence
  synthetic [barcode part1]
taggttgatcgtcgac

SEQ ID NO: 19342 - DNA, 16 bp, Artificial Sequence
  synthetic [barcode part1]
aggcagtacacaaccg

SEQ ID NO: 19343 - DNA, 16 bp, Artificial Sequence
  synthetic [barcode part1]
agtaatccgtgagagt

SEQ ID NO: 19344 - DNA, 16 bp, Artificial Sequence
  synthetic [barcode part1]
gacagttctggtagtc

SEQ ID NO: 19345 - DNA, 16 bp, Artificial Sequence
  synthetic [barcode part1]
tcgtgcggaagaatcg

SEQ ID NO: 19346 - DNA, 16 bp, Artificial Sequence
  synthetic [barcode part1]
cctgagaccttcttct

SEQ ID NO: 19347 - DNA, 16 bp, Artificial Sequence
  synthetic [barcode part1]
cagagtctgtgacact

SEQ ID NO: 19348 - DNA, 16 bp, Artificial Sequence
  synthetic [barcode part1]
gtaaccgcacgtgatt

SEQ ID NO: 19349 - DNA, 16 bp, Artificial Sequence
  synthetic [barcode part1]
gcgaagattcttacgc

SEQ ID NO: 19350 - DNA, 16 bp, Artificial Sequence
  synthetic [barcode part1]
attactactggtggcg

SEQ ID NO: 19351 - DNA, 16 bp, Artificial Sequence
  synthetic [barcode part1]
tacggtgcgttcgtct

SEQ ID NO: 19352 - DNA, 16 bp, Artificial Sequence
  synthetic [barcode part1]
ttataagtgtcctgcc

SEQ ID NO: 19353 - DNA, 16 bp, Artificial Sequence
  synthetic [barcode part1]
tagtccacctacaccg

SEQ ID NO: 19354 - DNA, 16 bp, Artificial Sequence
  synthetic [barcode part1]
tggtgtgtgacctcct

SEQ ID NO: 19355 - DNA, 16 bp, Artificial Sequence
  synthetic [barcode part1]
tgcgaacgccttgtct

SEQ ID NO: 19356 - DNA, 16 bp, Artificial Sequence
  synthetic [barcode part1]
ttccacacaacggcct

SEQ ID NO: 19357 - DNA, 16 bp, Artificial Sequence
  synthetic [barcode part1]
tctagtcctgaggagt

SEQ ID NO: 19358 - DNA, 16 bp, Artificial Sequence
  synthetic [barcode part1]
cctctacgaattatcg

SEQ ID NO: 19359 - DNA, 16 bp, Artificial Sequence
  synthetic [barcode part1]
cgtaaggactatcaag

SEQ ID NO: 19360 - DNA, 16 bp, Artificial Sequence
  synthetic [barcode part1]
tcactaccaggtgcct

SEQ ID NO: 19361 - DNA, 16 bp, Artificial Sequence
  synthetic [barcode part1]
ttgtcgtctacgagtt

SEQ ID NO: 19362 - DNA, 16 bp, Artificial Sequence
  synthetic [barcode part1]
cagtgcacaacgaggt

SEQ ID NO: 19363 - DNA, 16 bp, Artificial Sequence
  synthetic [barcode part1]
gttccgcagtatactt

SEQ ID NO: 19364 - DNA, 16 bp, Artificial Sequence
  synthetic [barcode part1]
accagtagtcttccgc

SEQ ID NO: 19365 - DNA, 16 bp, Artificial Sequence
  synthetic [barcode part1]
gttgtcacgatctgag

SEQ ID NO: 19366 - DNA, 16 bp, Artificial Sequence
  synthetic [barcode part1]
taatcgcgaacgtctg

SEQ ID NO: 19367 - DNA, 16 bp, Artificial Sequence
  synthetic [barcode part1]
tctctgcgacagtctg

SEQ ID NO: 19368 - DNA, 16 bp, Artificial Sequence
  synthetic [barcode part1]
cctacactaatagtcc

SEQ ID NO: 19369 - DNA, 16 bp, Artificial Sequence
  synthetic [barcode part1]
tgatataccggcgtac

SEQ ID NO: 19370 - DNA, 16 bp, Artificial Sequence
  synthetic [barcode part1]
caccttcagttcggtg

SEQ ID NO: 19371 - DNA, 16 bp, Artificial Sequence
  synthetic [barcode part1]
acggttggactcctct

SEQ ID NO: 19372 - DNA, 16 bp, Artificial Sequence
  synthetic [barcode part1]
atcgtactcgagtgtg

SEQ ID NO: 19373 - DNA, 16 bp, Artificial Sequence
  synthetic [barcode part1]
aggtgttgacacttgc

SEQ ID NO: 19374 - DNA, 16 bp, Artificial Sequence
  synthetic [barcode part1]
accgcggataatacct

SEQ ID NO: 19375 - DNA, 16 bp, Artificial Sequence
  synthetic [barcode part1]
taggactacgttgtgc

SEQ ID NO: 19376 - DNA, 16 bp, Artificial Sequence
  synthetic [barcode part1]
ccacacttagaccgtc

SEQ ID NO: 19377 - DNA, 16 bp, Artificial Sequence
  synthetic [barcode part1]
cctggttgtacgtcac

SEQ ID NO: 19378 - DNA, 16 bp, Artificial Sequence
  synthetic [barcode part1]
tgcgttagacctcctg

SEQ ID NO: 19379 - DNA, 16 bp, Artificial Sequence
  synthetic [barcode part1]
tccaattacgtcgatc

SEQ ID NO: 19380 - DNA, 16 bp, Artificial Sequence
  synthetic [barcode part1]
gttctgagactgatcg

SEQ ID NO: 19381 - DNA, 16 bp, Artificial Sequence
  synthetic [barcode part1]
acgatcgcacacaact

SEQ ID NO: 19382 - DNA, 16 bp, Artificial Sequence
  synthetic [barcode part1]
cctacacgactattac

SEQ ID NO: 19383 - DNA, 16 bp, Artificial Sequence
  synthetic [barcode part1]
gtaggcagataccgtg

SEQ ID NO: 19384 - DNA, 16 bp, Artificial Sequence
  synthetic [barcode part1]
cgcgatatagataggt

SEQ ID NO: 19385 - DNA, 16 bp, Artificial Sequence
  synthetic [barcode part1]
aaccttcggtctgcgt

SEQ ID NO: 19386 - DNA, 16 bp, Artificial Sequence
  synthetic [barcode part1]
taccgaatcgcacctc

SEQ ID NO: 19387 - DNA, 16 bp, Artificial Sequence
  synthetic [barcode part1]
gatcgatatatcgcgc

SEQ ID NO: 19388 - DNA, 16 bp, Artificial Sequence
  synthetic [barcode part1]
tcaagaattggcgtag

SEQ ID NO: 19389 - DNA, 16 bp, Artificial Sequence
  synthetic [barcode part1]
agaccttatacgtgcg

SEQ ID NO: 19390 - DNA, 16 bp, Artificial Sequence
  synthetic [barcode part1]
tccttagtggcgcgtt

SEQ ID NO: 19391 - DNA, 16 bp, Artificial Sequence
  synthetic [barcode part1]
gccttaagtgtacgtg

SEQ ID NO: 19392 - DNA, 16 bp, Artificial Sequence
  synthetic [barcode part1]
taggtcagactaccac

SEQ ID NO: 19393 - DNA, 16 bp, Artificial Sequence
  synthetic [barcode part1]
taacgacctggactac

SEQ ID NO: 19394 - DNA, 16 bp, Artificial Sequence
  synthetic [barcode part1]
gtgtcgagttggaggt

SEQ ID NO: 19395 - DNA, 16 bp, Artificial Sequence
  synthetic [barcode part1]
tattagttcggtcctg

SEQ ID NO: 19396 - DNA, 16 bp, Artificial Sequence
  synthetic [barcode part1]
gagaggtattctctgc

SEQ ID NO: 19397 - DNA, 16 bp, Artificial Sequence
  synthetic [barcode part1]
gtggtgcaactaatcc

SEQ ID NO: 19398 - DNA, 16 bp, Artificial Sequence
  synthetic [barcode part1]
acgaggagattcggtc

SEQ ID NO: 19399 - DNA, 16 bp, Artificial Sequence
  synthetic [barcode part1]
ccacggtagttaatcg

SEQ ID NO: 19400 - DNA, 16 bp, Artificial Sequence
  synthetic [barcode part1]
acttgagtctattgcc

SEQ ID NO: 19401 - DNA, 16 bp, Artificial Sequence
  synthetic [barcode part1]
taactcgtccgtaccg

SEQ ID NO: 19402 - DNA, 16 bp, Artificial Sequence
  synthetic [barcode part1]
gtacactacctgagtg

SEQ ID NO: 19403 - DNA, 16 bp, Artificial Sequence
  synthetic [barcode part1]
tctgagtacgatcacg

SEQ ID NO: 19404 - DNA, 16 bp, Artificial Sequence
  synthetic [barcode part1]
agtctgtcttgccacg

SEQ ID NO: 19405 - DNA, 16 bp, Artificial Sequence
  synthetic [barcode part1]
gttccggatatcgtag

SEQ ID NO: 19406 - DNA, 16 bp, Artificial Sequence
  synthetic [barcode part1]
actggactgtctccgt

SEQ ID NO: 19407 - DNA, 16 bp, Artificial Sequence
  synthetic [barcode part1]
aacgtacctagagaac

SEQ ID NO: 19408 - DNA, 16 bp, Artificial Sequence
  synthetic [barcode part1]
tgcagtattgcctatc

SEQ ID NO: 19409 - DNA, 16 bp, Artificial Sequence
  synthetic [barcode part1]
gcgttctgttggatcc

SEQ ID NO: 19410 - DNA, 16 bp, Artificial Sequence
  synthetic [barcode part1]
agttgtgtcagttctc

SEQ ID NO: 19411 - DNA, 16 bp, Artificial Sequence
  synthetic [barcode part1]
aacaattaagacgcgc

SEQ ID NO: 19412 - DNA, 16 bp, Artificial Sequence
  synthetic [barcode part1]
gtacgagtattgagtg

SEQ ID NO: 19413 - DNA, 16 bp, Artificial Sequence
  synthetic [barcode part1]
tcgaatctgtattccg

SEQ ID NO: 19414 - DNA, 16 bp, Artificial Sequence
  synthetic [barcode part1]
tggcgaataggtgtcg

SEQ ID NO: 19415 - DNA, 16 bp, Artificial Sequence
  synthetic [barcode part1]
actattcggtactcac

SEQ ID NO: 19416 - DNA, 16 bp, Artificial Sequence
  synthetic [barcode part1]
tatcgagtcaccagac

SEQ ID NO: 19417 - DNA, 16 bp, Artificial Sequence
  synthetic [barcode part1]
gatacgttcagtcttc

SEQ ID NO: 19418 - DNA, 16 bp, Artificial Sequence
  synthetic [barcode part1]
aattgtggcgccagtt

SEQ ID NO: 19419 - DNA, 16 bp, Artificial Sequence
  synthetic [barcode part1]
gtggagagtcgttgac

SEQ ID NO: 19420 - DNA, 16 bp, Artificial Sequence
  synthetic [barcode part1]
aactgacgtacgtacc

SEQ ID NO: 19421 - DNA, 16 bp, Artificial Sequence
  synthetic [barcode part1]
agtgtggcgagttacg

SEQ ID NO: 19422 - DNA, 16 bp, Artificial Sequence
  synthetic [barcode part1]
atcgaacaacgacctc

SEQ ID NO: 19423 - DNA, 16 bp, Artificial Sequence
  synthetic [barcode part1]
attggtagtccggact

SEQ ID NO: 19424 - DNA, 16 bp, Artificial Sequence
  synthetic [barcode part1]
ttgtccgcagatagac

SEQ ID NO: 19425 - DNA, 16 bp, Artificial Sequence
  synthetic [barcode part1]
tagtgaatccaccgtg

SEQ ID NO: 19426 - DNA, 16 bp, Artificial Sequence
  synthetic [barcode part1]
cctgttgtgcaggttc

SEQ ID NO: 19427 - DNA, 16 bp, Artificial Sequence
  synthetic [barcode part1]
gtacgcacaatcggtt

SEQ ID NO: 19428 - DNA, 16 bp, Artificial Sequence
  synthetic [barcode part1]
tgttcgacgataagag

SEQ ID NO: 19429 - DNA, 16 bp, Artificial Sequence
  synthetic [barcode part1]
tcggtctctgtataac

SEQ ID NO: 19430 - DNA, 16 bp, Artificial Sequence
  synthetic [barcode part1]
gttagtgagtgtgtcc

SEQ ID NO: 19431 - DNA, 16 bp, Artificial Sequence
  synthetic [barcode part1]
tctctgacacacagtt

SEQ ID NO: 19432 - DNA, 16 bp, Artificial Sequence
  synthetic [barcode part1]
tactccgatctcactc

SEQ ID NO: 19433 - DNA, 16 bp, Artificial Sequence
  synthetic [barcode part1]
cctgaagaccgcaatt

SEQ ID NO: 19434 - DNA, 16 bp, Artificial Sequence
  synthetic [barcode part1]
tcgataccgtggttag

SEQ ID NO: 19435 - DNA, 16 bp, Artificial Sequence
  synthetic [barcode part1]
ccaactacacgtacag

SEQ ID NO: 19436 - DNA, 16 bp, Artificial Sequence
  synthetic [barcode part1]
gttagtgacgagacgc

SEQ ID NO: 19437 - DNA, 16 bp, Artificial Sequence
  synthetic [barcode part1]
aggttgcacggagact

SEQ ID NO: 19438 - DNA, 16 bp, Artificial Sequence
  synthetic [barcode part1]
acttactcgtcacggc

SEQ ID NO: 19439 - DNA, 16 bp, Artificial Sequence
  synthetic [barcode part1]
aagagtgacttgacgt

SEQ ID NO: 19440 - DNA, 16 bp, Artificial Sequence
  synthetic [barcode part1]
gagtattgtctgcggt

SEQ ID NO: 19441 - DNA, 16 bp, Artificial Sequence
  synthetic [barcode part1]
tgcggtatactgcagt

SEQ ID NO: 19442 - DNA, 16 bp, Artificial Sequence
  synthetic [barcode part1]
tggcagacagagtaag

SEQ ID NO: 19443 - DNA, 16 bp, Artificial Sequence
  synthetic [barcode part1]
caattcgtcgtatctg

SEQ ID NO: 19444 - DNA, 16 bp, Artificial Sequence
  synthetic [barcode part1]
ccaaggatcaatacag

SEQ ID NO: 19445 - DNA, 16 bp, Artificial Sequence
  synthetic [barcode part1]
ttgcaacgccgattag

SEQ ID NO: 19446 - DNA, 16 bp, Artificial Sequence
  synthetic [barcode part1]
gtctgtaattgtctcg

SEQ ID NO: 19447 - DNA, 16 bp, Artificial Sequence
  synthetic [barcode part1]
caggtgcaactgtatc

SEQ ID NO: 19448 - DNA, 16 bp, Artificial Sequence
  synthetic [barcode part1]
cgtgtattcctggaag

SEQ ID NO: 19449 - DNA, 16 bp, Artificial Sequence
  synthetic [barcode part1]
gtcagaggccaatacg

SEQ ID NO: 19450 - DNA, 16 bp, Artificial Sequence
  synthetic [barcode part1]
acgtactagtggtaag

SEQ ID NO: 19451 - DNA, 16 bp, Artificial Sequence
  synthetic [barcode part1]
ttcctggtgcgtagtc

SEQ ID NO: 19452 - DNA, 16 bp, Artificial Sequence
  synthetic [barcode part1]
ttgaggcgtcttaggt

SEQ ID NO: 19453 - DNA, 16 bp, Artificial Sequence
  synthetic [barcode part1]
ccggtactcttggttg

SEQ ID NO: 19454 - DNA, 16 bp, Artificial Sequence
  synthetic [barcode part1]
ttgacgagagtgtaac

SEQ ID NO: 19455 - DNA, 16 bp, Artificial Sequence
  synthetic [barcode part1]
gatagttcttccacgt

SEQ ID NO: 19456 - DNA, 16 bp, Artificial Sequence
  synthetic [barcode part1]
cacgtaacctacgaac

SEQ ID NO: 19457 - DNA, 16 bp, Artificial Sequence
  synthetic [barcode part1]
aacagtaacctgcaag

SEQ ID NO: 19458 - DNA, 16 bp, Artificial Sequence
  synthetic [barcode part1]
cagagtctcttgaggt

SEQ ID NO: 19459 - DNA, 16 bp, Artificial Sequence
  synthetic [barcode part1]
atattaggaccgcacc

SEQ ID NO: 19460 - DNA, 16 bp, Artificial Sequence
  synthetic [barcode part1]
cacgtggtaagttcac

SEQ ID NO: 19461 - DNA, 16 bp, Artificial Sequence
  synthetic [barcode part1]
cgtagtagtggtatcc

SEQ ID NO: 19462 - DNA, 16 bp, Artificial Sequence
  synthetic [barcode part1]
cggtagtaggaatact

SEQ ID NO: 19463 - DNA, 16 bp, Artificial Sequence
  synthetic [barcode part1]
gcctaattggttcgag

SEQ ID NO: 19464 - DNA, 16 bp, Artificial Sequence
  synthetic [barcode part1]
gttcacctgcctattc

SEQ ID NO: 19465 - DNA, 16 bp, Artificial Sequence
  synthetic [barcode part1]
gcgatcacttcaatct

SEQ ID NO: 19466 - DNA, 16 bp, Artificial Sequence
  synthetic [barcode part1]
acctgtcacaagtgac

SEQ ID NO: 19467 - DNA, 16 bp, Artificial Sequence
  synthetic [barcode part1]
ttgactgtgtggtacg

SEQ ID NO: 19468 - DNA, 16 bp, Artificial Sequence
  synthetic [barcode part1]
agtgttagaccgacct

SEQ ID NO: 19469 - DNA, 16 bp, Artificial Sequence
  synthetic [barcode part1]
aactgacacacgtgtc

SEQ ID NO: 19470 - DNA, 16 bp, Artificial Sequence
  synthetic [barcode part1]
gttgaggtgacgtgtg

SEQ ID NO: 19471 - DNA, 16 bp, Artificial Sequence
  synthetic [barcode part1]
taacagtgaggcgcgt

SEQ ID NO: 19472 - DNA, 16 bp, Artificial Sequence
  synthetic [barcode part1]
actcggacactgtcct

SEQ ID NO: 19473 - DNA, 16 bp, Artificial Sequence
  synthetic [barcode part1]
ccacctgttcacttgt

SEQ ID NO: 19474 - DNA, 16 bp, Artificial Sequence
  synthetic [barcode part1]
ccttcgtacggtctag

SEQ ID NO: 19475 - DNA, 16 bp, Artificial Sequence
  synthetic [barcode part1]
tatcgccacaactatc

SEQ ID NO: 19476 - DNA, 16 bp, Artificial Sequence
  synthetic [barcode part1]
ttgtctagtaggcgac

SEQ ID NO: 19477 - DNA, 16 bp, Artificial Sequence
  synthetic [barcode part1]
ccaaccttgaaggatc

SEQ ID NO: 19478 - DNA, 16 bp, Artificial Sequence
  synthetic [barcode part1]
gtggttaaggagattc

SEQ ID NO: 19479 - DNA, 16 bp, Artificial Sequence
  synthetic [barcode part1]
gtcgtagtacttacct

SEQ ID NO: 19480 - DNA, 16 bp, Artificial Sequence
  synthetic [barcode part1]
gaggcctaatattgcc

SEQ ID NO: 19481 - DNA, 16 bp, Artificial Sequence
  synthetic [barcode part1]
acggtgacgaacctag

SEQ ID NO: 19482 - DNA, 16 bp, Artificial Sequence
  synthetic [barcode part1]
gagaggccgttagtgt

SEQ ID NO: 19483 - DNA, 16 bp, Artificial Sequence
  synthetic [barcode part1]
gatacgcctctccagt

SEQ ID NO: 19484 - DNA, 16 bp, Artificial Sequence
  synthetic [barcode part1]
tgcctgttacctgttc

SEQ ID NO: 19485 - DNA, 16 bp, Artificial Sequence
  synthetic [barcode part1]
tccaacttaaccgtgt

SEQ ID NO: 19486 - DNA, 16 bp, Artificial Sequence
  synthetic [barcode part1]
agtacacgactaagac

SEQ ID NO: 19487 - DNA, 16 bp, Artificial Sequence
  synthetic [barcode part1]
acagatcggttacacc

SEQ ID NO: 19488 - DNA, 16 bp, Artificial Sequence
  synthetic [barcode part1]
gagattaacacggccg

SEQ ID NO: 19489 - DNA, 16 bp, Artificial Sequence
  synthetic [barcode part1]
taccgtctactagtac

SEQ ID NO: 19490 - DNA, 16 bp, Artificial Sequence
  synthetic [barcode part1]
gccactcctcaagtgt

SEQ ID NO: 19491 - DNA, 16 bp, Artificial Sequence
  synthetic [barcode part1]
accgagtggtataagt

SEQ ID NO: 19492 - DNA, 16 bp, Artificial Sequence
  synthetic [barcode part1]
tcggccttactggtgt

SEQ ID NO: 19493 - DNA, 16 bp, Artificial Sequence
  synthetic [barcode part1]
tcctagaggcaggtag

SEQ ID NO: 19494 - DNA, 16 bp, Artificial Sequence
  synthetic [barcode part1]
ccgtcgtactctactt

SEQ ID NO: 19495 - DNA, 16 bp, Artificial Sequence
  synthetic [barcode part1]
aagttcacaccgacgt

SEQ ID NO: 19496 - DNA, 16 bp, Artificial Sequence
  synthetic [barcode part1]
ttccaatcggttcctc

SEQ ID NO: 19497 - DNA, 16 bp, Artificial Sequence
  synthetic [barcode part1]
cctaattacgtgttgc

SEQ ID NO: 19498 - DNA, 16 bp, Artificial Sequence
  synthetic [barcode part1]
cgtaggcagtaagacc

SEQ ID NO: 19499 - DNA, 16 bp, Artificial Sequence
  synthetic [barcode part1]
tacgtggtgaaggatt

SEQ ID NO: 19500 - DNA, 16 bp, Artificial Sequence
  synthetic [barcode part1]
acttgtgtgtgaaccg

SEQ ID NO: 19501 - DNA, 16 bp, Artificial Sequence
  synthetic [barcode part1]
aactctcaccgaaggt

SEQ ID NO: 19502 - DNA, 16 bp, Artificial Sequence
  synthetic [barcode part1]
cgagactctaggactt

SEQ ID NO: 19503 - DNA, 16 bp, Artificial Sequence
  synthetic [barcode part1]
ttgttggaagagtgtg

SEQ ID NO: 19504 - DNA, 16 bp, Artificial Sequence
  synthetic [barcode part1]
tgtcactggactgagt

SEQ ID NO: 19505 - DNA, 16 bp, Artificial Sequence
  synthetic [barcode part1]
ttagagaccaggcacg

SEQ ID NO: 19506 - DNA, 16 bp, Artificial Sequence
  synthetic [barcode part1]
attaggcctgtcagac

SEQ ID NO: 19507 - DNA, 16 bp, Artificial Sequence
  synthetic [barcode part1]
tctctggtgattacac

SEQ ID NO: 19508 - DNA, 16 bp, Artificial Sequence
  synthetic [barcode part1]
ttcactgtacgccggt

SEQ ID NO: 19509 - DNA, 16 bp, Artificial Sequence
  synthetic [barcode part1]
tctctaggtcagtgtt

SEQ ID NO: 19510 - DNA, 16 bp, Artificial Sequence
  synthetic [barcode part1]
tcaccgtaatattcgc

SEQ ID NO: 19511 - DNA, 16 bp, Artificial Sequence
  synthetic [barcode part1]
acaactcgtctctgcg

SEQ ID NO: 19512 - DNA, 16 bp, Artificial Sequence
  synthetic [barcode part1]
ttacaattgcgacgcg

SEQ ID NO: 19513 - DNA, 16 bp, Artificial Sequence
  synthetic [barcode part1]
aaggtggtattcgaac

SEQ ID NO: 19514 - DNA, 16 bp, Artificial Sequence
  synthetic [barcode part1]
acgtgatcacgcaatc

SEQ ID NO: 19515 - DNA, 16 bp, Artificial Sequence
  synthetic [barcode part1]
gtgcaagattcggcag

SEQ ID NO: 19516 - DNA, 16 bp, Artificial Sequence
  synthetic [barcode part1]
cctagtccgattgtgc

SEQ ID NO: 19517 - DNA, 16 bp, Artificial Sequence
  synthetic [barcode part1]
gacgtagatcttcacg

SEQ ID NO: 19518 - DNA, 16 bp, Artificial Sequence
  synthetic [barcode part1]
ttccgtgtggcaatcc

SEQ ID NO: 19519 - DNA, 16 bp, Artificial Sequence
  synthetic [barcode part1]
tagttctgccgcgtac

SEQ ID NO: 19520 - DNA, 16 bp, Artificial Sequence
  synthetic [barcode part1]
ttcacttcagaacctg

SEQ ID NO: 19521 - DNA, 16 bp, Artificial Sequence
  synthetic [barcode part1]
ttactaccgttcagac

SEQ ID NO: 19522 - DNA, 16 bp, Artificial Sequence
  synthetic [barcode part1]
gttacctagtactcgt

SEQ ID NO: 19523 - DNA, 16 bp, Artificial Sequence
  synthetic [barcode part1]
cgatagtgtcggattc

SEQ ID NO: 19524 - DNA, 16 bp, Artificial Sequence
  synthetic [barcode part1]
gaggtgtgccgaattg

SEQ ID NO: 19525 - DNA, 16 bp, Artificial Sequence
  synthetic [barcode part1]
gtacagtccaattctc

SEQ ID NO: 19526 - DNA, 16 bp, Artificial Sequence
  synthetic [barcode part1]
aagttgtgcctggtgt

SEQ ID NO: 19527 - DNA, 16 bp, Artificial Sequence
  synthetic [barcode part1]
gtgtagtataccggtc

SEQ ID NO: 19528 - DNA, 16 bp, Artificial Sequence
  synthetic [barcode part1]
actgatctcagaaccg

SEQ ID NO: 19529 - DNA, 16 bp, Artificial Sequence
  synthetic [barcode part1]
tcggcacaactctctg

SEQ ID NO: 19530 - DNA, 16 bp, Artificial Sequence
  synthetic [barcode part1]
gcggagatcggtgatt

SEQ ID NO: 19531 - DNA, 16 bp, Artificial Sequence
  synthetic [barcode part1]
acgtatcgagtgtctg

SEQ ID NO: 19532 - DNA, 16 bp, Artificial Sequence
  synthetic [barcode part1]
gtgcaagtactctcag

SEQ ID NO: 19533 - DNA, 16 bp, Artificial Sequence
  synthetic [barcode part1]
gaataacaggacgacg

SEQ ID NO: 19534 - DNA, 16 bp, Artificial Sequence
  synthetic [barcode part1]
aggtctgcctataggt

SEQ ID NO: 19535 - DNA, 16 bp, Artificial Sequence
  synthetic [barcode part1]
tgatagataccgtccg

SEQ ID NO: 19536 - DNA, 16 bp, Artificial Sequence
  synthetic [barcode part1]
cggtatagactacacc

SEQ ID NO: 19537 - DNA, 16 bp, Artificial Sequence
  synthetic [barcode part1]
gagtctgacggttgtt

SEQ ID NO: 19538 - DNA, 16 bp, Artificial Sequence
  synthetic [barcode part1]
tcttgccaacgcctag

SEQ ID NO: 19539 - DNA, 16 bp, Artificial Sequence
  synthetic [barcode part1]
ttacgttggtgacttc

SEQ ID NO: 19540 - DNA, 16 bp, Artificial Sequence
  synthetic [barcode part1]
acctagacttgtcgcc

SEQ ID NO: 19541 - DNA, 16 bp, Artificial Sequence
  synthetic [barcode part1]
ccacggaagatacttc

SEQ ID NO: 19542 - DNA, 16 bp, Artificial Sequence
  synthetic [barcode part1]
gtgcagtgatcggagt

SEQ ID NO: 19543 - DNA, 16 bp, Artificial Sequence
  synthetic [barcode part1]
gagtccactgttatct

SEQ ID NO: 19544 - DNA, 16 bp, Artificial Sequence
  synthetic [barcode part1]
actacagacgagtggc

SEQ ID NO: 19545 - DNA, 16 bp, Artificial Sequence
  synthetic [barcode part1]
cgttactgcctagatt

SEQ ID NO: 19546 - DNA, 16 bp, Artificial Sequence
  synthetic [barcode part1]
gacaaggcaattcctc

SEQ ID NO: 19547 - DNA, 16 bp, Artificial Sequence
  synthetic [barcode part1]
tcttggtccggatatt

SEQ ID NO: 19548 - DNA, 16 bp, Artificial Sequence
  synthetic [barcode part1]
tagataggtggtatcg

SEQ ID NO: 19549 - DNA, 16 bp, Artificial Sequence
  synthetic [barcode part1]
gagtactcagaacaac

SEQ ID NO: 19550 - DNA, 16 bp, Artificial Sequence
  synthetic [barcode part1]
attgtgaggcgtcact

SEQ ID NO: 19551 - DNA, 16 bp, Artificial Sequence
  synthetic [barcode part1]
gcgatacgccacaatt

SEQ ID NO: 19552 - DNA, 16 bp, Artificial Sequence
  synthetic [barcode part1]
aactcaccggatactg

SEQ ID NO: 19553 - DNA, 16 bp, Artificial Sequence
  synthetic [barcode part1]
tgcacggagtagtgac

SEQ ID NO: 19554 - DNA, 16 bp, Artificial Sequence
  synthetic [barcode part1]
actccgtgaactagac

SEQ ID NO: 19555 - DNA, 16 bp, Artificial Sequence
  synthetic [barcode part1]
gataatcgcgtaaggt

SEQ ID NO: 19556 - DNA, 16 bp, Artificial Sequence
  synthetic [barcode part1]
ttcggaatcaactggc

SEQ ID NO: 19557 - DNA, 16 bp, Artificial Sequence
  synthetic [barcode part1]
tgcctaattccactag

SEQ ID NO: 19558 - DNA, 16 bp, Artificial Sequence
  synthetic [barcode part1]
atcacacctgagtgtg

SEQ ID NO: 19559 - DNA, 16 bp, Artificial Sequence
  synthetic [barcode part1]
tctcgattgtgttggt

SEQ ID NO: 19560 - DNA, 16 bp, Artificial Sequence
  synthetic [barcode part1]
tagttggtgcagtacc

SEQ ID NO: 19561 - DNA, 16 bp, Artificial Sequence
  synthetic [barcode part1]
aggactgtacggatcg

SEQ ID NO: 19562 - DNA, 16 bp, Artificial Sequence
  synthetic [barcode part1]
taatccgacgacctag

SEQ ID NO: 19563 - DNA, 16 bp, Artificial Sequence
  synthetic [barcode part1]
aacgtcgataccacgt

SEQ ID NO: 19564 - DNA, 16 bp, Artificial Sequence
  synthetic [barcode part1]
atacggtaatctctcc

SEQ ID NO: 19565 - DNA, 16 bp, Artificial Sequence
  synthetic [barcode part1]
aacacgtacgtcagtc

SEQ ID NO: 19566 - DNA, 16 bp, Artificial Sequence
  synthetic [barcode part1]
accggtctagttaacg

SEQ ID NO: 19567 - DNA, 16 bp, Artificial Sequence
  synthetic [barcode part1]
gatacactgtgatcgc

SEQ ID NO: 19568 - DNA, 16 bp, Artificial Sequence
  synthetic [barcode part1]
ttgtcacggtgaggtt

SEQ ID NO: 19569 - DNA, 16 bp, Artificial Sequence
  synthetic [barcode part1]
ttctcctaaggtctcc

SEQ ID NO: 19570 - DNA, 16 bp, Artificial Sequence
  synthetic [barcode part1]
acacggattcgacgag

SEQ ID NO: 19571 - DNA, 16 bp, Artificial Sequence
  synthetic [barcode part1]
cactaccacaaccgtc

SEQ ID NO: 19572 - DNA, 16 bp, Artificial Sequence
  synthetic [barcode part1]
cgtggtctaacttccg

SEQ ID NO: 19573 - DNA, 16 bp, Artificial Sequence
  synthetic [barcode part1]
caagaattcaccgaag

SEQ ID NO: 19574 - DNA, 16 bp, Artificial Sequence
  synthetic [barcode part1]
cgaggtcaatcttgac

SEQ ID NO: 19575 - DNA, 16 bp, Artificial Sequence
  synthetic [barcode part1]
aggattatataggccg

SEQ ID NO: 19576 - DNA, 16 bp, Artificial Sequence
  synthetic [barcode part1]
attgcgtcttctaacg

SEQ ID NO: 19577 - DNA, 16 bp, Artificial Sequence
  synthetic [barcode part1]
agtgttgtgtgtgtgc

SEQ ID NO: 19578 - DNA, 16 bp, Artificial Sequence
  synthetic [barcode part1]
cagatacctggtacac

SEQ ID NO: 19579 - DNA, 16 bp, Artificial Sequence
  synthetic [barcode part1]
cctgaatactcgagtg

SEQ ID NO: 19580 - DNA, 16 bp, Artificial Sequence
  synthetic [barcode part1]
aactagacactccgtg

SEQ ID NO: 19581 - DNA, 16 bp, Artificial Sequence
  synthetic [barcode part1]
tggcgtgcaattcctc

SEQ ID NO: 19582 - DNA, 16 bp, Artificial Sequence
  synthetic [barcode part1]
attggcgtggaggact

SEQ ID NO: 19583 - DNA, 16 bp, Artificial Sequence
  synthetic [barcode part1]
ttccgtcacgatagag

SEQ ID NO: 19584 - DNA, 16 bp, Artificial Sequence
  synthetic [barcode part1]
gattcagtcagtggtc

SEQ ID NO: 19585 - DNA, 16 bp, Artificial Sequence
  synthetic [barcode part1]
acttgtcggactccgt

SEQ ID NO: 19586 - DNA, 16 bp, Artificial Sequence
  synthetic [barcode part1]
gtgccttccgacaatc

SEQ ID NO: 19587 - DNA, 16 bp, Artificial Sequence
  synthetic [barcode part1]
atctcacgttcggatt

SEQ ID NO: 19588 - DNA, 16 bp, Artificial Sequence
  synthetic [barcode part1]
gtcaacagtggaatac

SEQ ID NO: 19589 - DNA, 16 bp, Artificial Sequence
  synthetic [barcode part1]
ccttacctagacgtcg

SEQ ID NO: 19590 - DNA, 16 bp, Artificial Sequence
  synthetic [barcode part1]
agtataggttcgacag

SEQ ID NO: 19591 - DNA, 16 bp, Artificial Sequence
  synthetic [barcode part1]
aattgcgtcaaccttc

SEQ ID NO: 19592 - DNA, 16 bp, Artificial Sequence
  synthetic [barcode part1]
tccgtgcgttactggt

SEQ ID NO: 19593 - DNA, 16 bp, Artificial Sequence
  synthetic [barcode part1]
tctaccgtgcgttgac

SEQ ID NO: 19594 - DNA, 16 bp, Artificial Sequence
  synthetic [barcode part1]
gcaccttcggttcaac

SEQ ID NO: 19595 - DNA, 16 bp, Artificial Sequence
  synthetic [barcode part1]
atagaacttacaggcg

SEQ ID NO: 19596 - DNA, 16 bp, Artificial Sequence
  synthetic [barcode part1]
cgtgaattcactccgc

SEQ ID NO: 19597 - DNA, 16 bp, Artificial Sequence
  synthetic [barcode part1]
tcgatcctaagaggtc

SEQ ID NO: 19598 - DNA, 16 bp, Artificial Sequence
  synthetic [barcode part1]
cagaggatcctaactc

SEQ ID NO: 19599 - DNA, 16 bp, Artificial Sequence
  synthetic [barcode part1]
gatccttaatccacgt

SEQ ID NO: 19600 - DNA, 16 bp, Artificial Sequence
  synthetic [barcode part1]
tattcgcgtccgttct

SEQ ID NO: 19601 - DNA, 16 bp, Artificial Sequence
  synthetic [barcode part1]
cgaaggacacgatcac

SEQ ID NO: 19602 - DNA, 16 bp, Artificial Sequence
  synthetic [barcode part1]
agtcgaggataacgag

SEQ ID NO: 19603 - DNA, 16 bp, Artificial Sequence
  synthetic [barcode part1]
tctctaatcggtcctc

SEQ ID NO: 19604 - DNA, 16 bp, Artificial Sequence
  synthetic [barcode part1]
gcgaagagtacaagac

SEQ ID NO: 19605 - DNA, 16 bp, Artificial Sequence
  synthetic [barcode part1]
ttcgtatctctcgtgc

SEQ ID NO: 19606 - DNA, 16 bp, Artificial Sequence
  synthetic [barcode part1]
tgaattaagtccggcc

SEQ ID NO: 19607 - DNA, 16 bp, Artificial Sequence
  synthetic [barcode part1]
tggaataccgtcactg

SEQ ID NO: 19608 - DNA, 16 bp, Artificial Sequence
  synthetic [barcode part1]
gcacttcaactaccgc

SEQ ID NO: 19609 - DNA, 16 bp, Artificial Sequence
  synthetic [barcode part1]
cagatcaccttgtatc

SEQ ID NO: 19610 - DNA, 16 bp, Artificial Sequence
  synthetic [barcode part1]
gtcactatctccgcag

SEQ ID NO: 19611 - DNA, 16 bp, Artificial Sequence
  synthetic [barcode part1]
caggatctgtgacgtt

SEQ ID NO: 19612 - DNA, 16 bp, Artificial Sequence
  synthetic [barcode part1]
gataattgaggtacgc

SEQ ID NO: 19613 - DNA, 16 bp, Artificial Sequence
  synthetic [barcode part1]
cgtcctgtccgttatt

SEQ ID NO: 19614 - DNA, 16 bp, Artificial Sequence
  synthetic [barcode part1]
agacggaggaccttac

SEQ ID NO: 19615 - DNA, 16 bp, Artificial Sequence
  synthetic [barcode part1]
tgtacagttaccactc

SEQ ID NO: 19616 - DNA, 16 bp, Artificial Sequence
  synthetic [barcode part1]
ttaataatccgcgcct

SEQ ID NO: 19617 - DNA, 16 bp, Artificial Sequence
  synthetic [barcode part1]
tgcaataccacctgtt

SEQ ID NO: 19618 - DNA, 16 bp, Artificial Sequence
  synthetic [barcode part1]
gagtgttattccactc

SEQ ID NO: 19619 - DNA, 16 bp, Artificial Sequence
  synthetic [barcode part1]
agttgtaaccgcgtgt

SEQ ID NO: 19620 - DNA, 16 bp, Artificial Sequence
  synthetic [barcode part1]
actgaggtacgcaacg

SEQ ID NO: 19621 - DNA, 16 bp, Artificial Sequence
  synthetic [barcode part1]
ccaagtagatagaacc

SEQ ID NO: 19622 - DNA, 16 bp, Artificial Sequence
  synthetic [barcode part1]
tccgtacctagtaatc

SEQ ID NO: 19623 - DNA, 16 bp, Artificial Sequence
  synthetic [barcode part1]
aagtgccgcctcactt

SEQ ID NO: 19624 - DNA, 16 bp, Artificial Sequence
  synthetic [barcode part1]
cctaattgtgtcagtc

SEQ ID NO: 19625 - DNA, 16 bp, Artificial Sequence
  synthetic [barcode part1]
ccggcctacagttatc

SEQ ID NO: 19626 - DNA, 16 bp, Artificial Sequence
  synthetic [barcode part1]
tgttacctcacgcggt

SEQ ID NO: 19627 - DNA, 16 bp, Artificial Sequence
  synthetic [barcode part1]
aagtaacctaacgcag

SEQ ID NO: 19628 - DNA, 16 bp, Artificial Sequence
  synthetic [barcode part1]
gtcacagacttgtctt

SEQ ID NO: 19629 - DNA, 16 bp, Artificial Sequence
  synthetic [barcode part1]
gagtgccagtgagatc

SEQ ID NO: 19630 - DNA, 16 bp, Artificial Sequence
  synthetic [barcode part1]
cacaagtgtaacagac

SEQ ID NO: 19631 - DNA, 16 bp, Artificial Sequence
  synthetic [barcode part1]
tgtcagtgtgttggtg

SEQ ID NO: 19632 - DNA, 16 bp, Artificial Sequence
  synthetic [barcode part1]
ttcaggagtgcgtatc

SEQ ID NO: 19633 - DNA, 16 bp, Artificial Sequence
  synthetic [barcode part1]
caccgttctgttactc

SEQ ID NO: 19634 - DNA, 16 bp, Artificial Sequence
  synthetic [barcode part1]
tagtcaggatcagtcc

SEQ ID NO: 19635 - DNA, 16 bp, Artificial Sequence
  synthetic [barcode part1]
atattccgtgccttcc

SEQ ID NO: 19636 - DNA, 16 bp, Artificial Sequence
  synthetic [barcode part1]
cacgccttggactact

SEQ ID NO: 19637 - DNA, 16 bp, Artificial Sequence
  synthetic [barcode part1]
tctggtcgattccttc

SEQ ID NO: 19638 - DNA, 16 bp, Artificial Sequence
  synthetic [barcode part1]
ttcgcaagtgaatccg

SEQ ID NO: 19639 - DNA, 16 bp, Artificial Sequence
  synthetic [barcode part1]
tataatccgactctcg

SEQ ID NO: 19640 - DNA, 16 bp, Artificial Sequence
  synthetic [barcode part1]
tagaaccgactgactc

SEQ ID NO: 19641 - DNA, 16 bp, Artificial Sequence
  synthetic [barcode part1]
tggacagtgttgtaag

SEQ ID NO: 19642 - DNA, 16 bp, Artificial Sequence
  synthetic [barcode part1]
tctggaatcaaggtcc

SEQ ID NO: 19643 - DNA, 16 bp, Artificial Sequence
  synthetic [barcode part1]
ttatcctgccacttcg

SEQ ID NO: 19644 - DNA, 16 bp, Artificial Sequence
  synthetic [barcode part1]
ttcggcctgacacact

SEQ ID NO: 19645 - DNA, 16 bp, Artificial Sequence
  synthetic [barcode part1]
gcacgacaaggagttc

SEQ ID NO: 19646 - DNA, 16 bp, Artificial Sequence
  synthetic [barcode part1]
gttgacgtaccttact

SEQ ID NO: 19647 - DNA, 16 bp, Artificial Sequence
  synthetic [barcode part1]
ttaggaacacgccgag

SEQ ID NO: 19648 - DNA, 16 bp, Artificial Sequence
  synthetic [barcode part1]
actgcggttacttatc

SEQ ID NO: 19649 - DNA, 16 bp, Artificial Sequence
  synthetic [barcode part1]
agaaggactcttcctg

SEQ ID NO: 19650 - DNA, 16 bp, Artificial Sequence
  synthetic [barcode part1]
agttgacctaggatcc

SEQ ID NO: 19651 - DNA, 16 bp, Artificial Sequence
  synthetic [barcode part1]
cgttctcgccaagttg

SEQ ID NO: 19652 - DNA, 16 bp, Artificial Sequence
  synthetic [barcode part1]
gtattgagagacgact

SEQ ID NO: 19653 - DNA, 16 bp, Artificial Sequence
  synthetic [barcode part1]
tgcctacagtaccacc

SEQ ID NO: 19654 - DNA, 16 bp, Artificial Sequence
  synthetic [barcode part1]
caactcactacgtccg

SEQ ID NO: 19655 - DNA, 16 bp, Artificial Sequence
  synthetic [barcode part1]
gagttcgcctataggt

SEQ ID NO: 19656 - DNA, 16 bp, Artificial Sequence
  synthetic [barcode part1]
acaggtcctctaccgt

SEQ ID NO: 19657 - DNA, 16 bp, Artificial Sequence
  synthetic [barcode part1]
gtgaggataacaatcc

SEQ ID NO: 19658 - DNA, 16 bp, Artificial Sequence
  synthetic [barcode part1]
ccttggtcgtagatcc

SEQ ID NO: 19659 - DNA, 16 bp, Artificial Sequence
  synthetic [barcode part1]
agttcttgatccacac

SEQ ID NO: 19660 - DNA, 16 bp, Artificial Sequence
  synthetic [barcode part1]
atctcttatcgcgtag

SEQ ID NO: 19661 - DNA, 16 bp, Artificial Sequence
  synthetic [barcode part1]
agttcttgtgtagtcc

SEQ ID NO: 19662 - DNA, 16 bp, Artificial Sequence
  synthetic [barcode part1]
agttacgatcggtgtc

SEQ ID NO: 19663 - DNA, 16 bp, Artificial Sequence
  synthetic [barcode part1]
tgtgaacagtgtccac

SEQ ID NO: 19664 - DNA, 16 bp, Artificial Sequence
  synthetic [barcode part1]
gagttctactggtcag

SEQ ID NO: 19665 - DNA, 16 bp, Artificial Sequence
  synthetic [barcode part1]
ccacaggttattactc

SEQ ID NO: 19666 - DNA, 16 bp, Artificial Sequence
  synthetic [barcode part1]
ttcgtagacagacctg

SEQ ID NO: 19667 - DNA, 16 bp, Artificial Sequence
  synthetic [barcode part1]
tcgtacagagattgag

SEQ ID NO: 19668 - DNA, 16 bp, Artificial Sequence
  synthetic [barcode part1]
taaggaagtgccgacc

SEQ ID NO: 19669 - DNA, 16 bp, Artificial Sequence
  synthetic [barcode part1]
gtacacaacgtcgtac

SEQ ID NO: 19670 - DNA, 16 bp, Artificial Sequence
  synthetic [barcode part1]
tagtggcagaggcgtt

SEQ ID NO: 19671 - DNA, 16 bp, Artificial Sequence
  synthetic [barcode part1]
gatccgccttgttacg

SEQ ID NO: 19672 - DNA, 16 bp, Artificial Sequence
  synthetic [barcode part1]
cggacgtacacaattc

SEQ ID NO: 19673 - DNA, 16 bp, Artificial Sequence
  synthetic [barcode part1]
gagttcagacagtggc

SEQ ID NO: 19674 - DNA, 16 bp, Artificial Sequence
  synthetic [barcode part1]
gtggtgaataatcacg

SEQ ID NO: 19675 - DNA, 16 bp, Artificial Sequence
  synthetic [barcode part1]
aaggacggtctggtac

SEQ ID NO: 19676 - DNA, 16 bp, Artificial Sequence
  synthetic [barcode part1]
cactctgcctactatc

SEQ ID NO: 19677 - DNA, 16 bp, Artificial Sequence
  synthetic [barcode part1]
tgtagaacacactccg

SEQ ID NO: 19678 - DNA, 16 bp, Artificial Sequence
  synthetic [barcode part1]
aactcacggcagagtg

SEQ ID NO: 19679 - DNA, 16 bp, Artificial Sequence
  synthetic [barcode part1]
agattagtgtacggtg

SEQ ID NO: 19680 - DNA, 16 bp, Artificial Sequence
  synthetic [barcode part1]
acagtactggtgtcac

SEQ ID NO: 19681 - DNA, 16 bp, Artificial Sequence
  synthetic [barcode part1]
aggacctagataggtt

SEQ ID NO: 19682 - DNA, 16 bp, Artificial Sequence
  synthetic [barcode part1]
ttgttaaggccaccag

SEQ ID NO: 19683 - DNA, 16 bp, Artificial Sequence
  synthetic [barcode part1]
agtgagacgcaggtct

SEQ ID NO: 19684 - DNA, 16 bp, Artificial Sequence
  synthetic [barcode part1]
gaattagtgcgactag

SEQ ID NO: 19685 - DNA, 16 bp, Artificial Sequence
  synthetic [barcode part1]
aattgattcggccgac

SEQ ID NO: 19686 - DNA, 16 bp, Artificial Sequence
  synthetic [barcode part1]
gcgtgaattcgacgag

SEQ ID NO: 19687 - DNA, 16 bp, Artificial Sequence
  synthetic [barcode part1]
aattggcaccgcaatc

SEQ ID NO: 19688 - DNA, 16 bp, Artificial Sequence
  synthetic [barcode part1]
ccttggtaaccgtgtc

SEQ ID NO: 19689 - DNA, 16 bp, Artificial Sequence
  synthetic [barcode part1]
aagtcctccttggaag

SEQ ID NO: 19690 - DNA, 16 bp, Artificial Sequence
  synthetic [barcode part1]
gtactacacggataag

SEQ ID NO: 19691 - DNA, 16 bp, Artificial Sequence
  synthetic [barcode part1]
gatcagttgcacgtac

SEQ ID NO: 19692 - DNA, 16 bp, Artificial Sequence
  synthetic [barcode part1]
ttctaattgcaccggt

SEQ ID NO: 19693 - DNA, 16 bp, Artificial Sequence
  synthetic [barcode part1]
ttgttgtaggtctacc

SEQ ID NO: 19694 - DNA, 16 bp, Artificial Sequence
  synthetic [barcode part1]
gtacggacacttctag

SEQ ID NO: 19695 - DNA, 16 bp, Artificial Sequence
  synthetic [barcode part1]
tagagtaaggccgaag

SEQ ID NO: 19696 - DNA, 16 bp, Artificial Sequence
  synthetic [barcode part1]
aacgtggtagattgtg

SEQ ID NO: 19697 - DNA, 16 bp, Artificial Sequence
  synthetic [barcode part1]
tacgtggaccttccgt

SEQ ID NO: 19698 - DNA, 16 bp, Artificial Sequence
  synthetic [barcode part1]
acacttcgagacgtgt

SEQ ID NO: 19699 - DNA, 16 bp, Artificial Sequence
  synthetic [barcode part1]
gcctatatcgagtacg

SEQ ID NO: 19700 - DNA, 16 bp, Artificial Sequence
  synthetic [barcode part1]
tcgtaacctaaggtcg

SEQ ID NO: 19701 - DNA, 16 bp, Artificial Sequence
  synthetic [barcode part1]
taatcctgtgcgccac

SEQ ID NO: 19702 - DNA, 16 bp, Artificial Sequence
  synthetic [barcode part1]
gcacagacctggtaag

SEQ ID NO: 19703 - DNA, 16 bp, Artificial Sequence
  synthetic [barcode part1]
taaggataggttgtcg

SEQ ID NO: 19704 - DNA, 16 bp, Artificial Sequence
  synthetic [barcode part1]
atagaacggattcacg

SEQ ID NO: 19705 - DNA, 16 bp, Artificial Sequence
  synthetic [barcode part1]
acgttcactgcaagtg

SEQ ID NO: 19706 - DNA, 16 bp, Artificial Sequence
  synthetic [barcode part1]
atatacacgtggtgcc

SEQ ID NO: 19707 - DNA, 16 bp, Artificial Sequence
  synthetic [barcode part1]
tgtcctacggaacagt

SEQ ID NO: 19708 - DNA, 16 bp, Artificial Sequence
  synthetic [barcode part1]
gccgtggtagaattct

SEQ ID NO: 19709 - DNA, 16 bp, Artificial Sequence
  synthetic [barcode part1]
cgcagtgattctgaac

SEQ ID NO: 19710 - DNA, 16 bp, Artificial Sequence
  synthetic [barcode part1]
accgtccaatatctgt

SEQ ID NO: 19711 - DNA, 16 bp, Artificial Sequence
  synthetic [barcode part1]
gttgcctgtccgtaac

SEQ ID NO: 19712 - DNA, 16 bp, Artificial Sequence
  synthetic [barcode part1]
caaggaagaccttcct

SEQ ID NO: 19713 - DNA, 16 bp, Artificial Sequence
  synthetic [barcode part1]
tcgagtggaacgacgt

SEQ ID NO: 19714 - DNA, 16 bp, Artificial Sequence
  synthetic [barcode part1]
taccggaggtgatctt

SEQ ID NO: 19715 - DNA, 16 bp, Artificial Sequence
  synthetic [barcode part1]
attggtgagatcagac

SEQ ID NO: 19716 - DNA, 16 bp, Artificial Sequence
  synthetic [barcode part1]
cagatatcacaggcct

SEQ ID NO: 19717 - DNA, 16 bp, Artificial Sequence
  synthetic [barcode part1]
ttgtcgcggataacac

SEQ ID NO: 19718 - DNA, 16 bp, Artificial Sequence
  synthetic [barcode part1]
gtctaacaggacgcag

SEQ ID NO: 19719 - DNA, 16 bp, Artificial Sequence
  synthetic [barcode part1]
acgcagtcgatacact

SEQ ID NO: 19720 - DNA, 16 bp, Artificial Sequence
  synthetic [barcode part1]
cctcgcaccgaattgt

SEQ ID NO: 19721 - DNA, 16 bp, Artificial Sequence
  synthetic [barcode part1]
gttatcttgccactcc

SEQ ID NO: 19722 - DNA, 16 bp, Artificial Sequence
  synthetic [barcode part1]
tactgaggcctctacc

SEQ ID NO: 19723 - DNA, 16 bp, Artificial Sequence
  synthetic [barcode part1]
ccgttgtattctgtcc

SEQ ID NO: 19724 - DNA, 16 bp, Artificial Sequence
  synthetic [barcode part1]
tcctacgcagtctgac

SEQ ID NO: 19725 - DNA, 16 bp, Artificial Sequence
  synthetic [barcode part1]
tactgaaggtgcaagt

SEQ ID NO: 19726 - DNA, 16 bp, Artificial Sequence
  synthetic [barcode part1]
tgttagaacctccact

SEQ ID NO: 19727 - DNA, 16 bp, Artificial Sequence
  synthetic [barcode part1]
ccgacgtgactagaag

SEQ ID NO: 19728 - DNA, 16 bp, Artificial Sequence
  synthetic [barcode part1]
ttgatccacctcctgt

SEQ ID NO: 19729 - DNA, 16 bp, Artificial Sequence
  synthetic [barcode part1]
gttccgtcgtcaacac

SEQ ID NO: 19730 - DNA, 16 bp, Artificial Sequence
  synthetic [barcode part1]
attcctaatccgacac

SEQ ID NO: 19731 - DNA, 16 bp, Artificial Sequence
  synthetic [barcode part1]
gttgatagtggaacgt

SEQ ID NO: 19732 - DNA, 16 bp, Artificial Sequence
  synthetic [barcode part1]
tggttggcgtaacgtt

SEQ ID NO: 19733 - DNA, 16 bp, Artificial Sequence
  synthetic [barcode part1]
caaggtcaccgattgt

SEQ ID NO: 19734 - DNA, 16 bp, Artificial Sequence
  synthetic [barcode part1]
ccgaagatcttcaacg

SEQ ID NO: 19735 - DNA, 16 bp, Artificial Sequence
  synthetic [barcode part1]
gaagtgagtagactct

SEQ ID NO: 19736 - DNA, 16 bp, Artificial Sequence
  synthetic [barcode part1]
acacgtacgataccac

SEQ ID NO: 19737 - DNA, 16 bp, Artificial Sequence
  synthetic [barcode part1]
tgtgtgttcgaagtcg

SEQ ID NO: 19738 - DNA, 16 bp, Artificial Sequence
  synthetic [barcode part1]
ttaggtaccaccttgt

SEQ ID NO: 19739 - DNA, 16 bp, Artificial Sequence
  synthetic [barcode part1]
tctcagaccactcgtg

SEQ ID NO: 19740 - DNA, 16 bp, Artificial Sequence
  synthetic [barcode part1]
atacgtgaaggaaggc

SEQ ID NO: 19741 - DNA, 16 bp, Artificial Sequence
  synthetic [barcode part1]
tctcggtgttactctc

SEQ ID NO: 19742 - DNA, 16 bp, Artificial Sequence
  synthetic [barcode part1]
actcttaccgtcaggc

SEQ ID NO: 19743 - DNA, 16 bp, Artificial Sequence
  synthetic [barcode part1]
tgcaagtagtagagtc

SEQ ID NO: 19744 - DNA, 16 bp, Artificial Sequence
  synthetic [barcode part1]
attgcggttactcact

SEQ ID NO: 19745 - DNA, 16 bp, Artificial Sequence
  synthetic [barcode part1]
cgtgttctaccgagtc

SEQ ID NO: 19746 - DNA, 16 bp, Artificial Sequence
  synthetic [barcode part1]
gtgccgaccttcaatc

SEQ ID NO: 19747 - DNA, 16 bp, Artificial Sequence
  synthetic [barcode part1]
acctgttggcgtcact

SEQ ID NO: 19748 - DNA, 16 bp, Artificial Sequence
  synthetic [barcode part1]
acgatcaatacaccgc

SEQ ID NO: 19749 - DNA, 16 bp, Artificial Sequence
  synthetic [barcode part1]
tcctgtgactgttggc

SEQ ID NO: 19750 - DNA, 16 bp, Artificial Sequence
  synthetic [barcode part1]
cgtaacacacttgttc

SEQ ID NO: 19751 - DNA, 16 bp, Artificial Sequence
  synthetic [barcode part1]
cggttagtcaaccagt

SEQ ID NO: 19752 - DNA, 16 bp, Artificial Sequence
  synthetic [barcode part1]
acttacgtacgtcgag

SEQ ID NO: 19753 - DNA, 16 bp, Artificial Sequence
  synthetic [barcode part1]
tccagtctggtgtacc

SEQ ID NO: 19754 - DNA, 16 bp, Artificial Sequence
  synthetic [barcode part1]
tattgaggagtcgcct

SEQ ID NO: 19755 - DNA, 16 bp, Artificial Sequence
  synthetic [barcode part1]
tgccgacgtatatcag

SEQ ID NO: 19756 - DNA, 16 bp, Artificial Sequence
  synthetic [barcode part1]
aagtctcagagtcctg

SEQ ID NO: 19757 - DNA, 16 bp, Artificial Sequence
  synthetic [barcode part1]
ccgacaccagttatag

SEQ ID NO: 19758 - DNA, 16 bp, Artificial Sequence
  synthetic [barcode part1]
aagtaggtgagacctt

SEQ ID NO: 19759 - DNA, 16 bp, Artificial Sequence
  synthetic [barcode part1]
gacaactggtcgttac

SEQ ID NO: 19760 - DNA, 16 bp, Artificial Sequence
  synthetic [barcode part1]
taacgcaccagatacc

SEQ ID NO: 19761 - DNA, 16 bp, Artificial Sequence
  synthetic [barcode part1]
ttcgcgttggcaatcc

SEQ ID NO: 19762 - DNA, 16 bp, Artificial Sequence
  synthetic [barcode part1]
acacctacactattcg

SEQ ID NO: 19763 - DNA, 16 bp, Artificial Sequence
  synthetic [barcode part1]
cacgacaccgtctgtt

SEQ ID NO: 19764 - DNA, 16 bp, Artificial Sequence
  synthetic [barcode part1]
gttagtgattcggacc

SEQ ID NO: 19765 - DNA, 16 bp, Artificial Sequence
  synthetic [barcode part1]
acttgttgccttagac

SEQ ID NO: 19766 - DNA, 16 bp, Artificial Sequence
  synthetic [barcode part1]
agtgatcttctgcgcc

SEQ ID NO: 19767 - DNA, 16 bp, Artificial Sequence
  synthetic [barcode part1]
gtgttcaattctaccg

SEQ ID NO: 19768 - DNA, 16 bp, Artificial Sequence
  synthetic [barcode part1]
aggcaggttcgagact

SEQ ID NO: 19769 - DNA, 16 bp, Artificial Sequence
  synthetic [barcode part1]
gcacgtatcttctcct

SEQ ID NO: 19770 - DNA, 16 bp, Artificial Sequence
  synthetic [barcode part1]
ccgattataatcggcg

SEQ ID NO: 19771 - DNA, 16 bp, Artificial Sequence
  synthetic [barcode part1]
atatcggatacctggc

SEQ ID NO: 19772 - DNA, 16 bp, Artificial Sequence
  synthetic [barcode part1]
tggatctggtaggacg

SEQ ID NO: 19773 - DNA, 16 bp, Artificial Sequence
  synthetic [barcode part1]
ccacctgaggttctgt

SEQ ID NO: 19774 - DNA, 16 bp, Artificial Sequence
  synthetic [barcode part1]
tcaccgtgaacctacc

SEQ ID NO: 19775 - DNA, 16 bp, Artificial Sequence
  synthetic [barcode part1]
cggtcttcacacaacc

SEQ ID NO: 19776 - DNA, 16 bp, Artificial Sequence
  synthetic [barcode part1]
tgatcgaagtcgatcc

SEQ ID NO: 19777 - DNA, 16 bp, Artificial Sequence
  synthetic [barcode part1]
agaagatccgcgcaac

SEQ ID NO: 19778 - DNA, 16 bp, Artificial Sequence
  synthetic [barcode part1]
cgcacttcgaattgcc

SEQ ID NO: 19779 - DNA, 16 bp, Artificial Sequence
  synthetic [barcode part1]
ttggataggcaggatt

SEQ ID NO: 19780 - DNA, 16 bp, Artificial Sequence
  synthetic [barcode part1]
cgtccagtgtagattg

SEQ ID NO: 19781 - DNA, 16 bp, Artificial Sequence
  synthetic [barcode part1]
aaggtcggtataactg

SEQ ID NO: 19782 - DNA, 16 bp, Artificial Sequence
  synthetic [barcode part1]
gacgtgaggtatagag

SEQ ID NO: 19783 - DNA, 16 bp, Artificial Sequence
  synthetic [barcode part1]
actctgcacagagtac

SEQ ID NO: 19784 - DNA, 16 bp, Artificial Sequence
  synthetic [barcode part1]
gtaatcggtaccaacc

SEQ ID NO: 19785 - DNA, 16 bp, Artificial Sequence
  synthetic [barcode part1]
taacgtggtgcaatcc

SEQ ID NO: 19786 - DNA, 16 bp, Artificial Sequence
  synthetic [barcode part1]
ttcagtccggcacact

SEQ ID NO: 19787 - DNA, 16 bp, Artificial Sequence
  synthetic [barcode part1]
taaccacctcgtgaag

SEQ ID NO: 19788 - DNA, 16 bp, Artificial Sequence
  synthetic [barcode part1]
cctgtctgacgttacg

SEQ ID NO: 19789 - DNA, 16 bp, Artificial Sequence
  synthetic [barcode part1]
gcagttatcaaggaac

SEQ ID NO: 19790 - DNA, 16 bp, Artificial Sequence
  synthetic [barcode part1]
gataaccgtgttcttc

SEQ ID NO: 19791 - DNA, 16 bp, Artificial Sequence
  synthetic [barcode part1]
taagtagagtgtcgtg

SEQ ID NO: 19792 - DNA, 16 bp, Artificial Sequence
  synthetic [barcode part1]
gccacgaataagtggc

SEQ ID NO: 19793 - DNA, 16 bp, Artificial Sequence
  synthetic [barcode part1]
gaatcggaatctctcg

SEQ ID NO: 19794 - DNA, 16 bp, Artificial Sequence
  synthetic [barcode part1]
tatatccgcgagaacc

SEQ ID NO: 19795 - DNA, 16 bp, Artificial Sequence
  synthetic [barcode part1]
ccaccttatacctaag

SEQ ID NO: 19796 - DNA, 16 bp, Artificial Sequence
  synthetic [barcode part1]
cgaatcaatactcctc

SEQ ID NO: 19797 - DNA, 16 bp, Artificial Sequence
  synthetic [barcode part1]
gttgccgtcttcacag

SEQ ID NO: 19798 - DNA, 16 bp, Artificial Sequence
  synthetic [barcode part1]
gtcggcgtctaatcct

SEQ ID NO: 19799 - DNA, 16 bp, Artificial Sequence
  synthetic [barcode part1]
tctagacacgatcacg

SEQ ID NO: 19800 - DNA, 16 bp, Artificial Sequence
  synthetic [barcode part1]
tccagtcaagaccaac

SEQ ID NO: 19801 - DNA, 16 bp, Artificial Sequence
  synthetic [barcode part1]
cgtgattcgcactaag

SEQ ID NO: 19802 - DNA, 16 bp, Artificial Sequence
  synthetic [barcode part1]
cgacgatacacctcct

SEQ ID NO: 19803 - DNA, 16 bp, Artificial Sequence
  synthetic [barcode part1]
tcgcaggacaagacac

SEQ ID NO: 19804 - DNA, 16 bp, Artificial Sequence
  synthetic [barcode part1]
acagagaagagtgcgt

SEQ ID NO: 19805 - DNA, 16 bp, Artificial Sequence
  synthetic [barcode part1]
tcgtgagaataacggt

SEQ ID NO: 19806 - DNA, 16 bp, Artificial Sequence
  synthetic [barcode part1]
ttacggtggaactctg

SEQ ID NO: 19807 - DNA, 16 bp, Artificial Sequence
  synthetic [barcode part1]
aagtacagtgcaggag

SEQ ID NO: 19808 - DNA, 16 bp, Artificial Sequence
  synthetic [barcode part1]
tcgaacggtagacctt

SEQ ID NO: 19809 - DNA, 16 bp, Artificial Sequence
  synthetic [barcode part1]
accgacagaaccaggt

SEQ ID NO: 19810 - DNA, 16 bp, Artificial Sequence
  synthetic [barcode part1]
gacttggtcgacagtt

SEQ ID NO: 19811 - DNA, 16 bp, Artificial Sequence
  synthetic [barcode part1]
cgttctaggcgaagtt

SEQ ID NO: 19812 - DNA, 16 bp, Artificial Sequence
  synthetic [barcode part1]
acctacactcttaacg

SEQ ID NO: 19813 - DNA, 16 bp, Artificial Sequence
  synthetic [barcode part1]
tcctgcaggcctaatc

SEQ ID NO: 19814 - DNA, 16 bp, Artificial Sequence
  synthetic [barcode part1]
acttgtcctacaacgt

SEQ ID NO: 19815 - DNA, 16 bp, Artificial Sequence
  synthetic [barcode part1]
taggatacttgtggag

SEQ ID NO: 19816 - DNA, 16 bp, Artificial Sequence
  synthetic [barcode part1]
acgagacaataggacg

SEQ ID NO: 19817 - DNA, 16 bp, Artificial Sequence
  synthetic [barcode part1]
tcgtattacaatccgc

SEQ ID NO: 19818 - DNA, 16 bp, Artificial Sequence
  synthetic [barcode part1]
actgtgattgtggtgc

SEQ ID NO: 19819 - DNA, 16 bp, Artificial Sequence
  synthetic [barcode part1]
caacacacgtagatcc

SEQ ID NO: 19820 - DNA, 16 bp, Artificial Sequence
  synthetic [barcode part1]
ttaataggcagaggtc

SEQ ID NO: 19821 - DNA, 16 bp, Artificial Sequence
  synthetic [barcode part1]
cggcactgtaatactg

SEQ ID NO: 19822 - DNA, 16 bp, Artificial Sequence
  synthetic [barcode part1]
ttgcaacgtcacagtg

SEQ ID NO: 19823 - DNA, 16 bp, Artificial Sequence
  synthetic [barcode part1]
gacttagaatccgacc

SEQ ID NO: 19824 - DNA, 16 bp, Artificial Sequence
  synthetic [barcode part1]
acctacttggaactct

SEQ ID NO: 19825 - DNA, 16 bp, Artificial Sequence
  synthetic [barcode part1]
caccagattacactct

SEQ ID NO: 19826 - DNA, 16 bp, Artificial Sequence
  synthetic [barcode part1]
aagtctccggtatcag

SEQ ID NO: 19827 - DNA, 16 bp, Artificial Sequence
  synthetic [barcode part1]
tgtgacaacagacggc

SEQ ID NO: 19828 - DNA, 16 bp, Artificial Sequence
  synthetic [barcode part1]
aacgattacgcgaagt

SEQ ID NO: 19829 - DNA, 16 bp, Artificial Sequence
  synthetic [barcode part1]
ccaacgagacacaggt

SEQ ID NO: 19830 - DNA, 16 bp, Artificial Sequence
  synthetic [barcode part1]
cgtgttctgtctctac

SEQ ID NO: 19831 - DNA, 16 bp, Artificial Sequence
  synthetic [barcode part1]
gacggtcgtatcttcc

SEQ ID NO: 19832 - DNA, 16 bp, Artificial Sequence
  synthetic [barcode part1]
tgcagacaacgaagtt

SEQ ID NO: 19833 - DNA, 16 bp, Artificial Sequence
  synthetic [barcode part1]
gatctcactgttcgcg

SEQ ID NO: 19834 - DNA, 16 bp, Artificial Sequence
  synthetic [barcode part1]
ttatcggaatccggtg

SEQ ID NO: 19835 - DNA, 16 bp, Artificial Sequence
  synthetic [barcode part1]
tcgcgtcttacacctt

SEQ ID NO: 19836 - DNA, 16 bp, Artificial Sequence
  synthetic [barcode part1]
tgatcgagtcaatcgc

SEQ ID NO: 19837 - DNA, 16 bp, Artificial Sequence
  synthetic [barcode part1]
aagaccgactaggaag

SEQ ID NO: 19838 - DNA, 16 bp, Artificial Sequence
  synthetic [barcode part1]
gtaggcagtaatatcg

SEQ ID NO: 19839 - DNA, 16 bp, Artificial Sequence
  synthetic [barcode part1]
caaccaattggccaac

SEQ ID NO: 19840 - DNA, 16 bp, Artificial Sequence
  synthetic [barcode part1]
tgtctaccgagtaggt

SEQ ID NO: 19841 - DNA, 16 bp, Artificial Sequence
  synthetic [barcode part1]
atcttattaccggcgt

SEQ ID NO: 19842 - DNA, 16 bp, Artificial Sequence
  synthetic [barcode part1]
tacttctcaactcgag

SEQ ID NO: 19843 - DNA, 16 bp, Artificial Sequence
  synthetic [barcode part1]
ccaatcttccgactct

SEQ ID NO: 19844 - DNA, 16 bp, Artificial Sequence
  synthetic [barcode part1]
tgagagatcggaaggt

SEQ ID NO: 19845 - DNA, 16 bp, Artificial Sequence
  synthetic [barcode part1]
ttgacgtacactggtg

SEQ ID NO: 19846 - DNA, 16 bp, Artificial Sequence
  synthetic [barcode part1]
gtcagactgagtcact

SEQ ID NO: 19847 - DNA, 16 bp, Artificial Sequence
  synthetic [barcode part1]
taggtgtcgataagac

SEQ ID NO: 19848 - DNA, 16 bp, Artificial Sequence
  synthetic [barcode part1]
tatcgtcggtatacct

SEQ ID NO: 19849 - DNA, 16 bp, Artificial Sequence
  synthetic [barcode part1]
ttcttgttgagtcacg

SEQ ID NO: 19850 - DNA, 16 bp, Artificial Sequence
  synthetic [barcode part1]
actacttcttaccgcc

SEQ ID NO: 19851 - DNA, 16 bp, Artificial Sequence
  synthetic [barcode part1]
actctataggtactcc

SEQ ID NO: 19852 - DNA, 16 bp, Artificial Sequence
  synthetic [barcode part1]
gtcagtagaatcagac

SEQ ID NO: 19853 - DNA, 16 bp, Artificial Sequence
  synthetic [barcode part1]
acacaaccacacagtc

SEQ ID NO: 19854 - DNA, 16 bp, Artificial Sequence
  synthetic [barcode part1]
agtcacacaactgtgc

SEQ ID NO: 19855 - DNA, 16 bp, Artificial Sequence
  synthetic [barcode part1]
tcaacaggcctctgtc

SEQ ID NO: 19856 - DNA, 16 bp, Artificial Sequence
  synthetic [barcode part1]
cggtacacaatctctt

SEQ ID NO: 19857 - DNA, 16 bp, Artificial Sequence
  synthetic [barcode part1]
aggaacagacggcctt

SEQ ID NO: 19858 - DNA, 16 bp, Artificial Sequence
  synthetic [barcode part1]
gtgtgcctatctcgtg

SEQ ID NO: 19859 - DNA, 16 bp, Artificial Sequence
  synthetic [barcode part1]
accttccactacgcag

SEQ ID NO: 19860 - DNA, 16 bp, Artificial Sequence
  synthetic [barcode part1]
gaatacaagttgccag

SEQ ID NO: 19861 - DNA, 16 bp, Artificial Sequence
  synthetic [barcode part1]
caatcttcgatcgtac

SEQ ID NO: 19862 - DNA, 16 bp, Artificial Sequence
  synthetic [barcode part1]
tataactaccgttccg

SEQ ID NO: 19863 - DNA, 16 bp, Artificial Sequence
  synthetic [barcode part1]
aagtctctcctccttg

SEQ ID NO: 19864 - DNA, 16 bp, Artificial Sequence
  synthetic [barcode part1]
tacacacctgagactg

SEQ ID NO: 19865 - DNA, 16 bp, Artificial Sequence
  synthetic [barcode part1]
gaatcggtctcaatcg

SEQ ID NO: 19866 - DNA, 16 bp, Artificial Sequence
  synthetic [barcode part1]
cgttcgcggtactact

SEQ ID NO: 19867 - DNA, 16 bp, Artificial Sequence
  synthetic [barcode part1]
atcacgttgcaggttg

SEQ ID NO: 19868 - DNA, 16 bp, Artificial Sequence
  synthetic [barcode part1]
accactaccttcgcag

SEQ ID NO: 19869 - DNA, 16 bp, Artificial Sequence
  synthetic [barcode part1]
cggtatatcagtacgc

SEQ ID NO: 19870 - DNA, 16 bp, Artificial Sequence
  synthetic [barcode part1]
agaataccggtaactg

SEQ ID NO: 19871 - DNA, 16 bp, Artificial Sequence
  synthetic [barcode part1]
aggcagatatccgttc

SEQ ID NO: 19872 - DNA, 16 bp, Artificial Sequence
  synthetic [barcode part1]
cggtatagtgtgactc

SEQ ID NO: 19873 - DNA, 16 bp, Artificial Sequence
  synthetic [barcode part1]
tggttgagaagaaggc

SEQ ID NO: 19874 - DNA, 16 bp, Artificial Sequence
  synthetic [barcode part1]
acgtccgttcactacg

SEQ ID NO: 19875 - DNA, 16 bp, Artificial Sequence
  synthetic [barcode part1]
tattcgtgttccgaac

SEQ ID NO: 19876 - DNA, 16 bp, Artificial Sequence
  synthetic [barcode part1]
acacgcagaagtcctt

SEQ ID NO: 19877 - DNA, 16 bp, Artificial Sequence
  synthetic [barcode part1]
acctgtaccttcggtg

SEQ ID NO: 19878 - DNA, 16 bp, Artificial Sequence
  synthetic [barcode part1]
acagataagtaccacg

SEQ ID NO: 19879 - DNA, 16 bp, Artificial Sequence
  synthetic [barcode part1]
tgaggtgaagtcgaag

SEQ ID NO: 19880 - DNA, 16 bp, Artificial Sequence
  synthetic [barcode part1]
gcaaccgtcctaactc

SEQ ID NO: 19881 - DNA, 16 bp, Artificial Sequence
  synthetic [barcode part1]
attattggcgttcctg

SEQ ID NO: 19882 - DNA, 16 bp, Artificial Sequence
  synthetic [barcode part1]
gagtcactgtcagact

SEQ ID NO: 19883 - DNA, 16 bp, Artificial Sequence
  synthetic [barcode part1]
gtcgtctgataagacc

SEQ ID NO: 19884 - DNA, 16 bp, Artificial Sequence
  synthetic [barcode part1]
tcaggaggatcgtacg

SEQ ID NO: 19885 - DNA, 16 bp, Artificial Sequence
  synthetic [barcode part1]
gtaagtcaccagaggc

SEQ ID NO: 19886 - DNA, 16 bp, Artificial Sequence
  synthetic [barcode part1]
gcacctccagtaacct

SEQ ID NO: 19887 - DNA, 16 bp, Artificial Sequence
  synthetic [barcode part1]
gtcctgtacaactatc

SEQ ID NO: 19888 - DNA, 16 bp, Artificial Sequence
  synthetic [barcode part1]
ttcgtgtaccactagt

SEQ ID NO: 19889 - DNA, 16 bp, Artificial Sequence
  synthetic [barcode part1]
ataccacacttcggag

SEQ ID NO: 19890 - DNA, 16 bp, Artificial Sequence
  synthetic [barcode part1]
tcttcgcaggttgtcg

SEQ ID NO: 19891 - DNA, 16 bp, Artificial Sequence
  synthetic [barcode part1]
acaccaatcttactgc

SEQ ID NO: 19892 - DNA, 16 bp, Artificial Sequence
  synthetic [barcode part1]
acggagtgtcctattg

SEQ ID NO: 19893 - DNA, 16 bp, Artificial Sequence
  synthetic [barcode part1]
ataggcgtgaggttcg

SEQ ID NO: 19894 - DNA, 16 bp, Artificial Sequence
  synthetic [barcode part1]
ccgagatcgcctatct

SEQ ID NO: 19895 - DNA, 16 bp, Artificial Sequence
  synthetic [barcode part1]
agaacgaggatctgtt

SEQ ID NO: 19896 - DNA, 16 bp, Artificial Sequence
  synthetic [barcode part1]
gtctcacttcgcgaac

SEQ ID NO: 19897 - DNA, 16 bp, Artificial Sequence
  synthetic [barcode part1]
cggaacagtctcttag

SEQ ID NO: 19898 - DNA, 16 bp, Artificial Sequence
  synthetic [barcode part1]
tctaacggtccgatag

SEQ ID NO: 19899 - DNA, 16 bp, Artificial Sequence
  synthetic [barcode part1]
aagtctgcggatctac

SEQ ID NO: 19900 - DNA, 16 bp, Artificial Sequence
  synthetic [barcode part1]
gcgtcttgttgaattc

SEQ ID NO: 19901 - DNA, 16 bp, Artificial Sequence
  synthetic [barcode part1]
aagagtacgccgaacc

SEQ ID NO: 19902 - DNA, 16 bp, Artificial Sequence
  synthetic [barcode part1]
acgtgttcaccaacag

SEQ ID NO: 19903 - DNA, 16 bp, Artificial Sequence
  synthetic [barcode part1]
cgaccaatcttgaggt

SEQ ID NO: 19904 - DNA, 16 bp, Artificial Sequence
  synthetic [barcode part1]
gatacgttggtcgtac

SEQ ID NO: 19905 - DNA, 16 bp, Artificial Sequence
  synthetic [barcode part1]
cgatcggaatcgattc

SEQ ID NO: 19906 - DNA, 16 bp, Artificial Sequence
  synthetic [barcode part1]
gacgtaggtccgatag

SEQ ID NO: 19907 - DNA, 16 bp, Artificial Sequence
  synthetic [barcode part1]
gtgcacgtgtaatacc

SEQ ID NO: 19908 - DNA, 16 bp, Artificial Sequence
  synthetic [barcode part1]
tcaacgtgatcctccg

SEQ ID NO: 19909 - DNA, 16 bp, Artificial Sequence
  synthetic [barcode part1]
aatagtgacttgcgag

SEQ ID NO: 19910 - DNA, 16 bp, Artificial Sequence
  synthetic [barcode part1]
gtgcaagatcttcgtg

SEQ ID NO: 19911 - DNA, 16 bp, Artificial Sequence
  synthetic [barcode part1]
ttcctggtctctcaac

SEQ ID NO: 19912 - DNA, 16 bp, Artificial Sequence
  synthetic [barcode part1]
aacgccaaggacttct

SEQ ID NO: 19913 - DNA, 16 bp, Artificial Sequence
  synthetic [barcode part1]
gaggttgccaagtgtg

SEQ ID NO: 19914 - DNA, 16 bp, Artificial Sequence
  synthetic [barcode part1]
ccggtggtgaattgtt

SEQ ID NO: 19915 - DNA, 16 bp, Artificial Sequence
  synthetic [barcode part1]
acaccagaatccgtgt

SEQ ID NO: 19916 - DNA, 16 bp, Artificial Sequence
  synthetic [barcode part1]
gatattggccagtcgt

SEQ ID NO: 19917 - DNA, 16 bp, Artificial Sequence
  synthetic [barcode part1]
ttgcgtatacgtgacg

SEQ ID NO: 19918 - DNA, 16 bp, Artificial Sequence
  synthetic [barcode part1]
caacagtatcgagtcc

SEQ ID NO: 19919 - DNA, 16 bp, Artificial Sequence
  synthetic [barcode part1]
cgtcgacgattctctg

SEQ ID NO: 19920 - DNA, 16 bp, Artificial Sequence
  synthetic [barcode part1]
atcactgactgaaccg

SEQ ID NO: 19921 - DNA, 16 bp, Artificial Sequence
  synthetic [barcode part1]
gcaacactggttgact

SEQ ID NO: 19922 - DNA, 16 bp, Artificial Sequence
  synthetic [barcode part1]
tctcagtcctccgatt

SEQ ID NO: 19923 - DNA, 16 bp, Artificial Sequence
  synthetic [barcode part1]
agtcctctgtgaattc

SEQ ID NO: 19924 - DNA, 16 bp, Artificial Sequence
  synthetic [barcode part1]
acgaacttagtcttcc

SEQ ID NO: 19925 - DNA, 16 bp, Artificial Sequence
  synthetic [barcode part1]
caagtaaggcaggtag

SEQ ID NO: 19926 - DNA, 16 bp, Artificial Sequence
  synthetic [barcode part1]
aatcaactgtgcgcgt

SEQ ID NO: 19927 - DNA, 16 bp, Artificial Sequence
  synthetic [barcode part1]
tgtacgtcaacaccag

SEQ ID NO: 19928 - DNA, 16 bp, Artificial Sequence
  synthetic [barcode part1]
aggtatacgattcgag

SEQ ID NO: 19929 - DNA, 16 bp, Artificial Sequence
  synthetic [barcode part1]
ttcggtaccacgttcg

SEQ ID NO: 19930 - DNA, 16 bp, Artificial Sequence
  synthetic [barcode part1]
acgttctctgacgatt

SEQ ID NO: 19931 - DNA, 16 bp, Artificial Sequence
  synthetic [barcode part1]
tctagtcgccgtgtgt

SEQ ID NO: 19932 - DNA, 16 bp, Artificial Sequence
  synthetic [barcode part1]
cctctaatagtcacgt

SEQ ID NO: 19933 - DNA, 16 bp, Artificial Sequence
  synthetic [barcode part1]
ttcgtgaacgagttcg

SEQ ID NO: 19934 - DNA, 16 bp, Artificial Sequence
  synthetic [barcode part1]
ccgagacacagtattc

SEQ ID NO: 19935 - DNA, 16 bp, Artificial Sequence
  synthetic [barcode part1]
tctcttagtccaggcg

SEQ ID NO: 19936 - DNA, 16 bp, Artificial Sequence
  synthetic [barcode part1]
cgtacgcaatctcaag

SEQ ID NO: 19937 - DNA, 16 bp, Artificial Sequence
  synthetic [barcode part1]
tacggcgttcaagatc

SEQ ID NO: 19938 - DNA, 16 bp, Artificial Sequence
  synthetic [barcode part1]
aagacttagtggacgt

SEQ ID NO: 19939 - DNA, 16 bp, Artificial Sequence
  synthetic [barcode part1]
ttgtcgaactggactg

SEQ ID NO: 19940 - DNA, 16 bp, Artificial Sequence
  synthetic [barcode part1]
gtctccgttacactct

SEQ ID NO: 19941 - DNA, 16 bp, Artificial Sequence
  synthetic [barcode part1]
atctgtcacggtatct

SEQ ID NO: 19942 - DNA, 16 bp, Artificial Sequence
  synthetic [barcode part1]
caactagacactgtgc

SEQ ID NO: 19943 - DNA, 16 bp, Artificial Sequence
  synthetic [barcode part1]
atcctccgtgtaccag

SEQ ID NO: 19944 - DNA, 16 bp, Artificial Sequence
  synthetic [barcode part1]
agacacgtgattcaag

SEQ ID NO: 19945 - DNA, 16 bp, Artificial Sequence
  synthetic [barcode part1]
aacaaggaggacgact

SEQ ID NO: 19946 - DNA, 16 bp, Artificial Sequence
  synthetic [barcode part1]
gtggtgtatatcgcgt

SEQ ID NO: 19947 - DNA, 16 bp, Artificial Sequence
  synthetic [barcode part1]
caatcactcgttgttg

SEQ ID NO: 19948 - DNA, 16 bp, Artificial Sequence
  synthetic [barcode part1]
actgtagtggagtctc

SEQ ID NO: 19949 - DNA, 16 bp, Artificial Sequence
  synthetic [barcode part1]
cgactctaccggtatc

SEQ ID NO: 19950 - DNA, 16 bp, Artificial Sequence
  synthetic [barcode part1]
ttcctcctcgagactt

SEQ ID NO: 19951 - DNA, 16 bp, Artificial Sequence
  synthetic [barcode part1]
tatccgagtgcaatcg

SEQ ID NO: 19952 - DNA, 16 bp, Artificial Sequence
  synthetic [barcode part1]
ttgcagtcgtacgtag

SEQ ID NO: 19953 - DNA, 16 bp, Artificial Sequence
  synthetic [barcode part1]
caggagtccgttgaag

SEQ ID NO: 19954 - DNA, 16 bp, Artificial Sequence
  synthetic [barcode part1]
ttgattcctcgcaggc

SEQ ID NO: 19955 - DNA, 16 bp, Artificial Sequence
  synthetic [barcode part1]
gtggccaatactagtc

SEQ ID NO: 19956 - DNA, 16 bp, Artificial Sequence
  synthetic [barcode part1]
cgagtataccgaaggc

SEQ ID NO: 19957 - DNA, 16 bp, Artificial Sequence
  synthetic [barcode part1]
gtactaacggtctctt

SEQ ID NO: 19958 - DNA, 16 bp, Artificial Sequence
  synthetic [barcode part1]
tatcaagacgaggact

SEQ ID NO: 19959 - DNA, 16 bp, Artificial Sequence
  synthetic [barcode part1]
tgatatactccaccac

SEQ ID NO: 19960 - DNA, 16 bp, Artificial Sequence
  synthetic [barcode part1]
aatccaggattcgacc

SEQ ID NO: 19961 - DNA, 16 bp, Artificial Sequence
  synthetic [barcode part1]
acgcgtagactctagt

SEQ ID NO: 19962 - DNA, 16 bp, Artificial Sequence
  synthetic [barcode part1]
tcctgaactcaagacg

SEQ ID NO: 19963 - DNA, 16 bp, Artificial Sequence
  synthetic [barcode part1]
gcgactagtcggtatt

SEQ ID NO: 19964 - DNA, 16 bp, Artificial Sequence
  synthetic [barcode part1]
tggtacaagagtagtc

SEQ ID NO: 19965 - DNA, 16 bp, Artificial Sequence
  synthetic [barcode part1]
tccttctattacggcc

SEQ ID NO: 19966 - DNA, 16 bp, Artificial Sequence
  synthetic [barcode part1]
tacgagtgagtggcac

SEQ ID NO: 19967 - DNA, 16 bp, Artificial Sequence
  synthetic [barcode part1]
caagaggatcgcacac

SEQ ID NO: 19968 - DNA, 16 bp, Artificial Sequence
  synthetic [barcode part1]
taccgccacggttgtt

SEQ ID NO: 19969 - DNA, 16 bp, Artificial Sequence
  synthetic [barcode part1]
atcctgcagtggtaac

SEQ ID NO: 19970 - DNA, 16 bp, Artificial Sequence
  synthetic [barcode part1]
acgcggtatcagtatc

SEQ ID NO: 19971 - DNA, 16 bp, Artificial Sequence
  synthetic [barcode part1]
gtagtcttgaaccacg

SEQ ID NO: 19972 - DNA, 16 bp, Artificial Sequence
  synthetic [barcode part1]
cacgtattacagtgcg

SEQ ID NO: 19973 - DNA, 16 bp, Artificial Sequence
  synthetic [barcode part1]
aggtggtgtactcgag

SEQ ID NO: 19974 - DNA, 16 bp, Artificial Sequence
  synthetic [barcode part1]
gattcagaacctgacc

SEQ ID NO: 19975 - DNA, 16 bp, Artificial Sequence
  synthetic [barcode part1]
tgttgagaggtacaac

SEQ ID NO: 19976 - DNA, 16 bp, Artificial Sequence
  synthetic [barcode part1]
tacttaccaaggtctc

SEQ ID NO: 19977 - DNA, 16 bp, Artificial Sequence
  synthetic [barcode part1]
gaactgtgacgatctc

SEQ ID NO: 19978 - DNA, 16 bp, Artificial Sequence
  synthetic [barcode part1]
cagttctactggtact

SEQ ID NO: 19979 - DNA, 16 bp, Artificial Sequence
  synthetic [barcode part1]
gcaaggaccagtgatc

SEQ ID NO: 19980 - DNA, 16 bp, Artificial Sequence
  synthetic [barcode part1]
atcttacctgcgtaac

SEQ ID NO: 19981 - DNA, 16 bp, Artificial Sequence
  synthetic [barcode part1]
gcgagtacggaattcg

SEQ ID NO: 19982 - DNA, 16 bp, Artificial Sequence
  synthetic [barcode part1]
taagaggccaacctct

SEQ ID NO: 19983 - DNA, 16 bp, Artificial Sequence
  synthetic [barcode part1]
atctgaattcgccgtt

SEQ ID NO: 19984 - DNA, 16 bp, Artificial Sequence
  synthetic [barcode part1]
atagaagtgcgtctcc

SEQ ID NO: 19985 - DNA, 16 bp, Artificial Sequence
  synthetic [barcode part1]
tagtgcacctcactgc

SEQ ID NO: 19986 - DNA, 16 bp, Artificial Sequence
  synthetic [barcode part1]
caggaagtctctcaac

SEQ ID NO: 19987 - DNA, 16 bp, Artificial Sequence
  synthetic [barcode part1]
attcctaggacacgac

SEQ ID NO: 19988 - DNA, 16 bp, Artificial Sequence
  synthetic [barcode part1]
gtggcgtatcaattgc

SEQ ID NO: 19989 - DNA, 16 bp, Artificial Sequence
  synthetic [barcode part1]
ttgagtgacgacaggc

SEQ ID NO: 19990 - DNA, 16 bp, Artificial Sequence
  synthetic [barcode part1]
aggacggatccacagt

SEQ ID NO: 19991 - DNA, 16 bp, Artificial Sequence
  synthetic [barcode part1]
aagttgactggtctcg

SEQ ID NO: 19992 - DNA, 16 bp, Artificial Sequence
  synthetic [barcode part1]
aggaagattctctccg

SEQ ID NO: 19993 - DNA, 16 bp, Artificial Sequence
  synthetic [barcode part1]
tatctgtgacgttgtc

SEQ ID NO: 19994 - DNA, 16 bp, Artificial Sequence
  synthetic [barcode part1]
tctctagatcgcgcgt

SEQ ID NO: 19995 - DNA, 16 bp, Artificial Sequence
  synthetic [barcode part1]
agacgaatccggaatt

SEQ ID NO: 19996 - DNA, 16 bp, Artificial Sequence
  synthetic [barcode part1]
gtagatccgattcttc

SEQ ID NO: 19997 - DNA, 16 bp, Artificial Sequence
  synthetic [barcode part1]
gccagtgataatcacc

SEQ ID NO: 19998 - DNA, 16 bp, Artificial Sequence
  synthetic [barcode part1]
tactcactctgcctgt

SEQ ID NO: 19999 - DNA, 16 bp, Artificial Sequence
  synthetic [barcode part1]
tctgccacacgaactc

SEQ ID NO: 20000 - DNA, 16 bp, Artificial Sequence
  synthetic [barcode part1]
gtatcgtgaatagacg

SEQ ID NO: 20001 - DNA, 16 bp, Artificial Sequence
  synthetic [barcode part1]
gactcagtgacgactt

SEQ ID NO: 20002 - DNA, 16 bp, Artificial Sequence
  synthetic [barcode part1]
aacaactcgtgttcct

SEQ ID NO: 20003 - DNA, 16 bp, Artificial Sequence
  synthetic [barcode part1]
gagacttagacttcgc

SEQ ID NO: 20004 - DNA, 16 bp, Artificial Sequence
  synthetic [barcode part1]
taggtcgaccgaactt

SEQ ID NO: 20005 - DNA, 16 bp, Artificial Sequence
  synthetic [barcode part1]
ccggcctggtatattc

SEQ ID NO: 20006 - DNA, 16 bp, Artificial Sequence
  synthetic [barcode part1]
taccactcttggtcct

SEQ ID NO: 20007 - DNA, 16 bp, Artificial Sequence
  synthetic [barcode part1]
taccaagttcacactc

SEQ ID NO: 20008 - DNA, 16 bp, Artificial Sequence
  synthetic [barcode part1]
gcgaattagtccgtac

SEQ ID NO: 20009 - DNA, 16 bp, Artificial Sequence
  synthetic [barcode part1]
ttagtccacgatcgtt

SEQ ID NO: 20010 - DNA, 16 bp, Artificial Sequence
  synthetic [barcode part1]
cggatattgtgagtcc

SEQ ID NO: 20011 - DNA, 16 bp, Artificial Sequence
  synthetic [barcode part1]
gagactcagatctcgt

SEQ ID NO: 20012 - DNA, 16 bp, Artificial Sequence
  synthetic [barcode part1]
caggatcacgttgtgt

SEQ ID NO: 20013 - DNA, 16 bp, Artificial Sequence
  synthetic [barcode part1]
tgtcggacttgcgtct

SEQ ID NO: 20014 - DNA, 16 bp, Artificial Sequence
  synthetic [barcode part1]
aacacgttaatcgcgc

SEQ ID NO: 20015 - DNA, 16 bp, Artificial Sequence
  synthetic [barcode part1]
agaaggttccgcgagt

SEQ ID NO: 20016 - DNA, 16 bp, Artificial Sequence
  synthetic [barcode part1]
gaccttcaatctgcgc

SEQ ID NO: 20017 - DNA, 16 bp, Artificial Sequence
  synthetic [barcode part1]
gtacctctggtgactc

SEQ ID NO: 20018 - DNA, 16 bp, Artificial Sequence
  synthetic [barcode part1]
tcgagtattgcggatc

SEQ ID NO: 20019 - DNA, 16 bp, Artificial Sequence
  synthetic [barcode part1]
tcgttcactcgtctgt

SEQ ID NO: 20020 - DNA, 16 bp, Artificial Sequence
  synthetic [barcode part1]
gaccagatatcctacg

SEQ ID NO: 20021 - DNA, 16 bp, Artificial Sequence
  synthetic [barcode part1]
tggcctgtactcctag

SEQ ID NO: 20022 - DNA, 16 bp, Artificial Sequence
  synthetic [barcode part1]
cgaggatcaagtcgtg

SEQ ID NO: 20023 - DNA, 16 bp, Artificial Sequence
  synthetic [barcode part1]
gttgaatacctggcgt

SEQ ID NO: 20024 - DNA, 16 bp, Artificial Sequence
  synthetic [barcode part1]
aggacgatcgcgaatc

SEQ ID NO: 20025 - DNA, 16 bp, Artificial Sequence
  synthetic [barcode part1]
taacaccgtagtgtcg

SEQ ID NO: 20026 - DNA, 16 bp, Artificial Sequence
  synthetic [barcode part1]
aggacagtgttcaggc

SEQ ID NO: 20027 - DNA, 16 bp, Artificial Sequence
  synthetic [barcode part1]
ccactggtccttgtag

SEQ ID NO: 20028 - DNA, 16 bp, Artificial Sequence
  synthetic [barcode part1]
caattctcgtaactgc

SEQ ID NO: 20029 - DNA, 16 bp, Artificial Sequence
  synthetic [barcode part1]
tcagtacgatcctccg

SEQ ID NO: 20030 - DNA, 16 bp, Artificial Sequence
  synthetic [barcode part1]
tgaagtctgtgacacc

SEQ ID NO: 20031 - DNA, 16 bp, Artificial Sequence
  synthetic [barcode part1]
ttgattccaccggcac

SEQ ID NO: 20032 - DNA, 16 bp, Artificial Sequence
  synthetic [barcode part1]
gcagattgcgtctaac

SEQ ID NO: 20033 - DNA, 16 bp, Artificial Sequence
  synthetic [barcode part1]
agaccacctcgatagt

SEQ ID NO: 20034 - DNA, 16 bp, Artificial Sequence
  synthetic [barcode part1]
cagttggcaacactgt

SEQ ID NO: 20035 - DNA, 16 bp, Artificial Sequence
  synthetic [barcode part1]
cgtatcttcgcacctt

SEQ ID NO: 20036 - DNA, 16 bp, Artificial Sequence
  synthetic [barcode part1]
taggcgagtggtatcg

SEQ ID NO: 20037 - DNA, 16 bp, Artificial Sequence
  synthetic [barcode part1]
atcagtacgttggcgt

SEQ ID NO: 20038 - DNA, 16 bp, Artificial Sequence
  synthetic [barcode part1]
gttctgatcagtcgag

SEQ ID NO: 20039 - DNA, 16 bp, Artificial Sequence
  synthetic [barcode part1]
atctctacctgacggc

SEQ ID NO: 20040 - DNA, 16 bp, Artificial Sequence
  synthetic [barcode part1]
tgcctattaggcgagt

SEQ ID NO: 20041 - DNA, 16 bp, Artificial Sequence
  synthetic [barcode part1]
tagttccaccgcgtgt

SEQ ID NO: 20042 - DNA, 16 bp, Artificial Sequence
  synthetic [barcode part1]
tgcacgattcaatcct

SEQ ID NO: 20043 - DNA, 16 bp, Artificial Sequence
  synthetic [barcode part1]
tgtggccgttgttctg

SEQ ID NO: 20044 - DNA, 16 bp, Artificial Sequence
  synthetic [barcode part1]
tctaatactcgcgttg

SEQ ID NO: 20045 - DNA, 16 bp, Artificial Sequence
  synthetic [barcode part1]
aagattgcgcaggtcg

SEQ ID NO: 20046 - DNA, 16 bp, Artificial Sequence
  synthetic [barcode part1]
gtaataccgtgcacgt

SEQ ID NO: 20047 - DNA, 16 bp, Artificial Sequence
  synthetic [barcode part1]
gcagtcgtctcctaac

SEQ ID NO: 20048 - DNA, 16 bp, Artificial Sequence
  synthetic [barcode part1]
tcgtacaaccgatacg

SEQ ID NO: 20049 - DNA, 16 bp, Artificial Sequence
  synthetic [barcode part1]
ttagacgaacagagtc

SEQ ID NO: 20050 - DNA, 16 bp, Artificial Sequence
  synthetic [barcode part1]
tcgcggactactgttc

SEQ ID NO: 20051 - DNA, 16 bp, Artificial Sequence
  synthetic [barcode part1]
taacgcagaaggccac

SEQ ID NO: 20052 - DNA, 16 bp, Artificial Sequence
  synthetic [barcode part1]
aaggtggtaagtactc

SEQ ID NO: 20053 - DNA, 16 bp, Artificial Sequence
  synthetic [barcode part1]
agaggacttcgacttc

SEQ ID NO: 20054 - DNA, 16 bp, Artificial Sequence
  synthetic [barcode part1]
gatattatacggcgcc

SEQ ID NO: 20055 - DNA, 16 bp, Artificial Sequence
  synthetic [barcode part1]
gcgcgacaactaaggt

SEQ ID NO: 20056 - DNA, 16 bp, Artificial Sequence
  synthetic [barcode part1]
atcaaccgatcaaccg

SEQ ID NO: 20057 - DNA, 16 bp, Artificial Sequence
  synthetic [barcode part1]
ttccaacgtacggcct

SEQ ID NO: 20058 - DNA, 16 bp, Artificial Sequence
  synthetic [barcode part1]
acgattcgacagtctg

SEQ ID NO: 20059 - DNA, 16 bp, Artificial Sequence
  synthetic [barcode part1]
tggtaacagttgccac

SEQ ID NO: 20060 - DNA, 16 bp, Artificial Sequence
  synthetic [barcode part1]
gcgaatcactagaagt

SEQ ID NO: 20061 - DNA, 16 bp, Artificial Sequence
  synthetic [barcode part1]
gcgttccaatccaatt

SEQ ID NO: 20062 - DNA, 16 bp, Artificial Sequence
  synthetic [barcode part1]
caccaccggatatcct

SEQ ID NO: 20063 - DNA, 16 bp, Artificial Sequence
  synthetic [barcode part1]
cgcgagttatcactcc

SEQ ID NO: 20064 - DNA, 16 bp, Artificial Sequence
  synthetic [barcode part1]
gactcgaagaagtgtt

SEQ ID NO: 20065 - DNA, 16 bp, Artificial Sequence
  synthetic [barcode part1]
agttacactggagagt

SEQ ID NO: 20066 - DNA, 16 bp, Artificial Sequence
  synthetic [barcode part1]
aattctcaatccgcac

SEQ ID NO: 20067 - DNA, 16 bp, Artificial Sequence
  synthetic [barcode part1]
cctaagtctaccaccg

SEQ ID NO: 20068 - DNA, 16 bp, Artificial Sequence
  synthetic [barcode part1]
ttacgcaccgaaggag

SEQ ID NO: 20069 - DNA, 16 bp, Artificial Sequence
  synthetic [barcode part1]
acaagtagacgttacg

SEQ ID NO: 20070 - DNA, 16 bp, Artificial Sequence
  synthetic [barcode part1]
tcagtactgtgtggtg

SEQ ID NO: 20071 - DNA, 16 bp, Artificial Sequence
  synthetic [barcode part1]
tcgtaggacaggacgt

SEQ ID NO: 20072 - DNA, 16 bp, Artificial Sequence
  synthetic [barcode part1]
actggattactcttgc

SEQ ID NO: 20073 - DNA, 16 bp, Artificial Sequence
  synthetic [barcode part1]
gtctgccttacctgtt

SEQ ID NO: 20074 - DNA, 16 bp, Artificial Sequence
  synthetic [barcode part1]
tgtacttaggtgtggc

SEQ ID NO: 20075 - DNA, 16 bp, Artificial Sequence
  synthetic [barcode part1]
tcctcaggtcacgtac

SEQ ID NO: 20076 - DNA, 16 bp, Artificial Sequence
  synthetic [barcode part1]
gtgtctagacaaggcg

SEQ ID NO: 20077 - DNA, 16 bp, Artificial Sequence
  synthetic [barcode part1]
atactcggaactcacg

SEQ ID NO: 20078 - DNA, 16 bp, Artificial Sequence
  synthetic [barcode part1]
tcgcgttgttcctatc

SEQ ID NO: 20079 - DNA, 16 bp, Artificial Sequence
  synthetic [barcode part1]
aatcgtgccttagttc

SEQ ID NO: 20080 - DNA, 16 bp, Artificial Sequence
  synthetic [barcode part1]
tactaagttcgcacct

SEQ ID NO: 20081 - DNA, 16 bp, Artificial Sequence
  synthetic [barcode part1]
gactggtgtactgtgt

SEQ ID NO: 20082 - DNA, 16 bp, Artificial Sequence
  synthetic [barcode part1]
tgaattactcctgcac

SEQ ID NO: 20083 - DNA, 16 bp, Artificial Sequence
  synthetic [barcode part1]
gtattcgcgttgcctg

SEQ ID NO: 20084 - DNA, 16 bp, Artificial Sequence
  synthetic [barcode part1]
atcctatccaccactc

SEQ ID NO: 20085 - DNA, 16 bp, Artificial Sequence
  synthetic [barcode part1]
cgaatcgacacctcct

SEQ ID NO: 20086 - DNA, 16 bp, Artificial Sequence
  synthetic [barcode part1]
cctaatcgaccgaagt

SEQ ID NO: 20087 - DNA, 16 bp, Artificial Sequence
  synthetic [barcode part1]
aactcttgacttgtgc

SEQ ID NO: 20088 - DNA, 16 bp, Artificial Sequence
  synthetic [barcode part1]
tatccgacacgaactg

SEQ ID NO: 20089 - DNA, 16 bp, Artificial Sequence
  synthetic [barcode part1]
ccgttgtggatctgtc

SEQ ID NO: 20090 - DNA, 16 bp, Artificial Sequence
  synthetic [barcode part1]
gcggaggaattattac

SEQ ID NO: 20091 - DNA, 16 bp, Artificial Sequence
  synthetic [barcode part1]
tattggcaaggccgag

SEQ ID NO: 20092 - DNA, 16 bp, Artificial Sequence
  synthetic [barcode part1]
aaccagtactggttgc

SEQ ID NO: 20093 - DNA, 16 bp, Artificial Sequence
  synthetic [barcode part1]
gccagacttactgaac

SEQ ID NO: 20094 - DNA, 16 bp, Artificial Sequence
  synthetic [barcode part1]
agatctcgacctcaag

SEQ ID NO: 20095 - DNA, 16 bp, Artificial Sequence
  synthetic [barcode part1]
acgacagttcaatccg

SEQ ID NO: 20096 - DNA, 16 bp, Artificial Sequence
  synthetic [barcode part1]
ttgataagtcctcgtc

SEQ ID NO: 20097 - DNA, 16 bp, Artificial Sequence
  synthetic [barcode part1]
gtgttagagttacgcc

SEQ ID NO: 20098 - DNA, 16 bp, Artificial Sequence
  synthetic [barcode part1]
tactatcgcctaggcc

SEQ ID NO: 20099 - DNA, 16 bp, Artificial Sequence
  synthetic [barcode part1]
ttagaccttcctacag

SEQ ID NO: 20100 - DNA, 16 bp, Artificial Sequence
  synthetic [barcode part1]
ccacaagttacgtggt

SEQ ID NO: 20101 - DNA, 16 bp, Artificial Sequence
  synthetic [barcode part1]
tgacgtgccaggtatt

SEQ ID NO: 20102 - DNA, 16 bp, Artificial Sequence
  synthetic [barcode part1]
gatatagacctggtag

SEQ ID NO: 20103 - DNA, 16 bp, Artificial Sequence
  synthetic [barcode part1]
cgatacgttctgccgt

SEQ ID NO: 20104 - DNA, 16 bp, Artificial Sequence
  synthetic [barcode part1]
atagacagtgacgttg

SEQ ID NO: 20105 - DNA, 16 bp, Artificial Sequence
  synthetic [barcode part1]
gtccgtctctacttgt

SEQ ID NO: 20106 - DNA, 16 bp, Artificial Sequence
  synthetic [barcode part1]
caggtactcttatcgt

SEQ ID NO: 20107 - DNA, 16 bp, Artificial Sequence
  synthetic [barcode part1]
agttacgtcagtcttc

SEQ ID NO: 20108 - DNA, 16 bp, Artificial Sequence
  synthetic [barcode part1]
atagaccgccaaggac

SEQ ID NO: 20109 - DNA, 16 bp, Artificial Sequence
  synthetic [barcode part1]
cacgaatctgtggatc

SEQ ID NO: 20110 - DNA, 16 bp, Artificial Sequence
  synthetic [barcode part1]
accgagacttcaactg

SEQ ID NO: 20111 - DNA, 16 bp, Artificial Sequence
  synthetic [barcode part1]
gcctctgtgaattact

SEQ ID NO: 20112 - DNA, 16 bp, Artificial Sequence
  synthetic [barcode part1]
ttgttcgttcgaggtt

SEQ ID NO: 20113 - DNA, 16 bp, Artificial Sequence
  synthetic [barcode part1]
tcggcaagtagttcgt

SEQ ID NO: 20114 - DNA, 16 bp, Artificial Sequence
  synthetic [barcode part1]
gcctcgagtactatag

SEQ ID NO: 20115 - DNA, 16 bp, Artificial Sequence
  synthetic [barcode part1]
tcctagacgcctgttg

SEQ ID NO: 20116 - DNA, 16 bp, Artificial Sequence
  synthetic [barcode part1]
aggtgtgcaacaaccg

SEQ ID NO: 20117 - DNA, 16 bp, Artificial Sequence
  synthetic [barcode part1]
aaccggaggtgtatcg

SEQ ID NO: 20118 - DNA, 16 bp, Artificial Sequence
  synthetic [barcode part1]
gtgactagagagattc

SEQ ID NO: 20119 - DNA, 16 bp, Artificial Sequence
  synthetic [barcode part1]
atctccagacggcctt

SEQ ID NO: 20120 - DNA, 16 bp, Artificial Sequence
  synthetic [barcode part1]
tatcggacgagttacc

SEQ ID NO: 20121 - DNA, 16 bp, Artificial Sequence
  synthetic [barcode part1]
gttacaggcaagtaac

SEQ ID NO: 20122 - DNA, 16 bp, Artificial Sequence
  synthetic [barcode part1]
gaagattcgactacag

SEQ ID NO: 20123 - DNA, 16 bp, Artificial Sequence
  synthetic [barcode part1]
agtcacacacagttgc

SEQ ID NO: 20124 - DNA, 16 bp, Artificial Sequence
  synthetic [barcode part1]
aacacactgacacacc

SEQ ID NO: 20125 - DNA, 16 bp, Artificial Sequence
  synthetic [barcode part1]
gttagtgcctgacctc

SEQ ID NO: 20126 - DNA, 16 bp, Artificial Sequence
  synthetic [barcode part1]
tagagatcggagacag

SEQ ID NO: 20127 - DNA, 16 bp, Artificial Sequence
  synthetic [barcode part1]
agagacgacctggtac

SEQ ID NO: 20128 - DNA, 16 bp, Artificial Sequence
  synthetic [barcode part1]
tgttgacgtgtaccag

SEQ ID NO: 20129 - DNA, 16 bp, Artificial Sequence
  synthetic [barcode part1]
ttgcctgagtgaacac

SEQ ID NO: 20130 - DNA, 16 bp, Artificial Sequence
  synthetic [barcode part1]
agaaggacacgatacg

SEQ ID NO: 20131 - DNA, 16 bp, Artificial Sequence
  synthetic [barcode part1]
tagacggaacagacag

SEQ ID NO: 20132 - DNA, 16 bp, Artificial Sequence
  synthetic [barcode part1]
cctgtcgtgtagacct

SEQ ID NO: 20133 - DNA, 16 bp, Artificial Sequence
  synthetic [barcode part1]
tcacagtgttgaccag

SEQ ID NO: 20134 - DNA, 16 bp, Artificial Sequence
  synthetic [barcode part1]
tgaacaatcgtccgtg

SEQ ID NO: 20135 - DNA, 16 bp, Artificial Sequence
  synthetic [barcode part1]
gtggcctgtagaagtg

SEQ ID NO: 20136 - DNA, 16 bp, Artificial Sequence
  synthetic [barcode part1]
tgtgtggacaaggcgt

SEQ ID NO: 20137 - DNA, 16 bp, Artificial Sequence
  synthetic [barcode part1]
gtcacctcactatctc

SEQ ID NO: 20138 - DNA, 16 bp, Artificial Sequence
  synthetic [barcode part1]
tcacactcggaagtgt

SEQ ID NO: 20139 - DNA, 16 bp, Artificial Sequence
  synthetic [barcode part1]
accgtcttctgttgtc

SEQ ID NO: 20140 - DNA, 16 bp, Artificial Sequence
  synthetic [barcode part1]
ttccgtagatcgttgt

SEQ ID NO: 20141 - DNA, 16 bp, Artificial Sequence
  synthetic [barcode part1]
aggagaaggagaagag

SEQ ID NO: 20142 - DNA, 16 bp, Artificial Sequence
  synthetic [barcode part1]
gttcactgtctcaagt

SEQ ID NO: 20143 - DNA, 16 bp, Artificial Sequence
  synthetic [barcode part1]
tagtgaagaattcgcg

SEQ ID NO: 20144 - DNA, 16 bp, Artificial Sequence
  synthetic [barcode part1]
aattcaggactgccgt

SEQ ID NO: 20145 - DNA, 16 bp, Artificial Sequence
  synthetic [barcode part1]
cctctagatcgatatc

SEQ ID NO: 20146 - DNA, 16 bp, Artificial Sequence
  synthetic [barcode part1]
gtactctcggttcggt

SEQ ID NO: 20147 - DNA, 16 bp, Artificial Sequence
  synthetic [barcode part1]
gtactcagtcttatcg

SEQ ID NO: 20148 - DNA, 16 bp, Artificial Sequence
  synthetic [barcode part1]
gaacgttccgccttac

SEQ ID NO: 20149 - DNA, 16 bp, Artificial Sequence
  synthetic [barcode part1]
cactcctgattatcag

SEQ ID NO: 20150 - DNA, 16 bp, Artificial Sequence
  synthetic [barcode part1]
acaataggttcagacg

SEQ ID NO: 20151 - DNA, 16 bp, Artificial Sequence
  synthetic [barcode part1]
aaccggcaagatcttc

SEQ ID NO: 20152 - DNA, 16 bp, Artificial Sequence
  synthetic [barcode part1]
tcgcaagtgttggtgt

SEQ ID NO: 20153 - DNA, 16 bp, Artificial Sequence
  synthetic [barcode part1]
gtaacaactgtcgtcg

SEQ ID NO: 20154 - DNA, 16 bp, Artificial Sequence
  synthetic [barcode part1]
gtcttccgtattggcg

SEQ ID NO: 20155 - DNA, 16 bp, Artificial Sequence
  synthetic [barcode part1]
agttctggtaagtgag

SEQ ID NO: 20156 - DNA, 16 bp, Artificial Sequence
  synthetic [barcode part1]
gtctcactaagaggtc

SEQ ID NO: 20157 - DNA, 16 bp, Artificial Sequence
  synthetic [barcode part1]
gatcactcactaggtg

SEQ ID NO: 20158 - DNA, 16 bp, Artificial Sequence
  synthetic [barcode part1]
tacctagtgcaccaag

SEQ ID NO: 20159 - DNA, 16 bp, Artificial Sequence
  synthetic [barcode part1]
ttgcaacttctctccg

SEQ ID NO: 20160 - DNA, 16 bp, Artificial Sequence
  synthetic [barcode part1]
acttagaactctgcct

SEQ ID NO: 20161 - DNA, 16 bp, Artificial Sequence
  synthetic [barcode part1]
tgcacaatctgattcc

SEQ ID NO: 20162 - DNA, 16 bp, Artificial Sequence
  synthetic [barcode part1]
aggcgtattggtgacg

SEQ ID NO: 20163 - DNA, 16 bp, Artificial Sequence
  synthetic [barcode part1]
gtcaggtggattgtct

SEQ ID NO: 20164 - DNA, 16 bp, Artificial Sequence
  synthetic [barcode part1]
tctatacgtgcggaac

SEQ ID NO: 20165 - DNA, 16 bp, Artificial Sequence
  synthetic [barcode part1]
gtactaatcctcgact

SEQ ID NO: 20166 - DNA, 16 bp, Artificial Sequence
  synthetic [barcode part1]
tacacttgaaccactc

SEQ ID NO: 20167 - DNA, 16 bp, Artificial Sequence
  synthetic [barcode part1]
tgttaatcggcgtacg

SEQ ID NO: 20168 - DNA, 16 bp, Artificial Sequence
  synthetic [barcode part1]
gtactctcgtgtcctt

SEQ ID NO: 20169 - DNA, 16 bp, Artificial Sequence
  synthetic [barcode part1]
agtacacaccagtgtc

SEQ ID NO: 20170 - DNA, 16 bp, Artificial Sequence
  synthetic [barcode part1]
aacactgcgcgtatac

SEQ ID NO: 20171 - DNA, 16 bp, Artificial Sequence
  synthetic [barcode part1]
ttgacttgcctggacc

SEQ ID NO: 20172 - DNA, 16 bp, Artificial Sequence
  synthetic [barcode part1]
agttagacctacagag

SEQ ID NO: 20173 - DNA, 16 bp, Artificial Sequence
  synthetic [barcode part1]
aaggaactgagttcgt

SEQ ID NO: 20174 - DNA, 16 bp, Artificial Sequence
  synthetic [barcode part1]
acagataactccgaag

SEQ ID NO: 20175 - DNA, 16 bp, Artificial Sequence
  synthetic [barcode part1]
cgaacgtaattcgcgt

SEQ ID NO: 20176 - DNA, 16 bp, Artificial Sequence
  synthetic [barcode part1]
tggcaattctccgcac

SEQ ID NO: 20177 - DNA, 16 bp, Artificial Sequence
  synthetic [barcode part1]
aaccgtgtgtagtcgt

SEQ ID NO: 20178 - DNA, 16 bp, Artificial Sequence
  synthetic [barcode part1]
tgtgtgtctaggactg

SEQ ID NO: 20179 - DNA, 16 bp, Artificial Sequence
  synthetic [barcode part1]
acaacactcgagatcc

SEQ ID NO: 20180 - DNA, 16 bp, Artificial Sequence
  synthetic [barcode part1]
tggattatcttcgcgt

SEQ ID NO: 20181 - DNA, 16 bp, Artificial Sequence
  synthetic [barcode part1]
cctctgagtactggtc

SEQ ID NO: 20182 - DNA, 16 bp, Artificial Sequence
  synthetic [barcode part1]
taccgagtgaaccact

SEQ ID NO: 20183 - DNA, 16 bp, Artificial Sequence
  synthetic [barcode part1]
atactccactgaacct

SEQ ID NO: 20184 - DNA, 16 bp, Artificial Sequence
  synthetic [barcode part1]
caaggtccaatcggtt

SEQ ID NO: 20185 - DNA, 16 bp, Artificial Sequence
  synthetic [barcode part1]
cactcgcggtatcact

SEQ ID NO: 20186 - DNA, 16 bp, Artificial Sequence
  synthetic [barcode part1]
gactacacacggttac

SEQ ID NO: 20187 - DNA, 16 bp, Artificial Sequence
  synthetic [barcode part1]
tatcacttcacgcaac

SEQ ID NO: 20188 - DNA, 16 bp, Artificial Sequence
  synthetic [barcode part1]
tcgtccggaactctgt

SEQ ID NO: 20189 - DNA, 16 bp, Artificial Sequence
  synthetic [barcode part1]
atcgtcctcgcagatc

SEQ ID NO: 20190 - DNA, 16 bp, Artificial Sequence
  synthetic [barcode part1]
caatctgtcgtacttg

SEQ ID NO: 20191 - DNA, 16 bp, Artificial Sequence
  synthetic [barcode part1]
tacacaggagtactcc

SEQ ID NO: 20192 - DNA, 16 bp, Artificial Sequence
  synthetic [barcode part1]
tcgcgttcaggaatac

SEQ ID NO: 20193 - DNA, 16 bp, Artificial Sequence
  synthetic [barcode part1]
gtggaaggttattgac

SEQ ID NO: 20194 - DNA, 16 bp, Artificial Sequence
  synthetic [barcode part1]
gaacctaggcaataac

SEQ ID NO: 20195 - DNA, 16 bp, Artificial Sequence
  synthetic [barcode part1]
acagtggtctgcagag

SEQ ID NO: 20196 - DNA, 16 bp, Artificial Sequence
  synthetic [barcode part1]
gtgttgtatctatccg

SEQ ID NO: 20197 - DNA, 16 bp, Artificial Sequence
  synthetic [barcode part1]
gttgatcgtactgcag

SEQ ID NO: 20198 - DNA, 16 bp, Artificial Sequence
  synthetic [barcode part1]
tcgtattccgccgaac

SEQ ID NO: 20199 - DNA, 16 bp, Artificial Sequence
  synthetic [barcode part1]
gttcgttgcagacagt

SEQ ID NO: 20200 - DNA, 16 bp, Artificial Sequence
  synthetic [barcode part1]
tgccttaggcgttcgt

SEQ ID NO: 20201 - DNA, 16 bp, Artificial Sequence
  synthetic [barcode part1]
gactaggataattgcg

SEQ ID NO: 20202 - DNA, 16 bp, Artificial Sequence
  synthetic [barcode part1]
ttccacgtagtaactc

SEQ ID NO: 20203 - DNA, 16 bp, Artificial Sequence
  synthetic [barcode part1]
cagtcttcacacgatt

SEQ ID NO: 20204 - DNA, 16 bp, Artificial Sequence
  synthetic [barcode part1]
tgtctgagaggcaacg

SEQ ID NO: 20205 - DNA, 16 bp, Artificial Sequence
  synthetic [barcode part1]
ttcaacctgtgcagtt

SEQ ID NO: 20206 - DNA, 16 bp, Artificial Sequence
  synthetic [barcode part1]
tcagtagattcctacc

SEQ ID NO: 20207 - DNA, 16 bp, Artificial Sequence
  synthetic [barcode part1]
accaaggattgtacag

SEQ ID NO: 20208 - DNA, 16 bp, Artificial Sequence
  synthetic [barcode part1]
tgattcttgcaaccac

SEQ ID NO: 20209 - DNA, 16 bp, Artificial Sequence
  synthetic [barcode part1]
caacactactccgaag

SEQ ID NO: 20210 - DNA, 16 bp, Artificial Sequence
  synthetic [barcode part1]
caagtctcaggataag

SEQ ID NO: 20211 - DNA, 16 bp, Artificial Sequence
  synthetic [barcode part1]
caacgtggtcgtctct

SEQ ID NO: 20212 - DNA, 16 bp, Artificial Sequence
  synthetic [barcode part1]
acaggaggatcactgc

SEQ ID NO: 20213 - DNA, 16 bp, Artificial Sequence
  synthetic [barcode part1]
taacgtcagacaggcg

SEQ ID NO: 20214 - DNA, 16 bp, Artificial Sequence
  synthetic [barcode part1]
ataggagtgacctagt

SEQ ID NO: 20215 - DNA, 16 bp, Artificial Sequence
  synthetic [barcode part1]
aggcgttgtggtgagt

SEQ ID NO: 20216 - DNA, 16 bp, Artificial Sequence
  synthetic [barcode part1]
ttgacagagacacaac

SEQ ID NO: 20217 - DNA, 16 bp, Artificial Sequence
  synthetic [barcode part1]
gacgtacaccagtact

SEQ ID NO: 20218 - DNA, 16 bp, Artificial Sequence
  synthetic [barcode part1]
tagtgtatctcaccgt

SEQ ID NO: 20219 - DNA, 16 bp, Artificial Sequence
  synthetic [barcode part1]
ccaagactggagtctt

SEQ ID NO: 20220 - DNA, 16 bp, Artificial Sequence
  synthetic [barcode part1]
aggtgaacctacctgt

SEQ ID NO: 20221 - DNA, 16 bp, Artificial Sequence
  synthetic [barcode part1]
tactatcaacggtggc

SEQ ID NO: 20222 - DNA, 16 bp, Artificial Sequence
  synthetic [barcode part1]
cacctgtagtatcgcc

SEQ ID NO: 20223 - DNA, 16 bp, Artificial Sequence
  synthetic [barcode part1]
ttatcgcacaggttct

SEQ ID NO: 20224 - DNA, 16 bp, Artificial Sequence
  synthetic [barcode part1]
cgtgcgtattgatcag

SEQ ID NO: 20225 - DNA, 16 bp, Artificial Sequence
  synthetic [barcode part1]
acactgtcttggaacg

SEQ ID NO: 20226 - DNA, 16 bp, Artificial Sequence
  synthetic [barcode part1]
tcgttaccacctaagt

SEQ ID NO: 20227 - DNA, 16 bp, Artificial Sequence
  synthetic [barcode part1]
attggtcaggacttcg

SEQ ID NO: 20228 - DNA, 16 bp, Artificial Sequence
  synthetic [barcode part1]
cgtgccactaattccg

SEQ ID NO: 20229 - DNA, 16 bp, Artificial Sequence
  synthetic [barcode part1]
agtcctcactgaagac

SEQ ID NO: 20230 - DNA, 16 bp, Artificial Sequence
  synthetic [barcode part1]
ttcactaagttcacgc

SEQ ID NO: 20231 - DNA, 16 bp, Artificial Sequence
  synthetic [barcode part1]
tatagttccaggcacg

SEQ ID NO: 20232 - DNA, 16 bp, Artificial Sequence
  synthetic [barcode part1]
tgaacctggtggaacg

SEQ ID NO: 20233 - DNA, 16 bp, Artificial Sequence
  synthetic [barcode part1]
ccacaggataggacac

SEQ ID NO: 20234 - DNA, 16 bp, Artificial Sequence
  synthetic [barcode part1]
atactggactaaggac

SEQ ID NO: 20235 - DNA, 16 bp, Artificial Sequence
  synthetic [barcode part1]
ttcggcctgcaactgt

SEQ ID NO: 20236 - DNA, 16 bp, Artificial Sequence
  synthetic [barcode part1]
gaggtgaccgtagatc

SEQ ID NO: 20237 - DNA, 16 bp, Artificial Sequence
  synthetic [barcode part1]
taaggaaggtctcctc

SEQ ID NO: 20238 - DNA, 16 bp, Artificial Sequence
  synthetic [barcode part1]
ccggataacctcacct

SEQ ID NO: 20239 - DNA, 16 bp, Artificial Sequence
  synthetic [barcode part1]
acggactgaggtggtt

SEQ ID NO: 20240 - DNA, 16 bp, Artificial Sequence
  synthetic [barcode part1]
acttcgaacgtacgtg

SEQ ID NO: 20241 - DNA, 16 bp, Artificial Sequence
  synthetic [barcode part1]
agatagactcactcgc

SEQ ID NO: 20242 - DNA, 16 bp, Artificial Sequence
  synthetic [barcode part1]
tgacagttggtccaac

SEQ ID NO: 20243 - DNA, 16 bp, Artificial Sequence
  synthetic [barcode part1]
gatctcctcgagtgtc

SEQ ID NO: 20244 - DNA, 16 bp, Artificial Sequence
  synthetic [barcode part1]
gcgacactgactaatc

SEQ ID NO: 20245 - DNA, 16 bp, Artificial Sequence
  synthetic [barcode part1]
agtgttacggtgtcgt

SEQ ID NO: 20246 - DNA, 16 bp, Artificial Sequence
  synthetic [barcode part1]
gtcagatctacgcctc

SEQ ID NO: 20247 - DNA, 16 bp, Artificial Sequence
  synthetic [barcode part1]
tgttcttgcgcaagag

SEQ ID NO: 20248 - DNA, 16 bp, Artificial Sequence
  synthetic [barcode part1]
cggattaggagatatc

SEQ ID NO: 20249 - DNA, 16 bp, Artificial Sequence
  synthetic [barcode part1]
tggtgccttacctacg

SEQ ID NO: 20250 - DNA, 16 bp, Artificial Sequence
  synthetic [barcode part1]
gttggacgtctccact

SEQ ID NO: 20251 - DNA, 16 bp, Artificial Sequence
  synthetic [barcode part1]
tcgtccactacctatc

SEQ ID NO: 20252 - DNA, 16 bp, Artificial Sequence
  synthetic [barcode part1]
gcgttaatcttcgatc

SEQ ID NO: 20253 - DNA, 16 bp, Artificial Sequence
  synthetic [barcode part1]
cgatctcagagtcaac

SEQ ID NO: 20254 - DNA, 16 bp, Artificial Sequence
  synthetic [barcode part1]
ttctggtggcctgtgt

SEQ ID NO: 20255 - DNA, 16 bp, Artificial Sequence
  synthetic [barcode part1]
gagattcctcggaatc

SEQ ID NO: 20256 - DNA, 16 bp, Artificial Sequence
  synthetic [barcode part1]
taactcgatcttcacg

SEQ ID NO: 20257 - DNA, 16 bp, Artificial Sequence
  synthetic [barcode part1]
gcgtcacaagtcttag

SEQ ID NO: 20258 - DNA, 16 bp, Artificial Sequence
  synthetic [barcode part1]
agtagaactcctgacc

SEQ ID NO: 20259 - DNA, 16 bp, Artificial Sequence
  synthetic [barcode part1]
cgcgtaactaccgtct

SEQ ID NO: 20260 - DNA, 16 bp, Artificial Sequence
  synthetic [barcode part1]
tggttctagaaccggt

SEQ ID NO: 20261 - DNA, 16 bp, Artificial Sequence
  synthetic [barcode part1]
tgtggagactgagtcg

SEQ ID NO: 20262 - DNA, 16 bp, Artificial Sequence
  synthetic [barcode part1]
tgttaagtcgtgcctt

SEQ ID NO: 20263 - DNA, 16 bp, Artificial Sequence
  synthetic [barcode part1]
gatccttgcacgacct

SEQ ID NO: 20264 - DNA, 16 bp, Artificial Sequence
  synthetic [barcode part1]
ccttacggactgtcac

SEQ ID NO: 20265 - DNA, 16 bp, Artificial Sequence
  synthetic [barcode part1]
gaggttgcacagactg

SEQ ID NO: 20266 - DNA, 16 bp, Artificial Sequence
  synthetic [barcode part1]
acagtgtaattccggc

SEQ ID NO: 20267 - DNA, 16 bp, Artificial Sequence
  synthetic [barcode part1]
gaatcctccagttgag

SEQ ID NO: 20268 - DNA, 16 bp, Artificial Sequence
  synthetic [barcode part1]
tccacaatccaccacg

SEQ ID NO: 20269 - DNA, 16 bp, Artificial Sequence
  synthetic [barcode part1]
tctagtgcagactgtg

SEQ ID NO: 20270 - DNA, 16 bp, Artificial Sequence
  synthetic [barcode part1]
aagtgccggattcact

SEQ ID NO: 20271 - DNA, 16 bp, Artificial Sequence
  synthetic [barcode part1]
agtggtcgtgcaaggt

SEQ ID NO: 20272 - DNA, 16 bp, Artificial Sequence
  synthetic [barcode part1]
ttgcactcgttgagtt

SEQ ID NO: 20273 - DNA, 16 bp, Artificial Sequence
  synthetic [barcode part1]
tcgatctaacggcagt

SEQ ID NO: 20274 - DNA, 16 bp, Artificial Sequence
  synthetic [barcode part1]
tagtcgtcgttggtag

SEQ ID NO: 20275 - DNA, 16 bp, Artificial Sequence
  synthetic [barcode part1]
taaggtcgcgttgtac

SEQ ID NO: 20276 - DNA, 16 bp, Artificial Sequence
  synthetic [barcode part1]
atcacgagtgagtaac

SEQ ID NO: 20277 - DNA, 16 bp, Artificial Sequence
  synthetic [barcode part1]
aatcgcgcacagttgt

SEQ ID NO: 20278 - DNA, 16 bp, Artificial Sequence
  synthetic [barcode part1]
agtatccggtggcaag

SEQ ID NO: 20279 - DNA, 16 bp, Artificial Sequence
  synthetic [barcode part1]
acaggtggcgatactg

SEQ ID NO: 20280 - DNA, 16 bp, Artificial Sequence
  synthetic [barcode part1]
tccgtgtgatccaacc

SEQ ID NO: 20281 - DNA, 16 bp, Artificial Sequence
  synthetic [barcode part1]
ccactcgtccgaagtt

SEQ ID NO: 20282 - DNA, 16 bp, Artificial Sequence
  synthetic [barcode part1]
caactgtcttggtccg

SEQ ID NO: 20283 - DNA, 16 bp, Artificial Sequence
  synthetic [barcode part1]
tctacttcaccacaag

SEQ ID NO: 20284 - DNA, 16 bp, Artificial Sequence
  synthetic [barcode part1]
tgcgcctataacttgt

SEQ ID NO: 20285 - DNA, 16 bp, Artificial Sequence
  synthetic [barcode part1]
acctaaccttccgcag

SEQ ID NO: 20286 - DNA, 16 bp, Artificial Sequence
  synthetic [barcode part1]
ttaatacagaggaccg

SEQ ID NO: 20287 - DNA, 16 bp, Artificial Sequence
  synthetic [barcode part1]
actcgcctctgagact

SEQ ID NO: 20288 - DNA, 16 bp, Artificial Sequence
  synthetic [barcode part1]
cagatctgtcctgtcg

SEQ ID NO: 20289 - DNA, 16 bp, Artificial Sequence
  synthetic [barcode part1]
tggtgacttcttacgt

SEQ ID NO: 20290 - DNA, 16 bp, Artificial Sequence
  synthetic [barcode part1]
aataactgcgtctctc

SEQ ID NO: 20291 - DNA, 16 bp, Artificial Sequence
  synthetic [barcode part1]
tcgattcagacgttct

SEQ ID NO: 20292 - DNA, 16 bp, Artificial Sequence
  synthetic [barcode part1]
agtcgtggagactggt

SEQ ID NO: 20293 - DNA, 16 bp, Artificial Sequence
  synthetic [barcode part1]
gttgatcacaccacag

SEQ ID NO: 20294 - DNA, 16 bp, Artificial Sequence
  synthetic [barcode part1]
tctaggaggtcagttc

SEQ ID NO: 20295 - DNA, 16 bp, Artificial Sequence
  synthetic [barcode part1]
cagagttatactgcgc

SEQ ID NO: 20296 - DNA, 16 bp, Artificial Sequence
  synthetic [barcode part1]
tgcgatacttgagacc

SEQ ID NO: 20297 - DNA, 16 bp, Artificial Sequence
  synthetic [barcode part1]
tgacctcacacaccac

SEQ ID NO: 20298 - DNA, 16 bp, Artificial Sequence
  synthetic [barcode part1]
cgtccgatctctaacg

SEQ ID NO: 20299 - DNA, 16 bp, Artificial Sequence
  synthetic [barcode part1]
cgtcttgagattcgcc

SEQ ID NO: 20300 - DNA, 16 bp, Artificial Sequence
  synthetic [barcode part1]
cgcggacacaataggt

SEQ ID NO: 20301 - DNA, 16 bp, Artificial Sequence
  synthetic [barcode part1]
cgcgagttctactgtc

SEQ ID NO: 20302 - DNA, 16 bp, Artificial Sequence
  synthetic [barcode part1]
cgttctctaacagttg

SEQ ID NO: 20303 - DNA, 16 bp, Artificial Sequence
  synthetic [barcode part1]
aacctactcacgaacg

SEQ ID NO: 20304 - DNA, 16 bp, Artificial Sequence
  synthetic [barcode part1]
cgcgccgttaatcttg

SEQ ID NO: 20305 - DNA, 16 bp, Artificial Sequence
  synthetic [barcode part1]
ttcgtcgattgaaggc

SEQ ID NO: 20306 - DNA, 16 bp, Artificial Sequence
  synthetic [barcode part1]
ccgatatcaacgtgtg

SEQ ID NO: 20307 - DNA, 16 bp, Artificial Sequence
  synthetic [barcode part1]
taattccgtcgtgcgc

SEQ ID NO: 20308 - DNA, 16 bp, Artificial Sequence
  synthetic [barcode part1]
taggttacggtccagt

SEQ ID NO: 20309 - DNA, 16 bp, Artificial Sequence
  synthetic [barcode part1]
cctgtattctccgtgt

SEQ ID NO: 20310 - DNA, 16 bp, Artificial Sequence
  synthetic [barcode part1]
aagttcctctctcctg

SEQ ID NO: 20311 - DNA, 16 bp, Artificial Sequence
  synthetic [barcode part1]
cgtagttcgactcctg

SEQ ID NO: 20312 - DNA, 16 bp, Artificial Sequence
  synthetic [barcode part1]
gagagactctatagac

SEQ ID NO: 20313 - DNA, 16 bp, Artificial Sequence
  synthetic [barcode part1]
tggagtcagaagaggt

SEQ ID NO: 20314 - DNA, 16 bp, Artificial Sequence
  synthetic [barcode part1]
tattccgagacctact

SEQ ID NO: 20315 - DNA, 16 bp, Artificial Sequence
  synthetic [barcode part1]
tggtgagttacctcag

SEQ ID NO: 20316 - DNA, 16 bp, Artificial Sequence
  synthetic [barcode part1]
tgaaggccgttaggtg

SEQ ID NO: 20317 - DNA, 16 bp, Artificial Sequence
  synthetic [barcode part1]
acctcgcgacaatagt

SEQ ID NO: 20318 - DNA, 16 bp, Artificial Sequence
  synthetic [barcode part1]
caagtacgtgtggttc

SEQ ID NO: 20319 - DNA, 16 bp, Artificial Sequence
  synthetic [barcode part1]
ttgtcaggaggacacg

SEQ ID NO: 20320 - DNA, 16 bp, Artificial Sequence
  synthetic [barcode part1]
tgaacactgtgagtcc

SEQ ID NO: 20321 - DNA, 16 bp, Artificial Sequence
  synthetic [barcode part1]
cacgagatagtaactg

SEQ ID NO: 20322 - DNA, 16 bp, Artificial Sequence
  synthetic [barcode part1]
gaactggcacgtagtg

SEQ ID NO: 20323 - DNA, 16 bp, Artificial Sequence
  synthetic [barcode part1]
tgccgacttagttccg

SEQ ID NO: 20324 - DNA, 16 bp, Artificial Sequence
  synthetic [barcode part1]
gcaatactgcgtgtac

SEQ ID NO: 20325 - DNA, 16 bp, Artificial Sequence
  synthetic [barcode part1]
cgttagaacggaggtc

SEQ ID NO: 20326 - DNA, 16 bp, Artificial Sequence
  synthetic [barcode part1]
tccactcagtactgcg

SEQ ID NO: 20327 - DNA, 16 bp, Artificial Sequence
  synthetic [barcode part1]
agtctctccagatact

SEQ ID NO: 20328 - DNA, 16 bp, Artificial Sequence
  synthetic [barcode part1]
acgttccggtccaatc

SEQ ID NO: 20329 - DNA, 16 bp, Artificial Sequence
  synthetic [barcode part1]
tctcaaccaacctcct

SEQ ID NO: 20330 - DNA, 16 bp, Artificial Sequence
  synthetic [barcode part1]
tgatcacggtgtactg

SEQ ID NO: 20331 - DNA, 16 bp, Artificial Sequence
  synthetic [barcode part1]
gtaatagacggtcgcg

SEQ ID NO: 20332 - DNA, 16 bp, Artificial Sequence
  synthetic [barcode part1]
caccgaactatactct

SEQ ID NO: 20333 - DNA, 16 bp, Artificial Sequence
  synthetic [barcode part1]
gtgcaccttactgtcg

SEQ ID NO: 20334 - DNA, 16 bp, Artificial Sequence
  synthetic [barcode part1]
ttgcgcgttggttctg

SEQ ID NO: 20335 - DNA, 16 bp, Artificial Sequence
  synthetic [barcode part1]
acctctgaacaattcc

SEQ ID NO: 20336 - DNA, 16 bp, Artificial Sequence
  synthetic [barcode part1]
cggtgattcctgcgtt

SEQ ID NO: 20337 - DNA, 16 bp, Artificial Sequence
  synthetic [barcode part1]
aggcgaaggtatcacc

SEQ ID NO: 20338 - DNA, 16 bp, Artificial Sequence
  synthetic [barcode part1]
aacgcaggttcgacag

SEQ ID NO: 20339 - DNA, 16 bp, Artificial Sequence
  synthetic [barcode part1]
atctggtcagtctgag

SEQ ID NO: 20340 - DNA, 16 bp, Artificial Sequence
  synthetic [barcode part1]
gatacaccacaatcgc

SEQ ID NO: 20341 - DNA, 16 bp, Artificial Sequence
  synthetic [barcode part1]
tcggacgacaacagac

SEQ ID NO: 20342 - DNA, 16 bp, Artificial Sequence
  synthetic [barcode part1]
aactcttctagtacgc

SEQ ID NO: 20343 - DNA, 16 bp, Artificial Sequence
  synthetic [barcode part1]
agttgcgtcggtctct

SEQ ID NO: 20344 - DNA, 16 bp, Artificial Sequence
  synthetic [barcode part1]
tatcgactcaatctcg

SEQ ID NO: 20345 - DNA, 16 bp, Artificial Sequence
  synthetic [barcode part1]
gcaactgattacgcgt

SEQ ID NO: 20346 - DNA, 16 bp, Artificial Sequence
  synthetic [barcode part1]
tatactcacctccgtc

SEQ ID NO: 20347 - DNA, 16 bp, Artificial Sequence
  synthetic [barcode part1]
acctgcggaagtaacg

SEQ ID NO: 20348 - DNA, 16 bp, Artificial Sequence
  synthetic [barcode part1]
gacgattgtgcaggac

SEQ ID NO: 20349 - DNA, 16 bp, Artificial Sequence
  synthetic [barcode part1]
agtactccggagaacg

SEQ ID NO: 20350 - DNA, 16 bp, Artificial Sequence
  synthetic [barcode part1]
gacgcaagagttaccg

SEQ ID NO: 20351 - DNA, 16 bp, Artificial Sequence
  synthetic [barcode part1]
accgtaacctacttac

SEQ ID NO: 20352 - DNA, 16 bp, Artificial Sequence
  synthetic [barcode part1]
gcaatcgcgtacagtt

SEQ ID NO: 20353 - DNA, 16 bp, Artificial Sequence
  synthetic [barcode part1]
cagagacttcacactg

SEQ ID NO: 20354 - DNA, 16 bp, Artificial Sequence
  synthetic [barcode part1]
gtgcgatcgtagttgt

SEQ ID NO: 20355 - DNA, 16 bp, Artificial Sequence
  synthetic [barcode part1]
agtctcacttggaacg

SEQ ID NO: 20356 - DNA, 16 bp, Artificial Sequence
  synthetic [barcode part1]
tgtgatctggtctccg

SEQ ID NO: 20357 - DNA, 16 bp, Artificial Sequence
  synthetic [barcode part1]
tacggattactacctc

SEQ ID NO: 20358 - DNA, 16 bp, Artificial Sequence
  synthetic [barcode part1]
gcgagtaactcacttg

SEQ ID NO: 20359 - DNA, 16 bp, Artificial Sequence
  synthetic [barcode part1]
tcagactaaccaccag

SEQ ID NO: 20360 - DNA, 16 bp, Artificial Sequence
  synthetic [barcode part1]
tcgcctacgagatctc

SEQ ID NO: 20361 - DNA, 16 bp, Artificial Sequence
  synthetic [barcode part1]
gttcttactgcacctc

SEQ ID NO: 20362 - DNA, 16 bp, Artificial Sequence
  synthetic [barcode part1]
gaaggaaccgagattg

SEQ ID NO: 20363 - DNA, 16 bp, Artificial Sequence
  synthetic [barcode part1]
accgtagttacgacgt

SEQ ID NO: 20364 - DNA, 16 bp, Artificial Sequence
  synthetic [barcode part1]
atagtgactcggttcg

SEQ ID NO: 20365 - DNA, 16 bp, Artificial Sequence
  synthetic [barcode part1]
tcggtggtgtcttcac

SEQ ID NO: 20366 - DNA, 16 bp, Artificial Sequence
  synthetic [barcode part1]
ttcgtcaccaacgcgt

SEQ ID NO: 20367 - DNA, 16 bp, Artificial Sequence
  synthetic [barcode part1]
tgccactgaattggac

SEQ ID NO: 20368 - DNA, 16 bp, Artificial Sequence
  synthetic [barcode part1]
gttaattccggccaag

SEQ ID NO: 20369 - DNA, 16 bp, Artificial Sequence
  synthetic [barcode part1]
cactacaataccgcag

SEQ ID NO: 20370 - DNA, 16 bp, Artificial Sequence
  synthetic [barcode part1]
tccgtgtgtacttctc

SEQ ID NO: 20371 - DNA, 16 bp, Artificial Sequence
  synthetic [barcode part1]
tctcgcaaccgaatcc

SEQ ID NO: 20372 - DNA, 16 bp, Artificial Sequence
  synthetic [barcode part1]
cctctctcgaccaatt

SEQ ID NO: 20373 - DNA, 16 bp, Artificial Sequence
  synthetic [barcode part1]
agtccaggcaccttct

SEQ ID NO: 20374 - DNA, 16 bp, Artificial Sequence
  synthetic [barcode part1]
aataggtgagtcctag

SEQ ID NO: 20375 - DNA, 16 bp, Artificial Sequence
  synthetic [barcode part1]
atctcgtaggcgcctt

SEQ ID NO: 20376 - DNA, 16 bp, Artificial Sequence
  synthetic [barcode part1]
agtaccgtctctcctt

SEQ ID NO: 20377 - DNA, 16 bp, Artificial Sequence
  synthetic [barcode part1]
ttcacacctgaactgt

SEQ ID NO: 20378 - DNA, 16 bp, Artificial Sequence
  synthetic [barcode part1]
gtctgttgcggtacct

SEQ ID NO: 20379 - DNA, 16 bp, Artificial Sequence
  synthetic [barcode part1]
tctaatcgcacgttac

SEQ ID NO: 20380 - DNA, 16 bp, Artificial Sequence
  synthetic [barcode part1]
tggagagaatcaggac

SEQ ID NO: 20381 - DNA, 16 bp, Artificial Sequence
  synthetic [barcode part1]
tctccttgaagtcctc

SEQ ID NO: 20382 - DNA, 16 bp, Artificial Sequence
  synthetic [barcode part1]
cgacaatctctcacgc

SEQ ID NO: 20383 - DNA, 16 bp, Artificial Sequence
  synthetic [barcode part1]
aacgcgcagtcttctc

SEQ ID NO: 20384 - DNA, 16 bp, Artificial Sequence
  synthetic [barcode part1]
taggttgcagtgactc

SEQ ID NO: 20385 - DNA, 16 bp, Artificial Sequence
  synthetic [barcode part1]
ttacggttctcctctg

SEQ ID NO: 20386 - DNA, 16 bp, Artificial Sequence
  synthetic [barcode part1]
tgactaagtgccacgt

SEQ ID NO: 20387 - DNA, 16 bp, Artificial Sequence
  synthetic [barcode part1]
tgtgtaggagtactcc

SEQ ID NO: 20388 - DNA, 16 bp, Artificial Sequence
  synthetic [barcode part1]
ttggacaaggtctgtc

SEQ ID NO: 20389 - DNA, 16 bp, Artificial Sequence
  synthetic [barcode part1]
tctccgaattggcgtc

SEQ ID NO: 20390 - DNA, 16 bp, Artificial Sequence
  synthetic [barcode part1]
aacggtcaccgaatct

SEQ ID NO: 20391 - DNA, 16 bp, Artificial Sequence
  synthetic [barcode part1]
tgatattgcagtgccg

SEQ ID NO: 20392 - DNA, 16 bp, Artificial Sequence
  synthetic [barcode part1]
gttccacgtccagatc

SEQ ID NO: 20393 - DNA, 16 bp, Artificial Sequence
  synthetic [barcode part1]
actcacctgagacctc

SEQ ID NO: 20394 - DNA, 16 bp, Artificial Sequence
  synthetic [barcode part1]
gcctgccgtgatattc

SEQ ID NO: 20395 - DNA, 16 bp, Artificial Sequence
  synthetic [barcode part1]
cacagataagttcgcc

SEQ ID NO: 20396 - DNA, 16 bp, Artificial Sequence
  synthetic [barcode part1]
gcaaggtagacctgtg

SEQ ID NO: 20397 - DNA, 16 bp, Artificial Sequence
  synthetic [barcode part1]
tgacgagtgtccgaag

SEQ ID NO: 20398 - DNA, 16 bp, Artificial Sequence
  synthetic [barcode part1]
gagttgttaggaacac

SEQ ID NO: 20399 - DNA, 16 bp, Artificial Sequence
  synthetic [barcode part1]
tgaccgaccagttagt

SEQ ID NO: 20400 - DNA, 16 bp, Artificial Sequence
  synthetic [barcode part1]
tcgacaagttcttgtc

SEQ ID NO: 20401 - DNA, 16 bp, Artificial Sequence
  synthetic [barcode part1]
aacagttgtgcgaagt

SEQ ID NO: 20402 - DNA, 16 bp, Artificial Sequence
  synthetic [barcode part1]
tcacgtccttacactc

SEQ ID NO: 20403 - DNA, 16 bp, Artificial Sequence
  synthetic [barcode part1]
aactctgacctacttg

SEQ ID NO: 20404 - DNA, 16 bp, Artificial Sequence
  synthetic [barcode part1]
ataactagtcgacgcc

SEQ ID NO: 20405 - DNA, 16 bp, Artificial Sequence
  synthetic [barcode part1]
cactcgtggacttcac

SEQ ID NO: 20406 - DNA, 16 bp, Artificial Sequence
  synthetic [barcode part1]
cggtggtattagatcc

SEQ ID NO: 20407 - DNA, 16 bp, Artificial Sequence
  synthetic [barcode part1]
cctctaaggaatcggt

SEQ ID NO: 20408 - DNA, 16 bp, Artificial Sequence
  synthetic [barcode part1]
cctaagaactgtggtc

SEQ ID NO: 20409 - DNA, 16 bp, Artificial Sequence
  synthetic [barcode part1]
tgtatccttcggtagt

SEQ ID NO: 20410 - DNA, 16 bp, Artificial Sequence
  synthetic [barcode part1]
ttctgactggtggagt

SEQ ID NO: 20411 - DNA, 16 bp, Artificial Sequence
  synthetic [barcode part1]
agattacctgccgagt

SEQ ID NO: 20412 - DNA, 16 bp, Artificial Sequence
  synthetic [barcode part1]
tgaattactccacacc

SEQ ID NO: 20413 - DNA, 16 bp, Artificial Sequence
  synthetic [barcode part1]
caccgaacctgtacct

SEQ ID NO: 20414 - DNA, 16 bp, Artificial Sequence
  synthetic [barcode part1]
acggattagagatcac

SEQ ID NO: 20415 - DNA, 16 bp, Artificial Sequence
  synthetic [barcode part1]
cgacgacttgaactac

SEQ ID NO: 20416 - DNA, 16 bp, Artificial Sequence
  synthetic [barcode part1]
actcacactccaccag

SEQ ID NO: 20417 - DNA, 16 bp, Artificial Sequence
  synthetic [barcode part1]
actctcggtgaagatc

SEQ ID NO: 20418 - DNA, 16 bp, Artificial Sequence
  synthetic [barcode part1]
ttctcctggaaggaac

SEQ ID NO: 20419 - DNA, 16 bp, Artificial Sequence
  synthetic [barcode part1]
tctatcagtcgtctcc

SEQ ID NO: 20420 - DNA, 16 bp, Artificial Sequence
  synthetic [barcode part1]
aagtgcggacctaacg

SEQ ID NO: 20421 - DNA, 16 bp, Artificial Sequence
  synthetic [barcode part1]
gtacacacaaccgatc

SEQ ID NO: 20422 - DNA, 16 bp, Artificial Sequence
  synthetic [barcode part1]
agagagatcaaggtcg

SEQ ID NO: 20423 - DNA, 16 bp, Artificial Sequence
  synthetic [barcode part1]
tccttggatatcgatc

SEQ ID NO: 20424 - DNA, 16 bp, Artificial Sequence
  synthetic [barcode part1]
tacagtgtccgcctac

SEQ ID NO: 20425 - DNA, 16 bp, Artificial Sequence
  synthetic [barcode part1]
gtaccgaattgttcct

SEQ ID NO: 20426 - DNA, 16 bp, Artificial Sequence
  synthetic [barcode part1]
acttgttcgtcgcgac

SEQ ID NO: 20427 - DNA, 16 bp, Artificial Sequence
  synthetic [barcode part1]
tgacactgatatcgcg

SEQ ID NO: 20428 - DNA, 16 bp, Artificial Sequence
  synthetic [barcode part1]
gcggccagtattaact

SEQ ID NO: 20429 - DNA, 16 bp, Artificial Sequence
  synthetic [barcode part1]
atccgaacgtcgtctc

SEQ ID NO: 20430 - DNA, 16 bp, Artificial Sequence
  synthetic [barcode part1]
acactctgtgcctctt

SEQ ID NO: 20431 - DNA, 16 bp, Artificial Sequence
  synthetic [barcode part1]
tcctcctggtcttagt

SEQ ID NO: 20432 - DNA, 16 bp, Artificial Sequence
  synthetic [barcode part1]
gcgaaccaattacgtc

SEQ ID NO: 20433 - DNA, 16 bp, Artificial Sequence
  synthetic [barcode part1]
attgaatccgcgcctc

SEQ ID NO: 20434 - DNA, 16 bp, Artificial Sequence
  synthetic [barcode part1]
aggaccaattacctcg

SEQ ID NO: 20435 - DNA, 16 bp, Artificial Sequence
  synthetic [barcode part1]
gatacctcttgcgaag

SEQ ID NO: 20436 - DNA, 16 bp, Artificial Sequence
  synthetic [barcode part1]
acgttcagagtgatag

SEQ ID NO: 20437 - DNA, 16 bp, Artificial Sequence
  synthetic [barcode part1]
cgttccttcaagttag

SEQ ID NO: 20438 - DNA, 16 bp, Artificial Sequence
  synthetic [barcode part1]
taccagtaccaacgtg

SEQ ID NO: 20439 - DNA, 16 bp, Artificial Sequence
  synthetic [barcode part1]
tacagtctaatcctcg

SEQ ID NO: 20440 - DNA, 16 bp, Artificial Sequence
  synthetic [barcode part1]
cctacaacggaacgag

SEQ ID NO: 20441 - DNA, 16 bp, Artificial Sequence
  synthetic [barcode part1]
gttgtacgaggcaacg

SEQ ID NO: 20442 - DNA, 16 bp, Artificial Sequence
  synthetic [barcode part1]
ccggaattaaggcctt

SEQ ID NO: 20443 - DNA, 16 bp, Artificial Sequence
  synthetic [barcode part1]
agacggtgattgtgcg

SEQ ID NO: 20444 - DNA, 16 bp, Artificial Sequence
  synthetic [barcode part1]
ttgtaggttcacggac

SEQ ID NO: 20445 - DNA, 16 bp, Artificial Sequence
  synthetic [barcode part1]
tgtagtggagtaagtc

SEQ ID NO: 20446 - DNA, 16 bp, Artificial Sequence
  synthetic [barcode part1]
gaagttagattgtgcg

SEQ ID NO: 20447 - DNA, 16 bp, Artificial Sequence
  synthetic [barcode part1]
aacgcgtccgatctct

SEQ ID NO: 20448 - DNA, 16 bp, Artificial Sequence
  synthetic [barcode part1]
acggagtataagttcg

SEQ ID NO: 20449 - DNA, 16 bp, Artificial Sequence
  synthetic [barcode part1]
gttccgtgtgagatac

SEQ ID NO: 20450 - DNA, 16 bp, Artificial Sequence
  synthetic [barcode part1]
cactctaacgacgagt

SEQ ID NO: 20451 - DNA, 16 bp, Artificial Sequence
  synthetic [barcode part1]
ccgtaagtccacaagt

SEQ ID NO: 20452 - DNA, 16 bp, Artificial Sequence
  synthetic [barcode part1]
atcagacggattgtcc

SEQ ID NO: 20453 - DNA, 16 bp, Artificial Sequence
  synthetic [barcode part1]
gccttgtgaactgaac

SEQ ID NO: 20454 - DNA, 16 bp, Artificial Sequence
  synthetic [barcode part1]
actgagtcaagaacac

SEQ ID NO: 20455 - DNA, 16 bp, Artificial Sequence
  synthetic [barcode part1]
acgtgttcagatccag

SEQ ID NO: 20456 - DNA, 16 bp, Artificial Sequence
  synthetic [barcode part1]
tagttcggtggtctag

SEQ ID NO: 20457 - DNA, 16 bp, Artificial Sequence
  synthetic [barcode part1]
ccgacgtgaggttaag

SEQ ID NO: 20458 - DNA, 16 bp, Artificial Sequence
  synthetic [barcode part1]
gtgtaactgcgcaatc

SEQ ID NO: 20459 - DNA, 16 bp, Artificial Sequence
  synthetic [barcode part1]
gtaactcgaatacgag

SEQ ID NO: 20460 - DNA, 16 bp, Artificial Sequence
  synthetic [barcode part1]
agtaacaacggtggag

SEQ ID NO: 20461 - DNA, 16 bp, Artificial Sequence
  synthetic [barcode part1]
atcctacgtctggatt

SEQ ID NO: 20462 - DNA, 16 bp, Artificial Sequence
  synthetic [barcode part1]
taagtgccttcgccac

SEQ ID NO: 20463 - DNA, 16 bp, Artificial Sequence
  synthetic [barcode part1]
gccaggttgaggatac

SEQ ID NO: 20464 - DNA, 16 bp, Artificial Sequence
  synthetic [barcode part1]
tatccgattccgccag

SEQ ID NO: 20465 - DNA, 16 bp, Artificial Sequence
  synthetic [barcode part1]
cgacttccgtgtagtc

SEQ ID NO: 20466 - DNA, 16 bp, Artificial Sequence
  synthetic [barcode part1]
cgttccactcagacac

SEQ ID NO: 20467 - DNA, 16 bp, Artificial Sequence
  synthetic [barcode part1]
gaagttcaggcagacc

SEQ ID NO: 20468 - DNA, 16 bp, Artificial Sequence
  synthetic [barcode part1]
gcaccgagttaaggac

SEQ ID NO: 20469 - DNA, 16 bp, Artificial Sequence
  synthetic [barcode part1]
ttaggaacttccgacg

SEQ ID NO: 20470 - DNA, 16 bp, Artificial Sequence
  synthetic [barcode part1]
cgactaagattctggc

SEQ ID NO: 20471 - DNA, 16 bp, Artificial Sequence
  synthetic [barcode part1]
gcaagacaacgcctag

SEQ ID NO: 20472 - DNA, 16 bp, Artificial Sequence
  synthetic [barcode part1]
taactctgcgttggcc

SEQ ID NO: 20473 - DNA, 16 bp, Artificial Sequence
  synthetic [barcode part1]
atctaggtaggcactc

SEQ ID NO: 20474 - DNA, 16 bp, Artificial Sequence
  synthetic [barcode part1]
tcacgtcgcaattcgc

SEQ ID NO: 20475 - DNA, 16 bp, Artificial Sequence
  synthetic [barcode part1]
aatctccaccaggagt

SEQ ID NO: 20476 - DNA, 16 bp, Artificial Sequence
  synthetic [barcode part1]
ccgtgaatctggcctt

SEQ ID NO: 20477 - DNA, 16 bp, Artificial Sequence
  synthetic [barcode part1]
gcgcaacctgatcttc

SEQ ID NO: 20478 - DNA, 16 bp, Artificial Sequence
  synthetic [barcode part1]
cggttataagtgcctg

SEQ ID NO: 20479 - DNA, 16 bp, Artificial Sequence
  synthetic [barcode part1]
caatcgaggagagaac

SEQ ID NO: 20480 - DNA, 16 bp, Artificial Sequence
  synthetic [barcode part1]
gaggactcctcaattg

SEQ ID NO: 20481 - DNA, 16 bp, Artificial Sequence
  synthetic [barcode part1]
gtcgttatacactctg

SEQ ID NO: 20482 - DNA, 16 bp, Artificial Sequence
  synthetic [barcode part1]
tgagaggcacacagtc

SEQ ID NO: 20483 - DNA, 16 bp, Artificial Sequence
  synthetic [barcode part1]
gcgtaagaagttgccg

SEQ ID NO: 20484 - DNA, 16 bp, Artificial Sequence
  synthetic [barcode part1]
accgcggttactcgtt

SEQ ID NO: 20485 - DNA, 16 bp, Artificial Sequence
  synthetic [barcode part1]
tcgcctataagattcc

SEQ ID NO: 20486 - DNA, 16 bp, Artificial Sequence
  synthetic [barcode part1]
caacagtcgtacctcc

SEQ ID NO: 20487 - DNA, 16 bp, Artificial Sequence
  synthetic [barcode part1]
caattggccaagatcc

SEQ ID NO: 20488 - DNA, 16 bp, Artificial Sequence
  synthetic [barcode part1]
tgtcctctcgacagtg

SEQ ID NO: 20489 - DNA, 16 bp, Artificial Sequence
  synthetic [barcode part1]
cggacaagtctcgaag

SEQ ID NO: 20490 - DNA, 16 bp, Artificial Sequence
  synthetic [barcode part1]
gtgataagtgaggcag

SEQ ID NO: 20491 - DNA, 16 bp, Artificial Sequence
  synthetic [barcode part1]
gcaacttgaacacaag

SEQ ID NO: 20492 - DNA, 16 bp, Artificial Sequence
  synthetic [barcode part1]
gtcacggacaatatcc

SEQ ID NO: 20493 - DNA, 16 bp, Artificial Sequence
  synthetic [barcode part1]
actgacggcgactatt

SEQ ID NO: 20494 - DNA, 16 bp, Artificial Sequence
  synthetic [barcode part1]
tcgaacttcggtaacg

SEQ ID NO: 20495 - DNA, 16 bp, Artificial Sequence
  synthetic [barcode part1]
cacaggataacggtcg

SEQ ID NO: 20496 - DNA, 16 bp, Artificial Sequence
  synthetic [barcode part1]
accgacgataggacac

SEQ ID NO: 20497 - DNA, 16 bp, Artificial Sequence
  synthetic [barcode part1]
aatcaaggcaaccgcg

SEQ ID NO: 20498 - DNA, 16 bp, Artificial Sequence
  synthetic [barcode part1]
ccggaattagataggt

SEQ ID NO: 20499 - DNA, 16 bp, Artificial Sequence
  synthetic [barcode part1]
ccaaggaaggagttag

SEQ ID NO: 20500 - DNA, 16 bp, Artificial Sequence
  synthetic [barcode part1]
atccgaacttatcacc

SEQ ID NO: 20501 - DNA, 16 bp, Artificial Sequence
  synthetic [barcode part1]
tgcggtcactaccttg

SEQ ID NO: 20502 - DNA, 16 bp, Artificial Sequence
  synthetic [barcode part1]
acgattgtgcgtaacc

SEQ ID NO: 20503 - DNA, 16 bp, Artificial Sequence
  synthetic [barcode part1]
gccttcaaggtacaac

SEQ ID NO: 20504 - DNA, 16 bp, Artificial Sequence
  synthetic [barcode part1]
gattacaaccggcgtt

SEQ ID NO: 20505 - DNA, 16 bp, Artificial Sequence
  synthetic [barcode part1]
acactagagtctgtgc

SEQ ID NO: 20506 - DNA, 16 bp, Artificial Sequence
  synthetic [barcode part1]
actggatatctctgtc

SEQ ID NO: 20507 - DNA, 16 bp, Artificial Sequence
  synthetic [barcode part1]
acctcacgtctgagtc

SEQ ID NO: 20508 - DNA, 16 bp, Artificial Sequence
  synthetic [barcode part1]
ccaggtacgtcactct

SEQ ID NO: 20509 - DNA, 16 bp, Artificial Sequence
  synthetic [barcode part1]
gatatcctaaggaacg

SEQ ID NO: 20510 - DNA, 16 bp, Artificial Sequence
  synthetic [barcode part1]
cgacaaggagtagtag

SEQ ID NO: 20511 - DNA, 16 bp, Artificial Sequence
  synthetic [barcode part1]
cgtagttagagtggcg

SEQ ID NO: 20512 - DNA, 16 bp, Artificial Sequence
  synthetic [barcode part1]
tgcaggtgacagaatt

SEQ ID NO: 20513 - DNA, 16 bp, Artificial Sequence
  synthetic [barcode part1]
ttacaccggattgtct

SEQ ID NO: 20514 - DNA, 16 bp, Artificial Sequence
  synthetic [barcode part1]
tgagtctgtctcaccg

SEQ ID NO: 20515 - DNA, 16 bp, Artificial Sequence
  synthetic [barcode part1]
gaagacgtctgtatcc

SEQ ID NO: 20516 - DNA, 16 bp, Artificial Sequence
  synthetic [barcode part1]
gtcagtaacggagtgc

SEQ ID NO: 20517 - DNA, 16 bp, Artificial Sequence
  synthetic [barcode part1]
caccagaacttgacgt

SEQ ID NO: 20518 - DNA, 16 bp, Artificial Sequence
  synthetic [barcode part1]
taagtcaagtcgccgt

SEQ ID NO: 20519 - DNA, 16 bp, Artificial Sequence
  synthetic [barcode part1]
aaccgacgttagtcgt

SEQ ID NO: 20520 - DNA, 16 bp, Artificial Sequence
  synthetic [barcode part1]
ttctggttcagacgtt

SEQ ID NO: 20521 - DNA, 16 bp, Artificial Sequence
  synthetic [barcode part1]
tccgtcagtcaagaac

SEQ ID NO: 20522 - DNA, 16 bp, Artificial Sequence
  synthetic [barcode part1]
cgaacagattcgttcg

SEQ ID NO: 20523 - DNA, 16 bp, Artificial Sequence
  synthetic [barcode part1]
cgatacagattgtgcc

SEQ ID NO: 20524 - DNA, 16 bp, Artificial Sequence
  synthetic [barcode part1]
gtagtctgtctccacg

SEQ ID NO: 20525 - DNA, 16 bp, Artificial Sequence
  synthetic [barcode part1]
gtcgtattaacggaag

SEQ ID NO: 20526 - DNA, 16 bp, Artificial Sequence
  synthetic [barcode part1]
agaagatcgaggagtc

SEQ ID NO: 20527 - DNA, 16 bp, Artificial Sequence
  synthetic [barcode part1]
gacaaccactggatct

SEQ ID NO: 20528 - DNA, 16 bp, Artificial Sequence
  synthetic [barcode part1]
agtcacttgtccttag

SEQ ID NO: 20529 - DNA, 16 bp, Artificial Sequence
  synthetic [barcode part1]
gccgatacgaggaact

SEQ ID NO: 20530 - DNA, 16 bp, Artificial Sequence
  synthetic [barcode part1]
gcagttagaagagttc

SEQ ID NO: 20531 - DNA, 16 bp, Artificial Sequence
  synthetic [barcode part1]
gagtaattcgacacag

SEQ ID NO: 20532 - DNA, 16 bp, Artificial Sequence
  synthetic [barcode part1]
ttcgatccgtagttgt

SEQ ID NO: 20533 - DNA, 16 bp, Artificial Sequence
  synthetic [barcode part1]
tgcgaagaatcactag

SEQ ID NO: 20534 - DNA, 16 bp, Artificial Sequence
  synthetic [barcode part1]
aatccacacagtagag

SEQ ID NO: 20535 - DNA, 16 bp, Artificial Sequence
  synthetic [barcode part1]
cggtcgtcttgacttg

SEQ ID NO: 20536 - DNA, 16 bp, Artificial Sequence
  synthetic [barcode part1]
gcacggcacgttaatt

SEQ ID NO: 20537 - DNA, 16 bp, Artificial Sequence
  synthetic [barcode part1]
aattcctgccacttcc

SEQ ID NO: 20538 - DNA, 16 bp, Artificial Sequence
  synthetic [barcode part1]
aatcggttctcctctc

SEQ ID NO: 20539 - DNA, 16 bp, Artificial Sequence
  synthetic [barcode part1]
taccgaacaagaacac

SEQ ID NO: 20540 - DNA, 16 bp, Artificial Sequence
  synthetic [barcode part1]
tattgaggcctgacgt

SEQ ID NO: 20541 - DNA, 16 bp, Artificial Sequence
  synthetic [barcode part1]
tcgtacactggtctcg

SEQ ID NO: 20542 - DNA, 16 bp, Artificial Sequence
  synthetic [barcode part1]
cggtatagaggcagtc

SEQ ID NO: 20543 - DNA, 16 bp, Artificial Sequence
  synthetic [barcode part1]
tggaggataacgcgtc

SEQ ID NO: 20544 - DNA, 16 bp, Artificial Sequence
  synthetic [barcode part1]
gtcaacaggtgacgac

SEQ ID NO: 20545 - DNA, 16 bp, Artificial Sequence
  synthetic [barcode part1]
atcacagtccgcctac

SEQ ID NO: 20546 - DNA, 16 bp, Artificial Sequence
  synthetic [barcode part1]
gattgcgaaggttagt

SEQ ID NO: 20547 - DNA, 16 bp, Artificial Sequence
  synthetic [barcode part1]
taaccgacacggtatc

SEQ ID NO: 20548 - DNA, 16 bp, Artificial Sequence
  synthetic [barcode part1]
gaaggtcttagaggag

SEQ ID NO: 20549 - DNA, 16 bp, Artificial Sequence
  synthetic [barcode part1]
cagtggcctaacaatc

SEQ ID NO: 20550 - DNA, 16 bp, Artificial Sequence
  synthetic [barcode part1]
ttaactcggacgcctc

SEQ ID NO: 20551 - DNA, 16 bp, Artificial Sequence
  synthetic [barcode part1]
gagttgccgttcctgt

SEQ ID NO: 20552 - DNA, 16 bp, Artificial Sequence
  synthetic [barcode part1]
gtctgccttcaggact

SEQ ID NO: 20553 - DNA, 16 bp, Artificial Sequence
  synthetic [barcode part1]
gtgagtgataacgttg

SEQ ID NO: 20554 - DNA, 16 bp, Artificial Sequence
  synthetic [barcode part1]
gccgaatcgttgaact

SEQ ID NO: 20555 - DNA, 16 bp, Artificial Sequence
  synthetic [barcode part1]
actctactccagtcct

SEQ ID NO: 20556 - DNA, 16 bp, Artificial Sequence
  synthetic [barcode part1]
tccgttgttctcaacc

SEQ ID NO: 20557 - DNA, 16 bp, Artificial Sequence
  synthetic [barcode part1]
gtacgacttgattcct

SEQ ID NO: 20558 - DNA, 16 bp, Artificial Sequence
  synthetic [barcode part1]
ttagagtgcggacggt

SEQ ID NO: 20559 - DNA, 16 bp, Artificial Sequence
  synthetic [barcode part1]
ttggtgtaccaacgtg

SEQ ID NO: 20560 - DNA, 16 bp, Artificial Sequence
  synthetic [barcode part1]
aataacttctcgcgtc

SEQ ID NO: 20561 - DNA, 16 bp, Artificial Sequence
  synthetic [barcode part1]
tggtgattcggtagtc

SEQ ID NO: 20562 - DNA, 16 bp, Artificial Sequence
  synthetic [barcode part1]
tatatcaacgcgccag

SEQ ID NO: 20563 - DNA, 16 bp, Artificial Sequence
  synthetic [barcode part1]
ttgacaggacagttcc

SEQ ID NO: 20564 - DNA, 16 bp, Artificial Sequence
  synthetic [barcode part1]
gaactgcagtggtctt

SEQ ID NO: 20565 - DNA, 16 bp, Artificial Sequence
  synthetic [barcode part1]
agatcacaggcgtgac

SEQ ID NO: 20566 - DNA, 16 bp, Artificial Sequence
  synthetic [barcode part1]
gcgataggaatattcg

SEQ ID NO: 20567 - DNA, 16 bp, Artificial Sequence
  synthetic [barcode part1]
tacgcaaggtagtggc

SEQ ID NO: 20568 - DNA, 16 bp, Artificial Sequence
  synthetic [barcode part1]
gtgtacggttgatcgt

SEQ ID NO: 20569 - DNA, 16 bp, Artificial Sequence
  synthetic [barcode part1]
agttcagtggtccaac

SEQ ID NO: 20570 - DNA, 16 bp, Artificial Sequence
  synthetic [barcode part1]
tcacagataggaagtc

SEQ ID NO: 20571 - DNA, 16 bp, Artificial Sequence
  synthetic [barcode part1]
tcgagttgattcgacg

SEQ ID NO: 20572 - DNA, 16 bp, Artificial Sequence
  synthetic [barcode part1]
tcgagtacggatactc

SEQ ID NO: 20573 - DNA, 16 bp, Artificial Sequence
  synthetic [barcode part1]
tggaggttccggtaag

SEQ ID NO: 20574 - DNA, 16 bp, Artificial Sequence
  synthetic [barcode part1]
agtactccgaggagtg

SEQ ID NO: 20575 - DNA, 16 bp, Artificial Sequence
  synthetic [barcode part1]
gcaacttattcctgtg

SEQ ID NO: 20576 - DNA, 16 bp, Artificial Sequence
  synthetic [barcode part1]
tcaggattatctgtcc

SEQ ID NO: 20577 - DNA, 16 bp, Artificial Sequence
  synthetic [barcode part1]
acgccacgcaagtaag

SEQ ID NO: 20578 - DNA, 16 bp, Artificial Sequence
  synthetic [barcode part1]
attctcttgatacgcg

SEQ ID NO: 20579 - DNA, 16 bp, Artificial Sequence
  synthetic [barcode part1]
cgaatctattccgttg

SEQ ID NO: 20580 - DNA, 16 bp, Artificial Sequence
  synthetic [barcode part1]
acttggtatcgagtcg

SEQ ID NO: 20581 - DNA, 16 bp, Artificial Sequence
  synthetic [barcode part1]
atcgttccggacacct

SEQ ID NO: 20582 - DNA, 16 bp, Artificial Sequence
  synthetic [barcode part1]
ccggcgattattaggt

SEQ ID NO: 20583 - DNA, 16 bp, Artificial Sequence
  synthetic [barcode part1]
gtagtctggacgcaag

SEQ ID NO: 20584 - DNA, 16 bp, Artificial Sequence
  synthetic [barcode part1]
ataactaccttggtcc

SEQ ID NO: 20585 - DNA, 16 bp, Artificial Sequence
  synthetic [barcode part1]
cgcgttctgaattact

SEQ ID NO: 20586 - DNA, 16 bp, Artificial Sequence
  synthetic [barcode part1]
gacgtgacagaagtag

SEQ ID NO: 20587 - DNA, 16 bp, Artificial Sequence
  synthetic [barcode part1]
acaggtgaagtaggtg

SEQ ID NO: 20588 - DNA, 16 bp, Artificial Sequence
  synthetic [barcode part1]
tgagtcgcgacttagt

SEQ ID NO: 20589 - DNA, 16 bp, Artificial Sequence
  synthetic [barcode part1]
acggttaatcacgtgc

SEQ ID NO: 20590 - DNA, 16 bp, Artificial Sequence
  synthetic [barcode part1]
cacacaacgttccgtc

SEQ ID NO: 20591 - DNA, 16 bp, Artificial Sequence
  synthetic [barcode part1]
ttcaggaggtcgattc

SEQ ID NO: 20592 - DNA, 16 bp, Artificial Sequence
  synthetic [barcode part1]
caggttacttcacgcc

SEQ ID NO: 20593 - DNA, 16 bp, Artificial Sequence
  synthetic [barcode part1]
taagaggaagaggcct

SEQ ID NO: 20594 - DNA, 16 bp, Artificial Sequence
  synthetic [barcode part1]
aacagttcacgagagt

SEQ ID NO: 20595 - DNA, 16 bp, Artificial Sequence
  synthetic [barcode part1]
atcgttgtcaggtcag

SEQ ID NO: 20596 - DNA, 16 bp, Artificial Sequence
  synthetic [barcode part1]
aacaacacctatcgcg

SEQ ID NO: 20597 - DNA, 16 bp, Artificial Sequence
  synthetic [barcode part1]
atcacacacgtaaccg

SEQ ID NO: 20598 - DNA, 16 bp, Artificial Sequence
  synthetic [barcode part1]
ccagtataggattgag

SEQ ID NO: 20599 - DNA, 16 bp, Artificial Sequence
  synthetic [barcode part1]
gcgttcgagtatctag

SEQ ID NO: 20600 - DNA, 16 bp, Artificial Sequence
  synthetic [barcode part1]
attctctgcgttagtg

SEQ ID NO: 20601 - DNA, 16 bp, Artificial Sequence
  synthetic [barcode part1]
aacggtgtgtccagag

SEQ ID NO: 20602 - DNA, 16 bp, Artificial Sequence
  synthetic [barcode part1]
ttatacaggtctctcg

SEQ ID NO: 20603 - DNA, 16 bp, Artificial Sequence
  synthetic [barcode part1]
aggcgagtctggagtt

SEQ ID NO: 20604 - DNA, 16 bp, Artificial Sequence
  synthetic [barcode part1]
agatcaaccgaggaag

SEQ ID NO: 20605 - DNA, 16 bp, Artificial Sequence
  synthetic [barcode part1]
aagaggataactggcg

SEQ ID NO: 20606 - DNA, 16 bp, Artificial Sequence
  synthetic [barcode part1]
ccagtgcctaatcctg

SEQ ID NO: 20607 - DNA, 16 bp, Artificial Sequence
  synthetic [barcode part1]
aactcggtggcaatct

SEQ ID NO: 20608 - DNA, 16 bp, Artificial Sequence
  synthetic [barcode part1]
gcgtcaatcggatact

SEQ ID NO: 20609 - DNA, 16 bp, Artificial Sequence
  synthetic [barcode part1]
tctccagaactgagac

SEQ ID NO: 20610 - DNA, 16 bp, Artificial Sequence
  synthetic [barcode part1]
ttacctacggaatctc

SEQ ID NO: 20611 - DNA, 16 bp, Artificial Sequence
  synthetic [barcode part1]
ccgtgaacgttctatt

SEQ ID NO: 20612 - DNA, 16 bp, Artificial Sequence
  synthetic [barcode part1]
agaggacaagtcgaac

SEQ ID NO: 20613 - DNA, 16 bp, Artificial Sequence
  synthetic [barcode part1]
ccttgactcgacacac

SEQ ID NO: 20614 - DNA, 16 bp, Artificial Sequence
  synthetic [barcode part1]
ccggacaacgatagac

SEQ ID NO: 20615 - DNA, 16 bp, Artificial Sequence
  synthetic [barcode part1]
gttgaacaggtacaac

SEQ ID NO: 20616 - DNA, 16 bp, Artificial Sequence
  synthetic [barcode part1]
gataacacggacaccg

SEQ ID NO: 20617 - DNA, 16 bp, Artificial Sequence
  synthetic [barcode part1]
ccaactaggtcaactg

SEQ ID NO: 20618 - DNA, 16 bp, Artificial Sequence
  synthetic [barcode part1]
ccggtaacaggttact

SEQ ID NO: 20619 - DNA, 16 bp, Artificial Sequence
  synthetic [barcode part1]
tagaggacacgcgact

SEQ ID NO: 20620 - DNA, 16 bp, Artificial Sequence
  synthetic [barcode part1]
tctggaacaatcggtc

SEQ ID NO: 20621 - DNA, 16 bp, Artificial Sequence
  synthetic [barcode part1]
atcaggtacgatccac

SEQ ID NO: 20622 - DNA, 16 bp, Artificial Sequence
  synthetic [barcode part1]
gttgacacaccttatc

SEQ ID NO: 20623 - DNA, 16 bp, Artificial Sequence
  synthetic [barcode part1]
aggaatagagtcactc

SEQ ID NO: 20624 - DNA, 16 bp, Artificial Sequence
  synthetic [barcode part1]
tgatatacgcgccaac

SEQ ID NO: 20625 - DNA, 16 bp, Artificial Sequence
  synthetic [barcode part1]
gtgagtgagtgtcgtg

SEQ ID NO: 20626 - DNA, 16 bp, Artificial Sequence
  synthetic [barcode part1]
gtctaacgccagattg

SEQ ID NO: 20627 - DNA, 16 bp, Artificial Sequence
  synthetic [barcode part1]
tacgactagaacggcg

SEQ ID NO: 20628 - DNA, 16 bp, Artificial Sequence
  synthetic [barcode part1]
cggtaacctctgtatt

SEQ ID NO: 20629 - DNA, 16 bp, Artificial Sequence
  synthetic [barcode part1]
ccaataccgtgtagtg

SEQ ID NO: 20630 - DNA, 16 bp, Artificial Sequence
  synthetic [barcode part1]
cctctgtcttgtgttg

SEQ ID NO: 20631 - DNA, 16 bp, Artificial Sequence
  synthetic [barcode part1]
tggtgcgttagtgtac

SEQ ID NO: 20632 - DNA, 16 bp, Artificial Sequence
  synthetic [barcode part1]
gagtaggttcaggacc

SEQ ID NO: 20633 - DNA, 16 bp, Artificial Sequence
  synthetic [barcode part1]
ttgttcgcctaaggtt

SEQ ID NO: 20634 - DNA, 16 bp, Artificial Sequence
  synthetic [barcode part1]
tcgaggttccgtctgt

SEQ ID NO: 20635 - DNA, 16 bp, Artificial Sequence
  synthetic [barcode part1]
cgtagtagttccgaac

SEQ ID NO: 20636 - DNA, 16 bp, Artificial Sequence
  synthetic [barcode part1]
taagaactggatcacg

SEQ ID NO: 20637 - DNA, 16 bp, Artificial Sequence
  synthetic [barcode part1]
gttctagatcgcaacg

SEQ ID NO: 20638 - DNA, 16 bp, Artificial Sequence
  synthetic [barcode part1]
cggcgcagagatagtt

SEQ ID NO: 20639 - DNA, 16 bp, Artificial Sequence
  synthetic [barcode part1]
tagactccggaataag

SEQ ID NO: 20640 - DNA, 16 bp, Artificial Sequence
  synthetic [barcode part1]
tacgtccttgtactcc

SEQ ID NO: 20641 - DNA, 16 bp, Artificial Sequence
  synthetic [barcode part1]
cgttgaggtgattcgt

SEQ ID NO: 20642 - DNA, 16 bp, Artificial Sequence
  synthetic [barcode part1]
caattcgttcgacgag

SEQ ID NO: 20643 - DNA, 16 bp, Artificial Sequence
  synthetic [barcode part1]
atataacgcgtaccgc

SEQ ID NO: 20644 - DNA, 16 bp, Artificial Sequence
  synthetic [barcode part1]
ccaacggagtataggc

SEQ ID NO: 20645 - DNA, 16 bp, Artificial Sequence
  synthetic [barcode part1]
cggcactcactataag

SEQ ID NO: 20646 - DNA, 16 bp, Artificial Sequence
  synthetic [barcode part1]
gttcgtcaatattgcc

SEQ ID NO: 20647 - DNA, 16 bp, Artificial Sequence
  synthetic [barcode part1]
gcgtatacgtatacgc

SEQ ID NO: 20648 - DNA, 16 bp, Artificial Sequence
  synthetic [barcode part1]
cgtccttgtataggag

SEQ ID NO: 20649 - DNA, 16 bp, Artificial Sequence
  synthetic [barcode part1]
gcggttaggaaccagt

SEQ ID NO: 20650 - DNA, 16 bp, Artificial Sequence
  synthetic [barcode part1]
ttgtgagtggacctac

SEQ ID NO: 20651 - DNA, 16 bp, Artificial Sequence
  synthetic [barcode part1]
cctagatcgccaatag

SEQ ID NO: 20652 - DNA, 16 bp, Artificial Sequence
  synthetic [barcode part1]
cctgttgtgtgaattc

SEQ ID NO: 20653 - DNA, 16 bp, Artificial Sequence
  synthetic [barcode part1]
atactggaccgccttc

SEQ ID NO: 20654 - DNA, 16 bp, Artificial Sequence
  synthetic [barcode part1]
tacctcgttacaggcc

SEQ ID NO: 20655 - DNA, 16 bp, Artificial Sequence
  synthetic [barcode part1]
atcctacctgtcacct

SEQ ID NO: 20656 - DNA, 16 bp, Artificial Sequence
  synthetic [barcode part1]
cgtgtccttgtactct

SEQ ID NO: 20657 - DNA, 16 bp, Artificial Sequence
  synthetic [barcode part1]
gttacctgcgaatctt

SEQ ID NO: 20658 - DNA, 16 bp, Artificial Sequence
  synthetic [barcode part1]
ttccggtctggtgtac

SEQ ID NO: 20659 - DNA, 16 bp, Artificial Sequence
  synthetic [barcode part1]
tgtacacaccagtcag

SEQ ID NO: 20660 - DNA, 16 bp, Artificial Sequence
  synthetic [barcode part1]
tacttgtgacaggcac

SEQ ID NO: 20661 - DNA, 16 bp, Artificial Sequence
  synthetic [barcode part1]
tcacgccttcggtagt

SEQ ID NO: 20662 - DNA, 16 bp, Artificial Sequence
  synthetic [barcode part1]
tacaagtactctgcct

SEQ ID NO: 20663 - DNA, 16 bp, Artificial Sequence
  synthetic [barcode part1]
tgacaacacacgaggc

SEQ ID NO: 20664 - DNA, 16 bp, Artificial Sequence
  synthetic [barcode part1]
acactaggatcacacc

SEQ ID NO: 20665 - DNA, 16 bp, Artificial Sequence
  synthetic [barcode part1]
tcagtaccagttgcag

SEQ ID NO: 20666 - DNA, 16 bp, Artificial Sequence
  synthetic [barcode part1]
gataccagatcgatcc

SEQ ID NO: 20667 - DNA, 16 bp, Artificial Sequence
  synthetic [barcode part1]
attcggtaggaacgcg

SEQ ID NO: 20668 - DNA, 16 bp, Artificial Sequence
  synthetic [barcode part1]
tagatcacacggaagt

SEQ ID NO: 20669 - DNA, 16 bp, Artificial Sequence
  synthetic [barcode part1]
cgttccaggacttacc

SEQ ID NO: 20670 - DNA, 16 bp, Artificial Sequence
  synthetic [barcode part1]
atcacgtcagtctccg

SEQ ID NO: 20671 - DNA, 16 bp, Artificial Sequence
  synthetic [barcode part1]
cctctaacacgtagtt

SEQ ID NO: 20672 - DNA, 16 bp, Artificial Sequence
  synthetic [barcode part1]
taggtaagatactgcg

SEQ ID NO: 20673 - DNA, 16 bp, Artificial Sequence
  synthetic [barcode part1]
tgagtggtacctactg

SEQ ID NO: 20674 - DNA, 16 bp, Artificial Sequence
  synthetic [barcode part1]
tcgcagagtagtcact

SEQ ID NO: 20675 - DNA, 16 bp, Artificial Sequence
  synthetic [barcode part1]
taggcagtagagtccg

SEQ ID NO: 20676 - DNA, 16 bp, Artificial Sequence
  synthetic [barcode part1]
gatagaagtgtccggc

SEQ ID NO: 20677 - DNA, 16 bp, Artificial Sequence
  synthetic [barcode part1]
gtgtcggattggagac

SEQ ID NO: 20678 - DNA, 16 bp, Artificial Sequence
  synthetic [barcode part1]
tagtggtagtcactgc

SEQ ID NO: 20679 - DNA, 16 bp, Artificial Sequence
  synthetic [barcode part1]
gatacgtacaccgatc

SEQ ID NO: 20680 - DNA, 16 bp, Artificial Sequence
  synthetic [barcode part1]
gtctagtgagacgcag

SEQ ID NO: 20681 - DNA, 16 bp, Artificial Sequence
  synthetic [barcode part1]
gacgatccgtacctct

SEQ ID NO: 20682 - DNA, 16 bp, Artificial Sequence
  synthetic [barcode part1]
gaatagatccaaggtc

SEQ ID NO: 20683 - DNA, 16 bp, Artificial Sequence
  synthetic [barcode part1]
ttgccgtctcgagtac

SEQ ID NO: 20684 - DNA, 16 bp, Artificial Sequence
  synthetic [barcode part1]
cacgagtgacaggact

SEQ ID NO: 20685 - DNA, 16 bp, Artificial Sequence
  synthetic [barcode part1]
aggagtgaataactcc

SEQ ID NO: 20686 - DNA, 16 bp, Artificial Sequence
  synthetic [barcode part1]
tctcggcgtacagtct

SEQ ID NO: 20687 - DNA, 16 bp, Artificial Sequence
  synthetic [barcode part1]
gaccttcggaagttac

SEQ ID NO: 20688 - DNA, 16 bp, Artificial Sequence
  synthetic [barcode part1]
agaagttgaaggaccg

SEQ ID NO: 20689 - DNA, 16 bp, Artificial Sequence
  synthetic [barcode part1]
ttggcagtagaggcgt

SEQ ID NO: 20690 - DNA, 16 bp, Artificial Sequence
  synthetic [barcode part1]
ccagtgatactcttgt

SEQ ID NO: 20691 - DNA, 16 bp, Artificial Sequence
  synthetic [barcode part1]
tcagagtgtgaacggc

SEQ ID NO: 20692 - DNA, 16 bp, Artificial Sequence
  synthetic [barcode part1]
cgtggatcttactact

SEQ ID NO: 20693 - DNA, 16 bp, Artificial Sequence
  synthetic [barcode part1]
tcgaaggtaactcctg

SEQ ID NO: 20694 - DNA, 16 bp, Artificial Sequence
  synthetic [barcode part1]
gccacctatcctatct

SEQ ID NO: 20695 - DNA, 16 bp, Artificial Sequence
  synthetic [barcode part1]
gtatacctattccacg

SEQ ID NO: 20696 - DNA, 16 bp, Artificial Sequence
  synthetic [barcode part1]
tgcagtacggaattcc

SEQ ID NO: 20697 - DNA, 16 bp, Artificial Sequence
  synthetic [barcode part1]
tctagaggattggtcc

SEQ ID NO: 20698 - DNA, 16 bp, Artificial Sequence
  synthetic [barcode part1]
cgccttagacactcac

SEQ ID NO: 20699 - DNA, 16 bp, Artificial Sequence
  synthetic [barcode part1]
attacctgtctgtgac

SEQ ID NO: 20700 - DNA, 16 bp, Artificial Sequence
  synthetic [barcode part1]
gatcgttgttcggtag

SEQ ID NO: 20701 - DNA, 16 bp, Artificial Sequence
  synthetic [barcode part1]
gcaacttctcgcgttg

SEQ ID NO: 20702 - DNA, 16 bp, Artificial Sequence
  synthetic [barcode part1]
tcggattgtattctcg

SEQ ID NO: 20703 - DNA, 16 bp, Artificial Sequence
  synthetic [barcode part1]
acgagagaatcactac

SEQ ID NO: 20704 - DNA, 16 bp, Artificial Sequence
  synthetic [barcode part1]
cagagagttgaaggac

SEQ ID NO: 20705 - DNA, 16 bp, Artificial Sequence
  synthetic [barcode part1]
ataggcgagactccag

SEQ ID NO: 20706 - DNA, 16 bp, Artificial Sequence
  synthetic [barcode part1]
cgacaagtaggcactg

SEQ ID NO: 20707 - DNA, 16 bp, Artificial Sequence
  synthetic [barcode part1]
tcttacagtcgtcaac

SEQ ID NO: 20708 - DNA, 16 bp, Artificial Sequence
  synthetic [barcode part1]
ttaggcgtggacactt

SEQ ID NO: 20709 - DNA, 16 bp, Artificial Sequence
  synthetic [barcode part1]
actacttaggtctacc

SEQ ID NO: 20710 - DNA, 16 bp, Artificial Sequence
  synthetic [barcode part1]
actgtacgtacggttg

SEQ ID NO: 20711 - DNA, 16 bp, Artificial Sequence
  synthetic [barcode part1]
aataaggaatccgcac

SEQ ID NO: 20712 - DNA, 16 bp, Artificial Sequence
  synthetic [barcode part1]
gtgttacgtccacctg

SEQ ID NO: 20713 - DNA, 16 bp, Artificial Sequence
  synthetic [barcode part1]
taggtgccttccaatt

SEQ ID NO: 20714 - DNA, 16 bp, Artificial Sequence
  synthetic [barcode part1]
cagaattcggccagtt

SEQ ID NO: 20715 - DNA, 16 bp, Artificial Sequence
  synthetic [barcode part1]
cggcctctaatacgtc

SEQ ID NO: 20716 - DNA, 16 bp, Artificial Sequence
  synthetic [barcode part1]
aattccggtccactcg

SEQ ID NO: 20717 - DNA, 16 bp, Artificial Sequence
  synthetic [barcode part1]
tactggtgtcacacag

SEQ ID NO: 20718 - DNA, 16 bp, Artificial Sequence
  synthetic [barcode part1]
gtccgacaactgttag

SEQ ID NO: 20719 - DNA, 16 bp, Artificial Sequence
  synthetic [barcode part1]
cagttactacttcacg

SEQ ID NO: 20720 - DNA, 16 bp, Artificial Sequence
  synthetic [barcode part1]
gcagagactaatagtc

SEQ ID NO: 20721 - DNA, 16 bp, Artificial Sequence
  synthetic [barcode part1]
accagttcgacgttag

SEQ ID NO: 20722 - DNA, 16 bp, Artificial Sequence
  synthetic [barcode part1]
tccttctaattccggc

SEQ ID NO: 20723 - DNA, 16 bp, Artificial Sequence
  synthetic [barcode part1]
acaattgccagtcctt

SEQ ID NO: 20724 - DNA, 16 bp, Artificial Sequence
  synthetic [barcode part1]
agtcggatcacgcaag

SEQ ID NO: 20725 - DNA, 16 bp, Artificial Sequence
  synthetic [barcode part1]
tattgcgatacgcacg

SEQ ID NO: 20726 - DNA, 16 bp, Artificial Sequence
  synthetic [barcode part1]
tgaccgcagatcgaag

SEQ ID NO: 20727 - DNA, 16 bp, Artificial Sequence
  synthetic [barcode part1]
aggagaacctcagaag

SEQ ID NO: 20728 - DNA, 16 bp, Artificial Sequence
  synthetic [barcode part1]
tcgaatccacggagag

SEQ ID NO: 20729 - DNA, 16 bp, Artificial Sequence
  synthetic [barcode part1]
gtggattgagagtcgc

SEQ ID NO: 20730 - DNA, 16 bp, Artificial Sequence
  synthetic [barcode part1]
tgcgtatccttctctg

SEQ ID NO: 20731 - DNA, 16 bp, Artificial Sequence
  synthetic [barcode part1]
gaattgagacctctcg

SEQ ID NO: 20732 - DNA, 16 bp, Artificial Sequence
  synthetic [barcode part1]
caaggagaccagtgtc

SEQ ID NO: 20733 - DNA, 16 bp, Artificial Sequence
  synthetic [barcode part1]
aattaacgccaaccgc

SEQ ID NO: 20734 - DNA, 16 bp, Artificial Sequence
  synthetic [barcode part1]
tgacacgtcctcaatt

SEQ ID NO: 20735 - DNA, 16 bp, Artificial Sequence
  synthetic [barcode part1]
atcacgtctgacacag

SEQ ID NO: 20736 - DNA, 16 bp, Artificial Sequence
  synthetic [barcode part1]
aggtcacctactgagt

SEQ ID NO: 20737 - DNA, 16 bp, Artificial Sequence
  synthetic [barcode part1]
tacggactaaggcggt

SEQ ID NO: 20738 - DNA, 16 bp, Artificial Sequence
  synthetic [barcode part1]
ccaacaacttgacgac

SEQ ID NO: 20739 - DNA, 16 bp, Artificial Sequence
  synthetic [barcode part1]
tagacgcggaacaatt

SEQ ID NO: 20740 - DNA, 16 bp, Artificial Sequence
  synthetic [barcode part1]
cctaggaaggacttct

SEQ ID NO: 20741 - DNA, 16 bp, Artificial Sequence
  synthetic [barcode part1]
gttcctacgccagact

SEQ ID NO: 20742 - DNA, 16 bp, Artificial Sequence
  synthetic [barcode part1]
cgttattcaggagacc

SEQ ID NO: 20743 - DNA, 16 bp, Artificial Sequence
  synthetic [barcode part1]
cgacctcgccgatatt

SEQ ID NO: 20744 - DNA, 16 bp, Artificial Sequence
  synthetic [barcode part1]
tcttaatccggacgtt

SEQ ID NO: 20745 - DNA, 16 bp, Artificial Sequence
  synthetic [barcode part1]
gcgttgaatcagaagt

SEQ ID NO: 20746 - DNA, 16 bp, Artificial Sequence
  synthetic [barcode part1]
tgcaaggatacctctg

SEQ ID NO: 20747 - DNA, 16 bp, Artificial Sequence
  synthetic [barcode part1]
ttcaggattgatcggc

SEQ ID NO: 20748 - DNA, 16 bp, Artificial Sequence
  synthetic [barcode part1]
tgcctctaaggatacg

SEQ ID NO: 20749 - DNA, 16 bp, Artificial Sequence
  synthetic [barcode part1]
tgacctaggactgttg

SEQ ID NO: 20750 - DNA, 16 bp, Artificial Sequence
  synthetic [barcode part1]
atacgtgaccgattgc

SEQ ID NO: 20751 - DNA, 16 bp, Artificial Sequence
  synthetic [barcode part1]
gtctacctgtcacgac

SEQ ID NO: 20752 - DNA, 16 bp, Artificial Sequence
  synthetic [barcode part1]
gaacacgaatccgacg

SEQ ID NO: 20753 - DNA, 16 bp, Artificial Sequence
  synthetic [barcode part1]
ttggacgttcgccgtt

SEQ ID NO: 20754 - DNA, 16 bp, Artificial Sequence
  synthetic [barcode part1]
taggttggtacttctc

SEQ ID NO: 20755 - DNA, 16 bp, Artificial Sequence
  synthetic [barcode part1]
tccaactcacgaccgt

SEQ ID NO: 20756 - DNA, 16 bp, Artificial Sequence
  synthetic [barcode part1]
agataaccacgagttg

SEQ ID NO: 20757 - DNA, 16 bp, Artificial Sequence
  synthetic [barcode part1]
gcgagatactcacgag

SEQ ID NO: 20758 - DNA, 16 bp, Artificial Sequence
  synthetic [barcode part1]
ttagtctcgttaacgc

SEQ ID NO: 20759 - DNA, 16 bp, Artificial Sequence
  synthetic [barcode part1]
cgtgtcgaatcctctg

SEQ ID NO: 20760 - DNA, 16 bp, Artificial Sequence
  synthetic [barcode part1]
agaaggtgcctaagtt

SEQ ID NO: 20761 - DNA, 16 bp, Artificial Sequence
  synthetic [barcode part1]
tacaattcctctgacg

SEQ ID NO: 20762 - DNA, 16 bp, Artificial Sequence
  synthetic [barcode part1]
cagaagacgatacgtt

SEQ ID NO: 20763 - DNA, 16 bp, Artificial Sequence
  synthetic [barcode part1]
gcgcaataaggccagt

SEQ ID NO: 20764 - DNA, 16 bp, Artificial Sequence
  synthetic [barcode part1]
ttcgtccgagttccag

SEQ ID NO: 20765 - DNA, 16 bp, Artificial Sequence
  synthetic [barcode part1]
tcttccgtacttcgtg

SEQ ID NO: 20766 - DNA, 16 bp, Artificial Sequence
  synthetic [barcode part1]
cgtgtaacggagagtc

SEQ ID NO: 20767 - DNA, 16 bp, Artificial Sequence
  synthetic [barcode part1]
ccggactgtacagaag

SEQ ID NO: 20768 - DNA, 16 bp, Artificial Sequence
  synthetic [barcode part1]
accttagatacacgcg

SEQ ID NO: 20769 - DNA, 16 bp, Artificial Sequence
  synthetic [barcode part1]
tcacgtaccaattctg

SEQ ID NO: 20770 - DNA, 16 bp, Artificial Sequence
  synthetic [barcode part1]
atagattgtgcctggc

SEQ ID NO: 20771 - DNA, 16 bp, Artificial Sequence
  synthetic [barcode part1]
acgtcagatcggaggt

SEQ ID NO: 20772 - DNA, 16 bp, Artificial Sequence
  synthetic [barcode part1]
tcttggattacctacg

SEQ ID NO: 20773 - DNA, 16 bp, Artificial Sequence
  synthetic [barcode part1]
cctacacctagtggtc

SEQ ID NO: 20774 - DNA, 16 bp, Artificial Sequence
  synthetic [barcode part1]
tagactgttcttgcac

SEQ ID NO: 20775 - DNA, 16 bp, Artificial Sequence
  synthetic [barcode part1]
gcgatatacacacgtc

SEQ ID NO: 20776 - DNA, 16 bp, Artificial Sequence
  synthetic [barcode part1]
gcagaacttcaggcag

SEQ ID NO: 20777 - DNA, 16 bp, Artificial Sequence
  synthetic [barcode part1]
aataatctctccgcac

SEQ ID NO: 20778 - DNA, 16 bp, Artificial Sequence
  synthetic [barcode part1]
cgcgtaatcgtcgtct

SEQ ID NO: 20779 - DNA, 16 bp, Artificial Sequence
  synthetic [barcode part1]
tacgacggtggtatct

SEQ ID NO: 20780 - DNA, 16 bp, Artificial Sequence
  synthetic [barcode part1]
taacaacgtacctcct

SEQ ID NO: 20781 - DNA, 16 bp, Artificial Sequence
  synthetic [barcode part1]
gacctatagacttgcg

SEQ ID NO: 20782 - DNA, 16 bp, Artificial Sequence
  synthetic [barcode part1]
gttgcaactcgttcgc

SEQ ID NO: 20783 - DNA, 16 bp, Artificial Sequence
  synthetic [barcode part1]
gactctcaacttgcgc

SEQ ID NO: 20784 - DNA, 16 bp, Artificial Sequence
  synthetic [barcode part1]
tccaagtacctaggtg

SEQ ID NO: 20785 - DNA, 16 bp, Artificial Sequence
  synthetic [barcode part1]
acacaacggagttaac

SEQ ID NO: 20786 - DNA, 16 bp, Artificial Sequence
  synthetic [barcode part1]
agttcagagtcgtcac

SEQ ID NO: 20787 - DNA, 16 bp, Artificial Sequence
  synthetic [barcode part1]
aggcggacactgtagt

SEQ ID NO: 20788 - DNA, 16 bp, Artificial Sequence
  synthetic [barcode part1]
cagaacgtctagtctg

SEQ ID NO: 20789 - DNA, 16 bp, Artificial Sequence
  synthetic [barcode part1]
acctagacaggtatcc

SEQ ID NO: 20790 - DNA, 16 bp, Artificial Sequence
  synthetic [barcode part1]
cgagattcaatcggtc

SEQ ID NO: 20791 - DNA, 16 bp, Artificial Sequence
  synthetic [barcode part1]
gtgtgtagtcgattgc

SEQ ID NO: 20792 - DNA, 16 bp, Artificial Sequence
  synthetic [barcode part1]
agaggtcaccgtgtag

SEQ ID NO: 20793 - DNA, 16 bp, Artificial Sequence
  synthetic [barcode part1]
tacacagtactggcac

SEQ ID NO: 20794 - DNA, 16 bp, Artificial Sequence
  synthetic [barcode part1]
atctctaacagaggcc

SEQ ID NO: 20795 - DNA, 16 bp, Artificial Sequence
  synthetic [barcode part1]
atctcacgacgtactt

SEQ ID NO: 20796 - DNA, 16 bp, Artificial Sequence
  synthetic [barcode part1]
tcacgttcaggttgtt

SEQ ID NO: 20797 - DNA, 16 bp, Artificial Sequence
  synthetic [barcode part1]
cacaatcctcttggcg

SEQ ID NO: 20798 - DNA, 16 bp, Artificial Sequence
  synthetic [barcode part1]
gactacaggaattgac

SEQ ID NO: 20799 - DNA, 16 bp, Artificial Sequence
  synthetic [barcode part1]
attggtggaattggac

SEQ ID NO: 20800 - DNA, 16 bp, Artificial Sequence
  synthetic [barcode part1]
gtggtgtgtacgtgtt

SEQ ID NO: 20801 - DNA, 16 bp, Artificial Sequence
  synthetic [barcode part1]
gcaagtcgtactcagt

SEQ ID NO: 20802 - DNA, 16 bp, Artificial Sequence
  synthetic [barcode part1]
tacgtcagaggaattg

SEQ ID NO: 20803 - DNA, 16 bp, Artificial Sequence
  synthetic [barcode part1]
cagtccttagtcgcac

SEQ ID NO: 20804 - DNA, 16 bp, Artificial Sequence
  synthetic [barcode part1]
gtgcacctacttcgtg

SEQ ID NO: 20805 - DNA, 16 bp, Artificial Sequence
  synthetic [barcode part1]
ttcgtgactcggatag

SEQ ID NO: 20806 - DNA, 16 bp, Artificial Sequence
  synthetic [barcode part1]
gtgcacgatcacaatc

SEQ ID NO: 20807 - DNA, 16 bp, Artificial Sequence
  synthetic [barcode part1]
gcacaatctctaatcc

SEQ ID NO: 20808 - DNA, 16 bp, Artificial Sequence
  synthetic [barcode part1]
tatacgcgagacttcg

SEQ ID NO: 20809 - DNA, 16 bp, Artificial Sequence
  synthetic [barcode part1]
ttctctcgagaaggac

SEQ ID NO: 20810 - DNA, 16 bp, Artificial Sequence
  synthetic [barcode part1]
actcctgacttggcac

SEQ ID NO: 20811 - DNA, 16 bp, Artificial Sequence
  synthetic [barcode part1]
gtctcgccaagttcgt

SEQ ID NO: 20812 - DNA, 16 bp, Artificial Sequence
  synthetic [barcode part1]
gtcaacacggaagacc

SEQ ID NO: 20813 - DNA, 16 bp, Artificial Sequence
  synthetic [barcode part1]
cgtctgcgtgaatagt

SEQ ID NO: 20814 - DNA, 16 bp, Artificial Sequence
  synthetic [barcode part1]
acctccttgcggttag

SEQ ID NO: 20815 - DNA, 16 bp, Artificial Sequence
  synthetic [barcode part1]
gagtgccaatacttgc

SEQ ID NO: 20816 - DNA, 16 bp, Artificial Sequence
  synthetic [barcode part1]
taggccagagacacgt

SEQ ID NO: 20817 - DNA, 16 bp, Artificial Sequence
  synthetic [barcode part1]
cactgagattcctgtt

SEQ ID NO: 20818 - DNA, 16 bp, Artificial Sequence
  synthetic [barcode part1]
actcgaagtgatagac

SEQ ID NO: 20819 - DNA, 16 bp, Artificial Sequence
  synthetic [barcode part1]
gccttcttcgattctg

SEQ ID NO: 20820 - DNA, 16 bp, Artificial Sequence
  synthetic [barcode part1]
aattggtgcgcacact

SEQ ID NO: 20821 - DNA, 16 bp, Artificial Sequence
  synthetic [barcode part1]
tggcgaccaataatcc

SEQ ID NO: 20822 - DNA, 16 bp, Artificial Sequence
  synthetic [barcode part1]
gacgtgaattcctgtg

SEQ ID NO: 20823 - DNA, 16 bp, Artificial Sequence
  synthetic [barcode part1]
gttctattcgccactc

SEQ ID NO: 20824 - DNA, 16 bp, Artificial Sequence
  synthetic [barcode part1]
ttcctgactgacctct

SEQ ID NO: 20825 - DNA, 16 bp, Artificial Sequence
  synthetic [barcode part1]
ttccagttgcaggcct

SEQ ID NO: 20826 - DNA, 16 bp, Artificial Sequence
  synthetic [barcode part1]
tacacttgccttcgtc

SEQ ID NO: 20827 - DNA, 16 bp, Artificial Sequence
  synthetic [barcode part1]
acttggattgtcttgc

SEQ ID NO: 20828 - DNA, 16 bp, Artificial Sequence
  synthetic [barcode part1]
tcctggtacacttggc

SEQ ID NO: 20829 - DNA, 16 bp, Artificial Sequence
  synthetic [barcode part1]
acgactgaattctcct

SEQ ID NO: 20830 - DNA, 16 bp, Artificial Sequence
  synthetic [barcode part1]
tctaccggaagactac

SEQ ID NO: 20831 - DNA, 16 bp, Artificial Sequence
  synthetic [barcode part1]
cgtactattgaccttg

SEQ ID NO: 20832 - DNA, 16 bp, Artificial Sequence
  synthetic [barcode part1]
agtctccgactacacc

SEQ ID NO: 20833 - DNA, 16 bp, Artificial Sequence
  synthetic [barcode part1]
tgcagagtctctgtag

SEQ ID NO: 20834 - DNA, 16 bp, Artificial Sequence
  synthetic [barcode part1]
tcgacaggtgacttgt

SEQ ID NO: 20835 - DNA, 16 bp, Artificial Sequence
  synthetic [barcode part1]
tcacgttcactaggtt

SEQ ID NO: 20836 - DNA, 16 bp, Artificial Sequence
  synthetic [barcode part1]
ttgtcgcaacgaagtc

SEQ ID NO: 20837 - DNA, 16 bp, Artificial Sequence
  synthetic [barcode part1]
tgtcgaatatcaggcc

SEQ ID NO: 20838 - DNA, 16 bp, Artificial Sequence
  synthetic [barcode part1]
tggataatctaggacg

SEQ ID NO: 20839 - DNA, 16 bp, Artificial Sequence
  synthetic [barcode part1]
tagatatagaacggcc

SEQ ID NO: 20840 - DNA, 16 bp, Artificial Sequence
  synthetic [barcode part1]
agttctggcagataag

SEQ ID NO: 20841 - DNA, 16 bp, Artificial Sequence
  synthetic [barcode part1]
tctgccggtacagtct

SEQ ID NO: 20842 - DNA, 16 bp, Artificial Sequence
  synthetic [barcode part1]
atcgcaggcgatactt

SEQ ID NO: 20843 - DNA, 16 bp, Artificial Sequence
  synthetic [barcode part1]
gtggtgtggagttctt

SEQ ID NO: 20844 - DNA, 16 bp, Artificial Sequence
  synthetic [barcode part1]
atcactgtcttcacag

SEQ ID NO: 20845 - DNA, 16 bp, Artificial Sequence
  synthetic [barcode part1]
gacagaatacgttggt

SEQ ID NO: 20846 - DNA, 16 bp, Artificial Sequence
  synthetic [barcode part1]
cagaatcgtcgcaatc

SEQ ID NO: 20847 - DNA, 16 bp, Artificial Sequence
  synthetic [barcode part1]
tcgcggttgtaatacg

SEQ ID NO: 20848 - DNA, 16 bp, Artificial Sequence
  synthetic [barcode part1]
gattacgacacgtcac

SEQ ID NO: 20849 - DNA, 16 bp, Artificial Sequence
  synthetic [barcode part1]
tgaagtaacaatcgcg

SEQ ID NO: 20850 - DNA, 16 bp, Artificial Sequence
  synthetic [barcode part1]
taggatcgtactgcac

SEQ ID NO: 20851 - DNA, 16 bp, Artificial Sequence
  synthetic [barcode part1]
gagtactgaacctacc

SEQ ID NO: 20852 - DNA, 16 bp, Artificial Sequence
  synthetic [barcode part1]
cgtgtcggtattaacg

SEQ ID NO: 20853 - DNA, 16 bp, Artificial Sequence
  synthetic [barcode part1]
cagatcaggaatacac

SEQ ID NO: 20854 - DNA, 16 bp, Artificial Sequence
  synthetic [barcode part1]
tcggaataagtgaacc

SEQ ID NO: 20855 - DNA, 16 bp, Artificial Sequence
  synthetic [barcode part1]
aggcaactcagtgcag

SEQ ID NO: 20856 - DNA, 16 bp, Artificial Sequence
  synthetic [barcode part1]
taggttcgcgaatctg

SEQ ID NO: 20857 - DNA, 16 bp, Artificial Sequence
  synthetic [barcode part1]
gtgtccgatctcactg

SEQ ID NO: 20858 - DNA, 16 bp, Artificial Sequence
  synthetic [barcode part1]
ttgcgtcttgtcggac

SEQ ID NO: 20859 - DNA, 16 bp, Artificial Sequence
  synthetic [barcode part1]
ttctacggatctggtt

SEQ ID NO: 20860 - DNA, 16 bp, Artificial Sequence
  synthetic [barcode part1]
tggagtcctgactagt

SEQ ID NO: 20861 - DNA, 16 bp, Artificial Sequence
  synthetic [barcode part1]
agaagtactactggac

SEQ ID NO: 20862 - DNA, 16 bp, Artificial Sequence
  synthetic [barcode part1]
ttcgcgcgtcagactt

SEQ ID NO: 20863 - DNA, 16 bp, Artificial Sequence
  synthetic [barcode part1]
ccttctctgatcggtt

SEQ ID NO: 20864 - DNA, 16 bp, Artificial Sequence
  synthetic [barcode part1]
tgacctctgactgtgc

SEQ ID NO: 20865 - DNA, 16 bp, Artificial Sequence
  synthetic [barcode part1]
aggcctagatagtagt

SEQ ID NO: 20866 - DNA, 16 bp, Artificial Sequence
  synthetic [barcode part1]
cgaactgcctcgtgtt

SEQ ID NO: 20867 - DNA, 16 bp, Artificial Sequence
  synthetic [barcode part1]
tccttcgaagtgtccg

SEQ ID NO: 20868 - DNA, 16 bp, Artificial Sequence
  synthetic [barcode part1]
tattggccgtgatcag

SEQ ID NO: 20869 - DNA, 16 bp, Artificial Sequence
  synthetic [barcode part1]
tgtcaagtactcttgc

SEQ ID NO: 20870 - DNA, 16 bp, Artificial Sequence
  synthetic [barcode part1]
gcggaagtgtatcctt

SEQ ID NO: 20871 - DNA, 16 bp, Artificial Sequence
  synthetic [barcode part1]
tacactctctgacagt

SEQ ID NO: 20872 - DNA, 16 bp, Artificial Sequence
  synthetic [barcode part1]
aacttctgcgcgactc

SEQ ID NO: 20873 - DNA, 16 bp, Artificial Sequence
  synthetic [barcode part1]
atctagatctgccgtt

SEQ ID NO: 20874 - DNA, 16 bp, Artificial Sequence
  synthetic [barcode part1]
ataaccggttaacgcc

SEQ ID NO: 20875 - DNA, 16 bp, Artificial Sequence
  synthetic [barcode part1]
gccttgttactggtgc

SEQ ID NO: 20876 - DNA, 16 bp, Artificial Sequence
  synthetic [barcode part1]
tctatactctcgtgcc

SEQ ID NO: 20877 - DNA, 16 bp, Artificial Sequence
  synthetic [barcode part1]
acggacacttaggacg

SEQ ID NO: 20878 - DNA, 16 bp, Artificial Sequence
  synthetic [barcode part1]
aattccggtgacactg

SEQ ID NO: 20879 - DNA, 16 bp, Artificial Sequence
  synthetic [barcode part1]
agttctcgtgcaactt

SEQ ID NO: 20880 - DNA, 16 bp, Artificial Sequence
  synthetic [barcode part1]
aacaggacgactctct

SEQ ID NO: 20881 - DNA, 16 bp, Artificial Sequence
  synthetic [barcode part1]
ttgtggtctccagaag

SEQ ID NO: 20882 - DNA, 16 bp, Artificial Sequence
  synthetic [barcode part1]
tgcctaatcctcggtg

SEQ ID NO: 20883 - DNA, 16 bp, Artificial Sequence
  synthetic [barcode part1]
tctgtgaaggttcacg

SEQ ID NO: 20884 - DNA, 16 bp, Artificial Sequence
  synthetic [barcode part1]
gtcgtccgtgaactct

SEQ ID NO: 20885 - DNA, 16 bp, Artificial Sequence
  synthetic [barcode part1]
gttctagtacgcacag

SEQ ID NO: 20886 - DNA, 16 bp, Artificial Sequence
  synthetic [barcode part1]
atacgtctctaatccg

SEQ ID NO: 20887 - DNA, 16 bp, Artificial Sequence
  synthetic [barcode part1]
tgaccaagtacacgtc

SEQ ID NO: 20888 - DNA, 16 bp, Artificial Sequence
  synthetic [barcode part1]
tctcggcgttgttctt

SEQ ID NO: 20889 - DNA, 16 bp, Artificial Sequence
  synthetic [barcode part1]
tcgtcctggaataacg

SEQ ID NO: 20890 - DNA, 16 bp, Artificial Sequence
  synthetic [barcode part1]
ttccaccacgagtctg

SEQ ID NO: 20891 - DNA, 16 bp, Artificial Sequence
  synthetic [barcode part1]
agtcgcgacactaatc

SEQ ID NO: 20892 - DNA, 16 bp, Artificial Sequence
  synthetic [barcode part1]
gcactccttctacgtt

SEQ ID NO: 20893 - DNA, 16 bp, Artificial Sequence
  synthetic [barcode part1]
cacttcctaactcaag

SEQ ID NO: 20894 - DNA, 16 bp, Artificial Sequence
  synthetic [barcode part1]
cctgatctcttctgac

SEQ ID NO: 20895 - DNA, 16 bp, Artificial Sequence
  synthetic [barcode part1]
caggtacgtcagaggt

SEQ ID NO: 20896 - DNA, 16 bp, Artificial Sequence
  synthetic [barcode part1]
ttcttggcctcgatct

SEQ ID NO: 20897 - DNA, 16 bp, Artificial Sequence
  synthetic [barcode part1]
tgaccgactctctctt

SEQ ID NO: 20898 - DNA, 16 bp, Artificial Sequence
  synthetic [barcode part1]
cgacgattgcaggagt

SEQ ID NO: 20899 - DNA, 16 bp, Artificial Sequence
  synthetic [barcode part1]
caatctgatccttacg

SEQ ID NO: 20900 - DNA, 16 bp, Artificial Sequence
  synthetic [barcode part1]
gacaggtagtgtcgtg

SEQ ID NO: 20901 - DNA, 16 bp, Artificial Sequence
  synthetic [barcode part1]
cgtcgtcaacgtgtct

SEQ ID NO: 20902 - DNA, 16 bp, Artificial Sequence
  synthetic [barcode part1]
tagtggtgtcaagtcc

SEQ ID NO: 20903 - DNA, 16 bp, Artificial Sequence
  synthetic [barcode part1]
gcgtacaaccgtaact

SEQ ID NO: 20904 - DNA, 16 bp, Artificial Sequence
  synthetic [barcode part1]
gaattgtggcggttct

SEQ ID NO: 20905 - DNA, 16 bp, Artificial Sequence
  synthetic [barcode part1]
tggcacaggagactgt

SEQ ID NO: 20906 - DNA, 16 bp, Artificial Sequence
  synthetic [barcode part1]
tctaccaccggtacgt

SEQ ID NO: 20907 - DNA, 16 bp, Artificial Sequence
  synthetic [barcode part1]
gatatcgtgtgtgcac

SEQ ID NO: 20908 - DNA, 16 bp, Artificial Sequence
  synthetic [barcode part1]
tgttcgcaatactacc

SEQ ID NO: 20909 - DNA, 16 bp, Artificial Sequence
  synthetic [barcode part1]
attagttgcacacgcg

SEQ ID NO: 20910 - DNA, 16 bp, Artificial Sequence
  synthetic [barcode part1]
cagtgataatctggcc

SEQ ID NO: 20911 - DNA, 16 bp, Artificial Sequence
  synthetic [barcode part1]
cgcctgccttagaatc

SEQ ID NO: 20912 - DNA, 16 bp, Artificial Sequence
  synthetic [barcode part1]
acgataacgtctcgtg

SEQ ID NO: 20913 - DNA, 16 bp, Artificial Sequence
  synthetic [barcode part1]
tcagttgaccagtcag

SEQ ID NO: 20914 - DNA, 16 bp, Artificial Sequence
  synthetic [barcode part1]
cctgacgaagttactg

SEQ ID NO: 20915 - DNA, 16 bp, Artificial Sequence
  synthetic [barcode part1]
tgttggagtaggaatc

SEQ ID NO: 20916 - DNA, 16 bp, Artificial Sequence
  synthetic [barcode part1]
tgccactgttcaggtc

SEQ ID NO: 20917 - DNA, 16 bp, Artificial Sequence
  synthetic [barcode part1]
tgtgcctcagatcacc

SEQ ID NO: 20918 - DNA, 16 bp, Artificial Sequence
  synthetic [barcode part1]
gtgactgcctctcagt

SEQ ID NO: 20919 - DNA, 16 bp, Artificial Sequence
  synthetic [barcode part1]
cggccgatagtattgt

SEQ ID NO: 20920 - DNA, 16 bp, Artificial Sequence
  synthetic [barcode part1]
gttgttggatcaccag

SEQ ID NO: 20921 - DNA, 16 bp, Artificial Sequence
  synthetic [barcode part1]
tattgatcgtggccag

SEQ ID NO: 20922 - DNA, 16 bp, Artificial Sequence
  synthetic [barcode part1]
tgcgtggagattggac

SEQ ID NO: 20923 - DNA, 16 bp, Artificial Sequence
  synthetic [barcode part1]
tatccgatacagaccg

SEQ ID NO: 20924 - DNA, 16 bp, Artificial Sequence
  synthetic [barcode part1]
tgtcttgcactcaagt

SEQ ID NO: 20925 - DNA, 16 bp, Artificial Sequence
  synthetic [barcode part1]
gcggcacgtatatact

SEQ ID NO: 20926 - DNA, 16 bp, Artificial Sequence
  synthetic [barcode part1]
cagaccggaagatacc

SEQ ID NO: 20927 - DNA, 16 bp, Artificial Sequence
  synthetic [barcode part1]
atacgcggactaacct

SEQ ID NO: 20928 - DNA, 16 bp, Artificial Sequence
  synthetic [barcode part1]
ttaactccggaggatc

SEQ ID NO: 20929 - DNA, 16 bp, Artificial Sequence
  synthetic [barcode part1]
aactattgtggagacg

SEQ ID NO: 20930 - DNA, 16 bp, Artificial Sequence
  synthetic [barcode part1]
tcgcctatcacagtgc

SEQ ID NO: 20931 - DNA, 16 bp, Artificial Sequence
  synthetic [barcode part1]
aagttgcgttcggtac

SEQ ID NO: 20932 - DNA, 16 bp, Artificial Sequence
  synthetic [barcode part1]
acacttgtcgtagacg

SEQ ID NO: 20933 - DNA, 16 bp, Artificial Sequence
  synthetic [barcode part1]
gtgaactaggacgacc

SEQ ID NO: 20934 - DNA, 16 bp, Artificial Sequence
  synthetic [barcode part1]
tgactactgtcttgtg

SEQ ID NO: 20935 - DNA, 16 bp, Artificial Sequence
  synthetic [barcode part1]
cgtataatcgccactt

SEQ ID NO: 20936 - DNA, 16 bp, Artificial Sequence
  synthetic [barcode part1]
atctccgagtgacctc

SEQ ID NO: 20937 - DNA, 16 bp, Artificial Sequence
  synthetic [barcode part1]
gcctggtctcctatag

SEQ ID NO: 20938 - DNA, 16 bp, Artificial Sequence
  synthetic [barcode part1]
agacgtccttagacgt

SEQ ID NO: 20939 - DNA, 16 bp, Artificial Sequence
  synthetic [barcode part1]
aagaacgacgatctgt

SEQ ID NO: 20940 - DNA, 16 bp, Artificial Sequence
  synthetic [barcode part1]
gaacaggcctattcac

SEQ ID NO: 20941 - DNA, 16 bp, Artificial Sequence
  synthetic [barcode part1]
gtatagtcggtcacgt

SEQ ID NO: 20942 - DNA, 16 bp, Artificial Sequence
  synthetic [barcode part1]
aagacctgatatcgcc

SEQ ID NO: 20943 - DNA, 16 bp, Artificial Sequence
  synthetic [barcode part1]
caacctcttaacctcc

SEQ ID NO: 20944 - DNA, 16 bp, Artificial Sequence
  synthetic [barcode part1]
gttcacttccagagtt

SEQ ID NO: 20945 - DNA, 16 bp, Artificial Sequence
  synthetic [barcode part1]
tctccaggtattgatc

SEQ ID NO: 20946 - DNA, 16 bp, Artificial Sequence
  synthetic [barcode part1]
tcggagagaagtaacg

SEQ ID NO: 20947 - DNA, 16 bp, Artificial Sequence
  synthetic [barcode part1]
cctaaccgtacactgc

SEQ ID NO: 20948 - DNA, 16 bp, Artificial Sequence
  synthetic [barcode part1]
tgaggtccggtattgt

SEQ ID NO: 20949 - DNA, 16 bp, Artificial Sequence
  synthetic [barcode part1]
cgtcggtagttggaag

SEQ ID NO: 20950 - DNA, 16 bp, Artificial Sequence
  synthetic [barcode part1]
cctcacagtcaggttc

SEQ ID NO: 20951 - DNA, 16 bp, Artificial Sequence
  synthetic [barcode part1]
ttgcagtgtgtgtgtg

SEQ ID NO: 20952 - DNA, 16 bp, Artificial Sequence
  synthetic [barcode part1]
tcgatcctcactgttc

SEQ ID NO: 20953 - DNA, 16 bp, Artificial Sequence
  synthetic [barcode part1]
gtagtggtcgttatcg

SEQ ID NO: 20954 - DNA, 16 bp, Artificial Sequence
  synthetic [barcode part1]
aacgcaggcagtctag

SEQ ID NO: 20955 - DNA, 16 bp, Artificial Sequence
  synthetic [barcode part1]
tccagattagaagacg

SEQ ID NO: 20956 - DNA, 16 bp, Artificial Sequence
  synthetic [barcode part1]
cctcaactcgagtgtc

SEQ ID NO: 20957 - DNA, 16 bp, Artificial Sequence
  synthetic [barcode part1]
attctcactgtgcctc

SEQ ID NO: 20958 - DNA, 16 bp, Artificial Sequence
  synthetic [barcode part1]
ttcacgtggttcagtt

SEQ ID NO: 20959 - DNA, 16 bp, Artificial Sequence
  synthetic [barcode part1]
attcgacgcactcctg

SEQ ID NO: 20960 - DNA, 16 bp, Artificial Sequence
  synthetic [barcode part1]
agaacctcctatccgc

SEQ ID NO: 20961 - DNA, 16 bp, Artificial Sequence
  synthetic [barcode part1]
cctggaaccttgaagt

SEQ ID NO: 20962 - DNA, 16 bp, Artificial Sequence
  synthetic [barcode part1]
agtgttctctgtggag

SEQ ID NO: 20963 - DNA, 16 bp, Artificial Sequence
  synthetic [barcode part1]
gtctagtgaagatacg

SEQ ID NO: 20964 - DNA, 16 bp, Artificial Sequence
  synthetic [barcode part1]
aatctaagaaggtgcc

SEQ ID NO: 20965 - DNA, 16 bp, Artificial Sequence
  synthetic [barcode part1]
tacactgttggaagag

SEQ ID NO: 20966 - DNA, 16 bp, Artificial Sequence
  synthetic [barcode part1]
aagtccgtgagtctgt

SEQ ID NO: 20967 - DNA, 16 bp, Artificial Sequence
  synthetic [barcode part1]
gagtcttgaggagaag

SEQ ID NO: 20968 - DNA, 16 bp, Artificial Sequence
  synthetic [barcode part1]
tccaacaggcacgaag

SEQ ID NO: 20969 - DNA, 16 bp, Artificial Sequence
  synthetic [barcode part1]
cgtggattatcgtctt

SEQ ID NO: 20970 - DNA, 16 bp, Artificial Sequence
  synthetic [barcode part1]
cctctactgaaggtag

SEQ ID NO: 20971 - DNA, 16 bp, Artificial Sequence
  synthetic [barcode part1]
acgtgatcaatacgcc

SEQ ID NO: 20972 - DNA, 16 bp, Artificial Sequence
  synthetic [barcode part1]
aggacagttgttccac

SEQ ID NO: 20973 - DNA, 16 bp, Artificial Sequence
  synthetic [barcode part1]
gtcaggttgagtcgtt

SEQ ID NO: 20974 - DNA, 16 bp, Artificial Sequence
  synthetic [barcode part1]
ttgattctgccggtgc

SEQ ID NO: 20975 - DNA, 16 bp, Artificial Sequence
  synthetic [barcode part1]
agacctgtgccttatt

SEQ ID NO: 20976 - DNA, 16 bp, Artificial Sequence
  synthetic [barcode part1]
taggtgtgaggcagtc

SEQ ID NO: 20977 - DNA, 16 bp, Artificial Sequence
  synthetic [barcode part1]
gactgttgtccgatag

SEQ ID NO: 20978 - DNA, 16 bp, Artificial Sequence
  synthetic [barcode part1]
tgatcgtggtggcaag

SEQ ID NO: 20979 - DNA, 16 bp, Artificial Sequence
  synthetic [barcode part1]
aattcggttaggtcgc

SEQ ID NO: 20980 - DNA, 16 bp, Artificial Sequence
  synthetic [barcode part1]
cacgtagaacggcagt

SEQ ID NO: 20981 - DNA, 16 bp, Artificial Sequence
  synthetic [barcode part1]
tacctccgtgtagaag

SEQ ID NO: 20982 - DNA, 16 bp, Artificial Sequence
  synthetic [barcode part1]
accttcctcaatctcg

SEQ ID NO: 20983 - DNA, 16 bp, Artificial Sequence
  synthetic [barcode part1]
tggtgtgtacggatct

SEQ ID NO: 20984 - DNA, 16 bp, Artificial Sequence
  synthetic [barcode part1]
tgccgtcgaacacctt

SEQ ID NO: 20985 - DNA, 16 bp, Artificial Sequence
  synthetic [barcode part1]
taaccaccgaacctag

SEQ ID NO: 20986 - DNA, 16 bp, Artificial Sequence
  synthetic [barcode part1]
tgcctcgtactatcct

SEQ ID NO: 20987 - DNA, 16 bp, Artificial Sequence
  synthetic [barcode part1]
tggtacaactatctcc

SEQ ID NO: 20988 - DNA, 16 bp, Artificial Sequence
  synthetic [barcode part1]
gaacactgaatccgtc

SEQ ID NO: 20989 - DNA, 16 bp, Artificial Sequence
  synthetic [barcode part1]
gtataaccttcctggt

SEQ ID NO: 20990 - DNA, 16 bp, Artificial Sequence
  synthetic [barcode part1]
gaccagaggattagag

SEQ ID NO: 20991 - DNA, 16 bp, Artificial Sequence
  synthetic [barcode part1]
gaagttagaccacgcg

SEQ ID NO: 20992 - DNA, 16 bp, Artificial Sequence
  synthetic [barcode part1]
cgcgcaattgttgtcc

SEQ ID NO: 20993 - DNA, 16 bp, Artificial Sequence
  synthetic [barcode part1]
tagtcctgtgcaccgt

SEQ ID NO: 20994 - DNA, 16 bp, Artificial Sequence
  synthetic [barcode part1]
tctgcacagagtacac

SEQ ID NO: 20995 - DNA, 16 bp, Artificial Sequence
  synthetic [barcode part1]
tattccttctcgcgtg

SEQ ID NO: 20996 - DNA, 16 bp, Artificial Sequence
  synthetic [barcode part1]
tgtcgtcaatacactc

SEQ ID NO: 20997 - DNA, 16 bp, Artificial Sequence
  synthetic [barcode part1]
cgcaagtgttccgtct

SEQ ID NO: 20998 - DNA, 16 bp, Artificial Sequence
  synthetic [barcode part1]
caactccgtgttggtc

SEQ ID NO: 20999 - DNA, 16 bp, Artificial Sequence
  synthetic [barcode part1]
agaccagtgatatacg

SEQ ID NO: 21000 - DNA, 16 bp, Artificial Sequence
  synthetic [barcode part1]
tcgatcctattccgtc

SEQ ID NO: 21001 - DNA, 16 bp, Artificial Sequence
  synthetic [barcode part1]
tgatcacctgtgcaag

SEQ ID NO: 21002 - DNA, 16 bp, Artificial Sequence
  synthetic [barcode part1]
cgagagttatcggacg

SEQ ID NO: 21003 - DNA, 16 bp, Artificial Sequence
  synthetic [barcode part1]
gtcggcgacttagatt

SEQ ID NO: 21004 - DNA, 16 bp, Artificial Sequence
  synthetic [barcode part1]
agaccgcgttcctatc

SEQ ID NO: 21005 - DNA, 16 bp, Artificial Sequence
  synthetic [barcode part1]
gattcggagttaccgt

SEQ ID NO: 21006 - DNA, 16 bp, Artificial Sequence
  synthetic [barcode part1]
tacacgtgttgtgacg

SEQ ID NO: 21007 - DNA, 16 bp, Artificial Sequence
  synthetic [barcode part1]
tgtattcacttggcac

SEQ ID NO: 21008 - DNA, 16 bp, Artificial Sequence
  synthetic [barcode part1]
ttgtaggagtggcgac

SEQ ID NO: 21009 - DNA, 16 bp, Artificial Sequence
  synthetic [barcode part1]
attcgttggactctac

SEQ ID NO: 21010 - DNA, 16 bp, Artificial Sequence
  synthetic [barcode part1]
ttgtggttcgagatcg

SEQ ID NO: 21011 - DNA, 16 bp, Artificial Sequence
  synthetic [barcode part1]
gttgtagacttcggac

SEQ ID NO: 21012 - DNA, 16 bp, Artificial Sequence
  synthetic [barcode part1]
tcgtgtatacacggtg

SEQ ID NO: 21013 - DNA, 16 bp, Artificial Sequence
  synthetic [barcode part1]
aaggatacggattacc

SEQ ID NO: 21014 - DNA, 16 bp, Artificial Sequence
  synthetic [barcode part1]
aagaggaggaaggaag

SEQ ID NO: 21015 - DNA, 16 bp, Artificial Sequence
  synthetic [barcode part1]
gtaggcagaataggtg

SEQ ID NO: 21016 - DNA, 16 bp, Artificial Sequence
  synthetic [barcode part1]
tgaatcgcctccgtac

SEQ ID NO: 21017 - DNA, 16 bp, Artificial Sequence
  synthetic [barcode part1]
tagacgtagtcacgtc

SEQ ID NO: 21018 - DNA, 16 bp, Artificial Sequence
  synthetic [barcode part1]
atcgagtgtccaacac

SEQ ID NO: 21019 - DNA, 16 bp, Artificial Sequence
  synthetic [barcode part1]
gtctaagtacctaggc

SEQ ID NO: 21020 - DNA, 16 bp, Artificial Sequence
  synthetic [barcode part1]
gcaagaagttgtcagt

SEQ ID NO: 21021 - DNA, 16 bp, Artificial Sequence
  synthetic [barcode part1]
cgtgcgaagtaacgac

SEQ ID NO: 21022 - DNA, 16 bp, Artificial Sequence
  synthetic [barcode part1]
gtcttgtggtagtggt

SEQ ID NO: 21023 - DNA, 16 bp, Artificial Sequence
  synthetic [barcode part1]
agtgtgtagaaggttc

SEQ ID NO: 21024 - DNA, 16 bp, Artificial Sequence
  synthetic [barcode part1]
aagtccacggacttac

SEQ ID NO: 21025 - DNA, 16 bp, Artificial Sequence
  synthetic [barcode part1]
aactcacagatctgcg

SEQ ID NO: 21026 - DNA, 16 bp, Artificial Sequence
  synthetic [barcode part1]
ttaaccgcaattggcg

SEQ ID NO: 21027 - DNA, 16 bp, Artificial Sequence
  synthetic [barcode part1]
gatcggtattggtcgt

SEQ ID NO: 21028 - DNA, 16 bp, Artificial Sequence
  synthetic [barcode part1]
gtcagttgtatacgcg

SEQ ID NO: 21029 - DNA, 16 bp, Artificial Sequence
  synthetic [barcode part1]
tgtataggtggccgtt

SEQ ID NO: 21030 - DNA, 16 bp, Artificial Sequence
  synthetic [barcode part1]
ttcacgattacggacg

SEQ ID NO: 21031 - DNA, 16 bp, Artificial Sequence
  synthetic [barcode part1]
caagactagaacctcc

SEQ ID NO: 21032 - DNA, 16 bp, Artificial Sequence
  synthetic [barcode part1]
gtgtgactgtggttgt

SEQ ID NO: 21033 - DNA, 16 bp, Artificial Sequence
  synthetic [barcode part1]
tgttaaggtctccact

SEQ ID NO: 21034 - DNA, 16 bp, Artificial Sequence
  synthetic [barcode part1]
acaccgaatacggtct

SEQ ID NO: 21035 - DNA, 16 bp, Artificial Sequence
  synthetic [barcode part1]
tgtcacaactgtgacg

SEQ ID NO: 21036 - DNA, 16 bp, Artificial Sequence
  synthetic [barcode part1]
acctgtagttactctg

SEQ ID NO: 21037 - DNA, 16 bp, Artificial Sequence
  synthetic [barcode part1]
tgtggatccgtagatc

SEQ ID NO: 21038 - DNA, 16 bp, Artificial Sequence
  synthetic [barcode part1]
gtcgcagatagtatcc

SEQ ID NO: 21039 - DNA, 16 bp, Artificial Sequence
  synthetic [barcode part1]
tgtctgtcttggagtt

SEQ ID NO: 21040 - DNA, 16 bp, Artificial Sequence
  synthetic [barcode part1]
tagaggactggtcctt

SEQ ID NO: 21041 - DNA, 16 bp, Artificial Sequence
  synthetic [barcode part1]
ttggcagtgtcaggtt

SEQ ID NO: 21042 - DNA, 16 bp, Artificial Sequence
  synthetic [barcode part1]
ttacggaagattaggc

SEQ ID NO: 21043 - DNA, 16 bp, Artificial Sequence
  synthetic [barcode part1]
tattaccgcgagacac

SEQ ID NO: 21044 - DNA, 16 bp, Artificial Sequence
  synthetic [barcode part1]
tctcgtcacagtagag

SEQ ID NO: 21045 - DNA, 16 bp, Artificial Sequence
  synthetic [barcode part1]
agttgcagtacgtcac

SEQ ID NO: 21046 - DNA, 16 bp, Artificial Sequence
  synthetic [barcode part1]
cctccggtaattgcac

SEQ ID NO: 21047 - DNA, 16 bp, Artificial Sequence
  synthetic [barcode part1]
tggttaggagaggaac

SEQ ID NO: 21048 - DNA, 16 bp, Artificial Sequence
  synthetic [barcode part1]
gcgcaactaatacgtc

SEQ ID NO: 21049 - DNA, 16 bp, Artificial Sequence
  synthetic [barcode part1]
gactcctgattcgcac

SEQ ID NO: 21050 - DNA, 16 bp, Artificial Sequence
  synthetic [barcode part1]
gtgtggttgacacgtt

SEQ ID NO: 21051 - DNA, 16 bp, Artificial Sequence
  synthetic [barcode part1]
gtcaggcaagtataac

SEQ ID NO: 21052 - DNA, 16 bp, Artificial Sequence
  synthetic [barcode part1]
ttctgacgcgcagtct

SEQ ID NO: 21053 - DNA, 16 bp, Artificial Sequence
  synthetic [barcode part1]
agagagagttacggtg

SEQ ID NO: 21054 - DNA, 16 bp, Artificial Sequence
  synthetic [barcode part1]
atatccgattcgcgag

SEQ ID NO: 21055 - DNA, 16 bp, Artificial Sequence
  synthetic [barcode part1]
gtccggttagtagttg

SEQ ID NO: 21056 - DNA, 16 bp, Artificial Sequence
  synthetic [barcode part1]
gatctcagtctatctg

SEQ ID NO: 21057 - DNA, 16 bp, Artificial Sequence
  synthetic [barcode part1]
cagttctctccagtct

SEQ ID NO: 21058 - DNA, 16 bp, Artificial Sequence
  synthetic [barcode part1]
tggtacgcgtatcagt

SEQ ID NO: 21059 - DNA, 16 bp, Artificial Sequence
  synthetic [barcode part1]
tctcgtggccaagttc

SEQ ID NO: 21060 - DNA, 16 bp, Artificial Sequence
  synthetic [barcode part1]
tacgtacacacacacg

SEQ ID NO: 21061 - DNA, 16 bp, Artificial Sequence
  synthetic [barcode part1]
gcgtgtatctcagagt

SEQ ID NO: 21062 - DNA, 16 bp, Artificial Sequence
  synthetic [barcode part1]
gataacctcttacacc

SEQ ID NO: 21063 - DNA, 16 bp, Artificial Sequence
  synthetic [barcode part1]
caatacacgtgccagt

SEQ ID NO: 21064 - DNA, 16 bp, Artificial Sequence
  synthetic [barcode part1]
tggtatcctatctacg

SEQ ID NO: 21065 - DNA, 16 bp, Artificial Sequence
  synthetic [barcode part1]
aacacgtaaccttctc

SEQ ID NO: 21066 - DNA, 16 bp, Artificial Sequence
  synthetic [barcode part1]
tacggacggtgaggtt

SEQ ID NO: 21067 - DNA, 16 bp, Artificial Sequence
  synthetic [barcode part1]
tctacgtcgcgttctt

SEQ ID NO: 21068 - DNA, 16 bp, Artificial Sequence
  synthetic [barcode part1]
gtatcagatcgcctcc

SEQ ID NO: 21069 - DNA, 16 bp, Artificial Sequence
  synthetic [barcode part1]
acaccggtcttcaacc

SEQ ID NO: 21070 - DNA, 16 bp, Artificial Sequence
  synthetic [barcode part1]
taatcctctcttcggc

SEQ ID NO: 21071 - DNA, 16 bp, Artificial Sequence
  synthetic [barcode part1]
attaacgcctgcgagt

SEQ ID NO: 21072 - DNA, 16 bp, Artificial Sequence
  synthetic [barcode part1]
acgccggttctcaact

SEQ ID NO: 21073 - DNA, 16 bp, Artificial Sequence
  synthetic [barcode part1]
tcacgtccgaattgcc

SEQ ID NO: 21074 - DNA, 16 bp, Artificial Sequence
  synthetic [barcode part1]
gagttgcgcaggaact

SEQ ID NO: 21075 - DNA, 16 bp, Artificial Sequence
  synthetic [barcode part1]
tggacgaacttgtctg

SEQ ID NO: 21076 - DNA, 16 bp, Artificial Sequence
  synthetic [barcode part1]
actgtccacgaacctc

SEQ ID NO: 21077 - DNA, 16 bp, Artificial Sequence
  synthetic [barcode part1]
cgtagactcgcgaatt

SEQ ID NO: 21078 - DNA, 16 bp, Artificial Sequence
  synthetic [barcode part1]
aggttacggcgtgaac

SEQ ID NO: 21079 - DNA, 16 bp, Artificial Sequence
  synthetic [barcode part1]
gaagtataccgccgag

SEQ ID NO: 21080 - DNA, 16 bp, Artificial Sequence
  synthetic [barcode part1]
ccaaccttaagaggtc

SEQ ID NO: 21081 - DNA, 16 bp, Artificial Sequence
  synthetic [barcode part1]
agaccgtacagagatt

SEQ ID NO: 21082 - DNA, 16 bp, Artificial Sequence
  synthetic [barcode part1]
cgcaacagtggtatct

SEQ ID NO: 21083 - DNA, 16 bp, Artificial Sequence
  synthetic [barcode part1]
cgtgaattgtccgaac

SEQ ID NO: 21084 - DNA, 16 bp, Artificial Sequence
  synthetic [barcode part1]
tattggaaggtcgcct

SEQ ID NO: 21085 - DNA, 16 bp, Artificial Sequence
  synthetic [barcode part1]
aggatagtcgtaggtt

SEQ ID NO: 21086 - DNA, 16 bp, Artificial Sequence
  synthetic [barcode part1]
tcacgtcacttctgtc

SEQ ID NO: 21087 - DNA, 16 bp, Artificial Sequence
  synthetic [barcode part1]
tgagttggactaccac

SEQ ID NO: 21088 - DNA, 16 bp, Artificial Sequence
  synthetic [barcode part1]
aacaccttaccttgtg

SEQ ID NO: 21089 - DNA, 16 bp, Artificial Sequence
  synthetic [barcode part1]
tctctctatcagtcgc

SEQ ID NO: 21090 - DNA, 16 bp, Artificial Sequence
  synthetic [barcode part1]
agtcggccagttaatc

SEQ ID NO: 21091 - DNA, 16 bp, Artificial Sequence
  synthetic [barcode part1]
agtgtggtagaccgtg

SEQ ID NO: 21092 - DNA, 16 bp, Artificial Sequence
  synthetic [barcode part1]
gcacttcttgacgacc

SEQ ID NO: 21093 - DNA, 16 bp, Artificial Sequence
  synthetic [barcode part1]
acgaatcctggatacc

SEQ ID NO: 21094 - DNA, 16 bp, Artificial Sequence
  synthetic [barcode part1]
acttaccacctgtcct

SEQ ID NO: 21095 - DNA, 16 bp, Artificial Sequence
  synthetic [barcode part1]
tacaacacactcacct

SEQ ID NO: 21096 - DNA, 16 bp, Artificial Sequence
  synthetic [barcode part1]
aatcttcgcactcggc

SEQ ID NO: 21097 - DNA, 16 bp, Artificial Sequence
  synthetic [barcode part1]
gaggtccttacttgcc

SEQ ID NO: 21098 - DNA, 16 bp, Artificial Sequence
  synthetic [barcode part1]
tgcgtgaaggtatcct

SEQ ID NO: 21099 - DNA, 16 bp, Artificial Sequence
  synthetic [barcode part1]
accagttccagttgag

SEQ ID NO: 21100 - DNA, 16 bp, Artificial Sequence
  synthetic [barcode part1]
tctccggtacgtggtt

SEQ ID NO: 21101 - DNA, 16 bp, Artificial Sequence
  synthetic [barcode part1]
acaagagtggcgacct

SEQ ID NO: 21102 - DNA, 16 bp, Artificial Sequence
  synthetic [barcode part1]
ttcagtccacaatcgt

SEQ ID NO: 21103 - DNA, 16 bp, Artificial Sequence
  synthetic [barcode part1]
tgtgcctcttacactc

SEQ ID NO: 21104 - DNA, 16 bp, Artificial Sequence
  synthetic [barcode part1]
aacacctctgtcaccg

SEQ ID NO: 21105 - DNA, 16 bp, Artificial Sequence
  synthetic [barcode part1]
gaactcttcggtcaag

SEQ ID NO: 21106 - DNA, 16 bp, Artificial Sequence
  synthetic [barcode part1]
gatcacgaactgaagt

SEQ ID NO: 21107 - DNA, 16 bp, Artificial Sequence
  synthetic [barcode part1]
aagacggcaggtgttc

SEQ ID NO: 21108 - DNA, 16 bp, Artificial Sequence
  synthetic [barcode part1]
tccaccgttaggcgtt

SEQ ID NO: 21109 - DNA, 16 bp, Artificial Sequence
  synthetic [barcode part1]
attcgccagtaccgtc

SEQ ID NO: 21110 - DNA, 16 bp, Artificial Sequence
  synthetic [barcode part1]
agattacagacgtggt

SEQ ID NO: 21111 - DNA, 16 bp, Artificial Sequence
  synthetic [barcode part1]
atcaacgccactgtcc

SEQ ID NO: 21112 - DNA, 16 bp, Artificial Sequence
  synthetic [barcode part1]
gcaacgtggagttctt

SEQ ID NO: 21113 - DNA, 16 bp, Artificial Sequence
  synthetic [barcode part1]
tcgcacgtctcttgag

SEQ ID NO: 21114 - DNA, 16 bp, Artificial Sequence
  synthetic [barcode part1]
cagtgattacaccttc

SEQ ID NO: 21115 - DNA, 16 bp, Artificial Sequence
  synthetic [barcode part1]
atcctccgttgtgcag

SEQ ID NO: 21116 - DNA, 16 bp, Artificial Sequence
  synthetic [barcode part1]
taccagactcgtattc

SEQ ID NO: 21117 - DNA, 16 bp, Artificial Sequence
  synthetic [barcode part1]
gcaggaagacctagtc

SEQ ID NO: 21118 - DNA, 16 bp, Artificial Sequence
  synthetic [barcode part1]
acttgaccgatccaag

SEQ ID NO: 21119 - DNA, 16 bp, Artificial Sequence
  synthetic [barcode part1]
gcgttatcaggacttg

SEQ ID NO: 21120 - DNA, 16 bp, Artificial Sequence
  synthetic [barcode part1]
cgcgtgtgtactatag

SEQ ID NO: 21121 - DNA, 16 bp, Artificial Sequence
  synthetic [barcode part1]
cacgtgcgattgattg

SEQ ID NO: 21122 - DNA, 16 bp, Artificial Sequence
  synthetic [barcode part1]
gtgtaacgtgcgttac

SEQ ID NO: 21123 - DNA, 16 bp, Artificial Sequence
  synthetic [barcode part1]
cctacgtaagagtacc

SEQ ID NO: 21124 - DNA, 16 bp, Artificial Sequence
  synthetic [barcode part1]
tgatagagtggattcg

SEQ ID NO: 21125 - DNA, 16 bp, Artificial Sequence
  synthetic [barcode part1]
ttcgcaccgacgattc

SEQ ID NO: 21126 - DNA, 16 bp, Artificial Sequence
  synthetic [barcode part1]
tacaggcactctactt

SEQ ID NO: 21127 - DNA, 16 bp, Artificial Sequence
  synthetic [barcode part1]
taaccaaggccaacct

SEQ ID NO: 21128 - DNA, 16 bp, Artificial Sequence
  synthetic [barcode part1]
gactagttagtcgacc

SEQ ID NO: 21129 - DNA, 16 bp, Artificial Sequence
  synthetic [barcode part1]
gacgttgagtcaacct

SEQ ID NO: 21130 - DNA, 16 bp, Artificial Sequence
  synthetic [barcode part1]
ttgacggaagtgtagt

SEQ ID NO: 21131 - DNA, 16 bp, Artificial Sequence
  synthetic [barcode part1]
cacctctgagatacag

SEQ ID NO: 21132 - DNA, 16 bp, Artificial Sequence
  synthetic [barcode part1]
tcttcagacgtcagtt

SEQ ID NO: 21133 - DNA, 16 bp, Artificial Sequence
  synthetic [barcode part1]
tctccagtaacgcacc

SEQ ID NO: 21134 - DNA, 16 bp, Artificial Sequence
  synthetic [barcode part1]
attactaccaggccag

SEQ ID NO: 21135 - DNA, 16 bp, Artificial Sequence
  synthetic [barcode part1]
gtgcgaagtagtccag

SEQ ID NO: 21136 - DNA, 16 bp, Artificial Sequence
  synthetic [barcode part1]
aagaactcgtgcgacg

SEQ ID NO: 21137 - DNA, 16 bp, Artificial Sequence
  synthetic [barcode part1]
tagaggcggtgacttg

SEQ ID NO: 21138 - DNA, 16 bp, Artificial Sequence
  synthetic [barcode part1]
gtcgaccgattaatcg

SEQ ID NO: 21139 - DNA, 16 bp, Artificial Sequence
  synthetic [barcode part1]
aacaccaattacggcc

SEQ ID NO: 21140 - DNA, 16 bp, Artificial Sequence
  synthetic [barcode part1]
gttataagaacggacc

SEQ ID NO: 21141 - DNA, 16 bp, Artificial Sequence
  synthetic [barcode part1]
aagtgcctctactgtt

SEQ ID NO: 21142 - DNA, 16 bp, Artificial Sequence
  synthetic [barcode part1]
acgacgttacgtgtgt

SEQ ID NO: 21143 - DNA, 16 bp, Artificial Sequence
  synthetic [barcode part1]
gactaacttgactggc

SEQ ID NO: 21144 - DNA, 16 bp, Artificial Sequence
  synthetic [barcode part1]
actgcaatccgtccac

SEQ ID NO: 21145 - DNA, 16 bp, Artificial Sequence
  synthetic [barcode part1]
aagataagtccacggt

SEQ ID NO: 21146 - DNA, 16 bp, Artificial Sequence
  synthetic [barcode part1]
gtgattcctcggtaag

SEQ ID NO: 21147 - DNA, 16 bp, Artificial Sequence
  synthetic [barcode part1]
ataccgttgagtagag

SEQ ID NO: 21148 - DNA, 16 bp, Artificial Sequence
  synthetic [barcode part1]
caattctcctcagtcc

SEQ ID NO: 21149 - DNA, 16 bp, Artificial Sequence
  synthetic [barcode part1]
atcggaccaggaacgt

SEQ ID NO: 21150 - DNA, 16 bp, Artificial Sequence
  synthetic [barcode part1]
caactcctcttgactc

SEQ ID NO: 21151 - DNA, 16 bp, Artificial Sequence
  synthetic [barcode part1]
caagatatccacgaag

SEQ ID NO: 21152 - DNA, 16 bp, Artificial Sequence
  synthetic [barcode part1]
tgaaggacgactgcgt

SEQ ID NO: 21153 - DNA, 16 bp, Artificial Sequence
  synthetic [barcode part1]
cacgcaacaagtctgt

SEQ ID NO: 21154 - DNA, 16 bp, Artificial Sequence
  synthetic [barcode part1]
attgaaggcacactag

SEQ ID NO: 21155 - DNA, 16 bp, Artificial Sequence
  synthetic [barcode part1]
tgcggcacactataac

SEQ ID NO: 21156 - DNA, 16 bp, Artificial Sequence
  synthetic [barcode part1]
accgcaggtaatatcc

SEQ ID NO: 21157 - DNA, 16 bp, Artificial Sequence
  synthetic [barcode part1]
atccggaataggcctt

SEQ ID NO: 21158 - DNA, 16 bp, Artificial Sequence
  synthetic [barcode part1]
tggtcctctctaatcc

SEQ ID NO: 21159 - DNA, 16 bp, Artificial Sequence
  synthetic [barcode part1]
ccgacggtgaattact

SEQ ID NO: 21160 - DNA, 16 bp, Artificial Sequence
  synthetic [barcode part1]
gccgatagaattaggt

SEQ ID NO: 21161 - DNA, 16 bp, Artificial Sequence
  synthetic [barcode part1]
ttcacaggtgagtctg

SEQ ID NO: 21162 - DNA, 16 bp, Artificial Sequence
  synthetic [barcode part1]
tccttggtcgaagaac

SEQ ID NO: 21163 - DNA, 16 bp, Artificial Sequence
  synthetic [barcode part1]
tcactataacgtccac

SEQ ID NO: 21164 - DNA, 16 bp, Artificial Sequence
  synthetic [barcode part1]
actcctaacctccgtt

SEQ ID NO: 21165 - DNA, 16 bp, Artificial Sequence
  synthetic [barcode part1]
tctaactgcgttggcc

SEQ ID NO: 21166 - DNA, 16 bp, Artificial Sequence
  synthetic [barcode part1]
cggtgtaggaataact

SEQ ID NO: 21167 - DNA, 16 bp, Artificial Sequence
  synthetic [barcode part1]
cagtggacaagtaccg

SEQ ID NO: 21168 - DNA, 16 bp, Artificial Sequence
  synthetic [barcode part1]
cgccaagatctagtac

SEQ ID NO: 21169 - DNA, 16 bp, Artificial Sequence
  synthetic [barcode part1]
caaccggaagatcttc

SEQ ID NO: 21170 - DNA, 16 bp, Artificial Sequence
  synthetic [barcode part1]
ttgccacctgcagatc

SEQ ID NO: 21171 - DNA, 16 bp, Artificial Sequence
  synthetic [barcode part1]
attaccggtcgtcaag

SEQ ID NO: 21172 - DNA, 16 bp, Artificial Sequence
  synthetic [barcode part1]
agttcggaccgaactt

SEQ ID NO: 21173 - DNA, 16 bp, Artificial Sequence
  synthetic [barcode part1]
gtaattgagaggacct

SEQ ID NO: 21174 - DNA, 16 bp, Artificial Sequence
  synthetic [barcode part1]
agtctgaactggactc

SEQ ID NO: 21175 - DNA, 16 bp, Artificial Sequence
  synthetic [barcode part1]
gcactagaagaatcgt

SEQ ID NO: 21176 - DNA, 16 bp, Artificial Sequence
  synthetic [barcode part1]
cgcggagttcttatag

SEQ ID NO: 21177 - DNA, 16 bp, Artificial Sequence
  synthetic [barcode part1]
atcgcaggacgaacgt

SEQ ID NO: 21178 - DNA, 16 bp, Artificial Sequence
  synthetic [barcode part1]
gttggaggatcttctg

SEQ ID NO: 21179 - DNA, 16 bp, Artificial Sequence
  synthetic [barcode part1]
ttccagaccactcacg

SEQ ID NO: 21180 - DNA, 16 bp, Artificial Sequence
  synthetic [barcode part1]
gatcacagaggccaac

SEQ ID NO: 21181 - DNA, 16 bp, Artificial Sequence
  synthetic [barcode part1]
aacgactagaatacgc

SEQ ID NO: 21182 - DNA, 16 bp, Artificial Sequence
  synthetic [barcode part1]
tactaggaacggttcc

SEQ ID NO: 21183 - DNA, 16 bp, Artificial Sequence
  synthetic [barcode part1]
gcgcacaattacaacc

SEQ ID NO: 21184 - DNA, 16 bp, Artificial Sequence
  synthetic [barcode part1]
tcagttccgaggaact

SEQ ID NO: 21185 - DNA, 16 bp, Artificial Sequence
  synthetic [barcode part1]
taccaggtaccgaact

SEQ ID NO: 21186 - DNA, 16 bp, Artificial Sequence
  synthetic [barcode part1]
ttaggactaccacgac

SEQ ID NO: 21187 - DNA, 16 bp, Artificial Sequence
  synthetic [barcode part1]
actcgcgactgagaag

SEQ ID NO: 21188 - DNA, 16 bp, Artificial Sequence
  synthetic [barcode part1]
tcacctgagacctcac

SEQ ID NO: 21189 - DNA, 16 bp, Artificial Sequence
  synthetic [barcode part1]
acgacagacagaacag

SEQ ID NO: 21190 - DNA, 16 bp, Artificial Sequence
  synthetic [barcode part1]
cacgaaggttaccgag

SEQ ID NO: 21191 - DNA, 16 bp, Artificial Sequence
  synthetic [barcode part1]
caggactgtacgtgtt

SEQ ID NO: 21192 - DNA, 16 bp, Artificial Sequence
  synthetic [barcode part1]
gaactacaagtgtgac

SEQ ID NO: 21193 - DNA, 16 bp, Artificial Sequence
  synthetic [barcode part1]
taagtcctccgagtag

SEQ ID NO: 21194 - DNA, 16 bp, Artificial Sequence
  synthetic [barcode part1]
taccagtgatctcttg

SEQ ID NO: 21195 - DNA, 16 bp, Artificial Sequence
  synthetic [barcode part1]
cgtctcagataggatc

SEQ ID NO: 21196 - DNA, 16 bp, Artificial Sequence
  synthetic [barcode part1]
tctgcctggtactacg

SEQ ID NO: 21197 - DNA, 16 bp, Artificial Sequence
  synthetic [barcode part1]
tggaggttggatcgtg

SEQ ID NO: 21198 - DNA, 16 bp, Artificial Sequence
  synthetic [barcode part1]
aatcctgtctatccag

SEQ ID NO: 21199 - DNA, 16 bp, Artificial Sequence
  synthetic [barcode part1]
cgcgatacttgaggtt

SEQ ID NO: 21200 - DNA, 16 bp, Artificial Sequence
  synthetic [barcode part1]
cggcgactgataatct

SEQ ID NO: 21201 - DNA, 16 bp, Artificial Sequence
  synthetic [barcode part1]
ccgaagtggtgaacgt

SEQ ID NO: 21202 - DNA, 16 bp, Artificial Sequence
  synthetic [barcode part1]
ttcaatccgtgcaatc

SEQ ID NO: 21203 - DNA, 16 bp, Artificial Sequence
  synthetic [barcode part1]
gacgtgtcaacgtgtt

SEQ ID NO: 21204 - DNA, 16 bp, Artificial Sequence
  synthetic [barcode part1]
actacgtggttcacag

SEQ ID NO: 21205 - DNA, 16 bp, Artificial Sequence
  synthetic [barcode part1]
gtaacgtggttggttc

SEQ ID NO: 21206 - DNA, 16 bp, Artificial Sequence
  synthetic [barcode part1]
gtctgtcagtaccgtc

SEQ ID NO: 21207 - DNA, 16 bp, Artificial Sequence
  synthetic [barcode part1]
gttccacacttcctac

SEQ ID NO: 21208 - DNA, 16 bp, Artificial Sequence
  synthetic [barcode part1]
ttggcggtactcctac

SEQ ID NO: 21209 - DNA, 16 bp, Artificial Sequence
  synthetic [barcode part1]
tgaaggaaggagacct

SEQ ID NO: 21210 - DNA, 16 bp, Artificial Sequence
  synthetic [barcode part1]
attaggtgcctctact

SEQ ID NO: 21211 - DNA, 16 bp, Artificial Sequence
  synthetic [barcode part1]
tacctgtggacagact

SEQ ID NO: 21212 - DNA, 16 bp, Artificial Sequence
  synthetic [barcode part1]
gacgacactataggcg

SEQ ID NO: 21213 - DNA, 16 bp, Artificial Sequence
  synthetic [barcode part1]
ttgttgtgtagacctc

SEQ ID NO: 21214 - DNA, 16 bp, Artificial Sequence
  synthetic [barcode part1]
gagattcacagacaac

SEQ ID NO: 21215 - DNA, 16 bp, Artificial Sequence
  synthetic [barcode part1]
gcgactgttctagtcc

SEQ ID NO: 21216 - DNA, 16 bp, Artificial Sequence
  synthetic [barcode part1]
acgtatctactggcag

SEQ ID NO: 21217 - DNA, 16 bp, Artificial Sequence
  synthetic [barcode part1]
cacaccttaagttacc

SEQ ID NO: 21218 - DNA, 16 bp, Artificial Sequence
  synthetic [barcode part1]
tattagacggaccgtc

SEQ ID NO: 21219 - DNA, 16 bp, Artificial Sequence
  synthetic [barcode part1]
taagtactggtctcct

SEQ ID NO: 21220 - DNA, 16 bp, Artificial Sequence
  synthetic [barcode part1]
gacactggatcaacct

SEQ ID NO: 21221 - DNA, 16 bp, Artificial Sequence
  synthetic [barcode part1]
tagagatcgccgagtg

SEQ ID NO: 21222 - DNA, 16 bp, Artificial Sequence
  synthetic [barcode part1]
ttcacgaagtgaagtg

SEQ ID NO: 21223 - DNA, 16 bp, Artificial Sequence
  synthetic [barcode part1]
atctgtcttgcagtgt

SEQ ID NO: 21224 - DNA, 16 bp, Artificial Sequence
  synthetic [barcode part1]
atagagtgtagatccg

SEQ ID NO: 21225 - DNA, 16 bp, Artificial Sequence
  synthetic [barcode part1]
cagtctaggtaactcg

SEQ ID NO: 21226 - DNA, 16 bp, Artificial Sequence
  synthetic [barcode part1]
gtgattcagacgcgag

SEQ ID NO: 21227 - DNA, 16 bp, Artificial Sequence
  synthetic [barcode part1]
gtccggtaaggtgtag

SEQ ID NO: 21228 - DNA, 16 bp, Artificial Sequence
  synthetic [barcode part1]
gaaccagattggcacg

SEQ ID NO: 21229 - DNA, 16 bp, Artificial Sequence
  synthetic [barcode part1]
acctgaattattccgc

SEQ ID NO: 21230 - DNA, 16 bp, Artificial Sequence
  synthetic [barcode part1]
ataaccggacctcctc

SEQ ID NO: 21231 - DNA, 16 bp, Artificial Sequence
  synthetic [barcode part1]
gtctctaagtgacctt

SEQ ID NO: 21232 - DNA, 16 bp, Artificial Sequence
  synthetic [barcode part1]
ttggcgactcacgtct

SEQ ID NO: 21233 - DNA, 16 bp, Artificial Sequence
  synthetic [barcode part1]
aggtccaatccgaact

SEQ ID NO: 21234 - DNA, 16 bp, Artificial Sequence
  synthetic [barcode part1]
aggcaccaatattcgc

SEQ ID NO: 21235 - DNA, 16 bp, Artificial Sequence
  synthetic [barcode part1]
tgccttgtagagtgac

SEQ ID NO: 21236 - DNA, 16 bp, Artificial Sequence
  synthetic [barcode part1]
ttgactcacaaggcgt

SEQ ID NO: 21237 - DNA, 16 bp, Artificial Sequence
  synthetic [barcode part1]
tcggaccgaagtacag

SEQ ID NO: 21238 - DNA, 16 bp, Artificial Sequence
  synthetic [barcode part1]
gccgtacttaagtgtg

SEQ ID NO: 21239 - DNA, 16 bp, Artificial Sequence
  synthetic [barcode part1]
aggtcttaaccgatcg

SEQ ID NO: 21240 - DNA, 16 bp, Artificial Sequence
  synthetic [barcode part1]
tgcgccaggaatcaag

SEQ ID NO: 21241 - DNA, 16 bp, Artificial Sequence
  synthetic [barcode part1]
gaattgacacgactag

SEQ ID NO: 21242 - DNA, 16 bp, Artificial Sequence
  synthetic [barcode part1]
tacgttgttctaaccg

SEQ ID NO: 21243 - DNA, 16 bp, Artificial Sequence
  synthetic [barcode part1]
gtcagtatcacgcaac

SEQ ID NO: 21244 - DNA, 16 bp, Artificial Sequence
  synthetic [barcode part1]
gttgcaacctgaagtc

SEQ ID NO: 21245 - DNA, 16 bp, Artificial Sequence
  synthetic [barcode part1]
gaatcaaccagaggag

SEQ ID NO: 21246 - DNA, 16 bp, Artificial Sequence
  synthetic [barcode part1]
tacgtcaagaaggccg

SEQ ID NO: 21247 - DNA, 16 bp, Artificial Sequence
  synthetic [barcode part1]
ccgttcgaccttgagt

SEQ ID NO: 21248 - DNA, 16 bp, Artificial Sequence
  synthetic [barcode part1]
acacgcgccaattaac

SEQ ID NO: 21249 - DNA, 16 bp, Artificial Sequence
  synthetic [barcode part1]
gagacgaattccactc

SEQ ID NO: 21250 - DNA, 16 bp, Artificial Sequence
  synthetic [barcode part1]
taccaaggtccagtac

SEQ ID NO: 21251 - DNA, 16 bp, Artificial Sequence
  synthetic [barcode part1]
agaagtgtaggtcact

SEQ ID NO: 21252 - DNA, 16 bp, Artificial Sequence
  synthetic [barcode part1]
atacggccaactgtgt

SEQ ID NO: 21253 - DNA, 16 bp, Artificial Sequence
  synthetic [barcode part1]
gataaccggagtgcac

SEQ ID NO: 21254 - DNA, 16 bp, Artificial Sequence
  synthetic [barcode part1]
tctcaattctccggtc

SEQ ID NO: 21255 - DNA, 16 bp, Artificial Sequence
  synthetic [barcode part1]
gaccacagatcggagt

SEQ ID NO: 21256 - DNA, 16 bp, Artificial Sequence
  synthetic [barcode part1]
ccttgaacacttactg

SEQ ID NO: 21257 - DNA, 16 bp, Artificial Sequence
  synthetic [barcode part1]
tcgttgatagtccgag

SEQ ID NO: 21258 - DNA, 16 bp, Artificial Sequence
  synthetic [barcode part1]
attgagtgacacaggt

SEQ ID NO: 21259 - DNA, 16 bp, Artificial Sequence
  synthetic [barcode part1]
ttacggataagaggtc

SEQ ID NO: 21260 - DNA, 16 bp, Artificial Sequence
  synthetic [barcode part1]
aagaagtgtctgaacc

SEQ ID NO: 21261 - DNA, 16 bp, Artificial Sequence
  synthetic [barcode part1]
ttatctgcactcgtcc

SEQ ID NO: 21262 - DNA, 16 bp, Artificial Sequence
  synthetic [barcode part1]
tgtactcttcggcggt

SEQ ID NO: 21263 - DNA, 16 bp, Artificial Sequence
  synthetic [barcode part1]
caggtgtcacaagtct

SEQ ID NO: 21264 - DNA, 16 bp, Artificial Sequence
  synthetic [barcode part1]
tctcacaatcgttggt

SEQ ID NO: 21265 - DNA, 16 bp, Artificial Sequence
  synthetic [barcode part1]
ttgttctgcgcgactg

SEQ ID NO: 21266 - DNA, 16 bp, Artificial Sequence
  synthetic [barcode part1]
cgacgactacacttcc

SEQ ID NO: 21267 - DNA, 16 bp, Artificial Sequence
  synthetic [barcode part1]
cgcgatcttcttgacg

SEQ ID NO: 21268 - DNA, 16 bp, Artificial Sequence
  synthetic [barcode part1]
gaagtcttgaacgaac

SEQ ID NO: 21269 - DNA, 16 bp, Artificial Sequence
  synthetic [barcode part1]
attcctggagtacggt

SEQ ID NO: 21270 - DNA, 16 bp, Artificial Sequence
  synthetic [barcode part1]
aatactacgacgccac

SEQ ID NO: 21271 - DNA, 16 bp, Artificial Sequence
  synthetic [barcode part1]
agatccacttgtaggc

SEQ ID NO: 21272 - DNA, 16 bp, Artificial Sequence
  synthetic [barcode part1]
gtgacagttgtcactg

SEQ ID NO: 21273 - DNA, 16 bp, Artificial Sequence
  synthetic [barcode part1]
ccagtccaggtgtctt

SEQ ID NO: 21274 - DNA, 16 bp, Artificial Sequence
  synthetic [barcode part1]
acaactgccaatcttc

SEQ ID NO: 21275 - DNA, 16 bp, Artificial Sequence
  synthetic [barcode part1]
gaccaagatcttccag

SEQ ID NO: 21276 - DNA, 16 bp, Artificial Sequence
  synthetic [barcode part1]
ttgacgtcctcaaccg

SEQ ID NO: 21277 - DNA, 16 bp, Artificial Sequence
  synthetic [barcode part1]
tcggcaagacacaggt

SEQ ID NO: 21278 - DNA, 16 bp, Artificial Sequence
  synthetic [barcode part1]
cgaataacctgtccag

SEQ ID NO: 21279 - DNA, 16 bp, Artificial Sequence
  synthetic [barcode part1]
atctctagacacaggc

SEQ ID NO: 21280 - DNA, 16 bp, Artificial Sequence
  synthetic [barcode part1]
tatccttgtcgaatcg

SEQ ID NO: 21281 - DNA, 16 bp, Artificial Sequence
  synthetic [barcode part1]
cctgaattcaccgtcg

SEQ ID NO: 21282 - DNA, 16 bp, Artificial Sequence
  synthetic [barcode part1]
tcagaggcgtagatcg

SEQ ID NO: 21283 - DNA, 16 bp, Artificial Sequence
  synthetic [barcode part1]
gataagtgcagtgttg

SEQ ID NO: 21284 - DNA, 16 bp, Artificial Sequence
  synthetic [barcode part1]
atcacgagtgaacggc

SEQ ID NO: 21285 - DNA, 16 bp, Artificial Sequence
  synthetic [barcode part1]
tcggcggaatacgagt

SEQ ID NO: 21286 - DNA, 16 bp, Artificial Sequence
  synthetic [barcode part1]
tctatacggtccaatc

SEQ ID NO: 21287 - DNA, 16 bp, Artificial Sequence
  synthetic [barcode part1]
tacggcggcaagtaac

SEQ ID NO: 21288 - DNA, 16 bp, Artificial Sequence
  synthetic [barcode part1]
ttcgtatccaggttac

SEQ ID NO: 21289 - DNA, 16 bp, Artificial Sequence
  synthetic [barcode part1]
tctcctgtgttggcag

SEQ ID NO: 21290 - DNA, 16 bp, Artificial Sequence
  synthetic [barcode part1]
cactaagacctccgtc

SEQ ID NO: 21291 - DNA, 16 bp, Artificial Sequence
  synthetic [barcode part1]
tggcaattcctcgtgc

SEQ ID NO: 21292 - DNA, 16 bp, Artificial Sequence
  synthetic [barcode part1]
taggttacgacgacct

SEQ ID NO: 21293 - DNA, 16 bp, Artificial Sequence
  synthetic [barcode part1]
tcgatctgtgagacgt

SEQ ID NO: 21294 - DNA, 16 bp, Artificial Sequence
  synthetic [barcode part1]
gatccgcaacaaggtg

SEQ ID NO: 21295 - DNA, 16 bp, Artificial Sequence
  synthetic [barcode part1]
ttgtgtggtacgtcag

SEQ ID NO: 21296 - DNA, 16 bp, Artificial Sequence
  synthetic [barcode part1]
cgattgtaggtacctg

SEQ ID NO: 21297 - DNA, 16 bp, Artificial Sequence
  synthetic [barcode part1]
tgaaggccgagttgtg

SEQ ID NO: 21298 - DNA, 16 bp, Artificial Sequence
  synthetic [barcode part1]
gttaagttacctccgt

SEQ ID NO: 21299 - DNA, 16 bp, Artificial Sequence
  synthetic [barcode part1]
tgatacactggcgtgt

SEQ ID NO: 21300 - DNA, 16 bp, Artificial Sequence
  synthetic [barcode part1]
gaccagtacactgtgt

SEQ ID NO: 21301 - DNA, 16 bp, Artificial Sequence
  synthetic [barcode part1]
cgtaggaatcactaag

SEQ ID NO: 21302 - DNA, 16 bp, Artificial Sequence
  synthetic [barcode part1]
gaacctacaggagacc

SEQ ID NO: 21303 - DNA, 16 bp, Artificial Sequence
  synthetic [barcode part1]
gccagtgttgtgtaac

SEQ ID NO: 21304 - DNA, 16 bp, Artificial Sequence
  synthetic [barcode part1]
cgtcttaggatctact

SEQ ID NO: 21305 - DNA, 16 bp, Artificial Sequence
  synthetic [barcode part1]
atcagatcggaggcgt

SEQ ID NO: 21306 - DNA, 16 bp, Artificial Sequence
  synthetic [barcode part1]
acttgagttgtctcac

SEQ ID NO: 21307 - DNA, 16 bp, Artificial Sequence
  synthetic [barcode part1]
ttatcgtggacggtac

SEQ ID NO: 21308 - DNA, 16 bp, Artificial Sequence
  synthetic [barcode part1]
cagtacaccttgtcgc

SEQ ID NO: 21309 - DNA, 16 bp, Artificial Sequence
  synthetic [barcode part1]
agttggcggtcaactt

SEQ ID NO: 21310 - DNA, 16 bp, Artificial Sequence
  synthetic [barcode part1]
agacgttatccgtgac

SEQ ID NO: 21311 - DNA, 16 bp, Artificial Sequence
  synthetic [barcode part1]
ataagtcgtcagaggt

SEQ ID NO: 21312 - DNA, 16 bp, Artificial Sequence
  synthetic [barcode part1]
ttctggagagtctcag

SEQ ID NO: 21313 - DNA, 16 bp, Artificial Sequence
  synthetic [barcode part1]
gtcaaggttagaggag

SEQ ID NO: 21314 - DNA, 16 bp, Artificial Sequence
  synthetic [barcode part1]
agtatacaggatcggt

SEQ ID NO: 21315 - DNA, 16 bp, Artificial Sequence
  synthetic [barcode part1]
gactcgatcagatcgt

SEQ ID NO: 21316 - DNA, 16 bp, Artificial Sequence
  synthetic [barcode part1]
tggacgaatctatccg

SEQ ID NO: 21317 - DNA, 16 bp, Artificial Sequence
  synthetic [barcode part1]
gcctacctaccacagt

SEQ ID NO: 21318 - DNA, 16 bp, Artificial Sequence
  synthetic [barcode part1]
tggagtcttctcctct

SEQ ID NO: 21319 - DNA, 16 bp, Artificial Sequence
  synthetic [barcode part1]
agtatcgcgattgacc

SEQ ID NO: 21320 - DNA, 16 bp, Artificial Sequence
  synthetic [barcode part1]
tgttacgcgattgacg

SEQ ID NO: 21321 - DNA, 16 bp, Artificial Sequence
  synthetic [barcode part1]
tggatcaagagtacac

SEQ ID NO: 21322 - DNA, 16 bp, Artificial Sequence
  synthetic [barcode part1]
caacggatcgtaggtg

SEQ ID NO: 21323 - DNA, 16 bp, Artificial Sequence
  synthetic [barcode part1]
atatcttatcgccggt

SEQ ID NO: 21324 - DNA, 16 bp, Artificial Sequence
  synthetic [barcode part1]
gtcgacgttatacgac

SEQ ID NO: 21325 - DNA, 16 bp, Artificial Sequence
  synthetic [barcode part1]
ttctgcctgttgttcg

SEQ ID NO: 21326 - DNA, 16 bp, Artificial Sequence
  synthetic [barcode part1]
tgtctcactgtgaact

SEQ ID NO: 21327 - DNA, 16 bp, Artificial Sequence
  synthetic [barcode part1]
tggcgtggtataatcc

SEQ ID NO: 21328 - DNA, 16 bp, Artificial Sequence
  synthetic [barcode part1]
caactagtgcaacgtc

SEQ ID NO: 21329 - DNA, 16 bp, Artificial Sequence
  synthetic [barcode part1]
gcgtcttgactcgatc

SEQ ID NO: 21330 - DNA, 16 bp, Artificial Sequence
  synthetic [barcode part1]
gaacggtgtataactg

SEQ ID NO: 21331 - DNA, 16 bp, Artificial Sequence
  synthetic [barcode part1]
cagataccacggattc

SEQ ID NO: 21332 - DNA, 16 bp, Artificial Sequence
  synthetic [barcode part1]
tcgccgtacttgcagt

SEQ ID NO: 21333 - DNA, 16 bp, Artificial Sequence
  synthetic [barcode part1]
agacttccgtgatacg

SEQ ID NO: 21334 - DNA, 16 bp, Artificial Sequence
  synthetic [barcode part1]
tacaaccgccgaagag

SEQ ID NO: 21335 - DNA, 16 bp, Artificial Sequence
  synthetic [barcode part1]
tcactgacagtagtcg

SEQ ID NO: 21336 - DNA, 16 bp, Artificial Sequence
  synthetic [barcode part1]
aagtcctattggccag

SEQ ID NO: 21337 - DNA, 16 bp, Artificial Sequence
  synthetic [barcode part1]
actacgacttattcgc

SEQ ID NO: 21338 - DNA, 16 bp, Artificial Sequence
  synthetic [barcode part1]
taacgtacctcgttgt

SEQ ID NO: 21339 - DNA, 16 bp, Artificial Sequence
  synthetic [barcode part1]
ttaaggtgcctgttct

SEQ ID NO: 21340 - DNA, 16 bp, Artificial Sequence
  synthetic [barcode part1]
gaggcgcactgaattg

SEQ ID NO: 21341 - DNA, 16 bp, Artificial Sequence
  synthetic [barcode part1]
gaggatccagtgtacg

SEQ ID NO: 21342 - DNA, 16 bp, Artificial Sequence
  synthetic [barcode part1]
tgtactgtcgaagaag

SEQ ID NO: 21343 - DNA, 16 bp, Artificial Sequence
  synthetic [barcode part1]
ccgcgttataggagtt

SEQ ID NO: 21344 - DNA, 16 bp, Artificial Sequence
  synthetic [barcode part1]
gtgatcactctgattc

SEQ ID NO: 21345 - DNA, 16 bp, Artificial Sequence
  synthetic [barcode part1]
agacgagactctaggc

SEQ ID NO: 21346 - DNA, 16 bp, Artificial Sequence
  synthetic [barcode part1]
accttgtcgtcctgtt

SEQ ID NO: 21347 - DNA, 16 bp, Artificial Sequence
  synthetic [barcode part1]
ttgccgcagatagtgt

SEQ ID NO: 21348 - DNA, 16 bp, Artificial Sequence
  synthetic [barcode part1]
gtgtggaggtatagag

SEQ ID NO: 21349 - DNA, 16 bp, Artificial Sequence
  synthetic [barcode part1]
gtcaggacgtgtagtg

SEQ ID NO: 21350 - DNA, 16 bp, Artificial Sequence
  synthetic [barcode part1]
ttgtatcacgatccac

SEQ ID NO: 21351 - DNA, 16 bp, Artificial Sequence
  synthetic [barcode part1]
atctctactgccggac

SEQ ID NO: 21352 - DNA, 16 bp, Artificial Sequence
  synthetic [barcode part1]
gtagtcgaggatcggt

SEQ ID NO: 21353 - DNA, 16 bp, Artificial Sequence
  synthetic [barcode part1]
cacgagactcttacag

SEQ ID NO: 21354 - DNA, 16 bp, Artificial Sequence
  synthetic [barcode part1]
ttcagacggtagtaag

SEQ ID NO: 21355 - DNA, 16 bp, Artificial Sequence
  synthetic [barcode part1]
atctaggataacaggc

SEQ ID NO: 21356 - DNA, 16 bp, Artificial Sequence
  synthetic [barcode part1]
acggaagtgtactctc

SEQ ID NO: 21357 - DNA, 16 bp, Artificial Sequence
  synthetic [barcode part1]
atatcaatctcgccac

SEQ ID NO: 21358 - DNA, 16 bp, Artificial Sequence
  synthetic [barcode part1]
caactgtgcgagacag

SEQ ID NO: 21359 - DNA, 16 bp, Artificial Sequence
  synthetic [barcode part1]
gtctggaggtattcgt

SEQ ID NO: 21360 - DNA, 16 bp, Artificial Sequence
  synthetic [barcode part1]
gcgttatcgcctactg

SEQ ID NO: 21361 - DNA, 16 bp, Artificial Sequence
  synthetic [barcode part1]
ttggacttgacaaccg

SEQ ID NO: 21362 - DNA, 16 bp, Artificial Sequence
  synthetic [barcode part1]
actactgtcgaaccag

SEQ ID NO: 21363 - DNA, 16 bp, Artificial Sequence
  synthetic [barcode part1]
gacggttcagtgatct

SEQ ID NO: 21364 - DNA, 16 bp, Artificial Sequence
  synthetic [barcode part1]
tcgaggaattgttccg

SEQ ID NO: 21365 - DNA, 16 bp, Artificial Sequence
  synthetic [barcode part1]
aacaaccgatctggtc

SEQ ID NO: 21366 - DNA, 16 bp, Artificial Sequence
  synthetic [barcode part1]
aacgcgtggaagacct

SEQ ID NO: 21367 - DNA, 16 bp, Artificial Sequence
  synthetic [barcode part1]
cctgacctctcttagt

SEQ ID NO: 21368 - DNA, 16 bp, Artificial Sequence
  synthetic [barcode part1]
cagtgtagtgcaactc

SEQ ID NO: 21369 - DNA, 16 bp, Artificial Sequence
  synthetic [barcode part1]
ccagaaggaaggttag

SEQ ID NO: 21370 - DNA, 16 bp, Artificial Sequence
  synthetic [barcode part1]
gagtatcgtgagttcc

SEQ ID NO: 21371 - DNA, 16 bp, Artificial Sequence
  synthetic [barcode part1]
tcaggaccactacagt

SEQ ID NO: 21372 - DNA, 16 bp, Artificial Sequence
  synthetic [barcode part1]
tctgtgttcagtggtt

SEQ ID NO: 21373 - DNA, 16 bp, Artificial Sequence
  synthetic [barcode part1]
cactctacgaacactt

SEQ ID NO: 21374 - DNA, 16 bp, Artificial Sequence
  synthetic [barcode part1]
atcctccttctaaccg

SEQ ID NO: 21375 - DNA, 16 bp, Artificial Sequence
  synthetic [barcode part1]
ccttcaggttgcacac

SEQ ID NO: 21376 - DNA, 16 bp, Artificial Sequence
  synthetic [barcode part1]
aacgttctctgcagag

SEQ ID NO: 21377 - DNA, 16 bp, Artificial Sequence
  synthetic [barcode part1]
acaaccaggagttaac

SEQ ID NO: 21378 - DNA, 16 bp, Artificial Sequence
  synthetic [barcode part1]
cgaacgcaacttgtac

SEQ ID NO: 21379 - DNA, 16 bp, Artificial Sequence
  synthetic [barcode part1]
agagacggtctaatac

SEQ ID NO: 21380 - DNA, 16 bp, Artificial Sequence
  synthetic [barcode part1]
gcgatagaagtacttg

SEQ ID NO: 21381 - DNA, 16 bp, Artificial Sequence
  synthetic [barcode part1]
actccacctgcgtaac

SEQ ID NO: 21382 - DNA, 16 bp, Artificial Sequence
  synthetic [barcode part1]
tccttctactgcagtc

SEQ ID NO: 21383 - DNA, 16 bp, Artificial Sequence
  synthetic [barcode part1]
ttgagacttacggtgc

SEQ ID NO: 21384 - DNA, 16 bp, Artificial Sequence
  synthetic [barcode part1]
atctctactcggcgac

SEQ ID NO: 21385 - DNA, 16 bp, Artificial Sequence
  synthetic [barcode part1]
aggtccgttaccactc

SEQ ID NO: 21386 - DNA, 16 bp, Artificial Sequence
  synthetic [barcode part1]
tgacacgtgtactggt

SEQ ID NO: 21387 - DNA, 16 bp, Artificial Sequence
  synthetic [barcode part1]
aacgtgcaacttcctt

SEQ ID NO: 21388 - DNA, 16 bp, Artificial Sequence
  synthetic [barcode part1]
gtgtcaagttatcctc

SEQ ID NO: 21389 - DNA, 16 bp, Artificial Sequence
  synthetic [barcode part1]
ccgttacgcctacaac

SEQ ID NO: 21390 - DNA, 16 bp, Artificial Sequence
  synthetic [barcode part1]
aattctcgcactcaac

SEQ ID NO: 21391 - DNA, 16 bp, Artificial Sequence
  synthetic [barcode part1]
gtgataaggcgacaag

SEQ ID NO: 21392 - DNA, 16 bp, Artificial Sequence
  synthetic [barcode part1]
acacaggtagattgtg

SEQ ID NO: 21393 - DNA, 16 bp, Artificial Sequence
  synthetic [barcode part1]
tacaatatcgcctgtc

SEQ ID NO: 21394 - DNA, 16 bp, Artificial Sequence
  synthetic [barcode part1]
gtggtactgcaacact

SEQ ID NO: 21395 - DNA, 16 bp, Artificial Sequence
  synthetic [barcode part1]
caacactgtggataag

SEQ ID NO: 21396 - DNA, 16 bp, Artificial Sequence
  synthetic [barcode part1]
ttaacctggcacgtcc

SEQ ID NO: 21397 - DNA, 16 bp, Artificial Sequence
  synthetic [barcode part1]
tcgcaagattcttcgt

SEQ ID NO: 21398 - DNA, 16 bp, Artificial Sequence
  synthetic [barcode part1]
gaaggcaggactgttc

SEQ ID NO: 21399 - DNA, 16 bp, Artificial Sequence
  synthetic [barcode part1]
tgtgatccgtaagtcg

SEQ ID NO: 21400 - DNA, 16 bp, Artificial Sequence
  synthetic [barcode part1]
gacaatcgttactggc

SEQ ID NO: 21401 - DNA, 16 bp, Artificial Sequence
  synthetic [barcode part1]
agagacgttcgtatcc

SEQ ID NO: 21402 - DNA, 16 bp, Artificial Sequence
  synthetic [barcode part1]
ttcagtgcagatcgtg

SEQ ID NO: 21403 - DNA, 16 bp, Artificial Sequence
  synthetic [barcode part1]
tcacgtccgaagatac

SEQ ID NO: 21404 - DNA, 16 bp, Artificial Sequence
  synthetic [barcode part1]
agtcaacgtacacgtc

SEQ ID NO: 21405 - DNA, 16 bp, Artificial Sequence
  synthetic [barcode part1]
ccaaggaactaccttg

SEQ ID NO: 21406 - DNA, 16 bp, Artificial Sequence
  synthetic [barcode part1]
aatcttcttgacacgc

SEQ ID NO: 21407 - DNA, 16 bp, Artificial Sequence
  synthetic [barcode part1]
cgtgtgattcagtctt

SEQ ID NO: 21408 - DNA, 16 bp, Artificial Sequence
  synthetic [barcode part1]
gtagactgatcacacc

SEQ ID NO: 21409 - DNA, 16 bp, Artificial Sequence
  synthetic [barcode part1]
gcaacgattgttgtcg

SEQ ID NO: 21410 - DNA, 16 bp, Artificial Sequence
  synthetic [barcode part1]
tggtgaccgatagtct

SEQ ID NO: 21411 - DNA, 16 bp, Artificial Sequence
  synthetic [barcode part1]
tctcagacttaaggcg

SEQ ID NO: 21412 - DNA, 16 bp, Artificial Sequence
  synthetic [barcode part1]
cgtcaattctcaactg

SEQ ID NO: 21413 - DNA, 16 bp, Artificial Sequence
  synthetic [barcode part1]
caccggtcaattgtag

SEQ ID NO: 21414 - DNA, 16 bp, Artificial Sequence
  synthetic [barcode part1]
gtcgacaacttcttgt

SEQ ID NO: 21415 - DNA, 16 bp, Artificial Sequence
  synthetic [barcode part1]
tccggagtggttaatc

SEQ ID NO: 21416 - DNA, 16 bp, Artificial Sequence
  synthetic [barcode part1]
agaagaggaccttgag

SEQ ID NO: 21417 - DNA, 16 bp, Artificial Sequence
  synthetic [barcode part1]
aacgttgcacaacacc

SEQ ID NO: 21418 - DNA, 16 bp, Artificial Sequence
  synthetic [barcode part1]
gagtgtctctgccact

SEQ ID NO: 21419 - DNA, 16 bp, Artificial Sequence
  synthetic [barcode part1]
gaccacgtcctaactc

SEQ ID NO: 21420 - DNA, 16 bp, Artificial Sequence
  synthetic [barcode part1]
gacggatcttatccag

SEQ ID NO: 21421 - DNA, 16 bp, Artificial Sequence
  synthetic [barcode part1]
ttgacttaacgcgttc

SEQ ID NO: 21422 - DNA, 16 bp, Artificial Sequence
  synthetic [barcode part1]
ttccggtgattatacc

SEQ ID NO: 21423 - DNA, 16 bp, Artificial Sequence
  synthetic [barcode part1]
gtcaacgtggattcgt

SEQ ID NO: 21424 - DNA, 16 bp, Artificial Sequence
  synthetic [barcode part1]
aactggcggaactctt

SEQ ID NO: 21425 - DNA, 16 bp, Artificial Sequence
  synthetic [barcode part1]
gccgaataagtacagt

SEQ ID NO: 21426 - DNA, 16 bp, Artificial Sequence
  synthetic [barcode part1]
tcagaggtacgccaag

SEQ ID NO: 21427 - DNA, 16 bp, Artificial Sequence
  synthetic [barcode part1]
acctgatcgcagagag

SEQ ID NO: 21428 - DNA, 16 bp, Artificial Sequence
  synthetic [barcode part1]
gttaagacgcgtgacg

SEQ ID NO: 21429 - DNA, 16 bp, Artificial Sequence
  synthetic [barcode part1]
agataaggcgaacgac

SEQ ID NO: 21430 - DNA, 16 bp, Artificial Sequence
  synthetic [barcode part1]
acagtgtaccaaccac

SEQ ID NO: 21431 - DNA, 16 bp, Artificial Sequence
  synthetic [barcode part1]
tagtaatcgtacctcc

SEQ ID NO: 21432 - DNA, 16 bp, Artificial Sequence
  synthetic [barcode part1]
caacaggacctgcaag

SEQ ID NO: 21433 - DNA, 16 bp, Artificial Sequence
  synthetic [barcode part1]
gtgttcaattccgttg

SEQ ID NO: 21434 - DNA, 16 bp, Artificial Sequence
  synthetic [barcode part1]
tagtacgtaatcctcc

SEQ ID NO: 21435 - DNA, 16 bp, Artificial Sequence
  synthetic [barcode part1]
gcactctgtattctcc

SEQ ID NO: 21436 - DNA, 16 bp, Artificial Sequence
  synthetic [barcode part1]
aactcctagttgcact

SEQ ID NO: 21437 - DNA, 16 bp, Artificial Sequence
  synthetic [barcode part1]
agtattgccgatcggt

SEQ ID NO: 21438 - DNA, 16 bp, Artificial Sequence
  synthetic [barcode part1]
tgtacttcgtctctgc

SEQ ID NO: 21439 - DNA, 16 bp, Artificial Sequence
  synthetic [barcode part1]
aatcaataccgaccgc

SEQ ID NO: 21440 - DNA, 16 bp, Artificial Sequence
  synthetic [barcode part1]
tatcgtgaaggtcctg

SEQ ID NO: 21441 - DNA, 16 bp, Artificial Sequence
  synthetic [barcode part1]
agtctgacaacttggc

SEQ ID NO: 21442 - DNA, 16 bp, Artificial Sequence
  synthetic [barcode part1]
tggttggaattggcct

SEQ ID NO: 21443 - DNA, 16 bp, Artificial Sequence
  synthetic [barcode part1]
gtcactcttcgttgtc

SEQ ID NO: 21444 - DNA, 16 bp, Artificial Sequence
  synthetic [barcode part1]
agtcgagtaccaatag

SEQ ID NO: 21445 - DNA, 16 bp, Artificial Sequence
  synthetic [barcode part1]
gccagatcgagagtgt

SEQ ID NO: 21446 - DNA, 16 bp, Artificial Sequence
  synthetic [barcode part1]
gcgtcttgactatcgc

SEQ ID NO: 21447 - DNA, 16 bp, Artificial Sequence
  synthetic [barcode part1]
atctatactaggcgcg

SEQ ID NO: 21448 - DNA, 16 bp, Artificial Sequence
  synthetic [barcode part1]
tcggagagagaatcag

SEQ ID NO: 21449 - DNA, 16 bp, Artificial Sequence
  synthetic [barcode part1]
cgtgaattgaacgtcc

SEQ ID NO: 21450 - DNA, 16 bp, Artificial Sequence
  synthetic [barcode part1]
gcaccaaggttacgtt

SEQ ID NO: 21451 - DNA, 16 bp, Artificial Sequence
  synthetic [barcode part1]
ttccgtggattcggtc

SEQ ID NO: 21452 - DNA, 16 bp, Artificial Sequence
  synthetic [barcode part1]
agtagagtggcgaagt

SEQ ID NO: 21453 - DNA, 16 bp, Artificial Sequence
  synthetic [barcode part1]
tgagttaccgacggtt

SEQ ID NO: 21454 - DNA, 16 bp, Artificial Sequence
  synthetic [barcode part1]
cacaactccagtacag

SEQ ID NO: 21455 - DNA, 16 bp, Artificial Sequence
  synthetic [barcode part1]
tagttggattacggcc

SEQ ID NO: 21456 - DNA, 16 bp, Artificial Sequence
  synthetic [barcode part1]
gaatagacttggaacc

SEQ ID NO: 21457 - DNA, 16 bp, Artificial Sequence
  synthetic [barcode part1]
tggtcgcgagttgaag

SEQ ID NO: 21458 - DNA, 16 bp, Artificial Sequence
  synthetic [barcode part1]
gcaatcaactaacgcc

SEQ ID NO: 21459 - DNA, 16 bp, Artificial Sequence
  synthetic [barcode part1]
cagtcaacgtgatacc

SEQ ID NO: 21460 - DNA, 16 bp, Artificial Sequence
  synthetic [barcode part1]
acgccgagtatctaac

SEQ ID NO: 21461 - DNA, 16 bp, Artificial Sequence
  synthetic [barcode part1]
acagtaacggaagacg

SEQ ID NO: 21462 - DNA, 16 bp, Artificial Sequence
  synthetic [barcode part1]
tgtccgtctcgagatc

SEQ ID NO: 21463 - DNA, 16 bp, Artificial Sequence
  synthetic [barcode part1]
gagtctacctgtagac

SEQ ID NO: 21464 - DNA, 16 bp, Artificial Sequence
  synthetic [barcode part1]
aactcttgttggaggc

SEQ ID NO: 21465 - DNA, 16 bp, Artificial Sequence
  synthetic [barcode part1]
cgtatcaccgatcctg

SEQ ID NO: 21466 - DNA, 16 bp, Artificial Sequence
  synthetic [barcode part1]
actaagattctggccg

SEQ ID NO: 21467 - DNA, 16 bp, Artificial Sequence
  synthetic [barcode part1]
caactgacaacactgc

SEQ ID NO: 21468 - DNA, 16 bp, Artificial Sequence
  synthetic [barcode part1]
tggaacggtaggatag

SEQ ID NO: 21469 - DNA, 16 bp, Artificial Sequence
  synthetic [barcode part1]
ttgcaacggccttaag

SEQ ID NO: 21470 - DNA, 16 bp, Artificial Sequence
  synthetic [barcode part1]
aaggcggacttacggt

SEQ ID NO: 21471 - DNA, 16 bp, Artificial Sequence
  synthetic [barcode part1]
acagacgcaggattcg

SEQ ID NO: 21472 - DNA, 16 bp, Artificial Sequence
  synthetic [barcode part1]
atactgcgtagtgtcg

SEQ ID NO: 21473 - DNA, 16 bp, Artificial Sequence
  synthetic [barcode part1]
tgtccgttgttgtggc

SEQ ID NO: 21474 - DNA, 16 bp, Artificial Sequence
  synthetic [barcode part1]
tctgtagattcgcgag

SEQ ID NO: 21475 - DNA, 16 bp, Artificial Sequence
  synthetic [barcode part1]
ttggacactcgagtac

SEQ ID NO: 21476 - DNA, 16 bp, Artificial Sequence
  synthetic [barcode part1]
gttgcggttgtctgtc

SEQ ID NO: 21477 - DNA, 16 bp, Artificial Sequence
  synthetic [barcode part1]
ttcgtcgaacttacac

SEQ ID NO: 21478 - DNA, 16 bp, Artificial Sequence
  synthetic [barcode part1]
atcgtggtgtctactt

SEQ ID NO: 21479 - DNA, 16 bp, Artificial Sequence
  synthetic [barcode part1]
gaccaacgtcagttgt

SEQ ID NO: 21480 - DNA, 16 bp, Artificial Sequence
  synthetic [barcode part1]
acgcgtggttatagtc

SEQ ID NO: 21481 - DNA, 16 bp, Artificial Sequence
  synthetic [barcode part1]
atcacacggagtggtg

SEQ ID NO: 21482 - DNA, 16 bp, Artificial Sequence
  synthetic [barcode part1]
tagaattcggccaacc

SEQ ID NO: 21483 - DNA, 16 bp, Artificial Sequence
  synthetic [barcode part1]
cagacagaatatcacg

SEQ ID NO: 21484 - DNA, 16 bp, Artificial Sequence
  synthetic [barcode part1]
gtactgagtgtggttc

SEQ ID NO: 21485 - DNA, 16 bp, Artificial Sequence
  synthetic [barcode part1]
gagagtcacacgtcag

SEQ ID NO: 21486 - DNA, 16 bp, Artificial Sequence
  synthetic [barcode part1]
attgtctggacttacc

SEQ ID NO: 21487 - DNA, 16 bp, Artificial Sequence
  synthetic [barcode part1]
tccaccggttactctt

SEQ ID NO: 21488 - DNA, 16 bp, Artificial Sequence
  synthetic [barcode part1]
atactcgttgttccag

SEQ ID NO: 21489 - DNA, 16 bp, Artificial Sequence
  synthetic [barcode part1]
tggtctcttaggagac

SEQ ID NO: 21490 - DNA, 16 bp, Artificial Sequence
  synthetic [barcode part1]
cgccttgtgaatactt

SEQ ID NO: 21491 - DNA, 16 bp, Artificial Sequence
  synthetic [barcode part1]
cgaatctcctgtcacg

SEQ ID NO: 21492 - DNA, 16 bp, Artificial Sequence
  synthetic [barcode part1]
gtgattgcgtgtagtc

SEQ ID NO: 21493 - DNA, 16 bp, Artificial Sequence
  synthetic [barcode part1]
tactgagagacgtggc

SEQ ID NO: 21494 - DNA, 16 bp, Artificial Sequence
  synthetic [barcode part1]
acaactggtacaccac

SEQ ID NO: 21495 - DNA, 16 bp, Artificial Sequence
  synthetic [barcode part1]
acaatcctcgtattcg

SEQ ID NO: 21496 - DNA, 16 bp, Artificial Sequence
  synthetic [barcode part1]
gcacgtggattaactc

SEQ ID NO: 21497 - DNA, 16 bp, Artificial Sequence
  synthetic [barcode part1]
aaggcgacttgaatac

SEQ ID NO: 21498 - DNA, 16 bp, Artificial Sequence
  synthetic [barcode part1]
acacacagtactgtgc

SEQ ID NO: 21499 - DNA, 16 bp, Artificial Sequence
  synthetic [barcode part1]
aagtgtcgcgaatctc

SEQ ID NO: 21500 - DNA, 16 bp, Artificial Sequence
  synthetic [barcode part1]
gttcactcgaggcctt

SEQ ID NO: 21501 - DNA, 16 bp, Artificial Sequence
  synthetic [barcode part1]
ttaacaaggcacgaac

SEQ ID NO: 21502 - DNA, 16 bp, Artificial Sequence
  synthetic [barcode part1]
gacctccgatcacgtt

SEQ ID NO: 21503 - DNA, 16 bp, Artificial Sequence
  synthetic [barcode part1]
aacgaatcaggatctg

SEQ ID NO: 21504 - DNA, 16 bp, Artificial Sequence
  synthetic [barcode part1]
accaccggttatcaag

SEQ ID NO: 21505 - DNA, 16 bp, Artificial Sequence
  synthetic [barcode part1]
acgacaggtgatcgtg

SEQ ID NO: 21506 - DNA, 16 bp, Artificial Sequence
  synthetic [barcode part1]
cgtcctagatattcac

SEQ ID NO: 21507 - DNA, 16 bp, Artificial Sequence
  synthetic [barcode part1]
agagtcggtgcctaag

SEQ ID NO: 21508 - DNA, 16 bp, Artificial Sequence
  synthetic [barcode part1]
gccttgtacttaggcc

SEQ ID NO: 21509 - DNA, 16 bp, Artificial Sequence
  synthetic [barcode part1]
actacttgtccgtggc

SEQ ID NO: 21510 - DNA, 16 bp, Artificial Sequence
  synthetic [barcode part1]
acctaccgacgttacc

SEQ ID NO: 21511 - DNA, 16 bp, Artificial Sequence
  synthetic [barcode part1]
cggaacttacacacgt

SEQ ID NO: 21512 - DNA, 16 bp, Artificial Sequence
  synthetic [barcode part1]
aacgactggttcagtc

SEQ ID NO: 21513 - DNA, 16 bp, Artificial Sequence
  synthetic [barcode part1]
gtccaggacaacgaac

SEQ ID NO: 21514 - DNA, 16 bp, Artificial Sequence
  synthetic [barcode part1]
ccttaaccgtgccagt

SEQ ID NO: 21515 - DNA, 16 bp, Artificial Sequence
  synthetic [barcode part1]
caactccaccagtgtc

SEQ ID NO: 21516 - DNA, 16 bp, Artificial Sequence
  synthetic [barcode part1]
tggtatctactcactg

SEQ ID NO: 21517 - DNA, 16 bp, Artificial Sequence
  synthetic [barcode part1]
tgttgtggccgattag

SEQ ID NO: 21518 - DNA, 16 bp, Artificial Sequence
  synthetic [barcode part1]
attcggaagtaaggtc

SEQ ID NO: 21519 - DNA, 16 bp, Artificial Sequence
  synthetic [barcode part1]
gacaatcgagatacac

SEQ ID NO: 21520 - DNA, 16 bp, Artificial Sequence
  synthetic [barcode part1]
gttcaccttcagaatc

SEQ ID NO: 21521 - DNA, 16 bp, Artificial Sequence
  synthetic [barcode part1]
ttcctgacctctcagt

SEQ ID NO: 21522 - DNA, 16 bp, Artificial Sequence
  synthetic [barcode part1]
taacacgcggtctctc

SEQ ID NO: 21523 - DNA, 16 bp, Artificial Sequence
  synthetic [barcode part1]
taacgacttaggccac

SEQ ID NO: 21524 - DNA, 16 bp, Artificial Sequence
  synthetic [barcode part1]
cgacagagtcctattg

SEQ ID NO: 21525 - DNA, 16 bp, Artificial Sequence
  synthetic [barcode part1]
atcacagtcgcagtac

SEQ ID NO: 21526 - DNA, 16 bp, Artificial Sequence
  synthetic [barcode part1]
tagtggtaagacgtac

SEQ ID NO: 21527 - DNA, 16 bp, Artificial Sequence
  synthetic [barcode part1]
tgcacagaatagtggt

SEQ ID NO: 21528 - DNA, 16 bp, Artificial Sequence
  synthetic [barcode part1]
tacgccggtgtattag

SEQ ID NO: 21529 - DNA, 16 bp, Artificial Sequence
  synthetic [barcode part1]
tcaccacggtattcgc

SEQ ID NO: 21530 - DNA, 16 bp, Artificial Sequence
  synthetic [barcode part1]
tccagtcaccagtacc

SEQ ID NO: 21531 - DNA, 16 bp, Artificial Sequence
  synthetic [barcode part1]
atccgatagtctgacg

SEQ ID NO: 21532 - DNA, 16 bp, Artificial Sequence
  synthetic [barcode part1]
acgccaggattatacc

SEQ ID NO: 21533 - DNA, 16 bp, Artificial Sequence
  synthetic [barcode part1]
gtagacgttgcaatag

SEQ ID NO: 21534 - DNA, 16 bp, Artificial Sequence
  synthetic [barcode part1]
gtggaacctatcctag

SEQ ID NO: 21535 - DNA, 16 bp, Artificial Sequence
  synthetic [barcode part1]
agacaggtaagattcc

SEQ ID NO: 21536 - DNA, 16 bp, Artificial Sequence
  synthetic [barcode part1]
cgcaatagtagacaac

SEQ ID NO: 21537 - DNA, 16 bp, Artificial Sequence
  synthetic [barcode part1]
attctggtcggagttg

SEQ ID NO: 21538 - DNA, 16 bp, Artificial Sequence
  synthetic [barcode part1]
tagtcctctctgacct

SEQ ID NO: 21539 - DNA, 16 bp, Artificial Sequence
  synthetic [barcode part1]
aacactggacttcgac

SEQ ID NO: 21540 - DNA, 16 bp, Artificial Sequence
  synthetic [barcode part1]
atataacacgcgccac

SEQ ID NO: 21541 - DNA, 16 bp, Artificial Sequence
  synthetic [barcode part1]
gtagttctctgcgtcg

SEQ ID NO: 21542 - DNA, 16 bp, Artificial Sequence
  synthetic [barcode part1]
ttcaaggtgatcggtc

SEQ ID NO: 21543 - DNA, 16 bp, Artificial Sequence
  synthetic [barcode part1]
tcagacggatacctgt

SEQ ID NO: 21544 - DNA, 16 bp, Artificial Sequence
  synthetic [barcode part1]
tggcagaacaggttcg

SEQ ID NO: 21545 - DNA, 16 bp, Artificial Sequence
  synthetic [barcode part1]
tattagtcacggccag

SEQ ID NO: 21546 - DNA, 16 bp, Artificial Sequence
  synthetic [barcode part1]
actcctcaccacgtag

SEQ ID NO: 21547 - DNA, 16 bp, Artificial Sequence
  synthetic [barcode part1]
cgtgtagaggtactct

SEQ ID NO: 21548 - DNA, 16 bp, Artificial Sequence
  synthetic [barcode part1]
cgcaatacgaatagac

SEQ ID NO: 21549 - DNA, 16 bp, Artificial Sequence
  synthetic [barcode part1]
aacctggccgataact

SEQ ID NO: 21550 - DNA, 16 bp, Artificial Sequence
  synthetic [barcode part1]
atcggtactgccgttc

SEQ ID NO: 21551 - DNA, 16 bp, Artificial Sequence
  synthetic [barcode part1]
gacttacctcgttgcg

SEQ ID NO: 21552 - DNA, 16 bp, Artificial Sequence
  synthetic [barcode part1]
gagataggatacctgt

SEQ ID NO: 21553 - DNA, 16 bp, Artificial Sequence
  synthetic [barcode part1]
attccttatcaacgcg

SEQ ID NO: 21554 - DNA, 16 bp, Artificial Sequence
  synthetic [barcode part1]
gtaaccggaccaaggt

SEQ ID NO: 21555 - DNA, 16 bp, Artificial Sequence
  synthetic [barcode part1]
gaggtgaatctacggc

SEQ ID NO: 21556 - DNA, 16 bp, Artificial Sequence
  synthetic [barcode part1]
ccgagtactcaagtgt

SEQ ID NO: 21557 - DNA, 16 bp, Artificial Sequence
  synthetic [barcode part1]
acctcacacctgaacc

SEQ ID NO: 21558 - DNA, 16 bp, Artificial Sequence
  synthetic [barcode part1]
tatcgacttccttgag

SEQ ID NO: 21559 - DNA, 16 bp, Artificial Sequence
  synthetic [barcode part1]
atctcgcgtccagatc

SEQ ID NO: 21560 - DNA, 16 bp, Artificial Sequence
  synthetic [barcode part1]
tacacactgcacacag

SEQ ID NO: 21561 - DNA, 16 bp, Artificial Sequence
  synthetic [barcode part1]
atagagtgtccgcgag

SEQ ID NO: 21562 - DNA, 16 bp, Artificial Sequence
  synthetic [barcode part1]
aacgtacggagttaac

SEQ ID NO: 21563 - DNA, 16 bp, Artificial Sequence
  synthetic [barcode part1]
agaccacagaccactt

SEQ ID NO: 21564 - DNA, 16 bp, Artificial Sequence
  synthetic [barcode part1]
acagtcaggccttctc

SEQ ID NO: 21565 - DNA, 16 bp, Artificial Sequence
  synthetic [barcode part1]
gcgcagtcaactatac

SEQ ID NO: 21566 - DNA, 16 bp, Artificial Sequence
  synthetic [barcode part1]
cactcaccggaatctc

SEQ ID NO: 21567 - DNA, 16 bp, Artificial Sequence
  synthetic [barcode part1]
gaacttcaccgatcag

SEQ ID NO: 21568 - DNA, 16 bp, Artificial Sequence
  synthetic [barcode part1]
gacttgatagtggtcc

SEQ ID NO: 21569 - DNA, 16 bp, Artificial Sequence
  synthetic [barcode part1]
ttccgtccttaggcag

SEQ ID NO: 21570 - DNA, 16 bp, Artificial Sequence
  synthetic [barcode part1]
aaccacagtcaacgtc

SEQ ID NO: 21571 - DNA, 16 bp, Artificial Sequence
  synthetic [barcode part1]
tgcactaattggcacg

SEQ ID NO: 21572 - DNA, 16 bp, Artificial Sequence
  synthetic [barcode part1]
caagtgccgactcctt

SEQ ID NO: 21573 - DNA, 16 bp, Artificial Sequence
  synthetic [barcode part1]
atcgcaacgaagttcc

SEQ ID NO: 21574 - DNA, 16 bp, Artificial Sequence
  synthetic [barcode part1]
tgttccacgagtatct

SEQ ID NO: 21575 - DNA, 16 bp, Artificial Sequence
  synthetic [barcode part1]
agaaggtctcgtaagt

SEQ ID NO: 21576 - DNA, 16 bp, Artificial Sequence
  synthetic [barcode part1]
aactagagtctgaacg

SEQ ID NO: 21577 - DNA, 16 bp, Artificial Sequence
  synthetic [barcode part1]
atcttgtacagtcacc

SEQ ID NO: 21578 - DNA, 16 bp, Artificial Sequence
  synthetic [barcode part1]
ttacgcacttcggtcg

SEQ ID NO: 21579 - DNA, 16 bp, Artificial Sequence
  synthetic [barcode part1]
acgattaagtcggagt

SEQ ID NO: 21580 - DNA, 16 bp, Artificial Sequence
  synthetic [barcode part1]
aatcaagtccgacctg

SEQ ID NO: 21581 - DNA, 16 bp, Artificial Sequence
  synthetic [barcode part1]
tcgtgtatcctccgag

SEQ ID NO: 21582 - DNA, 16 bp, Artificial Sequence
  synthetic [barcode part1]
cgaggcgtatcagtag

SEQ ID NO: 21583 - DNA, 16 bp, Artificial Sequence
  synthetic [barcode part1]
caggcgttcctattgc

SEQ ID NO: 21584 - DNA, 16 bp, Artificial Sequence
  synthetic [barcode part1]
cgacggttaactcaac

SEQ ID NO: 21585 - DNA, 16 bp, Artificial Sequence
  synthetic [barcode part1]
aattcgccagacactg

SEQ ID NO: 21586 - DNA, 16 bp, Artificial Sequence
  synthetic [barcode part1]
ttgccacaggtaacac

SEQ ID NO: 21587 - DNA, 16 bp, Artificial Sequence
  synthetic [barcode part1]
gcacgcgtgtgatatt

SEQ ID NO: 21588 - DNA, 16 bp, Artificial Sequence
  synthetic [barcode part1]
tagagtaggtgacgag

SEQ ID NO: 21589 - DNA, 16 bp, Artificial Sequence
  synthetic [barcode part1]
tgcaatcgattgtgcg

SEQ ID NO: 21590 - DNA, 16 bp, Artificial Sequence
  synthetic [barcode part1]
agagaatcggagagtc

SEQ ID NO: 21591 - DNA, 16 bp, Artificial Sequence
  synthetic [barcode part1]
cgtactaccagttccg

SEQ ID NO: 21592 - DNA, 16 bp, Artificial Sequence
  synthetic [barcode part1]
attgcaggaatagacc

SEQ ID NO: 21593 - DNA, 16 bp, Artificial Sequence
  synthetic [barcode part1]
gataccaggttggttc

SEQ ID NO: 21594 - DNA, 16 bp, Artificial Sequence
  synthetic [barcode part1]
tcgaactaggaacgcg

SEQ ID NO: 21595 - DNA, 16 bp, Artificial Sequence
  synthetic [barcode part1]
gtacctagaattcgcg

SEQ ID NO: 21596 - DNA, 16 bp, Artificial Sequence
  synthetic [barcode part1]
tccacacttctcacac

SEQ ID NO: 21597 - DNA, 16 bp, Artificial Sequence
  synthetic [barcode part1]
aatcctggtagtaccg

SEQ ID NO: 21598 - DNA, 16 bp, Artificial Sequence
  synthetic [barcode part1]
tccgtctcgttgcaag

SEQ ID NO: 21599 - DNA, 16 bp, Artificial Sequence
  synthetic [barcode part1]
atctcgcgcaactacc

SEQ ID NO: 21600 - DNA, 16 bp, Artificial Sequence
  synthetic [barcode part1]
aagttgcgacgattcc

SEQ ID NO: 21601 - DNA, 16 bp, Artificial Sequence
  synthetic [barcode part1]
ttagtggcgcctctac

SEQ ID NO: 21602 - DNA, 16 bp, Artificial Sequence
  synthetic [barcode part1]
agagttcgataggcgc

SEQ ID NO: 21603 - DNA, 16 bp, Artificial Sequence
  synthetic [barcode part1]
tgagtcacctcacgtc

SEQ ID NO: 21604 - DNA, 16 bp, Artificial Sequence
  synthetic [barcode part1]
tcgttcgatagtatcc

SEQ ID NO: 21605 - DNA, 16 bp, Artificial Sequence
  synthetic [barcode part1]
ttgttcgacggtactt

SEQ ID NO: 21606 - DNA, 16 bp, Artificial Sequence
  synthetic [barcode part1]
agttctcacgcctggt

SEQ ID NO: 21607 - DNA, 16 bp, Artificial Sequence
  synthetic [barcode part1]
taagattcacgtgcgc

SEQ ID NO: 21608 - DNA, 16 bp, Artificial Sequence
  synthetic [barcode part1]
tcgaagtgtctatctc

SEQ ID NO: 21609 - DNA, 16 bp, Artificial Sequence
  synthetic [barcode part1]
ccaacttgagtgttct

SEQ ID NO: 21610 - DNA, 16 bp, Artificial Sequence
  synthetic [barcode part1]
cgatcttcctcgatct

SEQ ID NO: 21611 - DNA, 16 bp, Artificial Sequence
  synthetic [barcode part1]
accggatcaagtcgtt

SEQ ID NO: 21612 - DNA, 16 bp, Artificial Sequence
  synthetic [barcode part1]
ttcactgtggtctcct

SEQ ID NO: 21613 - DNA, 16 bp, Artificial Sequence
  synthetic [barcode part1]
tggtgcctacttaccg

SEQ ID NO: 21614 - DNA, 16 bp, Artificial Sequence
  synthetic [barcode part1]
ttccggcgtgtagtct

SEQ ID NO: 21615 - DNA, 16 bp, Artificial Sequence
  synthetic [barcode part1]
gaccggtgttaactac

SEQ ID NO: 21616 - DNA, 16 bp, Artificial Sequence
  synthetic [barcode part1]
tggtcaacaatcgacc

SEQ ID NO: 21617 - DNA, 16 bp, Artificial Sequence
  synthetic [barcode part1]
cctatcctccaagacg

SEQ ID NO: 21618 - DNA, 16 bp, Artificial Sequence
  synthetic [barcode part1]
taatacgtcttgccgt

SEQ ID NO: 21619 - DNA, 16 bp, Artificial Sequence
  synthetic [barcode part1]
ccgaataccgtcttgc

SEQ ID NO: 21620 - DNA, 16 bp, Artificial Sequence
  synthetic [barcode part1]
ttcaggaattgcggtc

SEQ ID NO: 21621 - DNA, 16 bp, Artificial Sequence
  synthetic [barcode part1]
ttcgcctatctgtctg

SEQ ID NO: 21622 - DNA, 16 bp, Artificial Sequence
  synthetic [barcode part1]
cgtcctggacacttgt

SEQ ID NO: 21623 - DNA, 16 bp, Artificial Sequence
  synthetic [barcode part1]
gcactggattgccttc

SEQ ID NO: 21624 - DNA, 16 bp, Artificial Sequence
  synthetic [barcode part1]
tgattgccggattcag

SEQ ID NO: 21625 - DNA, 16 bp, Artificial Sequence
  synthetic [barcode part1]
gtaccgagattgcact

SEQ ID NO: 21626 - DNA, 16 bp, Artificial Sequence
  synthetic [barcode part1]
gtacacactagtcgac

SEQ ID NO: 21627 - DNA, 16 bp, Artificial Sequence
  synthetic [barcode part1]
gtgtgttgaacgtctg

SEQ ID NO: 21628 - DNA, 16 bp, Artificial Sequence
  synthetic [barcode part1]
gcgacgtcaactaatc

SEQ ID NO: 21629 - DNA, 16 bp, Artificial Sequence
  synthetic [barcode part1]
gagtggatactcactc

SEQ ID NO: 21630 - DNA, 16 bp, Artificial Sequence
  synthetic [barcode part1]
agatcggttccaatcg

SEQ ID NO: 21631 - DNA, 16 bp, Artificial Sequence
  synthetic [barcode part1]
aaccaatccaggacct

SEQ ID NO: 21632 - DNA, 16 bp, Artificial Sequence
  synthetic [barcode part1]
gagagtgttgttgaac

SEQ ID NO: 21633 - DNA, 16 bp, Artificial Sequence
  synthetic [barcode part1]
gcaactgacgtcagtt

SEQ ID NO: 21634 - DNA, 16 bp, Artificial Sequence
  synthetic [barcode part1]
tgagtaaggcaccgtg

SEQ ID NO: 21635 - DNA, 16 bp, Artificial Sequence
  synthetic [barcode part1]
caatcaacgacaccgt

SEQ ID NO: 21636 - DNA, 16 bp, Artificial Sequence
  synthetic [barcode part1]
tcacgtcgagttattc

SEQ ID NO: 21637 - DNA, 16 bp, Artificial Sequence
  synthetic [barcode part1]
tccaaggagttctggt

SEQ ID NO: 21638 - DNA, 16 bp, Artificial Sequence
  synthetic [barcode part1]
ttatagaacaaggcgc

SEQ ID NO: 21639 - DNA, 16 bp, Artificial Sequence
  synthetic [barcode part1]
taatccggagttgtcg

SEQ ID NO: 21640 - DNA, 16 bp, Artificial Sequence
  synthetic [barcode part1]
gcaactattgaaggac

SEQ ID NO: 21641 - DNA, 16 bp, Artificial Sequence
  synthetic [barcode part1]
gacctatacagatccg

SEQ ID NO: 21642 - DNA, 16 bp, Artificial Sequence
  synthetic [barcode part1]
cggaccgtgtattcct

SEQ ID NO: 21643 - DNA, 16 bp, Artificial Sequence
  synthetic [barcode part1]
cagttggcagtcaact

SEQ ID NO: 21644 - DNA, 16 bp, Artificial Sequence
  synthetic [barcode part1]
atccgagagtactcgt

SEQ ID NO: 21645 - DNA, 16 bp, Artificial Sequence
  synthetic [barcode part1]
tgaacgcgattgcgtt

SEQ ID NO: 21646 - DNA, 16 bp, Artificial Sequence
  synthetic [barcode part1]
acacggaactcttacg

SEQ ID NO: 21647 - DNA, 16 bp, Artificial Sequence
  synthetic [barcode part1]
gccagtcaattagtcg

SEQ ID NO: 21648 - DNA, 16 bp, Artificial Sequence
  synthetic [barcode part1]
tgcgaccagagatcag

SEQ ID NO: 21649 - DNA, 16 bp, Artificial Sequence
  synthetic [barcode part1]
atccgaatctatcgtc

SEQ ID NO: 21650 - DNA, 16 bp, Artificial Sequence
  synthetic [barcode part1]
agactaccttgtactc

SEQ ID NO: 21651 - DNA, 16 bp, Artificial Sequence
  synthetic [barcode part1]
agtctactccagacag

SEQ ID NO: 21652 - DNA, 16 bp, Artificial Sequence
  synthetic [barcode part1]
gtaggaattcctgcgt

SEQ ID NO: 21653 - DNA, 16 bp, Artificial Sequence
  synthetic [barcode part1]
aacgtaatagaccgtg

SEQ ID NO: 21654 - DNA, 16 bp, Artificial Sequence
  synthetic [barcode part1]
accgacgagatattcc

SEQ ID NO: 21655 - DNA, 16 bp, Artificial Sequence
  synthetic [barcode part1]
gtagtatacgccacgt

SEQ ID NO: 21656 - DNA, 16 bp, Artificial Sequence
  synthetic [barcode part1]
cgatacactctgccac

SEQ ID NO: 21657 - DNA, 16 bp, Artificial Sequence
  synthetic [barcode part1]
tggactactaacgacc

SEQ ID NO: 21658 - DNA, 16 bp, Artificial Sequence
  synthetic [barcode part1]
cgccttgcacttaggt

SEQ ID NO: 21659 - DNA, 16 bp, Artificial Sequence
  synthetic [barcode part1]
agttctgcacttgccg

SEQ ID NO: 21660 - DNA, 16 bp, Artificial Sequence
  synthetic [barcode part1]
gcaccaggtatagttc

SEQ ID NO: 21661 - DNA, 16 bp, Artificial Sequence
  synthetic [barcode part1]
cacagtgtgagactct

SEQ ID NO: 21662 - DNA, 16 bp, Artificial Sequence
  synthetic [barcode part1]
cctactgacacaattc

SEQ ID NO: 21663 - DNA, 16 bp, Artificial Sequence
  synthetic [barcode part1]
gtagacttggtgaggc

SEQ ID NO: 21664 - DNA, 16 bp, Artificial Sequence
  synthetic [barcode part1]
tgaactcctacagacg

SEQ ID NO: 21665 - DNA, 16 bp, Artificial Sequence
  synthetic [barcode part1]
tgcgcactgtatacag

SEQ ID NO: 21666 - DNA, 16 bp, Artificial Sequence
  synthetic [barcode part1]
aggtattggtggagtt

SEQ ID NO: 21667 - DNA, 16 bp, Artificial Sequence
  synthetic [barcode part1]
agacgtcctgcagatt

SEQ ID NO: 21668 - DNA, 16 bp, Artificial Sequence
  synthetic [barcode part1]
acaatccggacgcaag

SEQ ID NO: 21669 - DNA, 16 bp, Artificial Sequence
  synthetic [barcode part1]
tgagtaactgtgacag

SEQ ID NO: 21670 - DNA, 16 bp, Artificial Sequence
  synthetic [barcode part1]
aatagttgcgtgagac

SEQ ID NO: 21671 - DNA, 16 bp, Artificial Sequence
  synthetic [barcode part1]
ttatctccggtggaag

SEQ ID NO: 21672 - DNA, 16 bp, Artificial Sequence
  synthetic [barcode part1]
gaacgaccgcaagttg

SEQ ID NO: 21673 - DNA, 16 bp, Artificial Sequence
  synthetic [barcode part1]
cacgtctcctaataac

SEQ ID NO: 21674 - DNA, 16 bp, Artificial Sequence
  synthetic [barcode part1]
agatcctgagacttcg

SEQ ID NO: 21675 - DNA, 16 bp, Artificial Sequence
  synthetic [barcode part1]
gaatcgcgaactgtct

SEQ ID NO: 21676 - DNA, 16 bp, Artificial Sequence
  synthetic [barcode part1]
accgtaactacttacc

SEQ ID NO: 21677 - DNA, 16 bp, Artificial Sequence
  synthetic [barcode part1]
ccacttccgtgttgag

SEQ ID NO: 21678 - DNA, 16 bp, Artificial Sequence
  synthetic [barcode part1]
gacacgacagagatag

SEQ ID NO: 21679 - DNA, 16 bp, Artificial Sequence
  synthetic [barcode part1]
cctggttgtcagtacc

SEQ ID NO: 21680 - DNA, 16 bp, Artificial Sequence
  synthetic [barcode part1]
cgttctatcgccttgt

SEQ ID NO: 21681 - DNA, 16 bp, Artificial Sequence
  synthetic [barcode part1]
tggatacaggacggtc

SEQ ID NO: 21682 - DNA, 16 bp, Artificial Sequence
  synthetic [barcode part1]
ttacctacctatccgc

SEQ ID NO: 21683 - DNA, 16 bp, Artificial Sequence
  synthetic [barcode part1]
cagtcaactaaccgac

SEQ ID NO: 21684 - DNA, 16 bp, Artificial Sequence
  synthetic [barcode part1]
cctggtccgcacaatt

SEQ ID NO: 21685 - DNA, 16 bp, Artificial Sequence
  synthetic [barcode part1]
atacgacgaaggattc

SEQ ID NO: 21686 - DNA, 16 bp, Artificial Sequence
  synthetic [barcode part1]
gtcaccgttgagttag

SEQ ID NO: 21687 - DNA, 16 bp, Artificial Sequence
  synthetic [barcode part1]
ttataccgtcttcgcc

SEQ ID NO: 21688 - DNA, 16 bp, Artificial Sequence
  synthetic [barcode part1]
atctggaagacctgtc

SEQ ID NO: 21689 - DNA, 16 bp, Artificial Sequence
  synthetic [barcode part1]
agttgacgtgtgtacc

SEQ ID NO: 21690 - DNA, 16 bp, Artificial Sequence
  synthetic [barcode part1]
aacggacgatactgcg

SEQ ID NO: 21691 - DNA, 16 bp, Artificial Sequence
  synthetic [barcode part1]
ccagtcgaactctaag

SEQ ID NO: 21692 - DNA, 16 bp, Artificial Sequence
  synthetic [barcode part1]
aatccgatccttgcgc

SEQ ID NO: 21693 - DNA, 16 bp, Artificial Sequence
  synthetic [barcode part1]
gtcgcaggtctacttc

SEQ ID NO: 21694 - DNA, 16 bp, Artificial Sequence
  synthetic [barcode part1]
gtctgttcacctgtct

SEQ ID NO: 21695 - DNA, 16 bp, Artificial Sequence
  synthetic [barcode part1]
cctctagtggtgtgtc

SEQ ID NO: 21696 - DNA, 16 bp, Artificial Sequence
  synthetic [barcode part1]
gcgcgccttatataag

SEQ ID NO: 21697 - DNA, 16 bp, Artificial Sequence
  synthetic [barcode part1]
gacagaactgaacgtt

SEQ ID NO: 21698 - DNA, 16 bp, Artificial Sequence
  synthetic [barcode part1]
cgttcgtacctcagac

SEQ ID NO: 21699 - DNA, 16 bp, Artificial Sequence
  synthetic [barcode part1]
attgcactgataggag

SEQ ID NO: 21700 - DNA, 16 bp, Artificial Sequence
  synthetic [barcode part1]
tgcaggttatcgtctt

SEQ ID NO: 21701 - DNA, 16 bp, Artificial Sequence
  synthetic [barcode part1]
agtgttgcagtaccac

SEQ ID NO: 21702 - DNA, 16 bp, Artificial Sequence
  synthetic [barcode part1]
aattgcctgccaagtg

SEQ ID NO: 21703 - DNA, 16 bp, Artificial Sequence
  synthetic [barcode part1]
gtcgatacggacttac

SEQ ID NO: 21704 - DNA, 16 bp, Artificial Sequence
  synthetic [barcode part1]
cgcgaggaagatatag

SEQ ID NO: 21705 - DNA, 16 bp, Artificial Sequence
  synthetic [barcode part1]
attacggaagtcctgc

SEQ ID NO: 21706 - DNA, 16 bp, Artificial Sequence
  synthetic [barcode part1]
ataacagataaccgcg

SEQ ID NO: 21707 - DNA, 16 bp, Artificial Sequence
  synthetic [barcode part1]
tctgttaggtccgtgc

SEQ ID NO: 21708 - DNA, 16 bp, Artificial Sequence
  synthetic [barcode part1]
gagatagacctcgtct

SEQ ID NO: 21709 - DNA, 16 bp, Artificial Sequence
  synthetic [barcode part1]
tatagttagaggccag

SEQ ID NO: 21710 - DNA, 16 bp, Artificial Sequence
  synthetic [barcode part1]
gtacggtctaatctct

SEQ ID NO: 21711 - DNA, 16 bp, Artificial Sequence
  synthetic [barcode part1]
gaactgccgtcaagtt

SEQ ID NO: 21712 - DNA, 16 bp, Artificial Sequence
  synthetic [barcode part1]
actggtacaagttcgc

SEQ ID NO: 21713 - DNA, 16 bp, Artificial Sequence
  synthetic [barcode part1]
cgtgtcgcaattacag

SEQ ID NO: 21714 - DNA, 16 bp, Artificial Sequence
  synthetic [barcode part1]
tgtcacctaggtctgc

SEQ ID NO: 21715 - DNA, 16 bp, Artificial Sequence
  synthetic [barcode part1]
aattcggcggttcaac

SEQ ID NO: 21716 - DNA, 16 bp, Artificial Sequence
  synthetic [barcode part1]
ccagaacacttactct

SEQ ID NO: 21717 - DNA, 16 bp, Artificial Sequence
  synthetic [barcode part1]
aaggtccacgaatagt

SEQ ID NO: 21718 - DNA, 16 bp, Artificial Sequence
  synthetic [barcode part1]
gattgtacttcgacct

SEQ ID NO: 21719 - DNA, 16 bp, Artificial Sequence
  synthetic [barcode part1]
taaccttgttaacgcc

SEQ ID NO: 21720 - DNA, 16 bp, Artificial Sequence
  synthetic [barcode part1]
actacaacctacctgt

SEQ ID NO: 21721 - DNA, 16 bp, Artificial Sequence
  synthetic [barcode part1]
gtgtgacggaggatct

SEQ ID NO: 21722 - DNA, 16 bp, Artificial Sequence
  synthetic [barcode part1]
aggtagagtctgtcct

SEQ ID NO: 21723 - DNA, 16 bp, Artificial Sequence
  synthetic [barcode part1]
tccactgcacaccaac

SEQ ID NO: 21724 - DNA, 16 bp, Artificial Sequence
  synthetic [barcode part1]
acgttaggcacgattc

SEQ ID NO: 21725 - DNA, 16 bp, Artificial Sequence
  synthetic [barcode part1]
acgactacggtatacc

SEQ ID NO: 21726 - DNA, 16 bp, Artificial Sequence
  synthetic [barcode part1]
tgtattagaggccaag

SEQ ID NO: 21727 - DNA, 16 bp, Artificial Sequence
  synthetic [barcode part1]
tccttcctctctctct

SEQ ID NO: 21728 - DNA, 16 bp, Artificial Sequence
  synthetic [barcode part1]
tcgtcacgtcttactc

SEQ ID NO: 21729 - DNA, 16 bp, Artificial Sequence
  synthetic [barcode part1]
cggatataagacggcc

SEQ ID NO: 21730 - DNA, 16 bp, Artificial Sequence
  synthetic [barcode part1]
tcgacttccactacct

SEQ ID NO: 21731 - DNA, 16 bp, Artificial Sequence
  synthetic [barcode part1]
cgtggcagataggtac

SEQ ID NO: 21732 - DNA, 16 bp, Artificial Sequence
  synthetic [barcode part1]
aaggtcgtgatcttcg

SEQ ID NO: 21733 - DNA, 16 bp, Artificial Sequence
  synthetic [barcode part1]
ccaccagagttgttag

SEQ ID NO: 21734 - DNA, 16 bp, Artificial Sequence
  synthetic [barcode part1]
cgattctggagttggt

SEQ ID NO: 21735 - DNA, 16 bp, Artificial Sequence
  synthetic [barcode part1]
tgacggatagagtgag

SEQ ID NO: 21736 - DNA, 16 bp, Artificial Sequence
  synthetic [barcode part1]
ttgacgagtgaaggcc

SEQ ID NO: 21737 - DNA, 16 bp, Artificial Sequence
  synthetic [barcode part1]
cacggtaatctgtctt

SEQ ID NO: 21738 - DNA, 16 bp, Artificial Sequence
  synthetic [barcode part1]
tccgcgttagtctggt

SEQ ID NO: 21739 - DNA, 16 bp, Artificial Sequence
  synthetic [barcode part1]
agtgtggtagagacag

SEQ ID NO: 21740 - DNA, 16 bp, Artificial Sequence
  synthetic [barcode part1]
ttgacacgttggtacg

SEQ ID NO: 21741 - DNA, 16 bp, Artificial Sequence
  synthetic [barcode part1]
tgtactgacgttgacg

SEQ ID NO: 21742 - DNA, 16 bp, Artificial Sequence
  synthetic [barcode part1]
ttacggagtctctcgc

SEQ ID NO: 21743 - DNA, 16 bp, Artificial Sequence
  synthetic [barcode part1]
agacttaacgaggtgt

SEQ ID NO: 21744 - DNA, 16 bp, Artificial Sequence
  synthetic [barcode part1]
aatagaggcacgattc

SEQ ID NO: 21745 - DNA, 16 bp, Artificial Sequence
  synthetic [barcode part1]
cagtactagtgtcacg

SEQ ID NO: 21746 - DNA, 16 bp, Artificial Sequence
  synthetic [barcode part1]
agttggcagttgacct

SEQ ID NO: 21747 - DNA, 16 bp, Artificial Sequence
  synthetic [barcode part1]
aactcgtgtctcaccg

SEQ ID NO: 21748 - DNA, 16 bp, Artificial Sequence
  synthetic [barcode part1]
gtgtggcaggattgac

SEQ ID NO: 21749 - DNA, 16 bp, Artificial Sequence
  synthetic [barcode part1]
gcaatctctgcgttcg

SEQ ID NO: 21750 - DNA, 16 bp, Artificial Sequence
  synthetic [barcode part1]
acctgttcacctacct

SEQ ID NO: 21751 - DNA, 16 bp, Artificial Sequence
  synthetic [barcode part1]
cacttataacaggcgc

SEQ ID NO: 21752 - DNA, 16 bp, Artificial Sequence
  synthetic [barcode part1]
tctatacaaggtgcgc

SEQ ID NO: 21753 - DNA, 16 bp, Artificial Sequence
  synthetic [barcode part1]
gttaggttctacgttc

SEQ ID NO: 21754 - DNA, 16 bp, Artificial Sequence
  synthetic [barcode part1]
cgtatcctagactgcc

SEQ ID NO: 21755 - DNA, 16 bp, Artificial Sequence
  synthetic [barcode part1]
agttcgtgttctgttg

SEQ ID NO: 21756 - DNA, 16 bp, Artificial Sequence
  synthetic [barcode part1]
gaatagtccttcgacg

SEQ ID NO: 21757 - DNA, 16 bp, Artificial Sequence
  synthetic [barcode part1]
cgttcctactaggtcg

SEQ ID NO: 21758 - DNA, 16 bp, Artificial Sequence
  synthetic [barcode part1]
tatcttgagatccgtc

SEQ ID NO: 21759 - DNA, 16 bp, Artificial Sequence
  synthetic [barcode part1]
tgcacctcgttcttac

SEQ ID NO: 21760 - DNA, 16 bp, Artificial Sequence
  synthetic [barcode part1]
taaccggcgatcaact

SEQ ID NO: 21761 - DNA, 16 bp, Artificial Sequence
  synthetic [barcode part1]
tatcgcaactacgacg

SEQ ID NO: 21762 - DNA, 16 bp, Artificial Sequence
  synthetic [barcode part1]
gattccagttccgaag

SEQ ID NO: 21763 - DNA, 16 bp, Artificial Sequence
  synthetic [barcode part1]
tccgccaagttcacgt

SEQ ID NO: 21764 - DNA, 16 bp, Artificial Sequence
  synthetic [barcode part1]
cacgtaattcgatctc

SEQ ID NO: 21765 - DNA, 16 bp, Artificial Sequence
  synthetic [barcode part1]
caacgtgcgacagagt

SEQ ID NO: 21766 - DNA, 16 bp, Artificial Sequence
  synthetic [barcode part1]
ttcgtacgactatcgt

SEQ ID NO: 21767 - DNA, 16 bp, Artificial Sequence
  synthetic [barcode part1]
aaccacacaacgtgtc

SEQ ID NO: 21768 - DNA, 16 bp, Artificial Sequence
  synthetic [barcode part1]
atcacgaggcgttatc

SEQ ID NO: 21769 - DNA, 16 bp, Artificial Sequence
  synthetic [barcode part1]
ccacctgcagaacctt

SEQ ID NO: 21770 - DNA, 16 bp, Artificial Sequence
  synthetic [barcode part1]
acctgtcctcaaggtc

SEQ ID NO: 21771 - DNA, 16 bp, Artificial Sequence
  synthetic [barcode part1]
tcctcagagtcagaac

SEQ ID NO: 21772 - DNA, 16 bp, Artificial Sequence
  synthetic [barcode part1]
cgtgattgcgttcaag

SEQ ID NO: 21773 - DNA, 16 bp, Artificial Sequence
  synthetic [barcode part1]
aagtcggtaacgcacg

SEQ ID NO: 21774 - DNA, 16 bp, Artificial Sequence
  synthetic [barcode part1]
taacgaacctggatag

SEQ ID NO: 21775 - DNA, 16 bp, Artificial Sequence
  synthetic [barcode part1]
tgcagagactaggtcg

SEQ ID NO: 21776 - DNA, 16 bp, Artificial Sequence
  synthetic [barcode part1]
acgtaggcgaactgtg

SEQ ID NO: 21777 - DNA, 16 bp, Artificial Sequence
  synthetic [barcode part1]
gagttcttggttggtg

SEQ ID NO: 21778 - DNA, 16 bp, Artificial Sequence
  synthetic [barcode part1]
tatcaccgtgatcact

SEQ ID NO: 21779 - DNA, 16 bp, Artificial Sequence
  synthetic [barcode part1]
ccggagtattctgaac

SEQ ID NO: 21780 - DNA, 16 bp, Artificial Sequence
  synthetic [barcode part1]
cggttctatattggtc

SEQ ID NO: 21781 - DNA, 16 bp, Artificial Sequence
  synthetic [barcode part1]
cgaatcgtcagactgt

SEQ ID NO: 21782 - DNA, 16 bp, Artificial Sequence
  synthetic [barcode part1]
ccaagtacctattacc

SEQ ID NO: 21783 - DNA, 16 bp, Artificial Sequence
  synthetic [barcode part1]
gtagaggtgcaagaac

SEQ ID NO: 21784 - DNA, 16 bp, Artificial Sequence
  synthetic [barcode part1]
cgattccaaggtcaac

SEQ ID NO: 21785 - DNA, 16 bp, Artificial Sequence
  synthetic [barcode part1]
ttgaggtaataccgcc

SEQ ID NO: 21786 - DNA, 16 bp, Artificial Sequence
  synthetic [barcode part1]
aggtcaggccgtatag

SEQ ID NO: 21787 - DNA, 16 bp, Artificial Sequence
  synthetic [barcode part1]
tccgacgtgtccttag

SEQ ID NO: 21788 - DNA, 16 bp, Artificial Sequence
  synthetic [barcode part1]
cagaaccaacctcagt

SEQ ID NO: 21789 - DNA, 16 bp, Artificial Sequence
  synthetic [barcode part1]
acctcaccgagtctac

SEQ ID NO: 21790 - DNA, 16 bp, Artificial Sequence
  synthetic [barcode part1]
aatcgcagattccttc

SEQ ID NO: 21791 - DNA, 16 bp, Artificial Sequence
  synthetic [barcode part1]
cctagttctctgacct

SEQ ID NO: 21792 - DNA, 16 bp, Artificial Sequence
  synthetic [barcode part1]
gaacggttgcgtcaag

SEQ ID NO: 21793 - DNA, 16 bp, Artificial Sequence
  synthetic [barcode part1]
tataatccttccggtg

SEQ ID NO: 21794 - DNA, 16 bp, Artificial Sequence
  synthetic [barcode part1]
atcgcctcttactacc

SEQ ID NO: 21795 - DNA, 16 bp, Artificial Sequence
  synthetic [barcode part1]
gaagttaacgcagttg

SEQ ID NO: 21796 - DNA, 16 bp, Artificial Sequence
  synthetic [barcode part1]
caggtgaattcgtctg

SEQ ID NO: 21797 - DNA, 16 bp, Artificial Sequence
  synthetic [barcode part1]
gtagaaggccaccagt

SEQ ID NO: 21798 - DNA, 16 bp, Artificial Sequence
  synthetic [barcode part1]
tggtacggaggactgt

SEQ ID NO: 21799 - DNA, 16 bp, Artificial Sequence
  synthetic [barcode part1]
actgcagtgtctgcct

SEQ ID NO: 21800 - DNA, 16 bp, Artificial Sequence
  synthetic [barcode part1]
gaatcaccactctcgc

SEQ ID NO: 21801 - DNA, 16 bp, Artificial Sequence
  synthetic [barcode part1]
ttattccaactacgcg

SEQ ID NO: 21802 - DNA, 16 bp, Artificial Sequence
  synthetic [barcode part1]
gttgttgactggactg

SEQ ID NO: 21803 - DNA, 16 bp, Artificial Sequence
  synthetic [barcode part1]
gtatcggtaacctctt

SEQ ID NO: 21804 - DNA, 16 bp, Artificial Sequence
  synthetic [barcode part1]
gtacgacttaggaagt

SEQ ID NO: 21805 - DNA, 16 bp, Artificial Sequence
  synthetic [barcode part1]
gtggcgtcaattgatc

SEQ ID NO: 21806 - DNA, 16 bp, Artificial Sequence
  synthetic [barcode part1]
cctactcacctcgaag

SEQ ID NO: 21807 - DNA, 16 bp, Artificial Sequence
  synthetic [barcode part1]
gccagtagtggaacgt

SEQ ID NO: 21808 - DNA, 16 bp, Artificial Sequence
  synthetic [barcode part1]
caaccttccttggtct

SEQ ID NO: 21809 - DNA, 16 bp, Artificial Sequence
  synthetic [barcode part1]
ccgaatacagagtggc

SEQ ID NO: 21810 - DNA, 16 bp, Artificial Sequence
  synthetic [barcode part1]
gtgaggattcctgtac

SEQ ID NO: 21811 - DNA, 16 bp, Artificial Sequence
  synthetic [barcode part1]
gtactggaatccgtgt

SEQ ID NO: 21812 - DNA, 16 bp, Artificial Sequence
  synthetic [barcode part1]
aaggcctgtgacactt

SEQ ID NO: 21813 - DNA, 16 bp, Artificial Sequence
  synthetic [barcode part1]
tcagtagtgccagatc

SEQ ID NO: 21814 - DNA, 16 bp, Artificial Sequence
  synthetic [barcode part1]
acctaggatctgcagt

SEQ ID NO: 21815 - DNA, 16 bp, Artificial Sequence
  synthetic [barcode part1]
taggacggtggaatag

SEQ ID NO: 21816 - DNA, 16 bp, Artificial Sequence
  synthetic [barcode part1]
acaacaaggcaacgag

SEQ ID NO: 21817 - DNA, 16 bp, Artificial Sequence
  synthetic [barcode part1]
ttgattcacttggacc

SEQ ID NO: 21818 - DNA, 16 bp, Artificial Sequence
  synthetic [barcode part1]
tgtcgattacggtcag

SEQ ID NO: 21819 - DNA, 16 bp, Artificial Sequence
  synthetic [barcode part1]
gcaattcttcacgccg

SEQ ID NO: 21820 - DNA, 16 bp, Artificial Sequence
  synthetic [barcode part1]
tgattgaacgcgcgtt

SEQ ID NO: 21821 - DNA, 16 bp, Artificial Sequence
  synthetic [barcode part1]
acaacggaagttggag

SEQ ID NO: 21822 - DNA, 16 bp, Artificial Sequence
  synthetic [barcode part1]
gtggtgaagtgacaag

SEQ ID NO: 21823 - DNA, 16 bp, Artificial Sequence
  synthetic [barcode part1]
tactcgaggagattag

SEQ ID NO: 21824 - DNA, 16 bp, Artificial Sequence
  synthetic [barcode part1]
cgttctcgaagatacg

SEQ ID NO: 21825 - DNA, 16 bp, Artificial Sequence
  synthetic [barcode part1]
agtctcctgacttctc

SEQ ID NO: 21826 - DNA, 16 bp, Artificial Sequence
  synthetic [barcode part1]
ttacgtcaacgatcct

SEQ ID NO: 21827 - DNA, 16 bp, Artificial Sequence
  synthetic [barcode part1]
aggtcaggtgttggtg

SEQ ID NO: 21828 - DNA, 16 bp, Artificial Sequence
  synthetic [barcode part1]
tgacgtagtacctgac

SEQ ID NO: 21829 - DNA, 16 bp, Artificial Sequence
  synthetic [barcode part1]
acgagtgcgtcgtaag

SEQ ID NO: 21830 - DNA, 16 bp, Artificial Sequence
  synthetic [barcode part1]
aagtagtcacgccgag

SEQ ID NO: 21831 - DNA, 16 bp, Artificial Sequence
  synthetic [barcode part1]
gacgaagttaggtatc

SEQ ID NO: 21832 - DNA, 16 bp, Artificial Sequence
  synthetic [barcode part1]
gacaggataactctcc

SEQ ID NO: 21833 - DNA, 16 bp, Artificial Sequence
  synthetic [barcode part1]
aggattcgagtaggcc

SEQ ID NO: 21834 - DNA, 16 bp, Artificial Sequence
  synthetic [barcode part1]
ccttacgtcttcgtac

SEQ ID NO: 21835 - DNA, 16 bp, Artificial Sequence
  synthetic [barcode part1]
ccggttcgatacacct

SEQ ID NO: 21836 - DNA, 16 bp, Artificial Sequence
  synthetic [barcode part1]
cgttaacgtcgtgtag

SEQ ID NO: 21837 - DNA, 16 bp, Artificial Sequence
  synthetic [barcode part1]
ataggccacgtctagt

SEQ ID NO: 21838 - DNA, 16 bp, Artificial Sequence
  synthetic [barcode part1]
tcaagtaacctcgtct

SEQ ID NO: 21839 - DNA, 16 bp, Artificial Sequence
  synthetic [barcode part1]
caggagtggattaccg

SEQ ID NO: 21840 - DNA, 16 bp, Artificial Sequence
  synthetic [barcode part1]
tcctcggattggcgtt

SEQ ID NO: 21841 - DNA, 16 bp, Artificial Sequence
  synthetic [barcode part1]
tacaacgtgttcgttc

SEQ ID NO: 21842 - DNA, 16 bp, Artificial Sequence
  synthetic [barcode part1]
gatcgcggacttcttc

SEQ ID NO: 21843 - DNA, 16 bp, Artificial Sequence
  synthetic [barcode part1]
aaggataacctggtac

SEQ ID NO: 21844 - DNA, 16 bp, Artificial Sequence
  synthetic [barcode part1]
gtccaattgtaccttg

SEQ ID NO: 21845 - DNA, 16 bp, Artificial Sequence
  synthetic [barcode part1]
tctggcgtctataccg

SEQ ID NO: 21846 - DNA, 16 bp, Artificial Sequence
  synthetic [barcode part1]
ttattgcaggcggtac

SEQ ID NO: 21847 - DNA, 16 bp, Artificial Sequence
  synthetic [barcode part1]
tactcttagtcaccag

SEQ ID NO: 21848 - DNA, 16 bp, Artificial Sequence
  synthetic [barcode part1]
atctattggcaccact

SEQ ID NO: 21849 - DNA, 16 bp, Artificial Sequence
  synthetic [barcode part1]
cactctcgattcggtg

SEQ ID NO: 21850 - DNA, 16 bp, Artificial Sequence
  synthetic [barcode part1]
tgagtattggccttct

SEQ ID NO: 21851 - DNA, 16 bp, Artificial Sequence
  synthetic [barcode part1]
tggcaatcgactcaac

SEQ ID NO: 21852 - DNA, 16 bp, Artificial Sequence
  synthetic [barcode part1]
gccgtgaacagtattc

SEQ ID NO: 21853 - DNA, 16 bp, Artificial Sequence
  synthetic [barcode part1]
gatatacgtcggcact

SEQ ID NO: 21854 - DNA, 16 bp, Artificial Sequence
  synthetic [barcode part1]
gacagttccgagttac

SEQ ID NO: 21855 - DNA, 16 bp, Artificial Sequence
  synthetic [barcode part1]
gcgccttaatcaccgt

SEQ ID NO: 21856 - DNA, 16 bp, Artificial Sequence
  synthetic [barcode part1]
tccagagaatctcggt

SEQ ID NO: 21857 - DNA, 16 bp, Artificial Sequence
  synthetic [barcode part1]
gatccagactatcggt

SEQ ID NO: 21858 - DNA, 16 bp, Artificial Sequence
  synthetic [barcode part1]
aagtattctgtctcgc

SEQ ID NO: 21859 - DNA, 16 bp, Artificial Sequence
  synthetic [barcode part1]
taggacggtaaggtag

SEQ ID NO: 21860 - DNA, 16 bp, Artificial Sequence
  synthetic [barcode part1]
ccggttgttaagatcg

SEQ ID NO: 21861 - DNA, 16 bp, Artificial Sequence
  synthetic [barcode part1]
aacgcagtgaattgtg

SEQ ID NO: 21862 - DNA, 16 bp, Artificial Sequence
  synthetic [barcode part1]
acttacgtgcagatcg

SEQ ID NO: 21863 - DNA, 16 bp, Artificial Sequence
  synthetic [barcode part1]
acgcgtcttactgtcg

SEQ ID NO: 21864 - DNA, 16 bp, Artificial Sequence
  synthetic [barcode part1]
gaccgacctaattgac

SEQ ID NO: 21865 - DNA, 16 bp, Artificial Sequence
  synthetic [barcode part1]
acgtaactcctctggc

SEQ ID NO: 21866 - DNA, 16 bp, Artificial Sequence
  synthetic [barcode part1]
tacagtccggcagaag

SEQ ID NO: 21867 - DNA, 16 bp, Artificial Sequence
  synthetic [barcode part1]
accgttccaggtgttc

SEQ ID NO: 21868 - DNA, 16 bp, Artificial Sequence
  synthetic [barcode part1]
tgaacaagtcttggag

SEQ ID NO: 21869 - DNA, 16 bp, Artificial Sequence
  synthetic [barcode part1]
tagttctcgtacggcc

SEQ ID NO: 21870 - DNA, 16 bp, Artificial Sequence
  synthetic [barcode part1]
ccgtgttgtagtctgc

SEQ ID NO: 21871 - DNA, 16 bp, Artificial Sequence
  synthetic [barcode part1]
gcgagtaaggccttag

SEQ ID NO: 21872 - DNA, 16 bp, Artificial Sequence
  synthetic [barcode part1]
gaggacttcttccaag

SEQ ID NO: 21873 - DNA, 16 bp, Artificial Sequence
  synthetic [barcode part1]
taccagttcttccaag

SEQ ID NO: 21874 - DNA, 16 bp, Artificial Sequence
  synthetic [barcode part1]
gccgagtataatctgc

SEQ ID NO: 21875 - DNA, 16 bp, Artificial Sequence
  synthetic [barcode part1]
aaggaacgtccagatt

SEQ ID NO: 21876 - DNA, 16 bp, Artificial Sequence
  synthetic [barcode part1]
tgaagtcggagttctc

SEQ ID NO: 21877 - DNA, 16 bp, Artificial Sequence
  synthetic [barcode part1]
attgtccgcaagttct

SEQ ID NO: 21878 - DNA, 16 bp, Artificial Sequence
  synthetic [barcode part1]
ttcagttgcgtcgacc

SEQ ID NO: 21879 - DNA, 16 bp, Artificial Sequence
  synthetic [barcode part1]
ttcacgagtgagttcg

SEQ ID NO: 21880 - DNA, 16 bp, Artificial Sequence
  synthetic [barcode part1]
tggttcaccgttagag

SEQ ID NO: 21881 - DNA, 16 bp, Artificial Sequence
  synthetic [barcode part1]
gcctatacacaggttg

SEQ ID NO: 21882 - DNA, 16 bp, Artificial Sequence
  synthetic [barcode part1]
agagtcgagttgcacg

SEQ ID NO: 21883 - DNA, 16 bp, Artificial Sequence
  synthetic [barcode part1]
cctccttaggatctct

SEQ ID NO: 21884 - DNA, 16 bp, Artificial Sequence
  synthetic [barcode part1]
cggttggtaataccac

SEQ ID NO: 21885 - DNA, 16 bp, Artificial Sequence
  synthetic [barcode part1]
gtcaggtcgaagacgt

SEQ ID NO: 21886 - DNA, 16 bp, Artificial Sequence
  synthetic [barcode part1]
actctgtggtgtgcct

SEQ ID NO: 21887 - DNA, 16 bp, Artificial Sequence
  synthetic [barcode part1]
gtatagataccgaacg

SEQ ID NO: 21888 - DNA, 16 bp, Artificial Sequence
  synthetic [barcode part1]
attcgtgtagtggaag

SEQ ID NO: 21889 - DNA, 16 bp, Artificial Sequence
  synthetic [barcode part1]
cagtagtaaggcgtgc

SEQ ID NO: 21890 - DNA, 16 bp, Artificial Sequence
  synthetic [barcode part1]
acgcagttggttacgt

SEQ ID NO: 21891 - DNA, 16 bp, Artificial Sequence
  synthetic [barcode part1]
aactgtgactgcacac

SEQ ID NO: 21892 - DNA, 16 bp, Artificial Sequence
  synthetic [barcode part1]
tcgaaggatactcaag

SEQ ID NO: 21893 - DNA, 16 bp, Artificial Sequence
  synthetic [barcode part1]
tgaggactcgtatctg

SEQ ID NO: 21894 - DNA, 16 bp, Artificial Sequence
  synthetic [barcode part1]
tcgagatagtaggcgc

SEQ ID NO: 21895 - DNA, 16 bp, Artificial Sequence
  synthetic [barcode part1]
ttgcaactgtgtgcag

SEQ ID NO: 21896 - DNA, 16 bp, Artificial Sequence
  synthetic [barcode part1]
gagacggacctgtagt

SEQ ID NO: 21897 - DNA, 16 bp, Artificial Sequence
  synthetic [barcode part1]
cgattgatcaaggtcc

SEQ ID NO: 21898 - DNA, 16 bp, Artificial Sequence
  synthetic [barcode part1]
gatctgaagaatacgc

SEQ ID NO: 21899 - DNA, 16 bp, Artificial Sequence
  synthetic [barcode part1]
gtggagatagtaatcc

SEQ ID NO: 21900 - DNA, 16 bp, Artificial Sequence
  synthetic [barcode part1]
cctaaccgttggtgtc

SEQ ID NO: 21901 - DNA, 16 bp, Artificial Sequence
  synthetic [barcode part1]
tcactacggcacctgt

SEQ ID NO: 21902 - DNA, 16 bp, Artificial Sequence
  synthetic [barcode part1]
tgttactgcaaccgcc

SEQ ID NO: 21903 - DNA, 16 bp, Artificial Sequence
  synthetic [barcode part1]
gtaccagtacaccagt

SEQ ID NO: 21904 - DNA, 16 bp, Artificial Sequence
  synthetic [barcode part1]
gttgttgtcttcgtag

SEQ ID NO: 21905 - DNA, 16 bp, Artificial Sequence
  synthetic [barcode part1]
cgtcgaaggtagttct

SEQ ID NO: 21906 - DNA, 16 bp, Artificial Sequence
  synthetic [barcode part1]
actcgtattggtgcag

SEQ ID NO: 21907 - DNA, 16 bp, Artificial Sequence
  synthetic [barcode part1]
cactgccgagtgttct

SEQ ID NO: 21908 - DNA, 16 bp, Artificial Sequence
  synthetic [barcode part1]
cgtcctggtgaactct

SEQ ID NO: 21909 - DNA, 16 bp, Artificial Sequence
  synthetic [barcode part1]
ttgagatctgtggcgt

SEQ ID NO: 21910 - DNA, 16 bp, Artificial Sequence
  synthetic [barcode part1]
tgcgaatcgttgcctc

SEQ ID NO: 21911 - DNA, 16 bp, Artificial Sequence
  synthetic [barcode part1]
ttactaccaggcgtcc

SEQ ID NO: 21912 - DNA, 16 bp, Artificial Sequence
  synthetic [barcode part1]
tgaagtcggccttaac

SEQ ID NO: 21913 - DNA, 16 bp, Artificial Sequence
  synthetic [barcode part1]
tgcagttagttcgcag

SEQ ID NO: 21914 - DNA, 16 bp, Artificial Sequence
  synthetic [barcode part1]
aggaattacacaccag

SEQ ID NO: 21915 - DNA, 16 bp, Artificial Sequence
  synthetic [barcode part1]
tgcgtagttcaatcct

SEQ ID NO: 21916 - DNA, 16 bp, Artificial Sequence
  synthetic [barcode part1]
agacggtgttaccttg

SEQ ID NO: 21917 - DNA, 16 bp, Artificial Sequence
  synthetic [barcode part1]
taacgcacgtgttgac

SEQ ID NO: 21918 - DNA, 16 bp, Artificial Sequence
  synthetic [barcode part1]
cgcgtgtgttgattag

SEQ ID NO: 21919 - DNA, 16 bp, Artificial Sequence
  synthetic [barcode part1]
aggcaccttgtctcac

SEQ ID NO: 21920 - DNA, 16 bp, Artificial Sequence
  synthetic [barcode part1]
tcaacgaagtgacctc

SEQ ID NO: 21921 - DNA, 16 bp, Artificial Sequence
  synthetic [barcode part1]
tcgatccagatatctc

SEQ ID NO: 21922 - DNA, 16 bp, Artificial Sequence
  synthetic [barcode part1]
acgagttgcgtagttc

SEQ ID NO: 21923 - DNA, 16 bp, Artificial Sequence
  synthetic [barcode part1]
ttgttgcctactccgt

SEQ ID NO: 21924 - DNA, 16 bp, Artificial Sequence
  synthetic [barcode part1]
tgtcgccactcaggtt

SEQ ID NO: 21925 - DNA, 16 bp, Artificial Sequence
  synthetic [barcode part1]
tgttgacagtctcttg

SEQ ID NO: 21926 - DNA, 16 bp, Artificial Sequence
  synthetic [barcode part1]
atagacaagtgttgcg

SEQ ID NO: 21927 - DNA, 16 bp, Artificial Sequence
  synthetic [barcode part1]
gtctagtattgccgag

SEQ ID NO: 21928 - DNA, 16 bp, Artificial Sequence
  synthetic [barcode part1]
gacgtacgtgttgact

SEQ ID NO: 21929 - DNA, 16 bp, Artificial Sequence
  synthetic [barcode part1]
cgtaactcggtccttg

SEQ ID NO: 21930 - DNA, 16 bp, Artificial Sequence
  synthetic [barcode part1]
tgcaatctaactctcg

SEQ ID NO: 21931 - DNA, 16 bp, Artificial Sequence
  synthetic [barcode part1]
gtgtctcttgatagtc

SEQ ID NO: 21932 - DNA, 16 bp, Artificial Sequence
  synthetic [barcode part1]
ttactgtgatacctgc

SEQ ID NO: 21933 - DNA, 16 bp, Artificial Sequence
  synthetic [barcode part1]
gaccaatcgacgttac

SEQ ID NO: 21934 - DNA, 16 bp, Artificial Sequence
  synthetic [barcode part1]
gacgagagattcacgc

SEQ ID NO: 21935 - DNA, 16 bp, Artificial Sequence
  synthetic [barcode part1]
gcaatctgacaatccg

SEQ ID NO: 21936 - DNA, 16 bp, Artificial Sequence
  synthetic [barcode part1]
gagaattctccggttg

SEQ ID NO: 21937 - DNA, 16 bp, Artificial Sequence
  synthetic [barcode part1]
tcctagtgcactcggt

SEQ ID NO: 21938 - DNA, 16 bp, Artificial Sequence
  synthetic [barcode part1]
gagtcagatattgacg

SEQ ID NO: 21939 - DNA, 16 bp, Artificial Sequence
  synthetic [barcode part1]
atcggttcagtcagtg

SEQ ID NO: 21940 - DNA, 16 bp, Artificial Sequence
  synthetic [barcode part1]
agtgaggtatagactc

SEQ ID NO: 21941 - DNA, 16 bp, Artificial Sequence
  synthetic [barcode part1]
acagatctcttcagtc

SEQ ID NO: 21942 - DNA, 16 bp, Artificial Sequence
  synthetic [barcode part1]
tcgcgtgtacagttag

SEQ ID NO: 21943 - DNA, 16 bp, Artificial Sequence
  synthetic [barcode part1]
cctgttgttggatatc

SEQ ID NO: 21944 - DNA, 16 bp, Artificial Sequence
  synthetic [barcode part1]
cctgaaggaagtcctt

SEQ ID NO: 21945 - DNA, 16 bp, Artificial Sequence
  synthetic [barcode part1]
ccaataggtaagagtc

SEQ ID NO: 21946 - DNA, 16 bp, Artificial Sequence
  synthetic [barcode part1]
cgtggtcctctgttag

SEQ ID NO: 21947 - DNA, 16 bp, Artificial Sequence
  synthetic [barcode part1]
ttactaacgacggtcg

SEQ ID NO: 21948 - DNA, 16 bp, Artificial Sequence
  synthetic [barcode part1]
tcgccacggatctact

SEQ ID NO: 21949 - DNA, 16 bp, Artificial Sequence
  synthetic [barcode part1]
cctgcacgacctaact

SEQ ID NO: 21950 - DNA, 16 bp, Artificial Sequence
  synthetic [barcode part1]
ataattcctcgcgccg

SEQ ID NO: 21951 - DNA, 16 bp, Artificial Sequence
  synthetic [barcode part1]
tcggaattacctactc

SEQ ID NO: 21952 - DNA, 16 bp, Artificial Sequence
  synthetic [barcode part1]
aacttgactctgcact

SEQ ID NO: 21953 - DNA, 16 bp, Artificial Sequence
  synthetic [barcode part1]
ccaagagtgtaagttg

SEQ ID NO: 21954 - DNA, 16 bp, Artificial Sequence
  synthetic [barcode part1]
taacgtgtagtaggac

SEQ ID NO: 21955 - DNA, 16 bp, Artificial Sequence
  synthetic [barcode part1]
gatcgtggcgtcaatt

SEQ ID NO: 21956 - DNA, 16 bp, Artificial Sequence
  synthetic [barcode part1]
caactggagttgacct

SEQ ID NO: 21957 - DNA, 16 bp, Artificial Sequence
  synthetic [barcode part1]
tggtaacgcgtaggac

SEQ ID NO: 21958 - DNA, 16 bp, Artificial Sequence
  synthetic [barcode part1]
tagtcagatcggtcac

SEQ ID NO: 21959 - DNA, 16 bp, Artificial Sequence
  synthetic [barcode part1]
gttgaaccagaagtac

SEQ ID NO: 21960 - DNA, 16 bp, Artificial Sequence
  synthetic [barcode part1]
cgtcggaagattgttc

SEQ ID NO: 21961 - DNA, 16 bp, Artificial Sequence
  synthetic [barcode part1]
tcgcctactgtgacac

SEQ ID NO: 21962 - DNA, 16 bp, Artificial Sequence
  synthetic [barcode part1]
gtacaggcgagaatag

SEQ ID NO: 21963 - DNA, 16 bp, Artificial Sequence
  synthetic [barcode part1]
agatcgtcgttcttac

SEQ ID NO: 21964 - DNA, 16 bp, Artificial Sequence
  synthetic [barcode part1]
agtacaccacagtcac

SEQ ID NO: 21965 - DNA, 16 bp, Artificial Sequence
  synthetic [barcode part1]
tccgacctctcaatct

SEQ ID NO: 21966 - DNA, 16 bp, Artificial Sequence
  synthetic [barcode part1]
taattggacgtcgcgt

SEQ ID NO: 21967 - DNA, 16 bp, Artificial Sequence
  synthetic [barcode part1]
aagaagtcgttaacgc

SEQ ID NO: 21968 - DNA, 16 bp, Artificial Sequence
  synthetic [barcode part1]
gtacacgaggatctct

SEQ ID NO: 21969 - DNA, 16 bp, Artificial Sequence
  synthetic [barcode part1]
tcgtaggtaggtctgt

SEQ ID NO: 21970 - DNA, 16 bp, Artificial Sequence
  synthetic [barcode part1]
tcttatctgaggcgag

SEQ ID NO: 21971 - DNA, 16 bp, Artificial Sequence
  synthetic [barcode part1]
gcggtcttgtcttcag

SEQ ID NO: 21972 - DNA, 16 bp, Artificial Sequence
  synthetic [barcode part1]
tcagagttaggtagac

SEQ ID NO: 21973 - DNA, 16 bp, Artificial Sequence
  synthetic [barcode part1]
cgtctaacgtgagttg

SEQ ID NO: 21974 - DNA, 16 bp, Artificial Sequence
  synthetic [barcode part1]
cgcagtgacagtattc

SEQ ID NO: 21975 - DNA, 16 bp, Artificial Sequence
  synthetic [barcode part1]
ccagatattgcagacc

SEQ ID NO: 21976 - DNA, 16 bp, Artificial Sequence
  synthetic [barcode part1]
tccggtcgcgttaact

SEQ ID NO: 21977 - DNA, 16 bp, Artificial Sequence
  synthetic [barcode part1]
tgtctcctacgaagag

SEQ ID NO: 21978 - DNA, 16 bp, Artificial Sequence
  synthetic [barcode part1]
tcaacttgcaatcgtc

SEQ ID NO: 21979 - DNA, 16 bp, Artificial Sequence
  synthetic [barcode part1]
tcgcagaagaccgagt

SEQ ID NO: 21980 - DNA, 16 bp, Artificial Sequence
  synthetic [barcode part1]
cgaaggaagttccttc

SEQ ID NO: 21981 - DNA, 16 bp, Artificial Sequence
  synthetic [barcode part1]
tctctgatcgagaggt

SEQ ID NO: 21982 - DNA, 16 bp, Artificial Sequence
  synthetic [barcode part1]
ttccgcgccaacagtt

SEQ ID NO: 21983 - DNA, 16 bp, Artificial Sequence
  synthetic [barcode part1]
tgatcagatcgtggtc

SEQ ID NO: 21984 - DNA, 16 bp, Artificial Sequence
  synthetic [barcode part1]
tagatcggccgttaac

SEQ ID NO: 21985 - DNA, 16 bp, Artificial Sequence
  synthetic [barcode part1]
cagaccaactgttggt

SEQ ID NO: 21986 - DNA, 16 bp, Artificial Sequence
  synthetic [barcode part1]
tccgattgtcggcgtt

SEQ ID NO: 21987 - DNA, 16 bp, Artificial Sequence
  synthetic [barcode part1]
tgtgagtccactccac

SEQ ID NO: 21988 - DNA, 16 bp, Artificial Sequence
  synthetic [barcode part1]
ttctgcgactattgac

SEQ ID NO: 21989 - DNA, 16 bp, Artificial Sequence
  synthetic [barcode part1]
gtatcctgtcgttagt

SEQ ID NO: 21990 - DNA, 16 bp, Artificial Sequence
  synthetic [barcode part1]
cctaagttcacgtgag

SEQ ID NO: 21991 - DNA, 16 bp, Artificial Sequence
  synthetic [barcode part1]
cgtggatacttgcagt

SEQ ID NO: 21992 - DNA, 16 bp, Artificial Sequence
  synthetic [barcode part1]
agttcttgatcacgtc

SEQ ID NO: 21993 - DNA, 16 bp, Artificial Sequence
  synthetic [barcode part1]
aaggcctgacactgtt

SEQ ID NO: 21994 - DNA, 16 bp, Artificial Sequence
  synthetic [barcode part1]
cacgattgtcgaggag

SEQ ID NO: 21995 - DNA, 16 bp, Artificial Sequence
  synthetic [barcode part1]
gacgttgactggttgt

SEQ ID NO: 21996 - DNA, 16 bp, Artificial Sequence
  synthetic [barcode part1]
gagacgtgacttggtg

SEQ ID NO: 21997 - DNA, 16 bp, Artificial Sequence
  synthetic [barcode part1]
tatcgactgatcgcag

SEQ ID NO: 21998 - DNA, 16 bp, Artificial Sequence
  synthetic [barcode part1]
gtgacactgtggtgtt

SEQ ID NO: 21999 - DNA, 16 bp, Artificial Sequence
  synthetic [barcode part1]
acggtgattgtcgttg

SEQ ID NO: 22000 - DNA, 16 bp, Artificial Sequence
  synthetic [barcode part1]
gttccaccaaggaatc

SEQ ID NO: 22001 - DNA, 16 bp, Artificial Sequence
  synthetic [barcode part1]
aacgtcttgtctcgcg

SEQ ID NO: 22002 - DNA, 16 bp, Artificial Sequence
  synthetic [barcode part1]
gcaagactgttgtctg

SEQ ID NO: 22003 - DNA, 16 bp, Artificial Sequence
  synthetic [barcode part1]
accttgaggtctcaag

SEQ ID NO: 22004 - DNA, 16 bp, Artificial Sequence
  synthetic [barcode part1]
caagtcacgatagtcc

SEQ ID NO: 22005 - DNA, 16 bp, Artificial Sequence
  synthetic [barcode part1]
cacagactgttcaggt

SEQ ID NO: 22006 - DNA, 16 bp, Artificial Sequence
  synthetic [barcode part1]
tgtgataggtgaacgt

SEQ ID NO: 22007 - DNA, 16 bp, Artificial Sequence
  synthetic [barcode part1]
cacgcagagtaacgac

SEQ ID NO: 22008 - DNA, 16 bp, Artificial Sequence
  synthetic [barcode part1]
aatctccaacctgtgt

SEQ ID NO: 22009 - DNA, 16 bp, Artificial Sequence
  synthetic [barcode part1]
tgactgtacggttacg

SEQ ID NO: 22010 - DNA, 16 bp, Artificial Sequence
  synthetic [barcode part1]
gcgaacacgagacttg

SEQ ID NO: 22011 - DNA, 16 bp, Artificial Sequence
  synthetic [barcode part1]
gagttaacgtacggcg

SEQ ID NO: 22012 - DNA, 16 bp, Artificial Sequence
  synthetic [barcode part1]
tgaacgcgttatcctt

SEQ ID NO: 22013 - DNA, 16 bp, Artificial Sequence
  synthetic [barcode part1]
tgaactgcctcacgtc

SEQ ID NO: 22014 - DNA, 16 bp, Artificial Sequence
  synthetic [barcode part1]
tgaattgtctcgcact

SEQ ID NO: 22015 - DNA, 16 bp, Artificial Sequence
  synthetic [barcode part1]
ccaggtgaggcaatac

SEQ ID NO: 22016 - DNA, 16 bp, Artificial Sequence
  synthetic [barcode part1]
ttaactacgacgccag

SEQ ID NO: 22017 - DNA, 16 bp, Artificial Sequence
  synthetic [barcode part1]
caccaattcggtcctg

SEQ ID NO: 22018 - DNA, 16 bp, Artificial Sequence
  synthetic [barcode part1]
agttagttgcgcacgt

SEQ ID NO: 22019 - DNA, 16 bp, Artificial Sequence
  synthetic [barcode part1]
attcgagaagttcgcc

SEQ ID NO: 22020 - DNA, 16 bp, Artificial Sequence
  synthetic [barcode part1]
acttccgtgccgaatc

SEQ ID NO: 22021 - DNA, 16 bp, Artificial Sequence
  synthetic [barcode part1]
aatcgcactcttcaac

SEQ ID NO: 22022 - DNA, 16 bp, Artificial Sequence
  synthetic [barcode part1]
tgtagacgacactcac

SEQ ID NO: 22023 - DNA, 16 bp, Artificial Sequence
  synthetic [barcode part1]
cctgttcttatccacg

SEQ ID NO: 22024 - DNA, 16 bp, Artificial Sequence
  synthetic [barcode part1]
tctgagtcgtcgatag

SEQ ID NO: 22025 - DNA, 16 bp, Artificial Sequence
  synthetic [barcode part1]
aattccgagacaagtg

SEQ ID NO: 22026 - DNA, 16 bp, Artificial Sequence
  synthetic [barcode part1]
tcgaacactaccttac

SEQ ID NO: 22027 - DNA, 16 bp, Artificial Sequence
  synthetic [barcode part1]
gtgtgttcgtcaacag

SEQ ID NO: 22028 - DNA, 16 bp, Artificial Sequence
  synthetic [barcode part1]
atcgacggacgacagt

SEQ ID NO: 22029 - DNA, 16 bp, Artificial Sequence
  synthetic [barcode part1]
gttacctaacacctgt

SEQ ID NO: 22030 - DNA, 16 bp, Artificial Sequence
  synthetic [barcode part1]
tggttgtgcaattgcg

SEQ ID NO: 22031 - DNA, 16 bp, Artificial Sequence
  synthetic [barcode part1]
aggttactgcctctgc

SEQ ID NO: 22032 - DNA, 16 bp, Artificial Sequence
  synthetic [barcode part1]
ttatacttcgccgagt

SEQ ID NO: 22033 - DNA, 16 bp, Artificial Sequence
  synthetic [barcode part1]
atcggtgcggagaact

SEQ ID NO: 22034 - DNA, 16 bp, Artificial Sequence
  synthetic [barcode part1]
cggcagttatattctc

SEQ ID NO: 22035 - DNA, 16 bp, Artificial Sequence
  synthetic [barcode part1]
gtgacttcgaaggcag

SEQ ID NO: 22036 - DNA, 16 bp, Artificial Sequence
  synthetic [barcode part1]
acactgagactacacc

SEQ ID NO: 22037 - DNA, 16 bp, Artificial Sequence
  synthetic [barcode part1]
gcctcgtcttgattct

SEQ ID NO: 22038 - DNA, 16 bp, Artificial Sequence
  synthetic [barcode part1]
tctcttcgaaggagac

SEQ ID NO: 22039 - DNA, 16 bp, Artificial Sequence
  synthetic [barcode part1]
tcgattcgcggtcgtt

SEQ ID NO: 22040 - DNA, 16 bp, Artificial Sequence
  synthetic [barcode part1]
atcggatctcgcgttc

SEQ ID NO: 22041 - DNA, 16 bp, Artificial Sequence
  synthetic [barcode part1]
agtactgtggtgttgc

SEQ ID NO: 22042 - DNA, 16 bp, Artificial Sequence
  synthetic [barcode part1]
cactggacaccgaatt

SEQ ID NO: 22043 - DNA, 16 bp, Artificial Sequence
  synthetic [barcode part1]
taccacctatcctgtc

SEQ ID NO: 22044 - DNA, 16 bp, Artificial Sequence
  synthetic [barcode part1]
tagactaccttgcact

SEQ ID NO: 22045 - DNA, 16 bp, Artificial Sequence
  synthetic [barcode part1]
agacaaggcctactct

SEQ ID NO: 22046 - DNA, 16 bp, Artificial Sequence
  synthetic [barcode part1]
acgtaaccgactgtac

SEQ ID NO: 22047 - DNA, 16 bp, Artificial Sequence
  synthetic [barcode part1]
caactacacaaggtag

SEQ ID NO: 22048 - DNA, 16 bp, Artificial Sequence
  synthetic [barcode part1]
cctggaactcttcctt

SEQ ID NO: 22049 - DNA, 16 bp, Artificial Sequence
  synthetic [barcode part1]
actctagtggttgacg

SEQ ID NO: 22050 - DNA, 16 bp, Artificial Sequence
  synthetic [barcode part1]
tcttggcgaagactac

SEQ ID NO: 22051 - DNA, 16 bp, Artificial Sequence
  synthetic [barcode part1]
cacaacagtaagtgac

SEQ ID NO: 22052 - DNA, 16 bp, Artificial Sequence
  synthetic [barcode part1]
cgcctattcgcagtac

SEQ ID NO: 22053 - DNA, 16 bp, Artificial Sequence
  synthetic [barcode part1]
tcaacgtctgacctcg

SEQ ID NO: 22054 - DNA, 16 bp, Artificial Sequence
  synthetic [barcode part1]
ttcgtacgtacctcct

SEQ ID NO: 22055 - DNA, 16 bp, Artificial Sequence
  synthetic [barcode part1]
gcagagtacagacctg

SEQ ID NO: 22056 - DNA, 16 bp, Artificial Sequence
  synthetic [barcode part1]
cctcagtgtgtctgac

SEQ ID NO: 22057 - DNA, 16 bp, Artificial Sequence
  synthetic [barcode part1]
gcgtgacgtcaatatc

SEQ ID NO: 22058 - DNA, 16 bp, Artificial Sequence
  synthetic [barcode part1]
actgcaacctgagatc

SEQ ID NO: 22059 - DNA, 16 bp, Artificial Sequence
  synthetic [barcode part1]
ccttacgtgacttaac

SEQ ID NO: 22060 - DNA, 16 bp, Artificial Sequence
  synthetic [barcode part1]
gatcacactgatcttc

SEQ ID NO: 22061 - DNA, 16 bp, Artificial Sequence
  synthetic [barcode part1]
agtgaagatactcggt

SEQ ID NO: 22062 - DNA, 16 bp, Artificial Sequence
  synthetic [barcode part1]
aggccgttatcttcgc

SEQ ID NO: 22063 - DNA, 16 bp, Artificial Sequence
  synthetic [barcode part1]
gacctgagatcgttgt

SEQ ID NO: 22064 - DNA, 16 bp, Artificial Sequence
  synthetic [barcode part1]
tcggagtggataagtt

SEQ ID NO: 22065 - DNA, 16 bp, Artificial Sequence
  synthetic [barcode part1]
cctcactgcgaacttg

SEQ ID NO: 22066 - DNA, 16 bp, Artificial Sequence
  synthetic [barcode part1]
taacgaaggcgaagtg

SEQ ID NO: 22067 - DNA, 16 bp, Artificial Sequence
  synthetic [barcode part1]
agaggcgtgttaagtt

SEQ ID NO: 22068 - DNA, 16 bp, Artificial Sequence
  synthetic [barcode part1]
acaaggcaccttatcg

SEQ ID NO: 22069 - DNA, 16 bp, Artificial Sequence
  synthetic [barcode part1]
caccgagaacacgaac

SEQ ID NO: 22070 - DNA, 16 bp, Artificial Sequence
  synthetic [barcode part1]
cagatctgaactcacg

SEQ ID NO: 22071 - DNA, 16 bp, Artificial Sequence
  synthetic [barcode part1]
tcttcctgagaaggac

SEQ ID NO: 22072 - DNA, 16 bp, Artificial Sequence
  synthetic [barcode part1]
acgaattgtcaggagt

SEQ ID NO: 22073 - DNA, 16 bp, Artificial Sequence
  synthetic [barcode part1]
gtcaagtaagtgtgac

SEQ ID NO: 22074 - DNA, 16 bp, Artificial Sequence
  synthetic [barcode part1]
actgtagttgttcacc

SEQ ID NO: 22075 - DNA, 16 bp, Artificial Sequence
  synthetic [barcode part1]
gaatacctccagacac

SEQ ID NO: 22076 - DNA, 16 bp, Artificial Sequence
  synthetic [barcode part1]
tgtgatctgtgtcgag

SEQ ID NO: 22077 - DNA, 16 bp, Artificial Sequence
  synthetic [barcode part1]
agttccacgagattcg

SEQ ID NO: 22078 - DNA, 16 bp, Artificial Sequence
  synthetic [barcode part1]
cacagttaaggtagtg

SEQ ID NO: 22079 - DNA, 16 bp, Artificial Sequence
  synthetic [barcode part1]
tctggcgaatacggag

SEQ ID NO: 22080 - DNA, 16 bp, Artificial Sequence
  synthetic [barcode part1]
tattgagtcgcgttct

SEQ ID NO: 22081 - DNA, 16 bp, Artificial Sequence
  synthetic [barcode part1]
ttcgagagtatacgcc

SEQ ID NO: 22082 - DNA, 16 bp, Artificial Sequence
  synthetic [barcode part1]
cacgattaatcgcacg

SEQ ID NO: 22083 - DNA, 16 bp, Artificial Sequence
  synthetic [barcode part1]
tgtccgttggagttcc

SEQ ID NO: 22084 - DNA, 16 bp, Artificial Sequence
  synthetic [barcode part1]
ccaccgtaggtctgtt

SEQ ID NO: 22085 - DNA, 16 bp, Artificial Sequence
  synthetic [barcode part1]
tgatcacacctgagtg

SEQ ID NO: 22086 - DNA, 16 bp, Artificial Sequence
  synthetic [barcode part1]
ccaatccgtaattacc

SEQ ID NO: 22087 - DNA, 16 bp, Artificial Sequence
  synthetic [barcode part1]
gcgttattcacttacg

SEQ ID NO: 22088 - DNA, 16 bp, Artificial Sequence
  synthetic [barcode part1]
acttccggcaatccac

SEQ ID NO: 22089 - DNA, 16 bp, Artificial Sequence
  synthetic [barcode part1]
tgtccgtcgaatagac

SEQ ID NO: 22090 - DNA, 16 bp, Artificial Sequence
  synthetic [barcode part1]
cgagagtaataatccg

SEQ ID NO: 22091 - DNA, 16 bp, Artificial Sequence
  synthetic [barcode part1]
atcctgacaactgacg

SEQ ID NO: 22092 - DNA, 16 bp, Artificial Sequence
  synthetic [barcode part1]
ataccgataacaggac

SEQ ID NO: 22093 - DNA, 16 bp, Artificial Sequence
  synthetic [barcode part1]
cgtattcggtaactct

SEQ ID NO: 22094 - DNA, 16 bp, Artificial Sequence
  synthetic [barcode part1]
gtatcctaccgccagt

SEQ ID NO: 22095 - DNA, 16 bp, Artificial Sequence
  synthetic [barcode part1]
cgtctggtagtccttg

SEQ ID NO: 22096 - DNA, 16 bp, Artificial Sequence
  synthetic [barcode part1]
ttcgcggtactactcg

SEQ ID NO: 22097 - DNA, 16 bp, Artificial Sequence
  synthetic [barcode part1]
caactctcacgtagtt

SEQ ID NO: 22098 - DNA, 16 bp, Artificial Sequence
  synthetic [barcode part1]
aattcggatacctctc

SEQ ID NO: 22099 - DNA, 16 bp, Artificial Sequence
  synthetic [barcode part1]
gagttgtgcctctgtc

SEQ ID NO: 22100 - DNA, 16 bp, Artificial Sequence
  synthetic [barcode part1]
tgtgttcggacacagt

SEQ ID NO: 22101 - DNA, 16 bp, Artificial Sequence
  synthetic [barcode part1]
gtactgtgatagacag

SEQ ID NO: 22102 - DNA, 16 bp, Artificial Sequence
  synthetic [barcode part1]
ccaccgttaggatagt

SEQ ID NO: 22103 - DNA, 16 bp, Artificial Sequence
  synthetic [barcode part1]
gagagtgcaagagtac

SEQ ID NO: 22104 - DNA, 16 bp, Artificial Sequence
  synthetic [barcode part1]
tagtgatcacgtcctt

SEQ ID NO: 22105 - DNA, 16 bp, Artificial Sequence
  synthetic [barcode part1]
tggttgttcgcgtaag

SEQ ID NO: 22106 - DNA, 16 bp, Artificial Sequence
  synthetic [barcode part1]
aggataacctggatac

SEQ ID NO: 22107 - DNA, 16 bp, Artificial Sequence
  synthetic [barcode part1]
gagatctagacctcac

SEQ ID NO: 22108 - DNA, 16 bp, Artificial Sequence
  synthetic [barcode part1]
tcgacttcgaattcgt

SEQ ID NO: 22109 - DNA, 16 bp, Artificial Sequence
  synthetic [barcode part1]
agaagttaggaccgag

SEQ ID NO: 22110 - DNA, 16 bp, Artificial Sequence
  synthetic [barcode part1]
agtgacttcgaaccac

SEQ ID NO: 22111 - DNA, 16 bp, Artificial Sequence
  synthetic [barcode part1]
gatacggtgtcaggtg

SEQ ID NO: 22112 - DNA, 16 bp, Artificial Sequence
  synthetic [barcode part1]
gagacttatctactcc

SEQ ID NO: 22113 - DNA, 16 bp, Artificial Sequence
  synthetic [barcode part1]
acacaggcgttaggtg

SEQ ID NO: 22114 - DNA, 16 bp, Artificial Sequence
  synthetic [barcode part1]
tccggaatagtcgact

SEQ ID NO: 22115 - DNA, 16 bp, Artificial Sequence
  synthetic [barcode part1]
ccgcaggtgaagaact

SEQ ID NO: 22116 - DNA, 16 bp, Artificial Sequence
  synthetic [barcode part1]
cgcctgtgtctatctt

SEQ ID NO: 22117 - DNA, 16 bp, Artificial Sequence
  synthetic [barcode part1]
gttacttctgcaagtc

SEQ ID NO: 22118 - DNA, 16 bp, Artificial Sequence
  synthetic [barcode part1]
acaggtgtctgaggtg

SEQ ID NO: 22119 - DNA, 16 bp, Artificial Sequence
  synthetic [barcode part1]
gagttcggtaaggcgt

SEQ ID NO: 22120 - DNA, 16 bp, Artificial Sequence
  synthetic [barcode part1]
tgaatccagtagagtg

SEQ ID NO: 22121 - DNA, 16 bp, Artificial Sequence
  synthetic [barcode part1]
gaactatctgccgagt

SEQ ID NO: 22122 - DNA, 16 bp, Artificial Sequence
  synthetic [barcode part1]
aatcggcgttggttgt

SEQ ID NO: 22123 - DNA, 16 bp, Artificial Sequence
  synthetic [barcode part1]
tcagaacacagacaac

SEQ ID NO: 22124 - DNA, 16 bp, Artificial Sequence
  synthetic [barcode part1]
ccgagacttgtgatac

SEQ ID NO: 22125 - DNA, 16 bp, Artificial Sequence
  synthetic [barcode part1]
gtctcctgaaggattg

SEQ ID NO: 22126 - DNA, 16 bp, Artificial Sequence
  synthetic [barcode part1]
agtagaacgcgagtcc

SEQ ID NO: 22127 - DNA, 16 bp, Artificial Sequence
  synthetic [barcode part1]
gcacagtgtcaacgtt

SEQ ID NO: 22128 - DNA, 16 bp, Artificial Sequence
  synthetic [barcode part1]
aagtacaccttacgcg

SEQ ID NO: 22129 - DNA, 16 bp, Artificial Sequence
  synthetic [barcode part1]
gtcacggtcgtctatc

SEQ ID NO: 22130 - DNA, 16 bp, Artificial Sequence
  synthetic [barcode part1]
ttcgtccgacactacg

SEQ ID NO: 22131 - DNA, 16 bp, Artificial Sequence
  synthetic [barcode part1]
aggttctgactgatcg

SEQ ID NO: 22132 - DNA, 16 bp, Artificial Sequence
  synthetic [barcode part1]
cgaactgactggatct

SEQ ID NO: 22133 - DNA, 16 bp, Artificial Sequence
  synthetic [barcode part1]
acctacacgaccttcg

SEQ ID NO: 22134 - DNA, 16 bp, Artificial Sequence
  synthetic [barcode part1]
ataacacgactccggt

SEQ ID NO: 22135 - DNA, 16 bp, Artificial Sequence
  synthetic [barcode part1]
ttggcaaggatacaac

SEQ ID NO: 22136 - DNA, 16 bp, Artificial Sequence
  synthetic [barcode part1]
caaggttgtgtgtacc

SEQ ID NO: 22137 - DNA, 16 bp, Artificial Sequence
  synthetic [barcode part1]
gtcagaccgtcgaatt

SEQ ID NO: 22138 - DNA, 16 bp, Artificial Sequence
  synthetic [barcode part1]
ataacgcgtcgactac

SEQ ID NO: 22139 - DNA, 16 bp, Artificial Sequence
  synthetic [barcode part1]
tgtaagacgattcgag

SEQ ID NO: 22140 - DNA, 16 bp, Artificial Sequence
  synthetic [barcode part1]
tactgtccttggtcct

SEQ ID NO: 22141 - DNA, 16 bp, Artificial Sequence
  synthetic [barcode part1]
ccgttcaacagtattc

SEQ ID NO: 22142 - DNA, 16 bp, Artificial Sequence
  synthetic [barcode part1]
cggttcggttcttacg

SEQ ID NO: 22143 - DNA, 16 bp, Artificial Sequence
  synthetic [barcode part1]
tgccttggaatagtgc

SEQ ID NO: 22144 - DNA, 16 bp, Artificial Sequence
  synthetic [barcode part1]
ttaatccacggtcgcc

SEQ ID NO: 22145 - DNA, 16 bp, Artificial Sequence
  synthetic [barcode part1]
tgtcaccttcaactcc

SEQ ID NO: 22146 - DNA, 16 bp, Artificial Sequence
  synthetic [barcode part1]
cgatccttgtagtcgc

SEQ ID NO: 22147 - DNA, 16 bp, Artificial Sequence
  synthetic [barcode part1]
gtccaaggaactcact

SEQ ID NO: 22148 - DNA, 16 bp, Artificial Sequence
  synthetic [barcode part1]
cggttgcagatcagag

SEQ ID NO: 22149 - DNA, 16 bp, Artificial Sequence
  synthetic [barcode part1]
tcgaacacaggtatcc

SEQ ID NO: 22150 - DNA, 16 bp, Artificial Sequence
  synthetic [barcode part1]
ttgcaggcctaattct

SEQ ID NO: 22151 - DNA, 16 bp, Artificial Sequence
  synthetic [barcode part1]
tagaccaagtcactgc

SEQ ID NO: 22152 - DNA, 16 bp, Artificial Sequence
  synthetic [barcode part1]
gtagaggattatcgac

SEQ ID NO: 22153 - DNA, 16 bp, Artificial Sequence
  synthetic [barcode part1]
ttgagtcaagacacag

SEQ ID NO: 22154 - DNA, 16 bp, Artificial Sequence
  synthetic [barcode part1]
tcgtagaagatcgaac

SEQ ID NO: 22155 - DNA, 16 bp, Artificial Sequence
  synthetic [barcode part1]
acttgcaacacaaccg

SEQ ID NO: 22156 - DNA, 16 bp, Artificial Sequence
  synthetic [barcode part1]
acaatccgtggttcag

SEQ ID NO: 22157 - DNA, 16 bp, Artificial Sequence
  synthetic [barcode part1]
cacagtacttgtccgc

SEQ ID NO: 22158 - DNA, 16 bp, Artificial Sequence
  synthetic [barcode part1]
tatcttgttcggacac

SEQ ID NO: 22159 - DNA, 16 bp, Artificial Sequence
  synthetic [barcode part1]
gttcgagtaaggtagt

SEQ ID NO: 22160 - DNA, 16 bp, Artificial Sequence
  synthetic [barcode part1]
cggtcaagattgacct

SEQ ID NO: 22161 - DNA, 16 bp, Artificial Sequence
  synthetic [barcode part1]
aggaagattggaaccg

SEQ ID NO: 22162 - DNA, 16 bp, Artificial Sequence
  synthetic [barcode part1]
gtaatcctagaccacg

SEQ ID NO: 22163 - DNA, 16 bp, Artificial Sequence
  synthetic [barcode part1]
atccgatacgtcctcg

SEQ ID NO: 22164 - DNA, 16 bp, Artificial Sequence
  synthetic [barcode part1]
tcaagtgccgtcttgc

SEQ ID NO: 22165 - DNA, 16 bp, Artificial Sequence
  synthetic [barcode part1]
gacggaaccagtacac

SEQ ID NO: 22166 - DNA, 16 bp, Artificial Sequence
  synthetic [barcode part1]
cacgattaccggagag

SEQ ID NO: 22167 - DNA, 16 bp, Artificial Sequence
  synthetic [barcode part1]
tctgagtacgaggcag

SEQ ID NO: 22168 - DNA, 16 bp, Artificial Sequence
  synthetic [barcode part1]
acaacaaggacgtccg

SEQ ID NO: 22169 - DNA, 16 bp, Artificial Sequence
  synthetic [barcode part1]
cacctaacacgaatcg

SEQ ID NO: 22170 - DNA, 16 bp, Artificial Sequence
  synthetic [barcode part1]
ccgtgtgagtcagaag

SEQ ID NO: 22171 - DNA, 16 bp, Artificial Sequence
  synthetic [barcode part1]
cgagattgccagttac

SEQ ID NO: 22172 - DNA, 16 bp, Artificial Sequence
  synthetic [barcode part1]
gagtcgtctacgcctt

SEQ ID NO: 22173 - DNA, 16 bp, Artificial Sequence
  synthetic [barcode part1]
gatcctacgttgcaag

SEQ ID NO: 22174 - DNA, 16 bp, Artificial Sequence
  synthetic [barcode part1]
agaactcttatctgcc

SEQ ID NO: 22175 - DNA, 16 bp, Artificial Sequence
  synthetic [barcode part1]
tacgacaggtaagtac

SEQ ID NO: 22176 - DNA, 16 bp, Artificial Sequence
  synthetic [barcode part1]
aagttagtaacgtgcg

SEQ ID NO: 22177 - DNA, 16 bp, Artificial Sequence
  synthetic [barcode part1]
aaccgagacaattgtg

SEQ ID NO: 22178 - DNA, 16 bp, Artificial Sequence
  synthetic [barcode part1]
acagtcaaccaacgtc

SEQ ID NO: 22179 - DNA, 16 bp, Artificial Sequence
  synthetic [barcode part1]
aggataactgcctcac

SEQ ID NO: 22180 - DNA, 16 bp, Artificial Sequence
  synthetic [barcode part1]
gatcgatacactgtgc

SEQ ID NO: 22181 - DNA, 16 bp, Artificial Sequence
  synthetic [barcode part1]
tcctgataggacggtt

SEQ ID NO: 22182 - DNA, 16 bp, Artificial Sequence
  synthetic [barcode part1]
ccagagttatccgcct

SEQ ID NO: 22183 - DNA, 16 bp, Artificial Sequence
  synthetic [barcode part1]
gtcgcaaggtatcact

SEQ ID NO: 22184 - DNA, 16 bp, Artificial Sequence
  synthetic [barcode part1]
ttactctatacggtcg

SEQ ID NO: 22185 - DNA, 16 bp, Artificial Sequence
  synthetic [barcode part1]
agatctcttgaggtcg

SEQ ID NO: 22186 - DNA, 16 bp, Artificial Sequence
  synthetic [barcode part1]
acttcgccaagttcgc

SEQ ID NO: 22187 - DNA, 16 bp, Artificial Sequence
  synthetic [barcode part1]
gacgtgcagttccttc

SEQ ID NO: 22188 - DNA, 16 bp, Artificial Sequence
  synthetic [barcode part1]
acgtacacttcggaac

SEQ ID NO: 22189 - DNA, 16 bp, Artificial Sequence
  synthetic [barcode part1]
tcctgaacctatctag

SEQ ID NO: 22190 - DNA, 16 bp, Artificial Sequence
  synthetic [barcode part1]
tccaaggaggatcctt

SEQ ID NO: 22191 - DNA, 16 bp, Artificial Sequence
  synthetic [barcode part1]
agaggaatcctaggag

SEQ ID NO: 22192 - DNA, 16 bp, Artificial Sequence
  synthetic [barcode part1]
ttggttctcaccacct

SEQ ID NO: 22193 - DNA, 16 bp, Artificial Sequence
  synthetic [barcode part1]
agatcaattccggtcg

SEQ ID NO: 22194 - DNA, 16 bp, Artificial Sequence
  synthetic [barcode part1]
agacgtcgtgagtctt

SEQ ID NO: 22195 - DNA, 16 bp, Artificial Sequence
  synthetic [barcode part1]
agacctactcaacttc

SEQ ID NO: 22196 - DNA, 16 bp, Artificial Sequence
  synthetic [barcode part1]
gcacctgattctattg

SEQ ID NO: 22197 - DNA, 16 bp, Artificial Sequence
  synthetic [barcode part1]
aggacggttgcagact

SEQ ID NO: 22198 - DNA, 16 bp, Artificial Sequence
  synthetic [barcode part1]
tggagttgttaaccgc

SEQ ID NO: 22199 - DNA, 16 bp, Artificial Sequence
  synthetic [barcode part1]
gtgcctgtgagacaag

SEQ ID NO: 22200 - DNA, 16 bp, Artificial Sequence
  synthetic [barcode part1]
tgttcagtcgacgtag

SEQ ID NO: 22201 - DNA, 16 bp, Artificial Sequence
  synthetic [barcode part1]
cctgtgtaaccaccac

SEQ ID NO: 22202 - DNA, 16 bp, Artificial Sequence
  synthetic [barcode part1]
gataagacgcgttaac

SEQ ID NO: 22203 - DNA, 16 bp, Artificial Sequence
  synthetic [barcode part1]
gcgaagtcctagacag

SEQ ID NO: 22204 - DNA, 16 bp, Artificial Sequence
  synthetic [barcode part1]
gtattcgtctgttgtg

SEQ ID NO: 22205 - DNA, 16 bp, Artificial Sequence
  synthetic [barcode part1]
tagaacctgtgtacgc

SEQ ID NO: 22206 - DNA, 16 bp, Artificial Sequence
  synthetic [barcode part1]
cgtgattcgtgtcaag

SEQ ID NO: 22207 - DNA, 16 bp, Artificial Sequence
  synthetic [barcode part1]
tacctagtgtgagtcg

SEQ ID NO: 22208 - DNA, 16 bp, Artificial Sequence
  synthetic [barcode part1]
attgaacctcgcgcct

SEQ ID NO: 22209 - DNA, 16 bp, Artificial Sequence
  synthetic [barcode part1]
acaaccaactgcacac

SEQ ID NO: 22210 - DNA, 16 bp, Artificial Sequence
  synthetic [barcode part1]
tccttaagtacaccac

SEQ ID NO: 22211 - DNA, 16 bp, Artificial Sequence
  synthetic [barcode part1]
gcgagttaggacggtt

SEQ ID NO: 22212 - DNA, 16 bp, Artificial Sequence
  synthetic [barcode part1]
gttattcacgacaggc

SEQ ID NO: 22213 - DNA, 16 bp, Artificial Sequence
  synthetic [barcode part1]
gcgtcttcagttcgac

SEQ ID NO: 22214 - DNA, 16 bp, Artificial Sequence
  synthetic [barcode part1]
tgaactcaccttgccg

SEQ ID NO: 22215 - DNA, 16 bp, Artificial Sequence
  synthetic [barcode part1]
gccaacgccgttattc

SEQ ID NO: 22216 - DNA, 16 bp, Artificial Sequence
  synthetic [barcode part1]
gacctggtcaacaatc

SEQ ID NO: 22217 - DNA, 16 bp, Artificial Sequence
  synthetic [barcode part1]
aagatcacggttctcg

SEQ ID NO: 22218 - DNA, 16 bp, Artificial Sequence
  synthetic [barcode part1]
ttcgaccgcgttagtc

SEQ ID NO: 22219 - DNA, 16 bp, Artificial Sequence
  synthetic [barcode part1]
ccgattcggtatattc

SEQ ID NO: 22220 - DNA, 16 bp, Artificial Sequence
  synthetic [barcode part1]
atcaaccacaccacag

SEQ ID NO: 22221 - DNA, 16 bp, Artificial Sequence
  synthetic [barcode part1]
gataattccggcgatc

SEQ ID NO: 22222 - DNA, 16 bp, Artificial Sequence
  synthetic [barcode part1]
gtatcctcacgttcct

SEQ ID NO: 22223 - DNA, 16 bp, Artificial Sequence
  synthetic [barcode part1]
gaggaacttcagttcc

SEQ ID NO: 22224 - DNA, 16 bp, Artificial Sequence
  synthetic [barcode part1]
cctagtcagaagactc

SEQ ID NO: 22225 - DNA, 16 bp, Artificial Sequence
  synthetic [barcode part1]
tacgtccttacacctc

SEQ ID NO: 22226 - DNA, 16 bp, Artificial Sequence
  synthetic [barcode part1]
aacctaccgagtactg

SEQ ID NO: 22227 - DNA, 16 bp, Artificial Sequence
  synthetic [barcode part1]
tcacacctgttaggcc

SEQ ID NO: 22228 - DNA, 16 bp, Artificial Sequence
  synthetic [barcode part1]
cacggtaattcgttct

SEQ ID NO: 22229 - DNA, 16 bp, Artificial Sequence
  synthetic [barcode part1]
gagacctcactcacct

SEQ ID NO: 22230 - DNA, 16 bp, Artificial Sequence
  synthetic [barcode part1]
ttccaagtggaacctg

SEQ ID NO: 22231 - DNA, 16 bp, Artificial Sequence
  synthetic [barcode part1]
aaggaaggtatcgcag

SEQ ID NO: 22232 - DNA, 16 bp, Artificial Sequence
  synthetic [barcode part1]
cacttgacgaccttcg

SEQ ID NO: 22233 - DNA, 16 bp, Artificial Sequence
  synthetic [barcode part1]
agttggtggttgactc

SEQ ID NO: 22234 - DNA, 16 bp, Artificial Sequence
  synthetic [barcode part1]
ttggccttaggagatc

SEQ ID NO: 22235 - DNA, 16 bp, Artificial Sequence
  synthetic [barcode part1]
ttgcgtctactcctac

SEQ ID NO: 22236 - DNA, 16 bp, Artificial Sequence
  synthetic [barcode part1]
gttctatcctgcggac

SEQ ID NO: 22237 - DNA, 16 bp, Artificial Sequence
  synthetic [barcode part1]
tggcaagttgtctcag

SEQ ID NO: 22238 - DNA, 16 bp, Artificial Sequence
  synthetic [barcode part1]
tggcaattcggattgc

SEQ ID NO: 22239 - DNA, 16 bp, Artificial Sequence
  synthetic [barcode part1]
tctcgtcgtcctattg

SEQ ID NO: 22240 - DNA, 16 bp, Artificial Sequence
  synthetic [barcode part1]
cgtattcctcgacggt

SEQ ID NO: 22241 - DNA, 16 bp, Artificial Sequence
  synthetic [barcode part1]
tgcacaatccaatctc

SEQ ID NO: 22242 - DNA, 16 bp, Artificial Sequence
  synthetic [barcode part1]
cgccaacgtgtattag

SEQ ID NO: 22243 - DNA, 16 bp, Artificial Sequence
  synthetic [barcode part1]
acttgttgacactacc

SEQ ID NO: 22244 - DNA, 16 bp, Artificial Sequence
  synthetic [barcode part1]
cgagtcgaatctgatc

SEQ ID NO: 22245 - DNA, 16 bp, Artificial Sequence
  synthetic [barcode part1]
tagtacgatatccggc

SEQ ID NO: 22246 - DNA, 16 bp, Artificial Sequence
  synthetic [barcode part1]
gacgattatactctcc

SEQ ID NO: 22247 - DNA, 16 bp, Artificial Sequence
  synthetic [barcode part1]
cactacctgaattcac

SEQ ID NO: 22248 - DNA, 16 bp, Artificial Sequence
  synthetic [barcode part1]
gtggagtgtgagtctg

SEQ ID NO: 22249 - DNA, 16 bp, Artificial Sequence
  synthetic [barcode part1]
tgagaccggaatctct

SEQ ID NO: 22250 - DNA, 16 bp, Artificial Sequence
  synthetic [barcode part1]
ccgtcgtaagtaacgt

SEQ ID NO: 22251 - DNA, 16 bp, Artificial Sequence
  synthetic [barcode part1]
cggataccggtagagt

SEQ ID NO: 22252 - DNA, 16 bp, Artificial Sequence
  synthetic [barcode part1]
gtgaacgaataggcag

SEQ ID NO: 22253 - DNA, 16 bp, Artificial Sequence
  synthetic [barcode part1]
ttatctcgcgtaactg

SEQ ID NO: 22254 - DNA, 16 bp, Artificial Sequence
  synthetic [barcode part1]
tccacaacctaggtag

SEQ ID NO: 22255 - DNA, 16 bp, Artificial Sequence
  synthetic [barcode part1]
gacggatcgtcacaag

SEQ ID NO: 22256 - DNA, 16 bp, Artificial Sequence
  synthetic [barcode part1]
tctgccgatatctagt

SEQ ID NO: 22257 - DNA, 16 bp, Artificial Sequence
  synthetic [barcode part1]
aagtctccgtgatacg

SEQ ID NO: 22258 - DNA, 16 bp, Artificial Sequence
  synthetic [barcode part1]
acacagtctgattctc

SEQ ID NO: 22259 - DNA, 16 bp, Artificial Sequence
  synthetic [barcode part1]
gtcaagtcttgacgac

SEQ ID NO: 22260 - DNA, 16 bp, Artificial Sequence
  synthetic [barcode part1]
agaaggagaaggagag

SEQ ID NO: 22261 - DNA, 16 bp, Artificial Sequence
  synthetic [barcode part1]
gagtcgcacttctgtc

SEQ ID NO: 22262 - DNA, 16 bp, Artificial Sequence
  synthetic [barcode part1]
gacaattgaggacgtt

SEQ ID NO: 22263 - DNA, 16 bp, Artificial Sequence
  synthetic [barcode part1]
ccagtagagaccactt

SEQ ID NO: 22264 - DNA, 16 bp, Artificial Sequence
  synthetic [barcode part1]
atctctaaggtgtggc

SEQ ID NO: 22265 - DNA, 16 bp, Artificial Sequence
  synthetic [barcode part1]
acctccactgtattcc

SEQ ID NO: 22266 - DNA, 16 bp, Artificial Sequence
  synthetic [barcode part1]
cctctaacttcctggt

SEQ ID NO: 22267 - DNA, 16 bp, Artificial Sequence
  synthetic [barcode part1]
atcggacaagtcacct

SEQ ID NO: 22268 - DNA, 16 bp, Artificial Sequence
  synthetic [barcode part1]
caacgtacctctgacc

SEQ ID NO: 22269 - DNA, 16 bp, Artificial Sequence
  synthetic [barcode part1]
ccgcgttactcctatt

SEQ ID NO: 22270 - DNA, 16 bp, Artificial Sequence
  synthetic [barcode part1]
aggagtgaatagtctc

SEQ ID NO: 22271 - DNA, 16 bp, Artificial Sequence
  synthetic [barcode part1]
tctggagactgtgact

SEQ ID NO: 22272 - DNA, 16 bp, Artificial Sequence
  synthetic [barcode part1]
attgcggacttcaggt

SEQ ID NO: 22273 - DNA, 16 bp, Artificial Sequence
  synthetic [barcode part1]
cagtcggtgatactac

SEQ ID NO: 22274 - DNA, 16 bp, Artificial Sequence
  synthetic [barcode part1]
tgccacttagaggatc

SEQ ID NO: 22275 - DNA, 16 bp, Artificial Sequence
  synthetic [barcode part1]
tagtgcacagtcctcc

SEQ ID NO: 22276 - DNA, 16 bp, Artificial Sequence
  synthetic [barcode part1]
gcactatctattcacg

SEQ ID NO: 22277 - DNA, 16 bp, Artificial Sequence
  synthetic [barcode part1]
gatcgcactctggtct

SEQ ID NO: 22278 - DNA, 16 bp, Artificial Sequence
  synthetic [barcode part1]
attaggccaggaatac

SEQ ID NO: 22279 - DNA, 16 bp, Artificial Sequence
  synthetic [barcode part1]
gttggcagtggttact

SEQ ID NO: 22280 - DNA, 16 bp, Artificial Sequence
  synthetic [barcode part1]
aaggagtcaagttcgt

SEQ ID NO: 22281 - DNA, 16 bp, Artificial Sequence
  synthetic [barcode part1]
gccttaagtgtcacag

SEQ ID NO: 22282 - DNA, 16 bp, Artificial Sequence
  synthetic [barcode part1]
aggcgcctattattct

SEQ ID NO: 22283 - DNA, 16 bp, Artificial Sequence
  synthetic [barcode part1]
ccaacctacaatcgcc

SEQ ID NO: 22284 - DNA, 16 bp, Artificial Sequence
  synthetic [barcode part1]
ttgaagaaccacctcg

SEQ ID NO: 22285 - DNA, 16 bp, Artificial Sequence
  synthetic [barcode part1]
cgtggattactgttct

SEQ ID NO: 22286 - DNA, 16 bp, Artificial Sequence
  synthetic [barcode part1]
ccagttcgcagttacc

SEQ ID NO: 22287 - DNA, 16 bp, Artificial Sequence
  synthetic [barcode part1]
tccacgtccaacagtc

SEQ ID NO: 22288 - DNA, 16 bp, Artificial Sequence
  synthetic [barcode part1]
aactacctgaaccgtg

SEQ ID NO: 22289 - DNA, 16 bp, Artificial Sequence
  synthetic [barcode part1]
tgcctcaagatagtgc

SEQ ID NO: 22290 - DNA, 16 bp, Artificial Sequence
  synthetic [barcode part1]
cagagtctcaggactt

SEQ ID NO: 22291 - DNA, 16 bp, Artificial Sequence
  synthetic [barcode part1]
aacttaggcaccttct

SEQ ID NO: 22292 - DNA, 16 bp, Artificial Sequence
  synthetic [barcode part1]
cctactcagtaccgtg

SEQ ID NO: 22293 - DNA, 16 bp, Artificial Sequence
  synthetic [barcode part1]
gacctgaccaagttgt

SEQ ID NO: 22294 - DNA, 16 bp, Artificial Sequence
  synthetic [barcode part1]
aattgttgaaccgccg

SEQ ID NO: 22295 - DNA, 16 bp, Artificial Sequence
  synthetic [barcode part1]
cgtgcggtgttctact

SEQ ID NO: 22296 - DNA, 16 bp, Artificial Sequence
  synthetic [barcode part1]
gagaacctacgtggtg

SEQ ID NO: 22297 - DNA, 16 bp, Artificial Sequence
  synthetic [barcode part1]
actactgcaacggttg

SEQ ID NO: 22298 - DNA, 16 bp, Artificial Sequence
  synthetic [barcode part1]
tacttactgccgtggc

SEQ ID NO: 22299 - DNA, 16 bp, Artificial Sequence
  synthetic [barcode part1]
atatcggttgaacgcc

SEQ ID NO: 22300 - DNA, 16 bp, Artificial Sequence
  synthetic [barcode part1]
gaagtgcctggtaacg

SEQ ID NO: 22301 - DNA, 16 bp, Artificial Sequence
  synthetic [barcode part1]
ttacaggacggttacc

SEQ ID NO: 22302 - DNA, 16 bp, Artificial Sequence
  synthetic [barcode part1]
gttatctggcgcctac

SEQ ID NO: 22303 - DNA, 16 bp, Artificial Sequence
  synthetic [barcode part1]
agtcacaacaccagtc

SEQ ID NO: 22304 - DNA, 16 bp, Artificial Sequence
  synthetic [barcode part1]
gtgaactcacgaactc

SEQ ID NO: 22305 - DNA, 16 bp, Artificial Sequence
  synthetic [barcode part1]
ttacaccgtagtctgt

SEQ ID NO: 22306 - DNA, 16 bp, Artificial Sequence
  synthetic [barcode part1]
acacaactgtgcagtc

SEQ ID NO: 22307 - DNA, 16 bp, Artificial Sequence
  synthetic [barcode part1]
tagtattatccgtccg

SEQ ID NO: 22308 - DNA, 16 bp, Artificial Sequence
  synthetic [barcode part1]
taccagtactggtgtg

SEQ ID NO: 22309 - DNA, 16 bp, Artificial Sequence
  synthetic [barcode part1]
tgtgaggaattcaacg

SEQ ID NO: 22310 - DNA, 16 bp, Artificial Sequence
  synthetic [barcode part1]
acgaaggtaacaactc

SEQ ID NO: 22311 - DNA, 16 bp, Artificial Sequence
  synthetic [barcode part1]
tgaccggtatacgtac

SEQ ID NO: 22312 - DNA, 16 bp, Artificial Sequence
  synthetic [barcode part1]
ttgacctcttgcaagt

SEQ ID NO: 22313 - DNA, 16 bp, Artificial Sequence
  synthetic [barcode part1]
tcagacaccacaagtc

SEQ ID NO: 22314 - DNA, 16 bp, Artificial Sequence
  synthetic [barcode part1]
tgaccttcgtggtcgt

SEQ ID NO: 22315 - DNA, 16 bp, Artificial Sequence
  synthetic [barcode part1]
acgtgtacgtgtacac

SEQ ID NO: 22316 - DNA, 16 bp, Artificial Sequence
  synthetic [barcode part1]
gtatcggcggttctct

SEQ ID NO: 22317 - DNA, 16 bp, Artificial Sequence
  synthetic [barcode part1]
aattaggacgaccgcg

SEQ ID NO: 22318 - DNA, 16 bp, Artificial Sequence
  synthetic [barcode part1]
atataggacttccgcg

SEQ ID NO: 22319 - DNA, 16 bp, Artificial Sequence
  synthetic [barcode part1]
tattcgcctcggaatt

SEQ ID NO: 22320 - DNA, 16 bp, Artificial Sequence
  synthetic [barcode part1]
tcaacaacgttcctgt

SEQ ID NO: 22321 - DNA, 16 bp, Artificial Sequence
  synthetic [barcode part1]
ttaataggcgacctgc

SEQ ID NO: 22322 - DNA, 16 bp, Artificial Sequence
  synthetic [barcode part1]
gaggcaactcgagtac

SEQ ID NO: 22323 - DNA, 16 bp, Artificial Sequence
  synthetic [barcode part1]
gaatccgttcagttct

SEQ ID NO: 22324 - DNA, 16 bp, Artificial Sequence
  synthetic [barcode part1]
agactaatacacggtg

SEQ ID NO: 22325 - DNA, 16 bp, Artificial Sequence
  synthetic [barcode part1]
aagatctaggtggact

SEQ ID NO: 22326 - DNA, 16 bp, Artificial Sequence
  synthetic [barcode part1]
gccacaacttgagact

SEQ ID NO: 22327 - DNA, 16 bp, Artificial Sequence
  synthetic [barcode part1]
attaccttcgtaggtc

SEQ ID NO: 22328 - DNA, 16 bp, Artificial Sequence
  synthetic [barcode part1]
tcggaagaactacgcg

SEQ ID NO: 22329 - DNA, 16 bp, Artificial Sequence
  synthetic [barcode part1]
tcctggcgattgcact

SEQ ID NO: 22330 - DNA, 16 bp, Artificial Sequence
  synthetic [barcode part1]
gcaatcgtcgactcct

SEQ ID NO: 22331 - DNA, 16 bp, Artificial Sequence
  synthetic [barcode part1]
tctatcacacgaatcc

SEQ ID NO: 22332 - DNA, 16 bp, Artificial Sequence
  synthetic [barcode part1]
atagagactctacgcc

SEQ ID NO: 22333 - DNA, 16 bp, Artificial Sequence
  synthetic [barcode part1]
agaggactattggtac

SEQ ID NO: 22334 - DNA, 16 bp, Artificial Sequence
  synthetic [barcode part1]
tgacaggagtatctag

SEQ ID NO: 22335 - DNA, 16 bp, Artificial Sequence
  synthetic [barcode part1]
ccacttcacgcaatcg

SEQ ID NO: 22336 - DNA, 16 bp, Artificial Sequence
  synthetic [barcode part1]
actcagattgtctcac

SEQ ID NO: 22337 - DNA, 16 bp, Artificial Sequence
  synthetic [barcode part1]
cctcgatacacgatcc

SEQ ID NO: 22338 - DNA, 16 bp, Artificial Sequence
  synthetic [barcode part1]
acgttgatccttggcc

SEQ ID NO: 22339 - DNA, 16 bp, Artificial Sequence
  synthetic [barcode part1]
aacgaggtacgagtcc

SEQ ID NO: 22340 - DNA, 16 bp, Artificial Sequence
  synthetic [barcode part1]
caggtcagtcagactt

SEQ ID NO: 22341 - DNA, 16 bp, Artificial Sequence
  synthetic [barcode part1]
gtcggatagtggttct

SEQ ID NO: 22342 - DNA, 16 bp, Artificial Sequence
  synthetic [barcode part1]
ccgttgcctacaggtt

SEQ ID NO: 22343 - DNA, 16 bp, Artificial Sequence
  synthetic [barcode part1]
acaagatcggacaccg

SEQ ID NO: 22344 - DNA, 16 bp, Artificial Sequence
  synthetic [barcode part1]
atcgtgttcttcaacg

SEQ ID NO: 22345 - DNA, 16 bp, Artificial Sequence
  synthetic [barcode part1]
gaacgacctggtgtag

SEQ ID NO: 22346 - DNA, 16 bp, Artificial Sequence
  synthetic [barcode part1]
tctacgcactagattc

SEQ ID NO: 22347 - DNA, 16 bp, Artificial Sequence
  synthetic [barcode part1]
cgttcggaacttgtag

SEQ ID NO: 22348 - DNA, 16 bp, Artificial Sequence
  synthetic [barcode part1]
tgatcgtcctaacttg

SEQ ID NO: 22349 - DNA, 16 bp, Artificial Sequence
  synthetic [barcode part1]
cacctcactgtaggtc

SEQ ID NO: 22350 - DNA, 16 bp, Artificial Sequence
  synthetic [barcode part1]
ccacggatcgttatcc

SEQ ID NO: 22351 - DNA, 16 bp, Artificial Sequence
  synthetic [barcode part1]
tcagtgtatcgcgtag

SEQ ID NO: 22352 - DNA, 16 bp, Artificial Sequence
  synthetic [barcode part1]
tcagtggcctacgtct

SEQ ID NO: 22353 - DNA, 16 bp, Artificial Sequence
  synthetic [barcode part1]
tggaagagtaccagtt

SEQ ID NO: 22354 - DNA, 16 bp, Artificial Sequence
  synthetic [barcode part1]
caagtaagataccgtg

SEQ ID NO: 22355 - DNA, 16 bp, Artificial Sequence
  synthetic [barcode part1]
gcctactgagtctcac

SEQ ID NO: 22356 - DNA, 16 bp, Artificial Sequence
  synthetic [barcode part1]
acttcgtcgccttgtt

SEQ ID NO: 22357 - DNA, 16 bp, Artificial Sequence
  synthetic [barcode part1]
ttccaccagtgaagtg

SEQ ID NO: 22358 - DNA, 16 bp, Artificial Sequence
  synthetic [barcode part1]
atatcgcgagtaagtg

SEQ ID NO: 22359 - DNA, 16 bp, Artificial Sequence
  synthetic [barcode part1]
attcgtcggcgttatt

SEQ ID NO: 22360 - DNA, 16 bp, Artificial Sequence
  synthetic [barcode part1]
ttgtatctcgcacctc

SEQ ID NO: 22361 - DNA, 16 bp, Artificial Sequence
  synthetic [barcode part1]
acgttagattggagac

SEQ ID NO: 22362 - DNA, 16 bp, Artificial Sequence
  synthetic [barcode part1]
caacagtaagacacac

SEQ ID NO: 22363 - DNA, 16 bp, Artificial Sequence
  synthetic [barcode part1]
tagttctcagtgtgtc

SEQ ID NO: 22364 - DNA, 16 bp, Artificial Sequence
  synthetic [barcode part1]
ttgcgcgacgtattag

SEQ ID NO: 22365 - DNA, 16 bp, Artificial Sequence
  synthetic [barcode part1]
acttggaccgttctgc

SEQ ID NO: 22366 - DNA, 16 bp, Artificial Sequence
  synthetic [barcode part1]
aatcgtggcgtactac

SEQ ID NO: 22367 - DNA, 16 bp, Artificial Sequence
  synthetic [barcode part1]
actgcaagtgacgttc

SEQ ID NO: 22368 - DNA, 16 bp, Artificial Sequence
  synthetic [barcode part1]
tatccagaactgtgcg

SEQ ID NO: 22369 - DNA, 16 bp, Artificial Sequence
  synthetic [barcode part1]
taccaacacgttgacg

SEQ ID NO: 22370 - DNA, 16 bp, Artificial Sequence
  synthetic [barcode part1]
ttggcctcaagtccac

SEQ ID NO: 22371 - DNA, 16 bp, Artificial Sequence
  synthetic [barcode part1]
ccgtgaaggtgtactt

SEQ ID NO: 22372 - DNA, 16 bp, Artificial Sequence
  synthetic [barcode part1]
gttgcctagtgtctgc

SEQ ID NO: 22373 - DNA, 16 bp, Artificial Sequence
  synthetic [barcode part1]
ttgaggtacagacggc

SEQ ID NO: 22374 - DNA, 16 bp, Artificial Sequence
  synthetic [barcode part1]
agtacgtacgtcaacc

SEQ ID NO: 22375 - DNA, 16 bp, Artificial Sequence
  synthetic [barcode part1]
attggcggaaccgagt

SEQ ID NO: 22376 - DNA, 16 bp, Artificial Sequence
  synthetic [barcode part1]
caatcttgtacgtcac

SEQ ID NO: 22377 - DNA, 16 bp, Artificial Sequence
  synthetic [barcode part1]
cacgtccttgtgttct

SEQ ID NO: 22378 - DNA, 16 bp, Artificial Sequence
  synthetic [barcode part1]
gccgttcgtaacaagt

SEQ ID NO: 22379 - DNA, 16 bp, Artificial Sequence
  synthetic [barcode part1]
gactctaacaggcgag

SEQ ID NO: 22380 - DNA, 16 bp, Artificial Sequence
  synthetic [barcode part1]
tggaggatcctagttc

SEQ ID NO: 22381 - DNA, 16 bp, Artificial Sequence
  synthetic [barcode part1]
gcagtacaccacaact

SEQ ID NO: 22382 - DNA, 16 bp, Artificial Sequence
  synthetic [barcode part1]
ttccgcgttaagttgt

SEQ ID NO: 22383 - DNA, 16 bp, Artificial Sequence
  synthetic [barcode part1]
agaagtgtctacgcct

SEQ ID NO: 22384 - DNA, 16 bp, Artificial Sequence
  synthetic [barcode part1]
ttggtactcttgactg

SEQ ID NO: 22385 - DNA, 16 bp, Artificial Sequence
  synthetic [barcode part1]
gtattgcctacttgtg

SEQ ID NO: 22386 - DNA, 16 bp, Artificial Sequence
  synthetic [barcode part1]
acgataacaccagtag

SEQ ID NO: 22387 - DNA, 16 bp, Artificial Sequence
  synthetic [barcode part1]
agtctggttgacggtt

SEQ ID NO: 22388 - DNA, 16 bp, Artificial Sequence
  synthetic [barcode part1]
cacgccaggaagattg

SEQ ID NO: 22389 - DNA, 16 bp, Artificial Sequence
  synthetic [barcode part1]
gacgtacgatcggagt

SEQ ID NO: 22390 - DNA, 16 bp, Artificial Sequence
  synthetic [barcode part1]
acgccaggagaatcac

SEQ ID NO: 22391 - DNA, 16 bp, Artificial Sequence
  synthetic [barcode part1]
atagttggtcacgcgt

SEQ ID NO: 22392 - DNA, 16 bp, Artificial Sequence
  synthetic [barcode part1]
agtgatcggttcagtc

SEQ ID NO: 22393 - DNA, 16 bp, Artificial Sequence
  synthetic [barcode part1]
taatccgtctacgttg

SEQ ID NO: 22394 - DNA, 16 bp, Artificial Sequence
  synthetic [barcode part1]
taataactcctgtgcc

SEQ ID NO: 22395 - DNA, 16 bp, Artificial Sequence
  synthetic [barcode part1]
ttcgttgtcagacgtt

SEQ ID NO: 22396 - DNA, 16 bp, Artificial Sequence
  synthetic [barcode part1]
tgttcgattggcacag

SEQ ID NO: 22397 - DNA, 16 bp, Artificial Sequence
  synthetic [barcode part1]
tactcgtggacaggtt

SEQ ID NO: 22398 - DNA, 16 bp, Artificial Sequence
  synthetic [barcode part1]
cacaatcagagtaacg

SEQ ID NO: 22399 - DNA, 16 bp, Artificial Sequence
  synthetic [barcode part1]
ttcgtcgtcggtacac

SEQ ID NO: 22400 - DNA, 16 bp, Artificial Sequence
  synthetic [barcode part1]
aactaccggtgcgaag

SEQ ID NO: 22401 - DNA, 16 bp, Artificial Sequence
  synthetic [barcode part1]
cggtaacgattcggtt

SEQ ID NO: 22402 - DNA, 16 bp, Artificial Sequence
  synthetic [barcode part1]
gactagtgagactctc

SEQ ID NO: 22403 - DNA, 16 bp, Artificial Sequence
  synthetic [barcode part1]
atcaacagttctccgt

SEQ ID NO: 22404 - DNA, 16 bp, Artificial Sequence
  synthetic [barcode part1]
caatataccggtgtgc

SEQ ID NO: 22405 - DNA, 16 bp, Artificial Sequence
  synthetic [barcode part1]
agtcggatcgtataag

SEQ ID NO: 22406 - DNA, 16 bp, Artificial Sequence
  synthetic [barcode part1]
attacgcctggtgtag

SEQ ID NO: 22407 - DNA, 16 bp, Artificial Sequence
  synthetic [barcode part1]
aatcgtgccgaccttc

SEQ ID NO: 22408 - DNA, 16 bp, Artificial Sequence
  synthetic [barcode part1]
gaactctgccagttag

SEQ ID NO: 22409 - DNA, 16 bp, Artificial Sequence
  synthetic [barcode part1]
tatcgacaccgatacg

SEQ ID NO: 22410 - DNA, 16 bp, Artificial Sequence
  synthetic [barcode part1]
gtgttagacgcagttc

SEQ ID NO: 22411 - DNA, 16 bp, Artificial Sequence
  synthetic [barcode part1]
gagagacggattagac

SEQ ID NO: 22412 - DNA, 16 bp, Artificial Sequence
  synthetic [barcode part1]
gcactgattcttggtt

SEQ ID NO: 22413 - DNA, 16 bp, Artificial Sequence
  synthetic [barcode part1]
atcttcaggcggttcc

SEQ ID NO: 22414 - DNA, 16 bp, Artificial Sequence
  synthetic [barcode part1]
tgcctaacacggattg

SEQ ID NO: 22415 - DNA, 16 bp, Artificial Sequence
  synthetic [barcode part1]
tgagtcgccttgcgtt

SEQ ID NO: 22416 - DNA, 16 bp, Artificial Sequence
  synthetic [barcode part1]
acacgtgcggttagtt

SEQ ID NO: 22417 - DNA, 16 bp, Artificial Sequence
  synthetic [barcode part1]
ttcgaccttgacttcc

SEQ ID NO: 22418 - DNA, 16 bp, Artificial Sequence
  synthetic [barcode part1]
cgaatactaacctctc

SEQ ID NO: 22419 - DNA, 16 bp, Artificial Sequence
  synthetic [barcode part1]
gacacagtactggacg

SEQ ID NO: 22420 - DNA, 16 bp, Artificial Sequence
  synthetic [barcode part1]
acggcactgattagtc

SEQ ID NO: 22421 - DNA, 16 bp, Artificial Sequence
  synthetic [barcode part1]
gtgactgttctggcct

SEQ ID NO: 22422 - DNA, 16 bp, Artificial Sequence
  synthetic [barcode part1]
taggcgtagttcacgt

SEQ ID NO: 22423 - DNA, 16 bp, Artificial Sequence
  synthetic [barcode part1]
aacggtcgtattctct

SEQ ID NO: 22424 - DNA, 16 bp, Artificial Sequence
  synthetic [barcode part1]
ccagtgcaactcttcg

SEQ ID NO: 22425 - DNA, 16 bp, Artificial Sequence
  synthetic [barcode part1]
gacacactgacgtact

SEQ ID NO: 22426 - DNA, 16 bp, Artificial Sequence
  synthetic [barcode part1]
cctaaccgtaccagtc

SEQ ID NO: 22427 - DNA, 16 bp, Artificial Sequence
  synthetic [barcode part1]
ccaagaggcacaatcg

SEQ ID NO: 22428 - DNA, 16 bp, Artificial Sequence
  synthetic [barcode part1]
gaacgtccttaggtgt

SEQ ID NO: 22429 - DNA, 16 bp, Artificial Sequence
  synthetic [barcode part1]
atccgtagtacgatcg

SEQ ID NO: 22430 - DNA, 16 bp, Artificial Sequence
  synthetic [barcode part1]
tcgaatcgaaggtgcg

SEQ ID NO: 22431 - DNA, 16 bp, Artificial Sequence
  synthetic [barcode part1]
tcttctactatcgccg

SEQ ID NO: 22432 - DNA, 16 bp, Artificial Sequence
  synthetic [barcode part1]
tgagaggagtcaagac

SEQ ID NO: 22433 - DNA, 16 bp, Artificial Sequence
  synthetic [barcode part1]
gcgatcgatcgatatc

SEQ ID NO: 22434 - DNA, 16 bp, Artificial Sequence
  synthetic [barcode part1]
tgacggtctggtagtt

SEQ ID NO: 22435 - DNA, 16 bp, Artificial Sequence
  synthetic [barcode part1]
gcaataagtagtcacg

SEQ ID NO: 22436 - DNA, 16 bp, Artificial Sequence
  synthetic [barcode part1]
gagagtcgtgtgtcag

SEQ ID NO: 22437 - DNA, 16 bp, Artificial Sequence
  synthetic [barcode part1]
tataccgccagtcctg

SEQ ID NO: 22438 - DNA, 16 bp, Artificial Sequence
  synthetic [barcode part1]
agtctaggatcgtcac

SEQ ID NO: 22439 - DNA, 16 bp, Artificial Sequence
  synthetic [barcode part1]
aaggcgagttcgcaac

SEQ ID NO: 22440 - DNA, 16 bp, Artificial Sequence
  synthetic [barcode part1]
ttgtgagaggttgaac

SEQ ID NO: 22441 - DNA, 16 bp, Artificial Sequence
  synthetic [barcode part1]
cgttgtcagtatactc

SEQ ID NO: 22442 - DNA, 16 bp, Artificial Sequence
  synthetic [barcode part1]
attccttgccagtgcg

SEQ ID NO: 22443 - DNA, 16 bp, Artificial Sequence
  synthetic [barcode part1]
agacaataccgtctcg

SEQ ID NO: 22444 - DNA, 16 bp, Artificial Sequence
  synthetic [barcode part1]
gagtgtcgataggatt

SEQ ID NO: 22445 - DNA, 16 bp, Artificial Sequence
  synthetic [barcode part1]
gacgtcaacgtgtgtt

SEQ ID NO: 22446 - DNA, 16 bp, Artificial Sequence
  synthetic [barcode part1]
ccacttcctaagtgcg

SEQ ID NO: 22447 - DNA, 16 bp, Artificial Sequence
  synthetic [barcode part1]
accacgatatcgtggt

SEQ ID NO: 22448 - DNA, 16 bp, Artificial Sequence
  synthetic [barcode part1]
tgcaccgtcaattccg

SEQ ID NO: 22449 - DNA, 16 bp, Artificial Sequence
  synthetic [barcode part1]
aagtcgttgtcgagtc

SEQ ID NO: 22450 - DNA, 16 bp, Artificial Sequence
  synthetic [barcode part1]
tatcctactacgaacc

SEQ ID NO: 22451 - DNA, 16 bp, Artificial Sequence
  synthetic [barcode part1]
taggactgactggttc

SEQ ID NO: 22452 - DNA, 16 bp, Artificial Sequence
  synthetic [barcode part1]
tatcttaccgtggact

SEQ ID NO: 22453 - DNA, 16 bp, Artificial Sequence
  synthetic [barcode part1]
tcctcgtgatagtccg

SEQ ID NO: 22454 - DNA, 16 bp, Artificial Sequence
  synthetic [barcode part1]
gtattaggcgtgacct

SEQ ID NO: 22455 - DNA, 16 bp, Artificial Sequence
  synthetic [barcode part1]
cgtctgcacttatcct

SEQ ID NO: 22456 - DNA, 16 bp, Artificial Sequence
  synthetic [barcode part1]
aagtggactcgtctgt

SEQ ID NO: 22457 - DNA, 16 bp, Artificial Sequence
  synthetic [barcode part1]
gtctgtcctacaacgc

SEQ ID NO: 22458 - DNA, 16 bp, Artificial Sequence
  synthetic [barcode part1]
agtcgcggttgtatac

SEQ ID NO: 22459 - DNA, 16 bp, Artificial Sequence
  synthetic [barcode part1]
tatcttcaatccggtg

SEQ ID NO: 22460 - DNA, 16 bp, Artificial Sequence
  synthetic [barcode part1]
gtacggagtctggtag

SEQ ID NO: 22461 - DNA, 16 bp, Artificial Sequence
  synthetic [barcode part1]
acggtacggttaacct

SEQ ID NO: 22462 - DNA, 16 bp, Artificial Sequence
  synthetic [barcode part1]
gtctccgaacgatcct

SEQ ID NO: 22463 - DNA, 16 bp, Artificial Sequence
  synthetic [barcode part1]
cctcctactcaattcg

SEQ ID NO: 22464 - DNA, 16 bp, Artificial Sequence
  synthetic [barcode part1]
agttctgtattcgtcg

SEQ ID NO: 22465 - DNA, 16 bp, Artificial Sequence
  synthetic [barcode part1]
ttctactgcggtgaag

SEQ ID NO: 22466 - DNA, 16 bp, Artificial Sequence
  synthetic [barcode part1]
agtaccactgaccaac

SEQ ID NO: 22467 - DNA, 16 bp, Artificial Sequence
  synthetic [barcode part1]
acgtcctatacggaac

SEQ ID NO: 22468 - DNA, 16 bp, Artificial Sequence
  synthetic [barcode part1]
atccgagtgaagtagt

SEQ ID NO: 22469 - DNA, 16 bp, Artificial Sequence
  synthetic [barcode part1]
tcagtgagagttgtcc

SEQ ID NO: 22470 - DNA, 16 bp, Artificial Sequence
  synthetic [barcode part1]
atatagtaccggcacc

SEQ ID NO: 22471 - DNA, 16 bp, Artificial Sequence
  synthetic [barcode part1]
cgcactccactgaact

SEQ ID NO: 22472 - DNA, 16 bp, Artificial Sequence
  synthetic [barcode part1]
agttattccgcgtccg

SEQ ID NO: 22473 - DNA, 16 bp, Artificial Sequence
  synthetic [barcode part1]
gcgttctgtcaagtcc

SEQ ID NO: 22474 - DNA, 16 bp, Artificial Sequence
  synthetic [barcode part1]
gaggcgattataggtt

SEQ ID NO: 22475 - DNA, 16 bp, Artificial Sequence
  synthetic [barcode part1]
agtcgatctgatcgac

SEQ ID NO: 22476 - DNA, 16 bp, Artificial Sequence
  synthetic [barcode part1]
gtctgtacaatccttg

SEQ ID NO: 22477 - DNA, 16 bp, Artificial Sequence
  synthetic [barcode part1]
tgttgttctgcgcgac

SEQ ID NO: 22478 - DNA, 16 bp, Artificial Sequence
  synthetic [barcode part1]
cgtcgtccgaagaatt

SEQ ID NO: 22479 - DNA, 16 bp, Artificial Sequence
  synthetic [barcode part1]
accgccaatacggaag

SEQ ID NO: 22480 - DNA, 16 bp, Artificial Sequence
  synthetic [barcode part1]
cacttatacggtatcc

SEQ ID NO: 22481 - DNA, 16 bp, Artificial Sequence
  synthetic [barcode part1]
aaggataaggccgtcc

SEQ ID NO: 22482 - DNA, 16 bp, Artificial Sequence
  synthetic [barcode part1]
gtcacttgagtctgtt

SEQ ID NO: 22483 - DNA, 16 bp, Artificial Sequence
  synthetic [barcode part1]
ccgatcttatcggcac

SEQ ID NO: 22484 - DNA, 16 bp, Artificial Sequence
  synthetic [barcode part1]
atacctgtccgtcacg

SEQ ID NO: 22485 - DNA, 16 bp, Artificial Sequence
  synthetic [barcode part1]
agttaccacctgacag

SEQ ID NO: 22486 - DNA, 16 bp, Artificial Sequence
  synthetic [barcode part1]
tcgcgtcgtgattcgt

SEQ ID NO: 22487 - DNA, 16 bp, Artificial Sequence
  synthetic [barcode part1]
aggtgaggagtaagtc

SEQ ID NO: 22488 - DNA, 16 bp, Artificial Sequence
  synthetic [barcode part1]
tacacgacgtcaacac

SEQ ID NO: 22489 - DNA, 16 bp, Artificial Sequence
  synthetic [barcode part1]
agtcctagacgttgtg

SEQ ID NO: 22490 - DNA, 16 bp, Artificial Sequence
  synthetic [barcode part1]
cactgtatctctctcg

SEQ ID NO: 22491 - DNA, 16 bp, Artificial Sequence
  synthetic [barcode part1]
gaccgcagaagaatcc

SEQ ID NO: 22492 - DNA, 16 bp, Artificial Sequence
  synthetic [barcode part1]
caaggagtaatcgcgc

SEQ ID NO: 22493 - DNA, 16 bp, Artificial Sequence
  synthetic [barcode part1]
actggaggaggaattg

SEQ ID NO: 22494 - DNA, 16 bp, Artificial Sequence
  synthetic [barcode part1]
agtgttccgagaggtg

SEQ ID NO: 22495 - DNA, 16 bp, Artificial Sequence
  synthetic [barcode part1]
agatagtcgactctcg

SEQ ID NO: 22496 - DNA, 16 bp, Artificial Sequence
  synthetic [barcode part1]
aggattagatctgcag

SEQ ID NO: 22497 - DNA, 16 bp, Artificial Sequence
  synthetic [barcode part1]
tacaccacacacagtg

SEQ ID NO: 22498 - DNA, 16 bp, Artificial Sequence
  synthetic [barcode part1]
gatcgtagtacgttgc

SEQ ID NO: 22499 - DNA, 16 bp, Artificial Sequence
  synthetic [barcode part1]
gtcggcaagatatctc

SEQ ID NO: 22500 - DNA, 16 bp, Artificial Sequence
  synthetic [barcode part1]
gagtcacctcacgtct

SEQ ID NO: 22501 - DNA, 16 bp, Artificial Sequence
  synthetic [barcode part1]
actactcctgtggatt

SEQ ID NO: 22502 - DNA, 16 bp, Artificial Sequence
  synthetic [barcode part1]
attggcacttgatctc

SEQ ID NO: 22503 - DNA, 16 bp, Artificial Sequence
  synthetic [barcode part1]
taagagttgccggacg

SEQ ID NO: 22504 - DNA, 16 bp, Artificial Sequence
  synthetic [barcode part1]
gactgaggtaggatag

SEQ ID NO: 22505 - DNA, 16 bp, Artificial Sequence
  synthetic [barcode part1]
tgagtcactagatcgc

SEQ ID NO: 22506 - DNA, 16 bp, Artificial Sequence
  synthetic [barcode part1]
gcgatatcagtactgc

SEQ ID NO: 22507 - DNA, 16 bp, Artificial Sequence
  synthetic [barcode part1]
atcggttggagttctg

SEQ ID NO: 22508 - DNA, 16 bp, Artificial Sequence
  synthetic [barcode part1]
cctcgattatactgac

SEQ ID NO: 22509 - DNA, 16 bp, Artificial Sequence
  synthetic [barcode part1]
gtcgattattgcggtg

SEQ ID NO: 22510 - DNA, 16 bp, Artificial Sequence
  synthetic [barcode part1]
tacgacgaggcgagtt

SEQ ID NO: 22511 - DNA, 16 bp, Artificial Sequence
  synthetic [barcode part1]
ttctgtagaagtgcgc

SEQ ID NO: 22512 - DNA, 16 bp, Artificial Sequence
  synthetic [barcode part1]
cggtattcaggcagag

SEQ ID NO: 22513 - DNA, 16 bp, Artificial Sequence
  synthetic [barcode part1]
acgttcaattctgtcg

SEQ ID NO: 22514 - DNA, 16 bp, Artificial Sequence
  synthetic [barcode part1]
attccacaggtactct

SEQ ID NO: 22515 - DNA, 16 bp, Artificial Sequence
  synthetic [barcode part1]
cgtgaacacgaactct

SEQ ID NO: 22516 - DNA, 16 bp, Artificial Sequence
  synthetic [barcode part1]
ttgccgtagacctacc

SEQ ID NO: 22517 - DNA, 16 bp, Artificial Sequence
  synthetic [barcode part1]
cctcaacctgagtacc

SEQ ID NO: 22518 - DNA, 16 bp, Artificial Sequence
  synthetic [barcode part1]
gacaccgattgactac

SEQ ID NO: 22519 - DNA, 16 bp, Artificial Sequence
  synthetic [barcode part1]
ttggcctcctgtagac

SEQ ID NO: 22520 - DNA, 16 bp, Artificial Sequence
  synthetic [barcode part1]
tggtgaggtccgtaag

SEQ ID NO: 22521 - DNA, 16 bp, Artificial Sequence
  synthetic [barcode part1]
gagaattgccgtgcag

SEQ ID NO: 22522 - DNA, 16 bp, Artificial Sequence
  synthetic [barcode part1]
gttgttgagtcgtcag

SEQ ID NO: 22523 - DNA, 16 bp, Artificial Sequence
  synthetic [barcode part1]
gcgatatatcgcgatc

SEQ ID NO: 22524 - DNA, 16 bp, Artificial Sequence
  synthetic [barcode part1]
ttagagtgtgacgcct

SEQ ID NO: 22525 - DNA, 16 bp, Artificial Sequence
  synthetic [barcode part1]
cagatcgttcttacgt

SEQ ID NO: 22526 - DNA, 16 bp, Artificial Sequence
  synthetic [barcode part1]
gtcgttcggcacttac

SEQ ID NO: 22527 - DNA, 16 bp, Artificial Sequence
  synthetic [barcode part1]
atagttggccgacgtt

SEQ ID NO: 22528 - DNA, 16 bp, Artificial Sequence
  synthetic [barcode part1]
accactagtcgtcaag

SEQ ID NO: 22529 - DNA, 16 bp, Artificial Sequence
  synthetic [barcode part1]
cgagagtccactgaag

SEQ ID NO: 22530 - DNA, 16 bp, Artificial Sequence
  synthetic [barcode part1]
tctcacgtaactcggc

SEQ ID NO: 22531 - DNA, 16 bp, Artificial Sequence
  synthetic [barcode part1]
gtctctcaatcggaag

SEQ ID NO: 22532 - DNA, 16 bp, Artificial Sequence
  synthetic [barcode part1]
atcacgaacaggtaac

SEQ ID NO: 22533 - DNA, 16 bp, Artificial Sequence
  synthetic [barcode part1]
cactgcggtattacag

SEQ ID NO: 22534 - DNA, 16 bp, Artificial Sequence
  synthetic [barcode part1]
gaacgacttcctagtg

SEQ ID NO: 22535 - DNA, 16 bp, Artificial Sequence
  synthetic [barcode part1]
aatcggtggaaggaac

SEQ ID NO: 22536 - DNA, 16 bp, Artificial Sequence
  synthetic [barcode part1]
acaaccttagaccgtg

SEQ ID NO: 22537 - DNA, 16 bp, Artificial Sequence
  synthetic [barcode part1]
acacacagtcacaacc

SEQ ID NO: 22538 - DNA, 16 bp, Artificial Sequence
  synthetic [barcode part1]
accttactccgcgagt

SEQ ID NO: 22539 - DNA, 16 bp, Artificial Sequence
  synthetic [barcode part1]
gaaggtggcagttcac

SEQ ID NO: 22540 - DNA, 16 bp, Artificial Sequence
  synthetic [barcode part1]
aaccgagttgcgtgag

SEQ ID NO: 22541 - DNA, 16 bp, Artificial Sequence
  synthetic [barcode part1]
tgtgcgatctgatctt

SEQ ID NO: 22542 - DNA, 16 bp, Artificial Sequence
  synthetic [barcode part1]
tgaggaccttgtatcg

SEQ ID NO: 22543 - DNA, 16 bp, Artificial Sequence
  synthetic [barcode part1]
atcaaccactggtcag

SEQ ID NO: 22544 - DNA, 16 bp, Artificial Sequence
  synthetic [barcode part1]
gcgtcgatcttactgc

SEQ ID NO: 22545 - DNA, 16 bp, Artificial Sequence
  synthetic [barcode part1]
actgtgttcgagtgtg

SEQ ID NO: 22546 - DNA, 16 bp, Artificial Sequence
  synthetic [barcode part1]
cactaccgtaattgtc

SEQ ID NO: 22547 - DNA, 16 bp, Artificial Sequence
  synthetic [barcode part1]
tgttctgtcacgaact

SEQ ID NO: 22548 - DNA, 16 bp, Artificial Sequence
  synthetic [barcode part1]
cgcgtctcggactatt

SEQ ID NO: 22549 - DNA, 16 bp, Artificial Sequence
  synthetic [barcode part1]
tagaattggccggttc

SEQ ID NO: 22550 - DNA, 16 bp, Artificial Sequence
  synthetic [barcode part1]
caggtcacctcgtact

SEQ ID NO: 22551 - DNA, 16 bp, Artificial Sequence
  synthetic [barcode part1]
cgttccaactctgttc

SEQ ID NO: 22552 - DNA, 16 bp, Artificial Sequence
  synthetic [barcode part1]
gtcaatccggtgttag

SEQ ID NO: 22553 - DNA, 16 bp, Artificial Sequence
  synthetic [barcode part1]
ttggtgtcctcctgag

SEQ ID NO: 22554 - DNA, 16 bp, Artificial Sequence
  synthetic [barcode part1]
tccagtatccaacgag

SEQ ID NO: 22555 - DNA, 16 bp, Artificial Sequence
  synthetic [barcode part1]
tcgagtgcaagatagt

SEQ ID NO: 22556 - DNA, 16 bp, Artificial Sequence
  synthetic [barcode part1]
tataagtcggaacgac

SEQ ID NO: 22557 - DNA, 16 bp, Artificial Sequence
  synthetic [barcode part1]
gcacctgtgttgtctg

SEQ ID NO: 22558 - DNA, 16 bp, Artificial Sequence
  synthetic [barcode part1]
tcctcgaaccacgtac

SEQ ID NO: 22559 - DNA, 16 bp, Artificial Sequence
  synthetic [barcode part1]
tcgcgttcgagttgtc

SEQ ID NO: 22560 - DNA, 16 bp, Artificial Sequence
  synthetic [barcode part1]
tacctgaagaagtcag

SEQ ID NO: 22561 - DNA, 16 bp, Artificial Sequence
  synthetic [barcode part1]
caagacgacggttgtg

SEQ ID NO: 22562 - DNA, 16 bp, Artificial Sequence
  synthetic [barcode part1]
gtccttaagtggtctt

SEQ ID NO: 22563 - DNA, 16 bp, Artificial Sequence
  synthetic [barcode part1]
caccaatactacgcag

SEQ ID NO: 22564 - DNA, 16 bp, Artificial Sequence
  synthetic [barcode part1]
acctaaccacgttccg

SEQ ID NO: 22565 - DNA, 16 bp, Artificial Sequence
  synthetic [barcode part1]
agatcgtggcacgaac

SEQ ID NO: 22566 - DNA, 16 bp, Artificial Sequence
  synthetic [barcode part1]
actcaaccacactccg

SEQ ID NO: 22567 - DNA, 16 bp, Artificial Sequence
  synthetic [barcode part1]
aaggacaggtacgagt

SEQ ID NO: 22568 - DNA, 16 bp, Artificial Sequence
  synthetic [barcode part1]
accggaaggaattgag

SEQ ID NO: 22569 - DNA, 16 bp, Artificial Sequence
  synthetic [barcode part1]
acggactagaacaact

SEQ ID NO: 22570 - DNA, 16 bp, Artificial Sequence
  synthetic [barcode part1]
tcagacaacgaacctc

SEQ ID NO: 22571 - DNA, 16 bp, Artificial Sequence
  synthetic [barcode part1]
acacgtgaccgtgatt

SEQ ID NO: 22572 - DNA, 16 bp, Artificial Sequence
  synthetic [barcode part1]
caactagatcgatcgc

SEQ ID NO: 22573 - DNA, 16 bp, Artificial Sequence
  synthetic [barcode part1]
aactgtccgttgagtg

SEQ ID NO: 22574 - DNA, 16 bp, Artificial Sequence
  synthetic [barcode part1]
tgtctcggtagtagac

SEQ ID NO: 22575 - DNA, 16 bp, Artificial Sequence
  synthetic [barcode part1]
gaagtctcgttgtgac

SEQ ID NO: 22576 - DNA, 16 bp, Artificial Sequence
  synthetic [barcode part1]
acgacgttcgactagt

SEQ ID NO: 22577 - DNA, 16 bp, Artificial Sequence
  synthetic [barcode part1]
tagacgttggtgaggc

SEQ ID NO: 22578 - DNA, 16 bp, Artificial Sequence
  synthetic [barcode part1]
tataccgtctcagttg

SEQ ID NO: 22579 - DNA, 16 bp, Artificial Sequence
  synthetic [barcode part1]
ccactatcgtccaggt

SEQ ID NO: 22580 - DNA, 16 bp, Artificial Sequence
  synthetic [barcode part1]
gtcgaaggaagaatcg

SEQ ID NO: 22581 - DNA, 16 bp, Artificial Sequence
  synthetic [barcode part1]
gactcagactgagtct

SEQ ID NO: 22582 - DNA, 16 bp, Artificial Sequence
  synthetic [barcode part1]
tgcctaagaagtggcg

SEQ ID NO: 22583 - DNA, 16 bp, Artificial Sequence
  synthetic [barcode part1]
cgttcacaagtcctgc

SEQ ID NO: 22584 - DNA, 16 bp, Artificial Sequence
  synthetic [barcode part1]
gattcgagtgtaagac

SEQ ID NO: 22585 - DNA, 16 bp, Artificial Sequence
  synthetic [barcode part1]
gacgactaacctggtt

SEQ ID NO: 22586 - DNA, 16 bp, Artificial Sequence
  synthetic [barcode part1]
gtgtatcttgtcgttg

SEQ ID NO: 22587 - DNA, 16 bp, Artificial Sequence
  synthetic [barcode part1]
actaagtgtctggcgt

SEQ ID NO: 22588 - DNA, 16 bp, Artificial Sequence
  synthetic [barcode part1]
atcaagtggaccacct

SEQ ID NO: 22589 - DNA, 16 bp, Artificial Sequence
  synthetic [barcode part1]
agataaggataccacc

SEQ ID NO: 22590 - DNA, 16 bp, Artificial Sequence
  synthetic [barcode part1]
tgagactaaccgatcc

SEQ ID NO: 22591 - DNA, 16 bp, Artificial Sequence
  synthetic [barcode part1]
ttgattctgccaacac

SEQ ID NO: 22592 - DNA, 16 bp, Artificial Sequence
  synthetic [barcode part1]
ttatcggtgtaccttg

SEQ ID NO: 22593 - DNA, 16 bp, Artificial Sequence
  synthetic [barcode part1]
gtaatcgacgtaccac

SEQ ID NO: 22594 - DNA, 16 bp, Artificial Sequence
  synthetic [barcode part1]
tatacggtgtcgacac

SEQ ID NO: 22595 - DNA, 16 bp, Artificial Sequence
  synthetic [barcode part1]
aggacagttgtcttgc

SEQ ID NO: 22596 - DNA, 16 bp, Artificial Sequence
  synthetic [barcode part1]
cgacacaagaagttgt

SEQ ID NO: 22597 - DNA, 16 bp, Artificial Sequence
  synthetic [barcode part1]
attaccggaagtacag

SEQ ID NO: 22598 - DNA, 16 bp, Artificial Sequence
  synthetic [barcode part1]
gcaaggtgcaatagag

SEQ ID NO: 22599 - DNA, 16 bp, Artificial Sequence
  synthetic [barcode part1]
cgaacgttataggcct

SEQ ID NO: 22600 - DNA, 16 bp, Artificial Sequence
  synthetic [barcode part1]
ataagaggcgtccttc

SEQ ID NO: 22601 - DNA, 16 bp, Artificial Sequence
  synthetic [barcode part1]
tgagtctgtaacagag

SEQ ID NO: 22602 - DNA, 16 bp, Artificial Sequence
  synthetic [barcode part1]
ccttcgacagtacgtc

SEQ ID NO: 22603 - DNA, 16 bp, Artificial Sequence
  synthetic [barcode part1]
gtaatacgcgtcacgt

SEQ ID NO: 22604 - DNA, 16 bp, Artificial Sequence
  synthetic [barcode part1]
aatcggcgtgtgtact

SEQ ID NO: 22605 - DNA, 16 bp, Artificial Sequence
  synthetic [barcode part1]
atctacgagaacagtg

SEQ ID NO: 22606 - DNA, 16 bp, Artificial Sequence
  synthetic [barcode part1]
tgacacgtacaccagt

SEQ ID NO: 22607 - DNA, 16 bp, Artificial Sequence
  synthetic [barcode part1]
ttgatagtctggcggt

SEQ ID NO: 22608 - DNA, 16 bp, Artificial Sequence
  synthetic [barcode part1]
tccttcgaagtacttg

SEQ ID NO: 22609 - DNA, 16 bp, Artificial Sequence
  synthetic [barcode part1]
tatccagtggccttcg

SEQ ID NO: 22610 - DNA, 16 bp, Artificial Sequence
  synthetic [barcode part1]
ccttcggatcacacgt

SEQ ID NO: 22611 - DNA, 16 bp, Artificial Sequence
  synthetic [barcode part1]
tgccttcaacttaacg

SEQ ID NO: 22612 - DNA, 16 bp, Artificial Sequence
  synthetic [barcode part1]
gacggttgtgtcctct

SEQ ID NO: 22613 - DNA, 16 bp, Artificial Sequence
  synthetic [barcode part1]
attcacctgttcgcct

SEQ ID NO: 22614 - DNA, 16 bp, Artificial Sequence
  synthetic [barcode part1]
tggttggacgttacgt

SEQ ID NO: 22615 - DNA, 16 bp, Artificial Sequence
  synthetic [barcode part1]
actcctaacaacctgt

SEQ ID NO: 22616 - DNA, 16 bp, Artificial Sequence
  synthetic [barcode part1]
aactgtgcaacgtgtc

SEQ ID NO: 22617 - DNA, 16 bp, Artificial Sequence
  synthetic [barcode part1]
gtgtcaatcctaccgc

SEQ ID NO: 22618 - DNA, 16 bp, Artificial Sequence
  synthetic [barcode part1]
cctcctctaatcagtc

SEQ ID NO: 22619 - DNA, 16 bp, Artificial Sequence
  synthetic [barcode part1]
agacgcagtcgagttg

SEQ ID NO: 22620 - DNA, 16 bp, Artificial Sequence
  synthetic [barcode part1]
gacttacgagtggcag

SEQ ID NO: 22621 - DNA, 16 bp, Artificial Sequence
  synthetic [barcode part1]
cgagtgtactgcctct

SEQ ID NO: 22622 - DNA, 16 bp, Artificial Sequence
  synthetic [barcode part1]
gtcacaaggactctac

SEQ ID NO: 22623 - DNA, 16 bp, Artificial Sequence
  synthetic [barcode part1]
agtgactatcgttggc

SEQ ID NO: 22624 - DNA, 16 bp, Artificial Sequence
  synthetic [barcode part1]
gatcttcaggagtcgt

SEQ ID NO: 22625 - DNA, 16 bp, Artificial Sequence
  synthetic [barcode part1]
tctggagtggtcaact

SEQ ID NO: 22626 - DNA, 16 bp, Artificial Sequence
  synthetic [barcode part1]
gtgtactgacacgttg

SEQ ID NO: 22627 - DNA, 16 bp, Artificial Sequence
  synthetic [barcode part1]
ttcggagagtcctagt

SEQ ID NO: 22628 - DNA, 16 bp, Artificial Sequence
  synthetic [barcode part1]
gtagatcgatcgtacc

SEQ ID NO: 22629 - DNA, 16 bp, Artificial Sequence
  synthetic [barcode part1]
cctagttgcactaact

SEQ ID NO: 22630 - DNA, 16 bp, Artificial Sequence
  synthetic [barcode part1]
cgcggcagaataggtt

SEQ ID NO: 22631 - DNA, 16 bp, Artificial Sequence
  synthetic [barcode part1]
tgtctcctcttcgtag

SEQ ID NO: 22632 - DNA, 16 bp, Artificial Sequence
  synthetic [barcode part1]
acctgatcgacgattg

SEQ ID NO: 22633 - DNA, 16 bp, Artificial Sequence
  synthetic [barcode part1]
ttgtcgagtacagaag

SEQ ID NO: 22634 - DNA, 16 bp, Artificial Sequence
  synthetic [barcode part1]
ataggaagaccgtcgc

SEQ ID NO: 22635 - DNA, 16 bp, Artificial Sequence
  synthetic [barcode part1]
tagacggcctacttag

SEQ ID NO: 22636 - DNA, 16 bp, Artificial Sequence
  synthetic [barcode part1]
gagtgtgtaataaccg

SEQ ID NO: 22637 - DNA, 16 bp, Artificial Sequence
  synthetic [barcode part1]
agtccttctggatact

SEQ ID NO: 22638 - DNA, 16 bp, Artificial Sequence
  synthetic [barcode part1]
gcgttgcagatcttag

SEQ ID NO: 22639 - DNA, 16 bp, Artificial Sequence
  synthetic [barcode part1]
ttgccaagtgttcttg

SEQ ID NO: 22640 - DNA, 16 bp, Artificial Sequence
  synthetic [barcode part1]
tctgaccttgactctc

SEQ ID NO: 22641 - DNA, 16 bp, Artificial Sequence
  synthetic [barcode part1]
acagtacctgagatcc

SEQ ID NO: 22642 - DNA, 16 bp, Artificial Sequence
  synthetic [barcode part1]
ataagttgaaggccac

SEQ ID NO: 22643 - DNA, 16 bp, Artificial Sequence
  synthetic [barcode part1]
taacctcctgaggagt

SEQ ID NO: 22644 - DNA, 16 bp, Artificial Sequence
  synthetic [barcode part1]
agttagtcacgtgcgt

SEQ ID NO: 22645 - DNA, 16 bp, Artificial Sequence
  synthetic [barcode part1]
ccgtctatctaaggcc

SEQ ID NO: 22646 - DNA, 16 bp, Artificial Sequence
  synthetic [barcode part1]
aggtggttcagtgcag

SEQ ID NO: 22647 - DNA, 16 bp, Artificial Sequence
  synthetic [barcode part1]
aacggttacgtagaac

SEQ ID NO: 22648 - DNA, 16 bp, Artificial Sequence
  synthetic [barcode part1]
agaacggttcgaatac

SEQ ID NO: 22649 - DNA, 16 bp, Artificial Sequence
  synthetic [barcode part1]
attgagagtatcgacg

SEQ ID NO: 22650 - DNA, 16 bp, Artificial Sequence
  synthetic [barcode part1]
acctctcaccgtgtag

SEQ ID NO: 22651 - DNA, 16 bp, Artificial Sequence
  synthetic [barcode part1]
tgaaccttctgccacg

SEQ ID NO: 22652 - DNA, 16 bp, Artificial Sequence
  synthetic [barcode part1]
gatccaggtatctctt

SEQ ID NO: 22653 - DNA, 16 bp, Artificial Sequence
  synthetic [barcode part1]
tgtgcctgcaacctac

SEQ ID NO: 22654 - DNA, 16 bp, Artificial Sequence
  synthetic [barcode part1]
acgttcttgcagaggt

SEQ ID NO: 22655 - DNA, 16 bp, Artificial Sequence
  synthetic [barcode part1]
agtgtgtcaacgtgtc

SEQ ID NO: 22656 - DNA, 16 bp, Artificial Sequence
  synthetic [barcode part1]
gaattgatcggttccg

SEQ ID NO: 22657 - DNA, 16 bp, Artificial Sequence
  synthetic [barcode part1]
aagtaagacggtatcc

SEQ ID NO: 22658 - DNA, 16 bp, Artificial Sequence
  synthetic [barcode part1]
gatcgtatcagttctc

SEQ ID NO: 22659 - DNA, 16 bp, Artificial Sequence
  synthetic [barcode part1]
tgcctgtacggataac

SEQ ID NO: 22660 - DNA, 16 bp, Artificial Sequence
  synthetic [barcode part1]
gttggcctatagtacg

SEQ ID NO: 22661 - DNA, 16 bp, Artificial Sequence
  synthetic [barcode part1]
gccagatcactctcgt

SEQ ID NO: 22662 - DNA, 16 bp, Artificial Sequence
  synthetic [barcode part1]
tagacgcaaggaccgt

SEQ ID NO: 22663 - DNA, 16 bp, Artificial Sequence
  synthetic [barcode part1]
actgtccacgagttcc

SEQ ID NO: 22664 - DNA, 16 bp, Artificial Sequence
  synthetic [barcode part1]
ccaatagatccggtac

SEQ ID NO: 22665 - DNA, 16 bp, Artificial Sequence
  synthetic [barcode part1]
cgagtgcgttatcctc

SEQ ID NO: 22666 - DNA, 16 bp, Artificial Sequence
  synthetic [barcode part1]
cacttacctcgttcgt

SEQ ID NO: 22667 - DNA, 16 bp, Artificial Sequence
  synthetic [barcode part1]
gcactggactacttcc

SEQ ID NO: 22668 - DNA, 16 bp, Artificial Sequence
  synthetic [barcode part1]
tcagttgagtctcgag

SEQ ID NO: 22669 - DNA, 16 bp, Artificial Sequence
  synthetic [barcode part1]
attgtggaggcggatc

SEQ ID NO: 22670 - DNA, 16 bp, Artificial Sequence
  synthetic [barcode part1]
agaatcagattacgcg

SEQ ID NO: 22671 - DNA, 16 bp, Artificial Sequence
  synthetic [barcode part1]
gcaactgtgactgtgt

SEQ ID NO: 22672 - DNA, 16 bp, Artificial Sequence
  synthetic [barcode part1]
tacacagacagagtac

SEQ ID NO: 22673 - DNA, 16 bp, Artificial Sequence
  synthetic [barcode part1]
actgcaacctgcctac

SEQ ID NO: 22674 - DNA, 16 bp, Artificial Sequence
  synthetic [barcode part1]
gaactgtactcaacgc

SEQ ID NO: 22675 - DNA, 16 bp, Artificial Sequence
  synthetic [barcode part1]
ttattcgcggacgaac

SEQ ID NO: 22676 - DNA, 16 bp, Artificial Sequence
  synthetic [barcode part1]
ccaagatctacggtac

SEQ ID NO: 22677 - DNA, 16 bp, Artificial Sequence
  synthetic [barcode part1]
cacctgttgtctgttc

SEQ ID NO: 22678 - DNA, 16 bp, Artificial Sequence
  synthetic [barcode part1]
aggaagtggcacacct

SEQ ID NO: 22679 - DNA, 16 bp, Artificial Sequence
  synthetic [barcode part1]
tctattgccgatacac

SEQ ID NO: 22680 - DNA, 16 bp, Artificial Sequence
  synthetic [barcode part1]
caattccagagtcggt

SEQ ID NO: 22681 - DNA, 16 bp, Artificial Sequence
  synthetic [barcode part1]
gtcagattgtcgaacc

SEQ ID NO: 22682 - DNA, 16 bp, Artificial Sequence
  synthetic [barcode part1]
actagtcgactgactg

SEQ ID NO: 22683 - DNA, 16 bp, Artificial Sequence
  synthetic [barcode part1]
tcggcaattacgtctt

SEQ ID NO: 22684 - DNA, 16 bp, Artificial Sequence
  synthetic [barcode part1]
tcactgaagtctgacg

SEQ ID NO: 22685 - DNA, 16 bp, Artificial Sequence
  synthetic [barcode part1]
accttcgtcgttggac

SEQ ID NO: 22686 - DNA, 16 bp, Artificial Sequence
  synthetic [barcode part1]
gtctagtgtattcctg

SEQ ID NO: 22687 - DNA, 16 bp, Artificial Sequence
  synthetic [barcode part1]
cgcgacttaatctccg

SEQ ID NO: 22688 - DNA, 16 bp, Artificial Sequence
  synthetic [barcode part1]
tctgagagaccaatcc

SEQ ID NO: 22689 - DNA, 16 bp, Artificial Sequence
  synthetic [barcode part1]
aggtactcaaggcgac

SEQ ID NO: 22690 - DNA, 16 bp, Artificial Sequence
  synthetic [barcode part1]
tcgtattacggtctac

SEQ ID NO: 22691 - DNA, 16 bp, Artificial Sequence
  synthetic [barcode part1]
gaggttggactgtacg

SEQ ID NO: 22692 - DNA, 16 bp, Artificial Sequence
  synthetic [barcode part1]
tatcgaggcagttcac

SEQ ID NO: 22693 - DNA, 16 bp, Artificial Sequence
  synthetic [barcode part1]
taagtgcaggacaatc

SEQ ID NO: 22694 - DNA, 16 bp, Artificial Sequence
  synthetic [barcode part1]
aactgactgcaacacc

SEQ ID NO: 22695 - DNA, 16 bp, Artificial Sequence
  synthetic [barcode part1]
tcgccttccagtacag

SEQ ID NO: 22696 - DNA, 16 bp, Artificial Sequence
  synthetic [barcode part1]
atccgagatcctactt

SEQ ID NO: 22697 - DNA, 16 bp, Artificial Sequence
  synthetic [barcode part1]
cgtgtagtatctcact

SEQ ID NO: 22698 - DNA, 16 bp, Artificial Sequence
  synthetic [barcode part1]
tgtaccaactgtgcag

SEQ ID NO: 22699 - DNA, 16 bp, Artificial Sequence
  synthetic [barcode part1]
acgtcggttagtgtac

SEQ ID NO: 22700 - DNA, 16 bp, Artificial Sequence
  synthetic [barcode part1]
gcctgagatctgtaac

SEQ ID NO: 22701 - DNA, 16 bp, Artificial Sequence
  synthetic [barcode part1]
tgaactggccgaattc

SEQ ID NO: 22702 - DNA, 16 bp, Artificial Sequence
  synthetic [barcode part1]
atacgaccgacgtatc

SEQ ID NO: 22703 - DNA, 16 bp, Artificial Sequence
  synthetic [barcode part1]
tagtggccaatctggt

SEQ ID NO: 22704 - DNA, 16 bp, Artificial Sequence
  synthetic [barcode part1]
gattacgcctcaattc

SEQ ID NO: 22705 - DNA, 16 bp, Artificial Sequence
  synthetic [barcode part1]
cactacctagaggatc

SEQ ID NO: 22706 - DNA, 16 bp, Artificial Sequence
  synthetic [barcode part1]
ccgattactaggatcg

SEQ ID NO: 22707 - DNA, 16 bp, Artificial Sequence
  synthetic [barcode part1]
ccgattaacgtacacg

SEQ ID NO: 22708 - DNA, 16 bp, Artificial Sequence
  synthetic [barcode part1]
aactgtctcgtacttg

SEQ ID NO: 22709 - DNA, 16 bp, Artificial Sequence
  synthetic [barcode part1]
atacggcggagttggt

SEQ ID NO: 22710 - DNA, 16 bp, Artificial Sequence
  synthetic [barcode part1]
atctcttactggtacg

SEQ ID NO: 22711 - DNA, 16 bp, Artificial Sequence
  synthetic [barcode part1]
actagaacgcgcagtg

SEQ ID NO: 22712 - DNA, 16 bp, Artificial Sequence
  synthetic [barcode part1]
ataggagactgaacct

SEQ ID NO: 22713 - DNA, 16 bp, Artificial Sequence
  synthetic [barcode part1]
gtactctgtgcagagt

SEQ ID NO: 22714 - DNA, 16 bp, Artificial Sequence
  synthetic [barcode part1]
gttcctctgtgtggtg

SEQ ID NO: 22715 - DNA, 16 bp, Artificial Sequence
  synthetic [barcode part1]
atctcgaacgtacacg

SEQ ID NO: 22716 - DNA, 16 bp, Artificial Sequence
  synthetic [barcode part1]
ttcggtaccacacctg

SEQ ID NO: 22717 - DNA, 16 bp, Artificial Sequence
  synthetic [barcode part1]
gacctctagagtagtc

SEQ ID NO: 22718 - DNA, 16 bp, Artificial Sequence
  synthetic [barcode part1]
cgccgattacgattag

SEQ ID NO: 22719 - DNA, 16 bp, Artificial Sequence
  synthetic [barcode part1]
aatcagaagtggcgag

SEQ ID NO: 22720 - DNA, 16 bp, Artificial Sequence
  synthetic [barcode part1]
gttaacgacgactacc

SEQ ID NO: 22721 - DNA, 16 bp, Artificial Sequence
  synthetic [barcode part1]
tgtggcagtaacacct

SEQ ID NO: 22722 - DNA, 16 bp, Artificial Sequence
  synthetic [barcode part1]
agataggtgagactct

SEQ ID NO: 22723 - DNA, 16 bp, Artificial Sequence
  synthetic [barcode part1]
aaccacgagagttagt

SEQ ID NO: 22724 - DNA, 16 bp, Artificial Sequence
  synthetic [barcode part1]
ttcgcacactactggc

SEQ ID NO: 22725 - DNA, 16 bp, Artificial Sequence
  synthetic [barcode part1]
acacggagttcttgtg

SEQ ID NO: 22726 - DNA, 16 bp, Artificial Sequence
  synthetic [barcode part1]
ttagtgcgacctcctg

SEQ ID NO: 22727 - DNA, 16 bp, Artificial Sequence
  synthetic [barcode part1]
gtggtagacgaagtag

SEQ ID NO: 22728 - DNA, 16 bp, Artificial Sequence
  synthetic [barcode part1]
gtctcctgtcgatacg

SEQ ID NO: 22729 - DNA, 16 bp, Artificial Sequence
  synthetic [barcode part1]
agttatacgcgcaacc

SEQ ID NO: 22730 - DNA, 16 bp, Artificial Sequence
  synthetic [barcode part1]
agtcgaggtctagacg

SEQ ID NO: 22731 - DNA, 16 bp, Artificial Sequence
  synthetic [barcode part1]
gtgattgattggcacc

SEQ ID NO: 22732 - DNA, 16 bp, Artificial Sequence
  synthetic [barcode part1]
agtatagaggccaccg

SEQ ID NO: 22733 - DNA, 16 bp, Artificial Sequence
  synthetic [barcode part1]
tctccaggttagtgcc

SEQ ID NO: 22734 - DNA, 16 bp, Artificial Sequence
  synthetic [barcode part1]
acttcgcggcgtattc

SEQ ID NO: 22735 - DNA, 16 bp, Artificial Sequence
  synthetic [barcode part1]
aatctaacgactcggc

SEQ ID NO: 22736 - DNA, 16 bp, Artificial Sequence
  synthetic [barcode part1]
acaacacctgagactc

SEQ ID NO: 22737 - DNA, 16 bp, Artificial Sequence
  synthetic [barcode part1]
tatagttgagacggtg

SEQ ID NO: 22738 - DNA, 16 bp, Artificial Sequence
  synthetic [barcode part1]
actcctaaggcgtagt

SEQ ID NO: 22739 - DNA, 16 bp, Artificial Sequence
  synthetic [barcode part1]
ttggtagaatacggac

SEQ ID NO: 22740 - DNA, 16 bp, Artificial Sequence
  synthetic [barcode part1]
ttgatctccgtgcgac

SEQ ID NO: 22741 - DNA, 16 bp, Artificial Sequence
  synthetic [barcode part1]
gttagtccacaacgtg

SEQ ID NO: 22742 - DNA, 16 bp, Artificial Sequence
  synthetic [barcode part1]
gacgaagttgagtgcc

SEQ ID NO: 22743 - DNA, 16 bp, Artificial Sequence
  synthetic [barcode part1]
gacactagttacggtc

SEQ ID NO: 22744 - DNA, 16 bp, Artificial Sequence
  synthetic [barcode part1]
gtgatcgatcgacact

SEQ ID NO: 22745 - DNA, 16 bp, Artificial Sequence
  synthetic [barcode part1]
cactctgactctgttc

SEQ ID NO: 22746 - DNA, 16 bp, Artificial Sequence
  synthetic [barcode part1]
gccgtacttcttgacg

SEQ ID NO: 22747 - DNA, 16 bp, Artificial Sequence
  synthetic [barcode part1]
tacagaaccggattag

SEQ ID NO: 22748 - DNA, 16 bp, Artificial Sequence
  synthetic [barcode part1]
cctaccaacactcgac

SEQ ID NO: 22749 - DNA, 16 bp, Artificial Sequence
  synthetic [barcode part1]
agtgttcttcgattcg

SEQ ID NO: 22750 - DNA, 16 bp, Artificial Sequence
  synthetic [barcode part1]
gtgatatccggagtct

SEQ ID NO: 22751 - DNA, 16 bp, Artificial Sequence
  synthetic [barcode part1]
ccgtgtcttcggtagt

SEQ ID NO: 22752 - DNA, 16 bp, Artificial Sequence
  synthetic [barcode part1]
gttacggcggataggt

SEQ ID NO: 22753 - DNA, 16 bp, Artificial Sequence
  synthetic [barcode part1]
cgagtcctctactgtg

SEQ ID NO: 22754 - DNA, 16 bp, Artificial Sequence
  synthetic [barcode part1]
ttcacaggaacaacag

SEQ ID NO: 22755 - DNA, 16 bp, Artificial Sequence
  synthetic [barcode part1]
ccttgtcgtcttactg

SEQ ID NO: 22756 - DNA, 16 bp, Artificial Sequence
  synthetic [barcode part1]
ttcctatctgccggag

SEQ ID NO: 22757 - DNA, 16 bp, Artificial Sequence
  synthetic [barcode part1]
tggaatcctggtcaac

SEQ ID NO: 22758 - DNA, 16 bp, Artificial Sequence
  synthetic [barcode part1]
cagacgactcgaagtg

SEQ ID NO: 22759 - DNA, 16 bp, Artificial Sequence
  synthetic [barcode part1]
aggcgcgtcagattag

SEQ ID NO: 22760 - DNA, 16 bp, Artificial Sequence
  synthetic [barcode part1]
tctcaaggtagtgtcg

SEQ ID NO: 22761 - DNA, 16 bp, Artificial Sequence
  synthetic [barcode part1]
acgagtcacacttggt

SEQ ID NO: 22762 - DNA, 16 bp, Artificial Sequence
  synthetic [barcode part1]
caaggttgaggtcttc

SEQ ID NO: 22763 - DNA, 16 bp, Artificial Sequence
  synthetic [barcode part1]
gagaggttaggtccac

SEQ ID NO: 22764 - DNA, 16 bp, Artificial Sequence
  synthetic [barcode part1]
gaagacctcctagttg

SEQ ID NO: 22765 - DNA, 16 bp, Artificial Sequence
  synthetic [barcode part1]
gatctgactcctgtgc

SEQ ID NO: 22766 - DNA, 16 bp, Artificial Sequence
  synthetic [barcode part1]
tgcggaatacaggaag

SEQ ID NO: 22767 - DNA, 16 bp, Artificial Sequence
  synthetic [barcode part1]
gtgattgtctcagttc

SEQ ID NO: 22768 - DNA, 16 bp, Artificial Sequence
  synthetic [barcode part1]
tgaccaaggttagtcc

SEQ ID NO: 22769 - DNA, 16 bp, Artificial Sequence
  synthetic [barcode part1]
tcagtgacaccttcgc

SEQ ID NO: 22770 - DNA, 16 bp, Artificial Sequence
  synthetic [barcode part1]
tcctgtcgtggacttg

SEQ ID NO: 22771 - DNA, 16 bp, Artificial Sequence
  synthetic [barcode part1]
gaccacgcaatatacc

SEQ ID NO: 22772 - DNA, 16 bp, Artificial Sequence
  synthetic [barcode part1]
gccaccttcacagact

SEQ ID NO: 22773 - DNA, 16 bp, Artificial Sequence
  synthetic [barcode part1]
ttactgtaagtggcgc

SEQ ID NO: 22774 - DNA, 16 bp, Artificial Sequence
  synthetic [barcode part1]
ttccaactacgttggt

SEQ ID NO: 22775 - DNA, 16 bp, Artificial Sequence
  synthetic [barcode part1]
ttcacgagtgaacctg

SEQ ID NO: 22776 - DNA, 16 bp, Artificial Sequence
  synthetic [barcode part1]
aagtattcgaggtgac

SEQ ID NO: 22777 - DNA, 16 bp, Artificial Sequence
  synthetic [barcode part1]
gcgtagaggtgacttg

SEQ ID NO: 22778 - DNA, 16 bp, Artificial Sequence
  synthetic [barcode part1]
gatcgactgatcgact

SEQ ID NO: 22779 - DNA, 16 bp, Artificial Sequence
  synthetic [barcode part1]
ttacgacagttgaccg

SEQ ID NO: 22780 - DNA, 16 bp, Artificial Sequence
  synthetic [barcode part1]
tcttggcaggaactac

SEQ ID NO: 22781 - DNA, 16 bp, Artificial Sequence
  synthetic [barcode part1]
gttgcaatctattcgc

SEQ ID NO: 22782 - DNA, 16 bp, Artificial Sequence
  synthetic [barcode part1]
gatctggtacactctt

SEQ ID NO: 22783 - DNA, 16 bp, Artificial Sequence
  synthetic [barcode part1]
acactacacggacgag

SEQ ID NO: 22784 - DNA, 16 bp, Artificial Sequence
  synthetic [barcode part1]
ccgttacctataagtc

SEQ ID NO: 22785 - DNA, 16 bp, Artificial Sequence
  synthetic [barcode part1]
tcgtaagactctccgc

SEQ ID NO: 22786 - DNA, 16 bp, Artificial Sequence
  synthetic [barcode part1]
ccttacctaagtatcg

SEQ ID NO: 22787 - DNA, 16 bp, Artificial Sequence
  synthetic [barcode part1]
agtcgccagatacgag

SEQ ID NO: 22788 - DNA, 16 bp, Artificial Sequence
  synthetic [barcode part1]
tggcgtacagtcctct

SEQ ID NO: 22789 - DNA, 16 bp, Artificial Sequence
  synthetic [barcode part1]
tgtcgaaggattgtcc

SEQ ID NO: 22790 - DNA, 16 bp, Artificial Sequence
  synthetic [barcode part1]
actggcgatctctcac

SEQ ID NO: 22791 - DNA, 16 bp, Artificial Sequence
  synthetic [barcode part1]
ccacgactaactagtg

SEQ ID NO: 22792 - DNA, 16 bp, Artificial Sequence
  synthetic [barcode part1]
actggatagacacaac

SEQ ID NO: 22793 - DNA, 16 bp, Artificial Sequence
  synthetic [barcode part1]
ccttcaggtgtgtcac

SEQ ID NO: 22794 - DNA, 16 bp, Artificial Sequence
  synthetic [barcode part1]
acacctctggttcgac

SEQ ID NO: 22795 - DNA, 16 bp, Artificial Sequence
  synthetic [barcode part1]
cgtagattccactatc

SEQ ID NO: 22796 - DNA, 16 bp, Artificial Sequence
  synthetic [barcode part1]
cgtcctatccaggtac

SEQ ID NO: 22797 - DNA, 16 bp, Artificial Sequence
  synthetic [barcode part1]
aggtaatcacaagtcg

SEQ ID NO: 22798 - DNA, 16 bp, Artificial Sequence
  synthetic [barcode part1]
ttggtggtccagtagt

SEQ ID NO: 22799 - DNA, 16 bp, Artificial Sequence
  synthetic [barcode part1]
ttcactagaccgtatc

SEQ ID NO: 22800 - DNA, 16 bp, Artificial Sequence
  synthetic [barcode part1]
gtggttgtgacgtact

SEQ ID NO: 22801 - DNA, 16 bp, Artificial Sequence
  synthetic [barcode part1]
gtacgtacagtcaacc

SEQ ID NO: 22802 - DNA, 16 bp, Artificial Sequence
  synthetic [barcode part1]
gcacagattcagtaag

SEQ ID NO: 22803 - DNA, 16 bp, Artificial Sequence
  synthetic [barcode part1]
tcaggcaacctacagt

SEQ ID NO: 22804 - DNA, 16 bp, Artificial Sequence
  synthetic [barcode part1]
aagtgtaccaggccag

SEQ ID NO: 22805 - DNA, 16 bp, Artificial Sequence
  synthetic [barcode part1]
ccactcagatactgcc

SEQ ID NO: 22806 - DNA, 16 bp, Artificial Sequence
  synthetic [barcode part1]
tctaccgttaggtatc

SEQ ID NO: 22807 - DNA, 16 bp, Artificial Sequence
  synthetic [barcode part1]
ttgcgccacaagagtt

SEQ ID NO: 22808 - DNA, 16 bp, Artificial Sequence
  synthetic [barcode part1]
gaccttcgcacgattc

SEQ ID NO: 22809 - DNA, 16 bp, Artificial Sequence
  synthetic [barcode part1]
gacgttgcaaccagtt

SEQ ID NO: 22810 - DNA, 16 bp, Artificial Sequence
  synthetic [barcode part1]
cgagtgcctctactac

SEQ ID NO: 22811 - DNA, 16 bp, Artificial Sequence
  synthetic [barcode part1]
actcttaagtggtctc

SEQ ID NO: 22812 - DNA, 16 bp, Artificial Sequence
  synthetic [barcode part1]
aaccgcggtactaatc

SEQ ID NO: 22813 - DNA, 16 bp, Artificial Sequence
  synthetic [barcode part1]
tgtcttgtcgtaggtt

SEQ ID NO: 22814 - DNA, 16 bp, Artificial Sequence
  synthetic [barcode part1]
accacctatcctactc

SEQ ID NO: 22815 - DNA, 16 bp, Artificial Sequence
  synthetic [barcode part1]
acgcctgacagtagag

SEQ ID NO: 22816 - DNA, 16 bp, Artificial Sequence
  synthetic [barcode part1]
tatcgaaccaccaggt

SEQ ID NO: 22817 - DNA, 16 bp, Artificial Sequence
  synthetic [barcode part1]
agacgaccacgttgag

SEQ ID NO: 22818 - DNA, 16 bp, Artificial Sequence
  synthetic [barcode part1]
cgtataccgactaacg

SEQ ID NO: 22819 - DNA, 16 bp, Artificial Sequence
  synthetic [barcode part1]
cgattggagaaggagt

SEQ ID NO: 22820 - DNA, 16 bp, Artificial Sequence
  synthetic [barcode part1]
ccgtcgatacgagaag

SEQ ID NO: 22821 - DNA, 16 bp, Artificial Sequence
  synthetic [barcode part1]
atctcgcggtatattc

SEQ ID NO: 22822 - DNA, 16 bp, Artificial Sequence
  synthetic [barcode part1]
tagagtaggactggag

SEQ ID NO: 22823 - DNA, 16 bp, Artificial Sequence
  synthetic [barcode part1]
gaggtcttctgagact

SEQ ID NO: 22824 - DNA, 16 bp, Artificial Sequence
  synthetic [barcode part1]
gatacgtatcgtgcac

SEQ ID NO: 22825 - DNA, 16 bp, Artificial Sequence
  synthetic [barcode part1]
tataactggtcgcgtg

SEQ ID NO: 22826 - DNA, 16 bp, Artificial Sequence
  synthetic [barcode part1]
gatcttgcctagaacg

SEQ ID NO: 22827 - DNA, 16 bp, Artificial Sequence
  synthetic [barcode part1]
acgcaacacgtcgatt

SEQ ID NO: 22828 - DNA, 16 bp, Artificial Sequence
  synthetic [barcode part1]
tgactctgagatcggt

SEQ ID NO: 22829 - DNA, 16 bp, Artificial Sequence
  synthetic [barcode part1]
tcactagtggtgactg

SEQ ID NO: 22830 - DNA, 16 bp, Artificial Sequence
  synthetic [barcode part1]
cgcacgtattagtcag

SEQ ID NO: 22831 - DNA, 16 bp, Artificial Sequence
  synthetic [barcode part1]
agtcttgcgagattcg

SEQ ID NO: 22832 - DNA, 16 bp, Artificial Sequence
  synthetic [barcode part1]
cgaatcacgactcaac

SEQ ID NO: 22833 - DNA, 16 bp, Artificial Sequence
  synthetic [barcode part1]
gaatccacggaagacc

SEQ ID NO: 22834 - DNA, 16 bp, Artificial Sequence
  synthetic [barcode part1]
aggatcctacctatct

SEQ ID NO: 22835 - DNA, 16 bp, Artificial Sequence
  synthetic [barcode part1]
cagataaccgtggcag

SEQ ID NO: 22836 - DNA, 16 bp, Artificial Sequence
  synthetic [barcode part1]
tggagttgtgcgtatc

SEQ ID NO: 22837 - DNA, 16 bp, Artificial Sequence
  synthetic [barcode part1]
ccaagaccgaataagt

SEQ ID NO: 22838 - DNA, 16 bp, Artificial Sequence
  synthetic [barcode part1]
attaacaggcacgtcc

SEQ ID NO: 22839 - DNA, 16 bp, Artificial Sequence
  synthetic [barcode part1]
atcgactggttctgag

SEQ ID NO: 22840 - DNA, 16 bp, Artificial Sequence
  synthetic [barcode part1]
tatctcaggcactcgc

SEQ ID NO: 22841 - DNA, 16 bp, Artificial Sequence
  synthetic [barcode part1]
tgactacgaattggag

SEQ ID NO: 22842 - DNA, 16 bp, Artificial Sequence
  synthetic [barcode part1]
tacagtcgtactcgag

SEQ ID NO: 22843 - DNA, 16 bp, Artificial Sequence
  synthetic [barcode part1]
gacggtcgtattcctc

SEQ ID NO: 22844 - DNA, 16 bp, Artificial Sequence
  synthetic [barcode part1]
cagactacaatctggc

SEQ ID NO: 22845 - DNA, 16 bp, Artificial Sequence
  synthetic [barcode part1]
agaggcgtggactgtt

SEQ ID NO: 22846 - DNA, 16 bp, Artificial Sequence
  synthetic [barcode part1]
acgagaattggcagtt

SEQ ID NO: 22847 - DNA, 16 bp, Artificial Sequence
  synthetic [barcode part1]
attactccaggtgttc

SEQ ID NO: 22848 - DNA, 16 bp, Artificial Sequence
  synthetic [barcode part1]
cgtactatcaactctg

SEQ ID NO: 22849 - DNA, 16 bp, Artificial Sequence
  synthetic [barcode part1]
agttaacgcacgcact

SEQ ID NO: 22850 - DNA, 16 bp, Artificial Sequence
  synthetic [barcode part1]
agaatcaggtcgcacg

SEQ ID NO: 22851 - DNA, 16 bp, Artificial Sequence
  synthetic [barcode part1]
ttgccggacgttcttg

SEQ ID NO: 22852 - DNA, 16 bp, Artificial Sequence
  synthetic [barcode part1]
aataaggagttacgcc

SEQ ID NO: 22853 - DNA, 16 bp, Artificial Sequence
  synthetic [barcode part1]
cgtgttcacctaatac

SEQ ID NO: 22854 - DNA, 16 bp, Artificial Sequence
  synthetic [barcode part1]
accaagtcggactatc

SEQ ID NO: 22855 - DNA, 16 bp, Artificial Sequence
  synthetic [barcode part1]
tagactcctcaccacg

SEQ ID NO: 22856 - DNA, 16 bp, Artificial Sequence
  synthetic [barcode part1]
gcacaagtatcggacg

SEQ ID NO: 22857 - DNA, 16 bp, Artificial Sequence
  synthetic [barcode part1]
tccacgtccaagtcac

SEQ ID NO: 22858 - DNA, 16 bp, Artificial Sequence
  synthetic [barcode part1]
tcgatcctgaaggatc

SEQ ID NO: 22859 - DNA, 16 bp, Artificial Sequence
  synthetic [barcode part1]
ttcaaggactacggtc

SEQ ID NO: 22860 - DNA, 16 bp, Artificial Sequence
  synthetic [barcode part1]
tcggagtggattctgt

SEQ ID NO: 22861 - DNA, 16 bp, Artificial Sequence
  synthetic [barcode part1]
gtacacgtcctagagt

SEQ ID NO: 22862 - DNA, 16 bp, Artificial Sequence
  synthetic [barcode part1]
taacttctagtacgcc

SEQ ID NO: 22863 - DNA, 16 bp, Artificial Sequence
  synthetic [barcode part1]
cgtgcctggattgtct

SEQ ID NO: 22864 - DNA, 16 bp, Artificial Sequence
  synthetic [barcode part1]
gcggagaactaggtct

SEQ ID NO: 22865 - DNA, 16 bp, Artificial Sequence
  synthetic [barcode part1]
acggcaataggaagtg

SEQ ID NO: 22866 - DNA, 16 bp, Artificial Sequence
  synthetic [barcode part1]
cggttcttatacagtc

SEQ ID NO: 22867 - DNA, 16 bp, Artificial Sequence
  synthetic [barcode part1]
ttgagattgtccgtct

SEQ ID NO: 22868 - DNA, 16 bp, Artificial Sequence
  synthetic [barcode part1]
caacacacgatagaac

SEQ ID NO: 22869 - DNA, 16 bp, Artificial Sequence
  synthetic [barcode part1]
aaggcacgttaagttg

SEQ ID NO: 22870 - DNA, 16 bp, Artificial Sequence
  synthetic [barcode part1]
gtaactaggaaccagt

SEQ ID NO: 22871 - DNA, 16 bp, Artificial Sequence
  synthetic [barcode part1]
aatatacgccagtgcc

SEQ ID NO: 22872 - DNA, 16 bp, Artificial Sequence
  synthetic [barcode part1]
agatcctaccgactag

SEQ ID NO: 22873 - DNA, 16 bp, Artificial Sequence
  synthetic [barcode part1]
aaccgactgtacacgt

SEQ ID NO: 22874 - DNA, 16 bp, Artificial Sequence
  synthetic [barcode part1]
agagatagtggtccgc

SEQ ID NO: 22875 - DNA, 16 bp, Artificial Sequence
  synthetic [barcode part1]
ttcaactcgtggtcgc

SEQ ID NO: 22876 - DNA, 16 bp, Artificial Sequence
  synthetic [barcode part1]
ttgcggcaccaattag

SEQ ID NO: 22877 - DNA, 16 bp, Artificial Sequence
  synthetic [barcode part1]
taggttgcctctgtgc

SEQ ID NO: 22878 - DNA, 16 bp, Artificial Sequence
  synthetic [barcode part1]
gtcgagacgtgtaacg

SEQ ID NO: 22879 - DNA, 16 bp, Artificial Sequence
  synthetic [barcode part1]
gtctctgtattagacc

SEQ ID NO: 22880 - DNA, 16 bp, Artificial Sequence
  synthetic [barcode part1]
tcaacacaccagtgtg

SEQ ID NO: 22881 - DNA, 16 bp, Artificial Sequence
  synthetic [barcode part1]
acctgtcagtaggtac

SEQ ID NO: 22882 - DNA, 16 bp, Artificial Sequence
  synthetic [barcode part1]
ataccacggtactacg

SEQ ID NO: 22883 - DNA, 16 bp, Artificial Sequence
  synthetic [barcode part1]
tagaggatagtcacgt

SEQ ID NO: 22884 - DNA, 16 bp, Artificial Sequence
  synthetic [barcode part1]
cacaactaggacggtg

SEQ ID NO: 22885 - DNA, 16 bp, Artificial Sequence
  synthetic [barcode part1]
cagtgatcgcaaggac

SEQ ID NO: 22886 - DNA, 16 bp, Artificial Sequence
  synthetic [barcode part1]
caataaggaattcgcg

SEQ ID NO: 22887 - DNA, 16 bp, Artificial Sequence
  synthetic [barcode part1]
gaacgactctcactag

SEQ ID NO: 22888 - DNA, 16 bp, Artificial Sequence
  synthetic [barcode part1]
gaggtgttcagattag

SEQ ID NO: 22889 - DNA, 16 bp, Artificial Sequence
  synthetic [barcode part1]
gtcgagtgcaattcgt

SEQ ID NO: 22890 - DNA, 16 bp, Artificial Sequence
  synthetic [barcode part1]
acggtattgtacacgc

SEQ ID NO: 22891 - DNA, 16 bp, Artificial Sequence
  synthetic [barcode part1]
gcctagagttctatct

SEQ ID NO: 22892 - DNA, 16 bp, Artificial Sequence
  synthetic [barcode part1]
tctgcactcggtgatc

SEQ ID NO: 22893 - DNA, 16 bp, Artificial Sequence
  synthetic [barcode part1]
caagtctcctattacg

SEQ ID NO: 22894 - DNA, 16 bp, Artificial Sequence
  synthetic [barcode part1]
accaggaaggattgag

SEQ ID NO: 22895 - DNA, 16 bp, Artificial Sequence
  synthetic [barcode part1]
gtacgccgtcttctag

SEQ ID NO: 22896 - DNA, 16 bp, Artificial Sequence
  synthetic [barcode part1]
cagataccttccggtc

SEQ ID NO: 22897 - DNA, 16 bp, Artificial Sequence
  synthetic [barcode part1]
caagactcagtcgatc

SEQ ID NO: 22898 - DNA, 16 bp, Artificial Sequence
  synthetic [barcode part1]
gccggagatatcagtg

SEQ ID NO: 22899 - DNA, 16 bp, Artificial Sequence
  synthetic [barcode part1]
aagaggccactaatac

SEQ ID NO: 22900 - DNA, 16 bp, Artificial Sequence
  synthetic [barcode part1]
agtgtcacgatcgatc

SEQ ID NO: 22901 - DNA, 16 bp, Artificial Sequence
  synthetic [barcode part1]
taacctggcctagtag

SEQ ID NO: 22902 - DNA, 16 bp, Artificial Sequence
  synthetic [barcode part1]
agatccactgttatcc

SEQ ID NO: 22903 - DNA, 16 bp, Artificial Sequence
  synthetic [barcode part1]
tgatagtcggtctggt

SEQ ID NO: 22904 - DNA, 16 bp, Artificial Sequence
  synthetic [barcode part1]
tagttctctccgatcc

SEQ ID NO: 22905 - DNA, 16 bp, Artificial Sequence
  synthetic [barcode part1]
tcagagtaataccgcc

SEQ ID NO: 22906 - DNA, 16 bp, Artificial Sequence
  synthetic [barcode part1]
tccttaagtcagtgtc

SEQ ID NO: 22907 - DNA, 16 bp, Artificial Sequence
  synthetic [barcode part1]
tgtattcttaccggac

SEQ ID NO: 22908 - DNA, 16 bp, Artificial Sequence
  synthetic [barcode part1]
agaggtactcggtggt

SEQ ID NO: 22909 - DNA, 16 bp, Artificial Sequence
  synthetic [barcode part1]
ccttaaggttctggag

SEQ ID NO: 22910 - DNA, 16 bp, Artificial Sequence
  synthetic [barcode part1]
tacgtgactcgtagac

SEQ ID NO: 22911 - DNA, 16 bp, Artificial Sequence
  synthetic [barcode part1]
tagtcacgtggttacg

SEQ ID NO: 22912 - DNA, 16 bp, Artificial Sequence
  synthetic [barcode part1]
gttcctgagtgacctc

SEQ ID NO: 22913 - DNA, 16 bp, Artificial Sequence
  synthetic [barcode part1]
ttgttggtggtggttg

SEQ ID NO: 22914 - DNA, 16 bp, Artificial Sequence
  synthetic [barcode part1]
ccaccacgtgagtctt

SEQ ID NO: 22915 - DNA, 16 bp, Artificial Sequence
  synthetic [barcode part1]
attcacctctaggact

SEQ ID NO: 22916 - DNA, 16 bp, Artificial Sequence
  synthetic [barcode part1]
ttgcagtcaaccagtg

SEQ ID NO: 22917 - DNA, 16 bp, Artificial Sequence
  synthetic [barcode part1]
gttgacagtaggacgc

SEQ ID NO: 22918 - DNA, 16 bp, Artificial Sequence
  synthetic [barcode part1]
gttgagtccgtgttcc

SEQ ID NO: 22919 - DNA, 16 bp, Artificial Sequence
  synthetic [barcode part1]
cactatctcgccactt

SEQ ID NO: 22920 - DNA, 16 bp, Artificial Sequence
  synthetic [barcode part1]
cacagtgttcaggact

SEQ ID NO: 22921 - DNA, 16 bp, Artificial Sequence
  synthetic [barcode part1]
tcgcgttacctaacgc

SEQ ID NO: 22922 - DNA, 16 bp, Artificial Sequence
  synthetic [barcode part1]
aagaggttctacgagt

SEQ ID NO: 22923 - DNA, 16 bp, Artificial Sequence
  synthetic [barcode part1]
ttccggtaatctgtac

SEQ ID NO: 22924 - DNA, 16 bp, Artificial Sequence
  synthetic [barcode part1]
gcaacttcgtcaagtg

SEQ ID NO: 22925 - DNA, 16 bp, Artificial Sequence
  synthetic [barcode part1]
agttgcagtgtcaacc

SEQ ID NO: 22926 - DNA, 16 bp, Artificial Sequence
  synthetic [barcode part1]
tcaaggtccgtaacac

SEQ ID NO: 22927 - DNA, 16 bp, Artificial Sequence
  synthetic [barcode part1]
cactgtctgaactcgc

SEQ ID NO: 22928 - DNA, 16 bp, Artificial Sequence
  synthetic [barcode part1]
tcttatcggcgtccag

SEQ ID NO: 22929 - DNA, 16 bp, Artificial Sequence
  synthetic [barcode part1]
gcgttaagatccacac

SEQ ID NO: 22930 - DNA, 16 bp, Artificial Sequence
  synthetic [barcode part1]
agtctacgttcacgag

SEQ ID NO: 22931 - DNA, 16 bp, Artificial Sequence
  synthetic [barcode part1]
cgtctgtaggccttac

SEQ ID NO: 22932 - DNA, 16 bp, Artificial Sequence
  synthetic [barcode part1]
tagtggtgccgaattc

SEQ ID NO: 22933 - DNA, 16 bp, Artificial Sequence
  synthetic [barcode part1]
gcggaccactatctct

SEQ ID NO: 22934 - DNA, 16 bp, Artificial Sequence
  synthetic [barcode part1]
agttgcacacacagtc

SEQ ID NO: 22935 - DNA, 16 bp, Artificial Sequence
  synthetic [barcode part1]
attgcgtgagaactag

SEQ ID NO: 22936 - DNA, 16 bp, Artificial Sequence
  synthetic [barcode part1]
tgcaacgcaaggttct

SEQ ID NO: 22937 - DNA, 16 bp, Artificial Sequence
  synthetic [barcode part1]
atctctgtcgttgagt

SEQ ID NO: 22938 - DNA, 16 bp, Artificial Sequence
  synthetic [barcode part1]
cagtcttgactgaggt

SEQ ID NO: 22939 - DNA, 16 bp, Artificial Sequence
  synthetic [barcode part1]
gttcagtccaacagtg

SEQ ID NO: 22940 - DNA, 16 bp, Artificial Sequence
  synthetic [barcode part1]
agattgccactctcgc

SEQ ID NO: 22941 - DNA, 16 bp, Artificial Sequence
  synthetic [barcode part1]
ccgaattcaactcgag

SEQ ID NO: 22942 - DNA, 16 bp, Artificial Sequence
  synthetic [barcode part1]
tactcacctgtagtgt

SEQ ID NO: 22943 - DNA, 16 bp, Artificial Sequence
  synthetic [barcode part1]
cctcacaatatcctcc

SEQ ID NO: 22944 - DNA, 16 bp, Artificial Sequence
  synthetic [barcode part1]
tacggagacacttctg

SEQ ID NO: 22945 - DNA, 16 bp, Artificial Sequence
  synthetic [barcode part1]
tagatcaaccggacct

SEQ ID NO: 22946 - DNA, 16 bp, Artificial Sequence
  synthetic [barcode part1]
gaaggataggtgttct

SEQ ID NO: 22947 - DNA, 16 bp, Artificial Sequence
  synthetic [barcode part1]
tctgattagagtcggc

SEQ ID NO: 22948 - DNA, 16 bp, Artificial Sequence
  synthetic [barcode part1]
cactcggtagtccttg

SEQ ID NO: 22949 - DNA, 16 bp, Artificial Sequence
  synthetic [barcode part1]
acagtggacggaatag

SEQ ID NO: 22950 - DNA, 16 bp, Artificial Sequence
  synthetic [barcode part1]
gacgagtgtagacaag

SEQ ID NO: 22951 - DNA, 16 bp, Artificial Sequence
  synthetic [barcode part1]
ttaccacgccttgtct

SEQ ID NO: 22952 - DNA, 16 bp, Artificial Sequence
  synthetic [barcode part1]
aacacgcgagagacct

SEQ ID NO: 22953 - DNA, 16 bp, Artificial Sequence
  synthetic [barcode part1]
ccactatagtgttcgt

SEQ ID NO: 22954 - DNA, 16 bp, Artificial Sequence
  synthetic [barcode part1]
tcgttagttaggccag

SEQ ID NO: 22955 - DNA, 16 bp, Artificial Sequence
  synthetic [barcode part1]
cgtaggtatcttacct

SEQ ID NO: 22956 - DNA, 16 bp, Artificial Sequence
  synthetic [barcode part1]
atagaaccgtcacctg

SEQ ID NO: 22957 - DNA, 16 bp, Artificial Sequence
  synthetic [barcode part1]
ttgtgcagtacaccag

SEQ ID NO: 22958 - DNA, 16 bp, Artificial Sequence
  synthetic [barcode part1]
atattgtcaccgcgag

SEQ ID NO: 22959 - DNA, 16 bp, Artificial Sequence
  synthetic [barcode part1]
acgaggttctatcgtg

SEQ ID NO: 22960 - DNA, 16 bp, Artificial Sequence
  synthetic [barcode part1]
actcttacagaccgcc

SEQ ID NO: 22961 - DNA, 16 bp, Artificial Sequence
  synthetic [barcode part1]
gacgaaggtgcgattc

SEQ ID NO: 22962 - DNA, 16 bp, Artificial Sequence
  synthetic [barcode part1]
tcttcggtaaccacgc

SEQ ID NO: 22963 - DNA, 16 bp, Artificial Sequence
  synthetic [barcode part1]
atctattaggcctcgt

SEQ ID NO: 22964 - DNA, 16 bp, Artificial Sequence
  synthetic [barcode part1]
tgccggttcaatctcg

SEQ ID NO: 22965 - DNA, 16 bp, Artificial Sequence
  synthetic [barcode part1]
gtagttaccgactctt

SEQ ID NO: 22966 - DNA, 16 bp, Artificial Sequence
  synthetic [barcode part1]
tgttcgccttatccac

SEQ ID NO: 22967 - DNA, 16 bp, Artificial Sequence
  synthetic [barcode part1]
agtaccttcgtcaccg

SEQ ID NO: 22968 - DNA, 16 bp, Artificial Sequence
  synthetic [barcode part1]
tgttggaccgtgttcc

SEQ ID NO: 22969 - DNA, 16 bp, Artificial Sequence
  synthetic [barcode part1]
tactaggtctagtggc

SEQ ID NO: 22970 - DNA, 16 bp, Artificial Sequence
  synthetic [barcode part1]
acctccagtaattcac

SEQ ID NO: 22971 - DNA, 16 bp, Artificial Sequence
  synthetic [barcode part1]
acctaagttcgagtgc

SEQ ID NO: 22972 - DNA, 16 bp, Artificial Sequence
  synthetic [barcode part1]
caccgtgtaactaacg

SEQ ID NO: 22973 - DNA, 16 bp, Artificial Sequence
  synthetic [barcode part1]
gtggtgtcgatcgatt

SEQ ID NO: 22974 - DNA, 16 bp, Artificial Sequence
  synthetic [barcode part1]
gcctcagacactatag

SEQ ID NO: 22975 - DNA, 16 bp, Artificial Sequence
  synthetic [barcode part1]
gagagacttcagtctc

SEQ ID NO: 22976 - DNA, 16 bp, Artificial Sequence
  synthetic [barcode part1]
gcaacgaggatatccg

SEQ ID NO: 22977 - DNA, 16 bp, Artificial Sequence
  synthetic [barcode part1]
aggacctgaatagact

SEQ ID NO: 22978 - DNA, 16 bp, Artificial Sequence
  synthetic [barcode part1]
cggttaagactagtcc

SEQ ID NO: 22979 - DNA, 16 bp, Artificial Sequence
  synthetic [barcode part1]
aaggccactggatacg

SEQ ID NO: 22980 - DNA, 16 bp, Artificial Sequence
  synthetic [barcode part1]
taactctgccaacgcc

SEQ ID NO: 22981 - DNA, 16 bp, Artificial Sequence
  synthetic [barcode part1]
actgacggtggttgtt

SEQ ID NO: 22982 - DNA, 16 bp, Artificial Sequence
  synthetic [barcode part1]
caacaaccgcgttctc

SEQ ID NO: 22983 - DNA, 16 bp, Artificial Sequence
  synthetic [barcode part1]
gaggcggaatacctac

SEQ ID NO: 22984 - DNA, 16 bp, Artificial Sequence
  synthetic [barcode part1]
gaggataggcacaagt

SEQ ID NO: 22985 - DNA, 16 bp, Artificial Sequence
  synthetic [barcode part1]
acttcacctacacagt

SEQ ID NO: 22986 - DNA, 16 bp, Artificial Sequence
  synthetic [barcode part1]
tgcaagtgacggagtc

SEQ ID NO: 22987 - DNA, 16 bp, Artificial Sequence
  synthetic [barcode part1]
cactagtctggaggag

SEQ ID NO: 22988 - DNA, 16 bp, Artificial Sequence
  synthetic [barcode part1]
atacgtcttcaactcg

SEQ ID NO: 22989 - DNA, 16 bp, Artificial Sequence
  synthetic [barcode part1]
gcgtagatattaggtg

SEQ ID NO: 22990 - DNA, 16 bp, Artificial Sequence
  synthetic [barcode part1]
acgccgacaataaggc

SEQ ID NO: 22991 - DNA, 16 bp, Artificial Sequence
  synthetic [barcode part1]
agacttcggtcagttg

SEQ ID NO: 22992 - DNA, 16 bp, Artificial Sequence
  synthetic [barcode part1]
ccgataggtctctatt

SEQ ID NO: 22993 - DNA, 16 bp, Artificial Sequence
  synthetic [barcode part1]
aatccttaaggtggcc

SEQ ID NO: 22994 - DNA, 16 bp, Artificial Sequence
  synthetic [barcode part1]
taacgcactaagtgcc

SEQ ID NO: 22995 - DNA, 16 bp, Artificial Sequence
  synthetic [barcode part1]
actctgtcggaaggtt

SEQ ID NO: 22996 - DNA, 16 bp, Artificial Sequence
  synthetic [barcode part1]
aatataaggcgcggag

SEQ ID NO: 22997 - DNA, 16 bp, Artificial Sequence
  synthetic [barcode part1]
cgcgcagatagttgtt

SEQ ID NO: 22998 - DNA, 16 bp, Artificial Sequence
  synthetic [barcode part1]
aagaggtgcctcttgt

SEQ ID NO: 22999 - DNA, 16 bp, Artificial Sequence
  synthetic [barcode part1]
gtctctaccgtgttct

SEQ ID NO: 23000 - DNA, 16 bp, Artificial Sequence
  synthetic [barcode part1]
atacggccaacgtact

SEQ ID NO: 23001 - DNA, 16 bp, Artificial Sequence
  synthetic [barcode part1]
acgcgatacacactgt

SEQ ID NO: 23002 - DNA, 16 bp, Artificial Sequence
  synthetic [barcode part1]
gtaggaacgtgtcctt

SEQ ID NO: 23003 - DNA, 16 bp, Artificial Sequence
  synthetic [barcode part1]
aggacactacgttctg

SEQ ID NO: 23004 - DNA, 16 bp, Artificial Sequence
  synthetic [barcode part1]
ttccaagattccggag

SEQ ID NO: 23005 - DNA, 16 bp, Artificial Sequence
  synthetic [barcode part1]
gacggataatatcgtg

SEQ ID NO: 23006 - DNA, 16 bp, Artificial Sequence
  synthetic [barcode part1]
gtagttcacaagaacg

SEQ ID NO: 23007 - DNA, 16 bp, Artificial Sequence
  synthetic [barcode part1]
gcgtaccgatatactg

SEQ ID NO: 23008 - DNA, 16 bp, Artificial Sequence
  synthetic [barcode part1]
cgtattgagttggaag

SEQ ID NO: 23009 - DNA, 16 bp, Artificial Sequence
  synthetic [barcode part1]
tggcacgtaactcctc

SEQ ID NO: 23010 - DNA, 16 bp, Artificial Sequence
  synthetic [barcode part1]
aagtaggccacctgtt

SEQ ID NO: 23011 - DNA, 16 bp, Artificial Sequence
  synthetic [barcode part1]
agtcggtccagaatct

SEQ ID NO: 23012 - DNA, 16 bp, Artificial Sequence
  synthetic [barcode part1]
ttcacgaagactcgtg

SEQ ID NO: 23013 - DNA, 16 bp, Artificial Sequence
  synthetic [barcode part1]
ccactggttgaatcag

SEQ ID NO: 23014 - DNA, 16 bp, Artificial Sequence
  synthetic [barcode part1]
tatagagtgcgtctcg

SEQ ID NO: 23015 - DNA, 16 bp, Artificial Sequence
  synthetic [barcode part1]
tagatcgtatagaggc

SEQ ID NO: 23016 - DNA, 16 bp, Artificial Sequence
  synthetic [barcode part1]
cggttccagagaatct

SEQ ID NO: 23017 - DNA, 16 bp, Artificial Sequence
  synthetic [barcode part1]
gattacgtgtgtggtc

SEQ ID NO: 23018 - DNA, 16 bp, Artificial Sequence
  synthetic [barcode part1]
cgtgtggtagagagtc

SEQ ID NO: 23019 - DNA, 16 bp, Artificial Sequence
  synthetic [barcode part1]
cgataggtaggtattg

SEQ ID NO: 23020 - DNA, 16 bp, Artificial Sequence
  synthetic [barcode part1]
aagaatccggtatacg

SEQ ID NO: 23021 - DNA, 16 bp, Artificial Sequence
  synthetic [barcode part1]
gaaccgtcagatcact

SEQ ID NO: 23022 - DNA, 16 bp, Artificial Sequence
  synthetic [barcode part1]
tgatcagtacgcacac

SEQ ID NO: 23023 - DNA, 16 bp, Artificial Sequence
  synthetic [barcode part1]
atatccttggcagttc

SEQ ID NO: 23024 - DNA, 16 bp, Artificial Sequence
  synthetic [barcode part1]
aacaagtgtcttggag

SEQ ID NO: 23025 - DNA, 16 bp, Artificial Sequence
  synthetic [barcode part1]
gtagtcgtcctgacct

SEQ ID NO: 23026 - DNA, 16 bp, Artificial Sequence
  synthetic [barcode part1]
actgaggtaatcacag

SEQ ID NO: 23027 - DNA, 16 bp, Artificial Sequence
  synthetic [barcode part1]
ttgccgcagtagagtt

SEQ ID NO: 23028 - DNA, 16 bp, Artificial Sequence
  synthetic [barcode part1]
ttacgttgtctggtac

SEQ ID NO: 23029 - DNA, 16 bp, Artificial Sequence
  synthetic [barcode part1]
cagtgcaacgtagtct

SEQ ID NO: 23030 - DNA, 16 bp, Artificial Sequence
  synthetic [barcode part1]
gtatcaacgacaaggt

SEQ ID NO: 23031 - DNA, 16 bp, Artificial Sequence
  synthetic [barcode part1]
cagatacaggacaatc

SEQ ID NO: 23032 - DNA, 16 bp, Artificial Sequence
  synthetic [barcode part1]
tcaacggtagaccact

SEQ ID NO: 23033 - DNA, 16 bp, Artificial Sequence
  synthetic [barcode part1]
tattgaatcgtgcctc

SEQ ID NO: 23034 - DNA, 16 bp, Artificial Sequence
  synthetic [barcode part1]
gacgtcctatcctacg

SEQ ID NO: 23035 - DNA, 16 bp, Artificial Sequence
  synthetic [barcode part1]
caacacgtggcgaagt

SEQ ID NO: 23036 - DNA, 16 bp, Artificial Sequence
  synthetic [barcode part1]
aatctcggcctatccg

SEQ ID NO: 23037 - DNA, 16 bp, Artificial Sequence
  synthetic [barcode part1]
gttcctcgtgttgacg

SEQ ID NO: 23038 - DNA, 16 bp, Artificial Sequence
  synthetic [barcode part1]
actaaccagtctcgag

SEQ ID NO: 23039 - DNA, 16 bp, Artificial Sequence
  synthetic [barcode part1]
ttaagagttgacgcag

SEQ ID NO: 23040 - DNA, 16 bp, Artificial Sequence
  synthetic [barcode part1]
tgtctcgttgtgaatc

SEQ ID NO: 23041 - DNA, 16 bp, Artificial Sequence
  synthetic [barcode part1]
tgattggtcgaagtcc

SEQ ID NO: 23042 - DNA, 16 bp, Artificial Sequence
  synthetic [barcode part1]
caagtacggttacacc

SEQ ID NO: 23043 - DNA, 16 bp, Artificial Sequence
  synthetic [barcode part1]
gagtgtgacacttctg

SEQ ID NO: 23044 - DNA, 16 bp, Artificial Sequence
  synthetic [barcode part1]
tcgaactgcgttcctg

SEQ ID NO: 23045 - DNA, 16 bp, Artificial Sequence
  synthetic [barcode part1]
ccttattggcagagtg

SEQ ID NO: 23046 - DNA, 16 bp, Artificial Sequence
  synthetic [barcode part1]
gtgacacggttgatct

SEQ ID NO: 23047 - DNA, 16 bp, Artificial Sequence
  synthetic [barcode part1]
aggtcgaacaccagtg

SEQ ID NO: 23048 - DNA, 16 bp, Artificial Sequence
  synthetic [barcode part1]
gtagtcacgtagttgc

SEQ ID NO: 23049 - DNA, 16 bp, Artificial Sequence
  synthetic [barcode part1]
tacctgtctgtccgtt

SEQ ID NO: 23050 - DNA, 16 bp, Artificial Sequence
  synthetic [barcode part1]
gtagaccggaacaatt

SEQ ID NO: 23051 - DNA, 16 bp, Artificial Sequence
  synthetic [barcode part1]
cacgataggaccttac

SEQ ID NO: 23052 - DNA, 16 bp, Artificial Sequence
  synthetic [barcode part1]
cactatcctgcgtggt

SEQ ID NO: 23053 - DNA, 16 bp, Artificial Sequence
  synthetic [barcode part1]
taatcgcacagttgcg

SEQ ID NO: 23054 - DNA, 16 bp, Artificial Sequence
  synthetic [barcode part1]
gtcggtcgattgattg

SEQ ID NO: 23055 - DNA, 16 bp, Artificial Sequence
  synthetic [barcode part1]
gtcggtggtaaggtac

SEQ ID NO: 23056 - DNA, 16 bp, Artificial Sequence
  synthetic [barcode part1]
cgaacacgactacact

SEQ ID NO: 23057 - DNA, 16 bp, Artificial Sequence
  synthetic [barcode part1]
attcgagactctactc

SEQ ID NO: 23058 - DNA, 16 bp, Artificial Sequence
  synthetic [barcode part1]
ttaacgaggcggttct

SEQ ID NO: 23059 - DNA, 16 bp, Artificial Sequence
  synthetic [barcode part1]
tagtcgtcgccaatag

SEQ ID NO: 23060 - DNA, 16 bp, Artificial Sequence
  synthetic [barcode part1]
ccttattcttgccgtg

SEQ ID NO: 23061 - DNA, 16 bp, Artificial Sequence
  synthetic [barcode part1]
agacaattcggtgtag

SEQ ID NO: 23062 - DNA, 16 bp, Artificial Sequence
  synthetic [barcode part1]
ttacgtgagagagttg

SEQ ID NO: 23063 - DNA, 16 bp, Artificial Sequence
  synthetic [barcode part1]
gtgtatcacgactgtg

SEQ ID NO: 23064 - DNA, 16 bp, Artificial Sequence
  synthetic [barcode part1]
tgcgaatacggtggac

SEQ ID NO: 23065 - DNA, 16 bp, Artificial Sequence
  synthetic [barcode part1]
ttcggagtgaccaact

SEQ ID NO: 23066 - DNA, 16 bp, Artificial Sequence
  synthetic [barcode part1]
caacgttcttgaggtg

SEQ ID NO: 23067 - DNA, 16 bp, Artificial Sequence
  synthetic [barcode part1]
aacagtctcgacagtc

SEQ ID NO: 23068 - DNA, 16 bp, Artificial Sequence
  synthetic [barcode part1]
atctggaaggtctacc

SEQ ID NO: 23069 - DNA, 16 bp, Artificial Sequence
  synthetic [barcode part1]
ccgtgaacactagtgt

SEQ ID NO: 23070 - DNA, 16 bp, Artificial Sequence
  synthetic [barcode part1]
cgatatactccactgt

SEQ ID NO: 23071 - DNA, 16 bp, Artificial Sequence
  synthetic [barcode part1]
cggacaactacaatag

SEQ ID NO: 23072 - DNA, 16 bp, Artificial Sequence
  synthetic [barcode part1]
aaggtggatcctatcc

SEQ ID NO: 23073 - DNA, 16 bp, Artificial Sequence
  synthetic [barcode part1]
agaatacggtcgccag

SEQ ID NO: 23074 - DNA, 16 bp, Artificial Sequence
  synthetic [barcode part1]
agatccgtgcctcact

SEQ ID NO: 23075 - DNA, 16 bp, Artificial Sequence
  synthetic [barcode part1]
tgagaggcgtacgatc

SEQ ID NO: 23076 - DNA, 16 bp, Artificial Sequence
  synthetic [barcode part1]
taccagttcttgatcg

SEQ ID NO: 23077 - DNA, 16 bp, Artificial Sequence
  synthetic [barcode part1]
gaagattggtcgagag

SEQ ID NO: 23078 - DNA, 16 bp, Artificial Sequence
  synthetic [barcode part1]
tccgttcctacttacg

SEQ ID NO: 23079 - DNA, 16 bp, Artificial Sequence
  synthetic [barcode part1]
actgccgttaagtcag

SEQ ID NO: 23080 - DNA, 16 bp, Artificial Sequence
  synthetic [barcode part1]
actacaaggacggatt

SEQ ID NO: 23081 - DNA, 16 bp, Artificial Sequence
  synthetic [barcode part1]
agtgcacggaattagt

SEQ ID NO: 23082 - DNA, 16 bp, Artificial Sequence
  synthetic [barcode part1]
tacttactccgttcgc

SEQ ID NO: 23083 - DNA, 16 bp, Artificial Sequence
  synthetic [barcode part1]
gtactaatcggcgtgt

SEQ ID NO: 23084 - DNA, 16 bp, Artificial Sequence
  synthetic [barcode part1]
ccgcgtagactaagag

SEQ ID NO: 23085 - DNA, 16 bp, Artificial Sequence
  synthetic [barcode part1]
aaccagtggttgactc

SEQ ID NO: 23086 - DNA, 16 bp, Artificial Sequence
  synthetic [barcode part1]
ccttcgtactcggtag

SEQ ID NO: 23087 - DNA, 16 bp, Artificial Sequence
  synthetic [barcode part1]
gatcgattgtgtgcac

SEQ ID NO: 23088 - DNA, 16 bp, Artificial Sequence
  synthetic [barcode part1]
caattctatcgcacac

SEQ ID NO: 23089 - DNA, 16 bp, Artificial Sequence
  synthetic [barcode part1]
taacgcagattgcgtc

SEQ ID NO: 23090 - DNA, 16 bp, Artificial Sequence
  synthetic [barcode part1]
acactacgttcgtccg

SEQ ID NO: 23091 - DNA, 16 bp, Artificial Sequence
  synthetic [barcode part1]
aacctaggtacgaggc

SEQ ID NO: 23092 - DNA, 16 bp, Artificial Sequence
  synthetic [barcode part1]
ttataaccgtggtgcg

SEQ ID NO: 23093 - DNA, 16 bp, Artificial Sequence
  synthetic [barcode part1]
gagatctagactctgc

SEQ ID NO: 23094 - DNA, 16 bp, Artificial Sequence
  synthetic [barcode part1]
ttccgtcgcaagttcg

SEQ ID NO: 23095 - DNA, 16 bp, Artificial Sequence
  synthetic [barcode part1]
gcaacgagaacgttcg

SEQ ID NO: 23096 - DNA, 16 bp, Artificial Sequence
  synthetic [barcode part1]
tgcagttatcaccttg

SEQ ID NO: 23097 - DNA, 16 bp, Artificial Sequence
  synthetic [barcode part1]
gccggtggtaattgtt

SEQ ID NO: 23098 - DNA, 16 bp, Artificial Sequence
  synthetic [barcode part1]
acgttcacaagtaccg

SEQ ID NO: 23099 - DNA, 16 bp, Artificial Sequence
  synthetic [barcode part1]
cgtcgttacctgagtc

SEQ ID NO: 23100 - DNA, 16 bp, Artificial Sequence
  synthetic [barcode part1]
gacactgtcgagatct

SEQ ID NO: 23101 - DNA, 16 bp, Artificial Sequence
  synthetic [barcode part1]
ccaagatcgagtggac

SEQ ID NO: 23102 - DNA, 16 bp, Artificial Sequence
  synthetic [barcode part1]
ataggcgtggagtctg

SEQ ID NO: 23103 - DNA, 16 bp, Artificial Sequence
  synthetic [barcode part1]
cgaactgaccaagtct

SEQ ID NO: 23104 - DNA, 16 bp, Artificial Sequence
  synthetic [barcode part1]
gaatcactgaaggtac

SEQ ID NO: 23105 - DNA, 16 bp, Artificial Sequence
  synthetic [barcode part1]
cactagtggtcttccg

SEQ ID NO: 23106 - DNA, 16 bp, Artificial Sequence
  synthetic [barcode part1]
agatctgcggacttac

SEQ ID NO: 23107 - DNA, 16 bp, Artificial Sequence
  synthetic [barcode part1]
accgaacgcaacttgt

SEQ ID NO: 23108 - DNA, 16 bp, Artificial Sequence
  synthetic [barcode part1]
agttcagtgtgcctcc

SEQ ID NO: 23109 - DNA, 16 bp, Artificial Sequence
  synthetic [barcode part1]
gaagtctggcaggtac

SEQ ID NO: 23110 - DNA, 16 bp, Artificial Sequence
  synthetic [barcode part1]
gcacaagagtgacctg

SEQ ID NO: 23111 - DNA, 16 bp, Artificial Sequence
  synthetic [barcode part1]
aacaagttccaagacg

SEQ ID NO: 23112 - DNA, 16 bp, Artificial Sequence
  synthetic [barcode part1]
cgataacgcgtctctc

SEQ ID NO: 23113 - DNA, 16 bp, Artificial Sequence
  synthetic [barcode part1]
attaatcgaccggtcg

SEQ ID NO: 23114 - DNA, 16 bp, Artificial Sequence
  synthetic [barcode part1]
agacctgtaggaagtt

SEQ ID NO: 23115 - DNA, 16 bp, Artificial Sequence
  synthetic [barcode part1]
gtggtacaccaactgt

SEQ ID NO: 23116 - DNA, 16 bp, Artificial Sequence
  synthetic [barcode part1]
cggttctgtactaatc

SEQ ID NO: 23117 - DNA, 16 bp, Artificial Sequence
  synthetic [barcode part1]
gtgcctcaattactgt

SEQ ID NO: 23118 - DNA, 16 bp, Artificial Sequence
  synthetic [barcode part1]
cagtatacgtaccggt

SEQ ID NO: 23119 - DNA, 16 bp, Artificial Sequence
  synthetic [barcode part1]
cggaatctctcaaggt

SEQ ID NO: 23120 - DNA, 16 bp, Artificial Sequence
  synthetic [barcode part1]
attcggacttgtcgcc

SEQ ID NO: 23121 - DNA, 16 bp, Artificial Sequence
  synthetic [barcode part1]
tcaacctgacgcgtct

SEQ ID NO: 23122 - DNA, 16 bp, Artificial Sequence
  synthetic [barcode part1]
tccgattagaggacct

SEQ ID NO: 23123 - DNA, 16 bp, Artificial Sequence
  synthetic [barcode part1]
atacctgcctgagtag

SEQ ID NO: 23124 - DNA, 16 bp, Artificial Sequence
  synthetic [barcode part1]
accagtgtactggtgt

SEQ ID NO: 23125 - DNA, 16 bp, Artificial Sequence
  synthetic [barcode part1]
aggatcctcacagtgt

SEQ ID NO: 23126 - DNA, 16 bp, Artificial Sequence
  synthetic [barcode part1]
accgtcgaatcactag

SEQ ID NO: 23127 - DNA, 16 bp, Artificial Sequence
  synthetic [barcode part1]
attagtgaacgcgcct

SEQ ID NO: 23128 - DNA, 16 bp, Artificial Sequence
  synthetic [barcode part1]
tcgcacttcaccgaac

SEQ ID NO: 23129 - DNA, 16 bp, Artificial Sequence
  synthetic [barcode part1]
gtcttgttatcgacgt

SEQ ID NO: 23130 - DNA, 16 bp, Artificial Sequence
  synthetic [barcode part1]
cgaagaagtcaacact

SEQ ID NO: 23131 - DNA, 16 bp, Artificial Sequence
  synthetic [barcode part1]
cggtcttcagtacacc

SEQ ID NO: 23132 - DNA, 16 bp, Artificial Sequence
  synthetic [barcode part1]
ccgagtcagaacacag

SEQ ID NO: 23133 - DNA, 16 bp, Artificial Sequence
  synthetic [barcode part1]
ataccgtctgcctacg

SEQ ID NO: 23134 - DNA, 16 bp, Artificial Sequence
  synthetic [barcode part1]
acaccgacgactcctt

SEQ ID NO: 23135 - DNA, 16 bp, Artificial Sequence
  synthetic [barcode part1]
gaagtggtcgtggatc

SEQ ID NO: 23136 - DNA, 16 bp, Artificial Sequence
  synthetic [barcode part1]
aattgcgccgatcctc

SEQ ID NO: 23137 - DNA, 16 bp, Artificial Sequence
  synthetic [barcode part1]
tggtcaggttgtgact

SEQ ID NO: 23138 - DNA, 16 bp, Artificial Sequence
  synthetic [barcode part1]
ttgcgagttatcacct

SEQ ID NO: 23139 - DNA, 16 bp, Artificial Sequence
  synthetic [barcode part1]
attgaaggaaggaccg

SEQ ID NO: 23140 - DNA, 16 bp, Artificial Sequence
  synthetic [barcode part1]
atcgaacgtgatctgc

SEQ ID NO: 23141 - DNA, 16 bp, Artificial Sequence
  synthetic [barcode part1]
taagttgcggcgatct

SEQ ID NO: 23142 - DNA, 16 bp, Artificial Sequence
  synthetic [barcode part1]
acgtgcggattctaac

SEQ ID NO: 23143 - DNA, 16 bp, Artificial Sequence
  synthetic [barcode part1]
tcactgtctcaagtgt

SEQ ID NO: 23144 - DNA, 16 bp, Artificial Sequence
  synthetic [barcode part1]
gtgacttatctggcag

SEQ ID NO: 23145 - DNA, 16 bp, Artificial Sequence
  synthetic [barcode part1]
gtcgcactaacaggag

SEQ ID NO: 23146 - DNA, 16 bp, Artificial Sequence
  synthetic [barcode part1]
actcaagaggtctgtc

SEQ ID NO: 23147 - DNA, 16 bp, Artificial Sequence
  synthetic [barcode part1]
caattatcgttctgcg

SEQ ID NO: 23148 - DNA, 16 bp, Artificial Sequence
  synthetic [barcode part1]
ttctagttggcggaac

SEQ ID NO: 23149 - DNA, 16 bp, Artificial Sequence
  synthetic [barcode part1]
gaggacgataggaact

SEQ ID NO: 23150 - DNA, 16 bp, Artificial Sequence
  synthetic [barcode part1]
tatactctaagtcgcc

SEQ ID NO: 23151 - DNA, 16 bp, Artificial Sequence
  synthetic [barcode part1]
tactccagttcacagt

SEQ ID NO: 23152 - DNA, 16 bp, Artificial Sequence
  synthetic [barcode part1]
cagtgaccgtaggagt

SEQ ID NO: 23153 - DNA, 16 bp, Artificial Sequence
  synthetic [barcode part1]
tcgttgcgacgtctac

SEQ ID NO: 23154 - DNA, 16 bp, Artificial Sequence
  synthetic [barcode part1]
tggtgcactgaacact

SEQ ID NO: 23155 - DNA, 16 bp, Artificial Sequence
  synthetic [barcode part1]
acgccgaactacttcc

SEQ ID NO: 23156 - DNA, 16 bp, Artificial Sequence
  synthetic [barcode part1]
caggcgtattgtcctc

SEQ ID NO: 23157 - DNA, 16 bp, Artificial Sequence
  synthetic [barcode part1]
cgcacctactcttact

SEQ ID NO: 23158 - DNA, 16 bp, Artificial Sequence
  synthetic [barcode part1]
tgatccaacctgacag

SEQ ID NO: 23159 - DNA, 16 bp, Artificial Sequence
  synthetic [barcode part1]
ttcgacctacacgacc

SEQ ID NO: 23160 - DNA, 16 bp, Artificial Sequence
  synthetic [barcode part1]
ttacgaggacgtactc

SEQ ID NO: 23161 - DNA, 16 bp, Artificial Sequence
  synthetic [barcode part1]
ttctcaggatcggagt

SEQ ID NO: 23162 - DNA, 16 bp, Artificial Sequence
  synthetic [barcode part1]
actctgactccagaag

SEQ ID NO: 23163 - DNA, 16 bp, Artificial Sequence
  synthetic [barcode part1]
ttggcaggtctccact

SEQ ID NO: 23164 - DNA, 16 bp, Artificial Sequence
  synthetic [barcode part1]
cctactgtggttcttc

SEQ ID NO: 23165 - DNA, 16 bp, Artificial Sequence
  synthetic [barcode part1]
gcggaatacaagtccg

SEQ ID NO: 23166 - DNA, 16 bp, Artificial Sequence
  synthetic [barcode part1]
cctgtattcggtagtt

SEQ ID NO: 23167 - DNA, 16 bp, Artificial Sequence
  synthetic [barcode part1]
attaccttccagacac

SEQ ID NO: 23168 - DNA, 16 bp, Artificial Sequence
  synthetic [barcode part1]
ccggtgatctaacaac

SEQ ID NO: 23169 - DNA, 16 bp, Artificial Sequence
  synthetic [barcode part1]
tcaactctctgtgagt

SEQ ID NO: 23170 - DNA, 16 bp, Artificial Sequence
  synthetic [barcode part1]
gttacttaggtgacgc

SEQ ID NO: 23171 - DNA, 16 bp, Artificial Sequence
  synthetic [barcode part1]
cctcttgcaggtctag

SEQ ID NO: 23172 - DNA, 16 bp, Artificial Sequence
  synthetic [barcode part1]
ttctaacacgcaatcc

SEQ ID NO: 23173 - DNA, 16 bp, Artificial Sequence
  synthetic [barcode part1]
gtgaatctaacaggac

SEQ ID NO: 23174 - DNA, 16 bp, Artificial Sequence
  synthetic [barcode part1]
tctgcggtatcgtctg

SEQ ID NO: 23175 - DNA, 16 bp, Artificial Sequence
  synthetic [barcode part1]
tgaatccgataaggtg

SEQ ID NO: 23176 - DNA, 16 bp, Artificial Sequence
  synthetic [barcode part1]
aggcactacggattct

SEQ ID NO: 23177 - DNA, 16 bp, Artificial Sequence
  synthetic [barcode part1]
gtgatcaggaagattc

SEQ ID NO: 23178 - DNA, 16 bp, Artificial Sequence
  synthetic [barcode part1]
ttgaccagaggaagag

SEQ ID NO: 23179 - DNA, 16 bp, Artificial Sequence
  synthetic [barcode part1]
actccgcgataacagt

SEQ ID NO: 23180 - DNA, 16 bp, Artificial Sequence
  synthetic [barcode part1]
tgaattacgcgttctc

SEQ ID NO: 23181 - DNA, 16 bp, Artificial Sequence
  synthetic [barcode part1]
tcggtgcgattcttcg

SEQ ID NO: 23182 - DNA, 16 bp, Artificial Sequence
  synthetic [barcode part1]
ccacaccgacaactct

SEQ ID NO: 23183 - DNA, 16 bp, Artificial Sequence
  synthetic [barcode part1]
tctgatcgttgcgcgt

SEQ ID NO: 23184 - DNA, 16 bp, Artificial Sequence
  synthetic [barcode part1]
gttgttggaggacgtg

SEQ ID NO: 23185 - DNA, 16 bp, Artificial Sequence
  synthetic [barcode part1]
agtccgacttcgcgtt

SEQ ID NO: 23186 - DNA, 16 bp, Artificial Sequence
  synthetic [barcode part1]
acagtgtagtcctgac

SEQ ID NO: 23187 - DNA, 16 bp, Artificial Sequence
  synthetic [barcode part1]
ccacaatccttccttg

SEQ ID NO: 23188 - DNA, 16 bp, Artificial Sequence
  synthetic [barcode part1]
ttcgccaccagatacc

SEQ ID NO: 23189 - DNA, 16 bp, Artificial Sequence
  synthetic [barcode part1]
agagatataccgagtc

SEQ ID NO: 23190 - DNA, 16 bp, Artificial Sequence
  synthetic [barcode part1]
tgcgttcttattggac

SEQ ID NO: 23191 - DNA, 16 bp, Artificial Sequence
  synthetic [barcode part1]
ttaaggccggaattcc

SEQ ID NO: 23192 - DNA, 16 bp, Artificial Sequence
  synthetic [barcode part1]
aggcgtctatcactcc

SEQ ID NO: 23193 - DNA, 16 bp, Artificial Sequence
  synthetic [barcode part1]
acacgcgtaataccac

SEQ ID NO: 23194 - DNA, 16 bp, Artificial Sequence
  synthetic [barcode part1]
gcagtcaagtcctcct

SEQ ID NO: 23195 - DNA, 16 bp, Artificial Sequence
  synthetic [barcode part1]
gttcaccgacaagtac

SEQ ID NO: 23196 - DNA, 16 bp, Artificial Sequence
  synthetic [barcode part1]
cgtcacggtatatacg

SEQ ID NO: 23197 - DNA, 16 bp, Artificial Sequence
  synthetic [barcode part1]
ttacactactcagtgc

SEQ ID NO: 23198 - DNA, 16 bp, Artificial Sequence
  synthetic [barcode part1]
ccacttggatactatc

SEQ ID NO: 23199 - DNA, 16 bp, Artificial Sequence
  synthetic [barcode part1]
tcgagatcctatctac

SEQ ID NO: 23200 - DNA, 16 bp, Artificial Sequence
  synthetic [barcode part1]
gtatcaggtgttcgac

SEQ ID NO: 23201 - DNA, 16 bp, Artificial Sequence
  synthetic [barcode part1]
gcactatagtggatag

SEQ ID NO: 23202 - DNA, 16 bp, Artificial Sequence
  synthetic [barcode part1]
aacaagagtacagtcc

SEQ ID NO: 23203 - DNA, 16 bp, Artificial Sequence
  synthetic [barcode part1]
agacgaggtctcgaac

SEQ ID NO: 23204 - DNA, 16 bp, Artificial Sequence
  synthetic [barcode part1]
agaccgtagtgacctt

SEQ ID NO: 23205 - DNA, 16 bp, Artificial Sequence
  synthetic [barcode part1]
acaacactcagagtcc

SEQ ID NO: 23206 - DNA, 16 bp, Artificial Sequence
  synthetic [barcode part1]
tgccaggagatacgac

SEQ ID NO: 23207 - DNA, 16 bp, Artificial Sequence
  synthetic [barcode part1]
gttccgccactaacgt

SEQ ID NO: 23208 - DNA, 16 bp, Artificial Sequence
  synthetic [barcode part1]
gtctagtgacctaacg

SEQ ID NO: 23209 - DNA, 16 bp, Artificial Sequence
  synthetic [barcode part1]
caagtacggttgtgtc

SEQ ID NO: 23210 - DNA, 16 bp, Artificial Sequence
  synthetic [barcode part1]
cagacttcttatcacg

SEQ ID NO: 23211 - DNA, 16 bp, Artificial Sequence
  synthetic [barcode part1]
attactcggacagtgc

SEQ ID NO: 23212 - DNA, 16 bp, Artificial Sequence
  synthetic [barcode part1]
aaccagtaaccgactc

SEQ ID NO: 23213 - DNA, 16 bp, Artificial Sequence
  synthetic [barcode part1]
atactgaggagtggtt

SEQ ID NO: 23214 - DNA, 16 bp, Artificial Sequence
  synthetic [barcode part1]
tgtaggtacgagttcc

SEQ ID NO: 23215 - DNA, 16 bp, Artificial Sequence
  synthetic [barcode part1]
gtctccaactcggtac

SEQ ID NO: 23216 - DNA, 16 bp, Artificial Sequence
  synthetic [barcode part1]
tcgttgaccagtaacg

SEQ ID NO: 23217 - DNA, 16 bp, Artificial Sequence
  synthetic [barcode part1]
aacaaccagaagtacc

SEQ ID NO: 23218 - DNA, 16 bp, Artificial Sequence
  synthetic [barcode part1]
cggagataacaattcg

SEQ ID NO: 23219 - DNA, 16 bp, Artificial Sequence
  synthetic [barcode part1]
cagatacaaggcgacc

SEQ ID NO: 23220 - DNA, 16 bp, Artificial Sequence
  synthetic [barcode part1]
ccaaggattaggtgcg

SEQ ID NO: 23221 - DNA, 16 bp, Artificial Sequence
  synthetic [barcode part1]
acgacgtgactagtct

SEQ ID NO: 23222 - DNA, 16 bp, Artificial Sequence
  synthetic [barcode part1]
tgtcgatctcctcgag

SEQ ID NO: 23223 - DNA, 16 bp, Artificial Sequence
  synthetic [barcode part1]
actggcgacagagtac

SEQ ID NO: 23224 - DNA, 16 bp, Artificial Sequence
  synthetic [barcode part1]
ataccaaggaggccgt

SEQ ID NO: 23225 - DNA, 16 bp, Artificial Sequence
  synthetic [barcode part1]
tctaacggtccttgcg

SEQ ID NO: 23226 - DNA, 16 bp, Artificial Sequence
  synthetic [barcode part1]
cggacgtaagacaacc

SEQ ID NO: 23227 - DNA, 16 bp, Artificial Sequence
  synthetic [barcode part1]
tcctgcaaccagatcc

SEQ ID NO: 23228 - DNA, 16 bp, Artificial Sequence
  synthetic [barcode part1]
tgacactgataggtag

SEQ ID NO: 23229 - DNA, 16 bp, Artificial Sequence
  synthetic [barcode part1]
tgcctgtacaatatcc

SEQ ID NO: 23230 - DNA, 16 bp, Artificial Sequence
  synthetic [barcode part1]
ttggatatcgttccgt

SEQ ID NO: 23231 - DNA, 16 bp, Artificial Sequence
  synthetic [barcode part1]
gcagtgagtagagtag

SEQ ID NO: 23232 - DNA, 16 bp, Artificial Sequence
  synthetic [barcode part1]
agtcctacctagagtg

SEQ ID NO: 23233 - DNA, 16 bp, Artificial Sequence
  synthetic [barcode part1]
tgtcaggagtataggt

SEQ ID NO: 23234 - DNA, 16 bp, Artificial Sequence
  synthetic [barcode part1]
acaacacgtgtacgtc

SEQ ID NO: 23235 - DNA, 16 bp, Artificial Sequence
  synthetic [barcode part1]
tctgtgtggcctggtt

SEQ ID NO: 23236 - DNA, 16 bp, Artificial Sequence
  synthetic [barcode part1]
tacttgtcaccacaac

SEQ ID NO: 23237 - DNA, 16 bp, Artificial Sequence
  synthetic [barcode part1]
aagttcgaacaacgac

SEQ ID NO: 23238 - DNA, 16 bp, Artificial Sequence
  synthetic [barcode part1]
agtgtgtgacttcttc

SEQ ID NO: 23239 - DNA, 16 bp, Artificial Sequence
  synthetic [barcode part1]
tattccgtcgcagatt

SEQ ID NO: 23240 - DNA, 16 bp, Artificial Sequence
  synthetic [barcode part1]
tagtaatctccacgtc

SEQ ID NO: 23241 - DNA, 16 bp, Artificial Sequence
  synthetic [barcode part1]
tccagtctgacacacc

SEQ ID NO: 23242 - DNA, 16 bp, Artificial Sequence
  synthetic [barcode part1]
cctactccaggattcg

SEQ ID NO: 23243 - DNA, 16 bp, Artificial Sequence
  synthetic [barcode part1]
gtcgtcggttaagttg

SEQ ID NO: 23244 - DNA, 16 bp, Artificial Sequence
  synthetic [barcode part1]
agacaggtgaacagac

SEQ ID NO: 23245 - DNA, 16 bp, Artificial Sequence
  synthetic [barcode part1]
cggtattacaacaccg

SEQ ID NO: 23246 - DNA, 16 bp, Artificial Sequence
  synthetic [barcode part1]
ttgccaccaagtgtcc

SEQ ID NO: 23247 - DNA, 16 bp, Artificial Sequence
  synthetic [barcode part1]
tcgttcgtaaggcctc

SEQ ID NO: 23248 - DNA, 16 bp, Artificial Sequence
  synthetic [barcode part1]
gtcggattctacgcct

SEQ ID NO: 23249 - DNA, 16 bp, Artificial Sequence
  synthetic [barcode part1]
ttgtactggtaactcc

SEQ ID NO: 23250 - DNA, 16 bp, Artificial Sequence
  synthetic [barcode part1]
ttaccagaggatacag

SEQ ID NO: 23251 - DNA, 16 bp, Artificial Sequence
  synthetic [barcode part1]
gagaacgattcgacgc

SEQ ID NO: 23252 - DNA, 16 bp, Artificial Sequence
  synthetic [barcode part1]
ccttcggtagtcacgt

SEQ ID NO: 23253 - DNA, 16 bp, Artificial Sequence
  synthetic [barcode part1]
ttggttgaccaaccag

SEQ ID NO: 23254 - DNA, 16 bp, Artificial Sequence
  synthetic [barcode part1]
tggactactggtaacc

SEQ ID NO: 23255 - DNA, 16 bp, Artificial Sequence
  synthetic [barcode part1]
gtatagtgtgccgact

SEQ ID NO: 23256 - DNA, 16 bp, Artificial Sequence
  synthetic [barcode part1]
agtcaggtaagaggtg

SEQ ID NO: 23257 - DNA, 16 bp, Artificial Sequence
  synthetic [barcode part1]
cgaacacgtgtgactt

SEQ ID NO: 23258 - DNA, 16 bp, Artificial Sequence
  synthetic [barcode part1]
gataccggtatcacgt

SEQ ID NO: 23259 - DNA, 16 bp, Artificial Sequence
  synthetic [barcode part1]
gtcggtaccgttgtct

SEQ ID NO: 23260 - DNA, 16 bp, Artificial Sequence
  synthetic [barcode part1]
cggtggttacgagaac

SEQ ID NO: 23261 - DNA, 16 bp, Artificial Sequence
  synthetic [barcode part1]
tctaatcggaatcggc

SEQ ID NO: 23262 - DNA, 16 bp, Artificial Sequence
  synthetic [barcode part1]
gacggtccaatctaac

SEQ ID NO: 23263 - DNA, 16 bp, Artificial Sequence
  synthetic [barcode part1]
ttcggttcaacacact

SEQ ID NO: 23264 - DNA, 16 bp, Artificial Sequence
  synthetic [barcode part1]
cctaactaaggtcggt

SEQ ID NO: 23265 - DNA, 16 bp, Artificial Sequence
  synthetic [barcode part1]
acctaagtaaggtgac

SEQ ID NO: 23266 - DNA, 16 bp, Artificial Sequence
  synthetic [barcode part1]
gttaagacctcgatcg

SEQ ID NO: 23267 - DNA, 16 bp, Artificial Sequence
  synthetic [barcode part1]
agtccgcctaccttag

SEQ ID NO: 23268 - DNA, 16 bp, Artificial Sequence
  synthetic [barcode part1]
cctgttcgtggataag

SEQ ID NO: 23269 - DNA, 16 bp, Artificial Sequence
  synthetic [barcode part1]
cacctgtagattccgc

SEQ ID NO: 23270 - DNA, 16 bp, Artificial Sequence
  synthetic [barcode part1]
tgtatcgtcgactccg

SEQ ID NO: 23271 - DNA, 16 bp, Artificial Sequence
  synthetic [barcode part1]
gacgttgcagtcaact

SEQ ID NO: 23272 - DNA, 16 bp, Artificial Sequence
  synthetic [barcode part1]
gagttgtgtgagaatc

SEQ ID NO: 23273 - DNA, 16 bp, Artificial Sequence
  synthetic [barcode part1]
gacgaaggtatccgac

SEQ ID NO: 23274 - DNA, 16 bp, Artificial Sequence
  synthetic [barcode part1]
tgttggttgactgcag

SEQ ID NO: 23275 - DNA, 16 bp, Artificial Sequence
  synthetic [barcode part1]
gtaagatcggacgtcg

SEQ ID NO: 23276 - DNA, 16 bp, Artificial Sequence
  synthetic [barcode part1]
gcaaccgtctctcaac

SEQ ID NO: 23277 - DNA, 16 bp, Artificial Sequence
  synthetic [barcode part1]
tgagatctcaggatcc

SEQ ID NO: 23278 - DNA, 16 bp, Artificial Sequence
  synthetic [barcode part1]
ataattcgtccttgcg

SEQ ID NO: 23279 - DNA, 16 bp, Artificial Sequence
  synthetic [barcode part1]
cgaattactccacgtt

SEQ ID NO: 23280 - DNA, 16 bp, Artificial Sequence
  synthetic [barcode part1]
agagaatcttgcagac

SEQ ID NO: 23281 - DNA, 16 bp, Artificial Sequence
  synthetic [barcode part1]
gacgagaaggacaatc

SEQ ID NO: 23282 - DNA, 16 bp, Artificial Sequence
  synthetic [barcode part1]
ccttaagaccttggag

SEQ ID NO: 23283 - DNA, 16 bp, Artificial Sequence
  synthetic [barcode part1]
tacacacacacgtacg

SEQ ID NO: 23284 - DNA, 16 bp, Artificial Sequence
  synthetic [barcode part1]
gccggtgtgtcttgtt

SEQ ID NO: 23285 - DNA, 16 bp, Artificial Sequence
  synthetic [barcode part1]
agtacgtgtacgttgc

SEQ ID NO: 23286 - DNA, 16 bp, Artificial Sequence
  synthetic [barcode part1]
aacaacagtggtggag

SEQ ID NO: 23287 - DNA, 16 bp, Artificial Sequence
  synthetic [barcode part1]
cactctcctcttgtag

SEQ ID NO: 23288 - DNA, 16 bp, Artificial Sequence
  synthetic [barcode part1]
acaatagaggcacttg

SEQ ID NO: 23289 - DNA, 16 bp, Artificial Sequence
  synthetic [barcode part1]
cgcgaggattaggttg

SEQ ID NO: 23290 - DNA, 16 bp, Artificial Sequence
  synthetic [barcode part1]
ccttaacttgacgtgt

SEQ ID NO: 23291 - DNA, 16 bp, Artificial Sequence
  synthetic [barcode part1]
tcagttccgttccgtt

SEQ ID NO: 23292 - DNA, 16 bp, Artificial Sequence
  synthetic [barcode part1]
gagtactacttgtggc

SEQ ID NO: 23293 - DNA, 16 bp, Artificial Sequence
  synthetic [barcode part1]
acgaagataatccggt

SEQ ID NO: 23294 - DNA, 16 bp, Artificial Sequence
  synthetic [barcode part1]
tgtataacaccggcac

SEQ ID NO: 23295 - DNA, 16 bp, Artificial Sequence
  synthetic [barcode part1]
tagtcaagtgccacgt

SEQ ID NO: 23296 - DNA, 16 bp, Artificial Sequence
  synthetic [barcode part1]
tgaagtcgtgtgtacc

SEQ ID NO: 23297 - DNA, 16 bp, Artificial Sequence
  synthetic [barcode part1]
acgcgatcacacaact

SEQ ID NO: 23298 - DNA, 16 bp, Artificial Sequence
  synthetic [barcode part1]
cgcggatataacggac

SEQ ID NO: 23299 - DNA, 16 bp, Artificial Sequence
  synthetic [barcode part1]
ttggataggcactcgt

SEQ ID NO: 23300 - DNA, 16 bp, Artificial Sequence
  synthetic [barcode part1]
tgaaccagatcgtcac

SEQ ID NO: 23301 - DNA, 16 bp, Artificial Sequence
  synthetic [barcode part1]
gtgacagttgttgtcg

SEQ ID NO: 23302 - DNA, 16 bp, Artificial Sequence
  synthetic [barcode part1]
tcgaactggtctaacg

SEQ ID NO: 23303 - DNA, 16 bp, Artificial Sequence
  synthetic [barcode part1]
ttgttcgtaccgtagt

SEQ ID NO: 23304 - DNA, 16 bp, Artificial Sequence
  synthetic [barcode part1]
gtgcaaccgcgtaatt

SEQ ID NO: 23305 - DNA, 16 bp, Artificial Sequence
  synthetic [barcode part1]
gccacaatctgaggtt

SEQ ID NO: 23306 - DNA, 16 bp, Artificial Sequence
  synthetic [barcode part1]
ttgtgttccgtcaggc

SEQ ID NO: 23307 - DNA, 16 bp, Artificial Sequence
  synthetic [barcode part1]
atacgcgcaactgact

SEQ ID NO: 23308 - DNA, 16 bp, Artificial Sequence
  synthetic [barcode part1]
ccacggtctaagattg

SEQ ID NO: 23309 - DNA, 16 bp, Artificial Sequence
  synthetic [barcode part1]
aattcaactggcgacc

SEQ ID NO: 23310 - DNA, 16 bp, Artificial Sequence
  synthetic [barcode part1]
acgtcttatcgttggt

SEQ ID NO: 23311 - DNA, 16 bp, Artificial Sequence
  synthetic [barcode part1]
ttcggttactgacgtt

SEQ ID NO: 23312 - DNA, 16 bp, Artificial Sequence
  synthetic [barcode part1]
cacactctgaactatc

SEQ ID NO: 23313 - DNA, 16 bp, Artificial Sequence
  synthetic [barcode part1]
aactctgaacaccgtg

SEQ ID NO: 23314 - DNA, 16 bp, Artificial Sequence
  synthetic [barcode part1]
tccttcgtcgtgtgag

SEQ ID NO: 23315 - DNA, 16 bp, Artificial Sequence
  synthetic [barcode part1]
tctcttcaaggtcctc

SEQ ID NO: 23316 - DNA, 16 bp, Artificial Sequence
  synthetic [barcode part1]
attaccgtctcgtgcg

SEQ ID NO: 23317 - DNA, 16 bp, Artificial Sequence
  synthetic [barcode part1]
tcaaggtagtgtcgtc

SEQ ID NO: 23318 - DNA, 16 bp, Artificial Sequence
  synthetic [barcode part1]
gatcctactacttgtg

SEQ ID NO: 23319 - DNA, 16 bp, Artificial Sequence
  synthetic [barcode part1]
ttcctctcggttgatc

SEQ ID NO: 23320 - DNA, 16 bp, Artificial Sequence
  synthetic [barcode part1]
cctggtggttcaatag

SEQ ID NO: 23321 - DNA, 16 bp, Artificial Sequence
  synthetic [barcode part1]
ttacctacttgcctgc

SEQ ID NO: 23322 - DNA, 16 bp, Artificial Sequence
  synthetic [barcode part1]
tggacgagagtctcag

SEQ ID NO: 23323 - DNA, 16 bp, Artificial Sequence
  synthetic [barcode part1]
ccttcggtgtatagtt

SEQ ID NO: 23324 - DNA, 16 bp, Artificial Sequence
  synthetic [barcode part1]
tgcgacgtattcgtcc

SEQ ID NO: 23325 - DNA, 16 bp, Artificial Sequence
  synthetic [barcode part1]
ttctactcgtcgtctg

SEQ ID NO: 23326 - DNA, 16 bp, Artificial Sequence
  synthetic [barcode part1]
aagaggcagatatctc

SEQ ID NO: 23327 - DNA, 16 bp, Artificial Sequence
  synthetic [barcode part1]
aaggccttactcgcct

SEQ ID NO: 23328 - DNA, 16 bp, Artificial Sequence
  synthetic [barcode part1]
gtactcctatacctcc

SEQ ID NO: 23329 - DNA, 16 bp, Artificial Sequence
  synthetic [barcode part1]
gttcagatcgccttgc

SEQ ID NO: 23330 - DNA, 16 bp, Artificial Sequence
  synthetic [barcode part1]
tacacctggaccacct

SEQ ID NO: 23331 - DNA, 16 bp, Artificial Sequence
  synthetic [barcode part1]
atcgtggtagacaagt

SEQ ID NO: 23332 - DNA, 16 bp, Artificial Sequence
  synthetic [barcode part1]
attcggatcacggatc

SEQ ID NO: 23333 - DNA, 16 bp, Artificial Sequence
  synthetic [barcode part1]
taatcctgcactggcc

SEQ ID NO: 23334 - DNA, 16 bp, Artificial Sequence
  synthetic [barcode part1]
gaattgccactagacc

SEQ ID NO: 23335 - DNA, 16 bp, Artificial Sequence
  synthetic [barcode part1]
gaggtagtctaggcac

SEQ ID NO: 23336 - DNA, 16 bp, Artificial Sequence
  synthetic [barcode part1]
gacagttcggtaactc

SEQ ID NO: 23337 - DNA, 16 bp, Artificial Sequence
  synthetic [barcode part1]
cgttccgacgaatcct

SEQ ID NO: 23338 - DNA, 16 bp, Artificial Sequence
  synthetic [barcode part1]
tatcgtcttacacggt

SEQ ID NO: 23339 - DNA, 16 bp, Artificial Sequence
  synthetic [barcode part1]
cgcaattctgaacgtg

SEQ ID NO: 23340 - DNA, 16 bp, Artificial Sequence
  synthetic [barcode part1]
cctacaacaggtatcg

SEQ ID NO: 23341 - DNA, 16 bp, Artificial Sequence
  synthetic [barcode part1]
aagtgtacgtggagag

SEQ ID NO: 23342 - DNA, 16 bp, Artificial Sequence
  synthetic [barcode part1]
aatacgtcgcggttgt

SEQ ID NO: 23343 - DNA, 16 bp, Artificial Sequence
  synthetic [barcode part1]
gacagttccgacaatc

SEQ ID NO: 23344 - DNA, 16 bp, Artificial Sequence
  synthetic [barcode part1]
gccggattaggttatc

SEQ ID NO: 23345 - DNA, 16 bp, Artificial Sequence
  synthetic [barcode part1]
actcaagtggagtggc

SEQ ID NO: 23346 - DNA, 16 bp, Artificial Sequence
  synthetic [barcode part1]
tcagacaaggttcgtc

SEQ ID NO: 23347 - DNA, 16 bp, Artificial Sequence
  synthetic [barcode part1]
gtagtgcaactccagt

SEQ ID NO: 23348 - DNA, 16 bp, Artificial Sequence
  synthetic [barcode part1]
acgtgcacgatactgt

SEQ ID NO: 23349 - DNA, 16 bp, Artificial Sequence
  synthetic [barcode part1]
atatactctgcgcgag

SEQ ID NO: 23350 - DNA, 16 bp, Artificial Sequence
  synthetic [barcode part1]
cctgcgtgtattctct

SEQ ID NO: 23351 - DNA, 16 bp, Artificial Sequence
  synthetic [barcode part1]
tcacctccgcgttaag

SEQ ID NO: 23352 - DNA, 16 bp, Artificial Sequence
  synthetic [barcode part1]
atcaagtcactctcgt

SEQ ID NO: 23353 - DNA, 16 bp, Artificial Sequence
  synthetic [barcode part1]
acactaacttcgtcgt

SEQ ID NO: 23354 - DNA, 16 bp, Artificial Sequence
  synthetic [barcode part1]
gtaagaacctctgcac

SEQ ID NO: 23355 - DNA, 16 bp, Artificial Sequence
  synthetic [barcode part1]
cgtcaataacttctcg

SEQ ID NO: 23356 - DNA, 16 bp, Artificial Sequence
  synthetic [barcode part1]
agtcttgttattcgcg

SEQ ID NO: 23357 - DNA, 16 bp, Artificial Sequence
  synthetic [barcode part1]
acttcgtgcgaccgtt

SEQ ID NO: 23358 - DNA, 16 bp, Artificial Sequence
  synthetic [barcode part1]
atctgtgtcagacgtg

SEQ ID NO: 23359 - DNA, 16 bp, Artificial Sequence
  synthetic [barcode part1]
agtcttggttcacttg

SEQ ID NO: 23360 - DNA, 16 bp, Artificial Sequence
  synthetic [barcode part1]
ttctcaactggtctcc

SEQ ID NO: 23361 - DNA, 16 bp, Artificial Sequence
  synthetic [barcode part1]
tcagacagaacggtgc

SEQ ID NO: 23362 - DNA, 16 bp, Artificial Sequence
  synthetic [barcode part1]
tccgacttacgattac

SEQ ID NO: 23363 - DNA, 16 bp, Artificial Sequence
  synthetic [barcode part1]
gacaccgtcaatcaac

SEQ ID NO: 23364 - DNA, 16 bp, Artificial Sequence
  synthetic [barcode part1]
tacggtaatctgttcc

SEQ ID NO: 23365 - DNA, 16 bp, Artificial Sequence
  synthetic [barcode part1]
tctgcgcgttgagtct

SEQ ID NO: 23366 - DNA, 16 bp, Artificial Sequence
  synthetic [barcode part1]
tgtccgcacggtatct

SEQ ID NO: 23367 - DNA, 16 bp, Artificial Sequence
  synthetic [barcode part1]
tcgagtggtgaatcct

SEQ ID NO: 23368 - DNA, 16 bp, Artificial Sequence
  synthetic [barcode part1]
gactacaagagtcaac

SEQ ID NO: 23369 - DNA, 16 bp, Artificial Sequence
  synthetic [barcode part1]
ttgagtggtccgtaac

SEQ ID NO: 23370 - DNA, 16 bp, Artificial Sequence
  synthetic [barcode part1]
aggtaccgttcgtagt

SEQ ID NO: 23371 - DNA, 16 bp, Artificial Sequence
  synthetic [barcode part1]
gttctcgcaagtcgtc

SEQ ID NO: 23372 - DNA, 16 bp, Artificial Sequence
  synthetic [barcode part1]
ttgagtgatctgcgac

SEQ ID NO: 23373 - DNA, 16 bp, Artificial Sequence
  synthetic [barcode part1]
gacggagttctactgt

SEQ ID NO: 23374 - DNA, 16 bp, Artificial Sequence
  synthetic [barcode part1]
tattgccggatactct

SEQ ID NO: 23375 - DNA, 16 bp, Artificial Sequence
  synthetic [barcode part1]
tgaacggtccaaggtg

SEQ ID NO: 23376 - DNA, 16 bp, Artificial Sequence
  synthetic [barcode part1]
cgcaagattaacggcg

SEQ ID NO: 23377 - DNA, 16 bp, Artificial Sequence
  synthetic [barcode part1]
tcagacggcgacaagt

SEQ ID NO: 23378 - DNA, 16 bp, Artificial Sequence
  synthetic [barcode part1]
ttgacgaacaggaatc

SEQ ID NO: 23379 - DNA, 16 bp, Artificial Sequence
  synthetic [barcode part1]
attctgtgtggttgtc

SEQ ID NO: 23380 - DNA, 16 bp, Artificial Sequence
  synthetic [barcode part1]
gcaaggtattccgttg

SEQ ID NO: 23381 - DNA, 16 bp, Artificial Sequence
  synthetic [barcode part1]
cgtcctggagtctgtt

SEQ ID NO: 23382 - DNA, 16 bp, Artificial Sequence
  synthetic [barcode part1]
tcactacctgtcctgt

SEQ ID NO: 23383 - DNA, 16 bp, Artificial Sequence
  synthetic [barcode part1]
gagaacggtgatctgc

SEQ ID NO: 23384 - DNA, 16 bp, Artificial Sequence
  synthetic [barcode part1]
cgtattctgagtcgtt

SEQ ID NO: 23385 - DNA, 16 bp, Artificial Sequence
  synthetic [barcode part1]
aggacgttatacctcg

SEQ ID NO: 23386 - DNA, 16 bp, Artificial Sequence
  synthetic [barcode part1]
gcagtacggttgatct

SEQ ID NO: 23387 - DNA, 16 bp, Artificial Sequence
  synthetic [barcode part1]
cggttcgaacaattcg

SEQ ID NO: 23388 - DNA, 16 bp, Artificial Sequence
  synthetic [barcode part1]
tcaagtacgccgtcct

SEQ ID NO: 23389 - DNA, 16 bp, Artificial Sequence
  synthetic [barcode part1]
agtccttgtatccagt

SEQ ID NO: 23390 - DNA, 16 bp, Artificial Sequence
  synthetic [barcode part1]
ccttggtcgtaccaac

SEQ ID NO: 23391 - DNA, 16 bp, Artificial Sequence
  synthetic [barcode part1]
cgacaccttacagtag

SEQ ID NO: 23392 - DNA, 16 bp, Artificial Sequence
  synthetic [barcode part1]
agaggtaggcggtctt

SEQ ID NO: 23393 - DNA, 16 bp, Artificial Sequence
  synthetic [barcode part1]
actctagacacacacg

SEQ ID NO: 23394 - DNA, 16 bp, Artificial Sequence
  synthetic [barcode part1]
taacggcgtacgaggt

SEQ ID NO: 23395 - DNA, 16 bp, Artificial Sequence
  synthetic [barcode part1]
agtccgaacgcgaagt

SEQ ID NO: 23396 - DNA, 16 bp, Artificial Sequence
  synthetic [barcode part1]
tgacctacggattgtg

SEQ ID NO: 23397 - DNA, 16 bp, Artificial Sequence
  synthetic [barcode part1]
ttctatcctgcctcag

SEQ ID NO: 23398 - DNA, 16 bp, Artificial Sequence
  synthetic [barcode part1]
cggagtcactgattac

SEQ ID NO: 23399 - DNA, 16 bp, Artificial Sequence
  synthetic [barcode part1]
ccgagaagatctgcag

SEQ ID NO: 23400 - DNA, 16 bp, Artificial Sequence
  synthetic [barcode part1]
tggattcgtcctattg

SEQ ID NO: 23401 - DNA, 16 bp, Artificial Sequence
  synthetic [barcode part1]
tcgttccaatcacgcg

SEQ ID NO: 23402 - DNA, 16 bp, Artificial Sequence
  synthetic [barcode part1]
aactcaggacttggtc

SEQ ID NO: 23403 - DNA, 16 bp, Artificial Sequence
  synthetic [barcode part1]
caatcagtgtggtacc

SEQ ID NO: 23404 - DNA, 16 bp, Artificial Sequence
  synthetic [barcode part1]
agttcggaaggtgcgt

SEQ ID NO: 23405 - DNA, 16 bp, Artificial Sequence
  synthetic [barcode part1]
acggtagttacgcgag

SEQ ID NO: 23406 - DNA, 16 bp, Artificial Sequence
  synthetic [barcode part1]
taggagacttcggtct

SEQ ID NO: 23407 - DNA, 16 bp, Artificial Sequence
  synthetic [barcode part1]
tcacggagttcgagtt

SEQ ID NO: 23408 - DNA, 16 bp, Artificial Sequence
  synthetic [barcode part1]
caggtagattcgttcg

SEQ ID NO: 23409 - DNA, 16 bp, Artificial Sequence
  synthetic [barcode part1]
gaactgtggtgacttc

SEQ ID NO: 23410 - DNA, 16 bp, Artificial Sequence
  synthetic [barcode part1]
tagaaggccgacttct

SEQ ID NO: 23411 - DNA, 16 bp, Artificial Sequence
  synthetic [barcode part1]
cagtctcgcgttagtc

SEQ ID NO: 23412 - DNA, 16 bp, Artificial Sequence
  synthetic [barcode part1]
acgtcgacaacctcct

SEQ ID NO: 23413 - DNA, 16 bp, Artificial Sequence
  synthetic [barcode part1]
tcgcaccagtgtaagt

SEQ ID NO: 23414 - DNA, 16 bp, Artificial Sequence
  synthetic [barcode part1]
cctgacttaatacacc

SEQ ID NO: 23415 - DNA, 16 bp, Artificial Sequence
  synthetic [barcode part1]
cgtattgaactccttg

SEQ ID NO: 23416 - DNA, 16 bp, Artificial Sequence
  synthetic [barcode part1]
atctgttcctgaagtc

SEQ ID NO: 23417 - DNA, 16 bp, Artificial Sequence
  synthetic [barcode part1]
tcaagaactcctgacg

SEQ ID NO: 23418 - DNA, 16 bp, Artificial Sequence
  synthetic [barcode part1]
tcacagtctgagactg

SEQ ID NO: 23419 - DNA, 16 bp, Artificial Sequence
  synthetic [barcode part1]
actagtagtggccact

SEQ ID NO: 23420 - DNA, 16 bp, Artificial Sequence
  synthetic [barcode part1]
tggtgattacactctc

SEQ ID NO: 23421 - DNA, 16 bp, Artificial Sequence
  synthetic [barcode part1]
cctactacggtaaggt

SEQ ID NO: 23422 - DNA, 16 bp, Artificial Sequence
  synthetic [barcode part1]
aggtaattacgaaccg

SEQ ID NO: 23423 - DNA, 16 bp, Artificial Sequence
  synthetic [barcode part1]
ccgcactactcttact

SEQ ID NO: 23424 - DNA, 16 bp, Artificial Sequence
  synthetic [barcode part1]
gccggattctagtaac

SEQ ID NO: 23425 - DNA, 16 bp, Artificial Sequence
  synthetic [barcode part1]
gtacacgaccgtgatt

SEQ ID NO: 23426 - DNA, 16 bp, Artificial Sequence
  synthetic [barcode part1]
gcgttagaggataact

SEQ ID NO: 23427 - DNA, 16 bp, Artificial Sequence
  synthetic [barcode part1]
gaactcgtctaatcct

SEQ ID NO: 23428 - DNA, 16 bp, Artificial Sequence
  synthetic [barcode part1]
caatcttacacaccac

SEQ ID NO: 23429 - DNA, 16 bp, Artificial Sequence
  synthetic [barcode part1]
caatcaccgttgacag

SEQ ID NO: 23430 - DNA, 16 bp, Artificial Sequence
  synthetic [barcode part1]
tctctaggccgtacgt

SEQ ID NO: 23431 - DNA, 16 bp, Artificial Sequence
  synthetic [barcode part1]
gacactaatactgcgc

SEQ ID NO: 23432 - DNA, 16 bp, Artificial Sequence
  synthetic [barcode part1]
aactctgaacagacag

SEQ ID NO: 23433 - DNA, 16 bp, Artificial Sequence
  synthetic [barcode part1]
tgtcctgtgttactcc

SEQ ID NO: 23434 - DNA, 16 bp, Artificial Sequence
  synthetic [barcode part1]
atctgtccggacaagt

SEQ ID NO: 23435 - DNA, 16 bp, Artificial Sequence
  synthetic [barcode part1]
caagaggtacgactgc

SEQ ID NO: 23436 - DNA, 16 bp, Artificial Sequence
  synthetic [barcode part1]
agagagtccacacggt

SEQ ID NO: 23437 - DNA, 16 bp, Artificial Sequence
  synthetic [barcode part1]
tagatcgcgatccaac

SEQ ID NO: 23438 - DNA, 16 bp, Artificial Sequence
  synthetic [barcode part1]
agttacgcgtagttgc

SEQ ID NO: 23439 - DNA, 16 bp, Artificial Sequence
  synthetic [barcode part1]
tggtcagtgcaacact

SEQ ID NO: 23440 - DNA, 16 bp, Artificial Sequence
  synthetic [barcode part1]
gcaattacggcgtact

SEQ ID NO: 23441 - DNA, 16 bp, Artificial Sequence
  synthetic [barcode part1]
tacgacagtccgttcc

SEQ ID NO: 23442 - DNA, 16 bp, Artificial Sequence
  synthetic [barcode part1]
cgtgtaacgttccgtc

SEQ ID NO: 23443 - DNA, 16 bp, Artificial Sequence
  synthetic [barcode part1]
gtctaggccacagatt

SEQ ID NO: 23444 - DNA, 16 bp, Artificial Sequence
  synthetic [barcode part1]
accaacactactactc

SEQ ID NO: 23445 - DNA, 16 bp, Artificial Sequence
  synthetic [barcode part1]
gtgtacagagatcctc

SEQ ID NO: 23446 - DNA, 16 bp, Artificial Sequence
  synthetic [barcode part1]
gttactctcgtgaact

SEQ ID NO: 23447 - DNA, 16 bp, Artificial Sequence
  synthetic [barcode part1]
cgtcttaattcgtggt

SEQ ID NO: 23448 - DNA, 16 bp, Artificial Sequence
  synthetic [barcode part1]
tatagactcgccttgt

SEQ ID NO: 23449 - DNA, 16 bp, Artificial Sequence
  synthetic [barcode part1]
gtgactgacgtcaact

SEQ ID NO: 23450 - DNA, 16 bp, Artificial Sequence
  synthetic [barcode part1]
ccttgtgtcttcacac

SEQ ID NO: 23451 - DNA, 16 bp, Artificial Sequence
  synthetic [barcode part1]
tgcacttgagttacct

SEQ ID NO: 23452 - DNA, 16 bp, Artificial Sequence
  synthetic [barcode part1]
gcaccgataaccttcc

SEQ ID NO: 23453 - DNA, 16 bp, Artificial Sequence
  synthetic [barcode part1]
tgcctggtcctatcag

SEQ ID NO: 23454 - DNA, 16 bp, Artificial Sequence
  synthetic [barcode part1]
ccgtgaagacggtagt

SEQ ID NO: 23455 - DNA, 16 bp, Artificial Sequence
  synthetic [barcode part1]
agttaattgacgccgc

SEQ ID NO: 23456 - DNA, 16 bp, Artificial Sequence
  synthetic [barcode part1]
gtgagagtcggattgc

SEQ ID NO: 23457 - DNA, 16 bp, Artificial Sequence
  synthetic [barcode part1]
acgtgactacgcaact

SEQ ID NO: 23458 - DNA, 16 bp, Artificial Sequence
  synthetic [barcode part1]
actctgcaacgtattc

SEQ ID NO: 23459 - DNA, 16 bp, Artificial Sequence
  synthetic [barcode part1]
agagagttaggtctgt

SEQ ID NO: 23460 - DNA, 16 bp, Artificial Sequence
  synthetic [barcode part1]
gtgactaagaggattc

SEQ ID NO: 23461 - DNA, 16 bp, Artificial Sequence
  synthetic [barcode part1]
gtggacctaacctctc

SEQ ID NO: 23462 - DNA, 16 bp, Artificial Sequence
  synthetic [barcode part1]
gcggtataggacttct

SEQ ID NO: 23463 - DNA, 16 bp, Artificial Sequence
  synthetic [barcode part1]
agaggtcgttaacgcg

SEQ ID NO: 23464 - DNA, 16 bp, Artificial Sequence
  synthetic [barcode part1]
gtgccttatcactggc

SEQ ID NO: 23465 - DNA, 16 bp, Artificial Sequence
  synthetic [barcode part1]
cgtattgccttctaag

SEQ ID NO: 23466 - DNA, 16 bp, Artificial Sequence
  synthetic [barcode part1]
gactaacaccgtgatc

SEQ ID NO: 23467 - DNA, 16 bp, Artificial Sequence
  synthetic [barcode part1]
gttgttgtacgaagag

SEQ ID NO: 23468 - DNA, 16 bp, Artificial Sequence
  synthetic [barcode part1]
gttctgactgaggttg

SEQ ID NO: 23469 - DNA, 16 bp, Artificial Sequence
  synthetic [barcode part1]
aatcaccagacgcgag

SEQ ID NO: 23470 - DNA, 16 bp, Artificial Sequence
  synthetic [barcode part1]
tggaggttggactacg

SEQ ID NO: 23471 - DNA, 16 bp, Artificial Sequence
  synthetic [barcode part1]
acgacgcactacaatc

SEQ ID NO: 23472 - DNA, 16 bp, Artificial Sequence
  synthetic [barcode part1]
cgtgagtgcggtaagt

SEQ ID NO: 23473 - DNA, 16 bp, Artificial Sequence
  synthetic [barcode part1]
tctattcagacaggcg

SEQ ID NO: 23474 - DNA, 16 bp, Artificial Sequence
  synthetic [barcode part1]
tccgccaccttcaatt

SEQ ID NO: 23475 - DNA, 16 bp, Artificial Sequence
  synthetic [barcode part1]
atccttggtctggcgt

SEQ ID NO: 23476 - DNA, 16 bp, Artificial Sequence
  synthetic [barcode part1]
ttgcaccacttagtac

SEQ ID NO: 23477 - DNA, 16 bp, Artificial Sequence
  synthetic [barcode part1]
ccgtgtgttctgactg

SEQ ID NO: 23478 - DNA, 16 bp, Artificial Sequence
  synthetic [barcode part1]
tataagtccgcgaacc

SEQ ID NO: 23479 - DNA, 16 bp, Artificial Sequence
  synthetic [barcode part1]
gcaggagagtcactgt

SEQ ID NO: 23480 - DNA, 16 bp, Artificial Sequence
  synthetic [barcode part1]
accgttctctgttacc

SEQ ID NO: 23481 - DNA, 16 bp, Artificial Sequence
  synthetic [barcode part1]
tccgtacgactaccac

SEQ ID NO: 23482 - DNA, 16 bp, Artificial Sequence
  synthetic [barcode part1]
ataccggaagaatcgt

SEQ ID NO: 23483 - DNA, 16 bp, Artificial Sequence
  synthetic [barcode part1]
ccgtaatcacagtgtg

SEQ ID NO: 23484 - DNA, 16 bp, Artificial Sequence
  synthetic [barcode part1]
tacacctctactgagt

SEQ ID NO: 23485 - DNA, 16 bp, Artificial Sequence
  synthetic [barcode part1]
tgcgtattcaaccgag

SEQ ID NO: 23486 - DNA, 16 bp, Artificial Sequence
  synthetic [barcode part1]
acttaccggtgagtgt

SEQ ID NO: 23487 - DNA, 16 bp, Artificial Sequence
  synthetic [barcode part1]
tgtctccgtcagactg

SEQ ID NO: 23488 - DNA, 16 bp, Artificial Sequence
  synthetic [barcode part1]
tcactcgattcacctc

SEQ ID NO: 23489 - DNA, 16 bp, Artificial Sequence
  synthetic [barcode part1]
tcaatatcggccacag

SEQ ID NO: 23490 - DNA, 16 bp, Artificial Sequence
  synthetic [barcode part1]
ataatcttgccaggcg

SEQ ID NO: 23491 - DNA, 16 bp, Artificial Sequence
  synthetic [barcode part1]
aacaaggtggcctctt

SEQ ID NO: 23492 - DNA, 16 bp, Artificial Sequence
  synthetic [barcode part1]
attgaagtagtgtgcg

SEQ ID NO: 23493 - DNA, 16 bp, Artificial Sequence
  synthetic [barcode part1]
cgcacctacaagaact

SEQ ID NO: 23494 - DNA, 16 bp, Artificial Sequence
  synthetic [barcode part1]
agataccaagtctgcc

SEQ ID NO: 23495 - DNA, 16 bp, Artificial Sequence
  synthetic [barcode part1]
tattcacagatcctgc

SEQ ID NO: 23496 - DNA, 16 bp, Artificial Sequence
  synthetic [barcode part1]
atcgtaccgtaccaag

SEQ ID NO: 23497 - DNA, 16 bp, Artificial Sequence
  synthetic [barcode part1]
atacggtgagagattc

SEQ ID NO: 23498 - DNA, 16 bp, Artificial Sequence
  synthetic [barcode part1]
tcactactgtccaagt

SEQ ID NO: 23499 - DNA, 16 bp, Artificial Sequence
  synthetic [barcode part1]
gtgattggagatcggc

SEQ ID NO: 23500 - DNA, 16 bp, Artificial Sequence
  synthetic [barcode part1]
caacgacgagaatact

SEQ ID NO: 23501 - DNA, 16 bp, Artificial Sequence
  synthetic [barcode part1]
atcactctacctgagt

SEQ ID NO: 23502 - DNA, 16 bp, Artificial Sequence
  synthetic [barcode part1]
acttacctccaagact

SEQ ID NO: 23503 - DNA, 16 bp, Artificial Sequence
  synthetic [barcode part1]
tcagtcactgaagtcg

SEQ ID NO: 23504 - DNA, 16 bp, Artificial Sequence
  synthetic [barcode part1]
attgtaaccgcctgcc

SEQ ID NO: 23505 - DNA, 16 bp, Artificial Sequence
  synthetic [barcode part1]
caggttaggtcgttac

SEQ ID NO: 23506 - DNA, 16 bp, Artificial Sequence
  synthetic [barcode part1]
cggtgacttcttatac

SEQ ID NO: 23507 - DNA, 16 bp, Artificial Sequence
  synthetic [barcode part1]
ccaacgactatatcct

SEQ ID NO: 23508 - DNA, 16 bp, Artificial Sequence
  synthetic [barcode part1]
cgttgccttgtcactt

SEQ ID NO: 23509 - DNA, 16 bp, Artificial Sequence
  synthetic [barcode part1]
aagactatcggtgtag

SEQ ID NO: 23510 - DNA, 16 bp, Artificial Sequence
  synthetic [barcode part1]
acagtaactgtgtgag

SEQ ID NO: 23511 - DNA, 16 bp, Artificial Sequence
  synthetic [barcode part1]
ccagttagtcgatcag

SEQ ID NO: 23512 - DNA, 16 bp, Artificial Sequence
  synthetic [barcode part1]
gacacagtctacgttg

SEQ ID NO: 23513 - DNA, 16 bp, Artificial Sequence
  synthetic [barcode part1]
agtgaggatatccaac

SEQ ID NO: 23514 - DNA, 16 bp, Artificial Sequence
  synthetic [barcode part1]
tcctccagaatacttg

SEQ ID NO: 23515 - DNA, 16 bp, Artificial Sequence
  synthetic [barcode part1]
gttaggtatctggtgc

SEQ ID NO: 23516 - DNA, 16 bp, Artificial Sequence
  synthetic [barcode part1]
cgccttggtaataggt

SEQ ID NO: 23517 - DNA, 16 bp, Artificial Sequence
  synthetic [barcode part1]
atcaggtcacctccac

SEQ ID NO: 23518 - DNA, 16 bp, Artificial Sequence
  synthetic [barcode part1]
gagattctccgcctac

SEQ ID NO: 23519 - DNA, 16 bp, Artificial Sequence
  synthetic [barcode part1]
tcagacgttgcgagtt

SEQ ID NO: 23520 - DNA, 16 bp, Artificial Sequence
  synthetic [barcode part1]
agatctagtccggact

SEQ ID NO: 23521 - DNA, 16 bp, Artificial Sequence
  synthetic [barcode part1]
gagatagacggattct

SEQ ID NO: 23522 - DNA, 16 bp, Artificial Sequence
  synthetic [barcode part1]
acagatataccgtgag

SEQ ID NO: 23523 - DNA, 16 bp, Artificial Sequence
  synthetic [barcode part1]
tgcacgatatcgacgt

SEQ ID NO: 23524 - DNA, 16 bp, Artificial Sequence
  synthetic [barcode part1]
gcgagtataaggcctg

SEQ ID NO: 23525 - DNA, 16 bp, Artificial Sequence
  synthetic [barcode part1]
gtctcctcgtgactag

SEQ ID NO: 23526 - DNA, 16 bp, Artificial Sequence
  synthetic [barcode part1]
tcacagagtgaagtac

SEQ ID NO: 23527 - DNA, 16 bp, Artificial Sequence
  synthetic [barcode part1]
gccgttgtaataaccg

SEQ ID NO: 23528 - DNA, 16 bp, Artificial Sequence
  synthetic [barcode part1]
tgtgcctggtaacctc

SEQ ID NO: 23529 - DNA, 16 bp, Artificial Sequence
  synthetic [barcode part1]
gaggtcacacagatcg

SEQ ID NO: 23530 - DNA, 16 bp, Artificial Sequence
  synthetic [barcode part1]
gagtgaataaggcctt

SEQ ID NO: 23531 - DNA, 16 bp, Artificial Sequence
  synthetic [barcode part1]
tctgttacgtgaactc

SEQ ID NO: 23532 - DNA, 16 bp, Artificial Sequence
  synthetic [barcode part1]
tcaatccgcagaacgt

SEQ ID NO: 23533 - DNA, 16 bp, Artificial Sequence
  synthetic [barcode part1]
cacttacgagttctgt

SEQ ID NO: 23534 - DNA, 16 bp, Artificial Sequence
  synthetic [barcode part1]
tgtacaagacggcggt

SEQ ID NO: 23535 - DNA, 16 bp, Artificial Sequence
  synthetic [barcode part1]
acagttggtgttggtc

SEQ ID NO: 23536 - DNA, 16 bp, Artificial Sequence
  synthetic [barcode part1]
gtgccggtcttgttgt

SEQ ID NO: 23537 - DNA, 16 bp, Artificial Sequence
  synthetic [barcode part1]
ttcaaccgtcaacgtt

SEQ ID NO: 23538 - DNA, 16 bp, Artificial Sequence
  synthetic [barcode part1]
aacaaggaccgaaggt

SEQ ID NO: 23539 - DNA, 16 bp, Artificial Sequence
  synthetic [barcode part1]
aagagtgcgaactact

SEQ ID NO: 23540 - DNA, 16 bp, Artificial Sequence
  synthetic [barcode part1]
ttgaataccacttcgc

SEQ ID NO: 23541 - DNA, 16 bp, Artificial Sequence
  synthetic [barcode part1]
cgatcaacggtattgc

SEQ ID NO: 23542 - DNA, 16 bp, Artificial Sequence
  synthetic [barcode part1]
cagagttaactctggc

SEQ ID NO: 23543 - DNA, 16 bp, Artificial Sequence
  synthetic [barcode part1]
gaagaatcgttaacgc

SEQ ID NO: 23544 - DNA, 16 bp, Artificial Sequence
  synthetic [barcode part1]
gtacttccacgagagt

SEQ ID NO: 23545 - DNA, 16 bp, Artificial Sequence
  synthetic [barcode part1]
tccgaagtgatcggtt

SEQ ID NO: 23546 - DNA, 16 bp, Artificial Sequence
  synthetic [barcode part1]
tccgttgttggtgcac

SEQ ID NO: 23547 - DNA, 16 bp, Artificial Sequence
  synthetic [barcode part1]
tcagagtagacaagtc

SEQ ID NO: 23548 - DNA, 16 bp, Artificial Sequence
  synthetic [barcode part1]
tagagatcgccagacg

SEQ ID NO: 23549 - DNA, 16 bp, Artificial Sequence
  synthetic [barcode part1]
attctacgtggccgtc

SEQ ID NO: 23550 - DNA, 16 bp, Artificial Sequence
  synthetic [barcode part1]
tgccttggatattcac

SEQ ID NO: 23551 - DNA, 16 bp, Artificial Sequence
  synthetic [barcode part1]
gacactgacactgtgt

SEQ ID NO: 23552 - DNA, 16 bp, Artificial Sequence
  synthetic [barcode part1]
gtaagaggaaggcgtt

SEQ ID NO: 23553 - DNA, 16 bp, Artificial Sequence
  synthetic [barcode part1]
acggattgaagtaacc

SEQ ID NO: 23554 - DNA, 16 bp, Artificial Sequence
  synthetic [barcode part1]
cggagtagtctaggtg

SEQ ID NO: 23555 - DNA, 16 bp, Artificial Sequence
  synthetic [barcode part1]
gtcgacgtcgtataac

SEQ ID NO: 23556 - DNA, 16 bp, Artificial Sequence
  synthetic [barcode part1]
tgagagaggtctctct

SEQ ID NO: 23557 - DNA, 16 bp, Artificial Sequence
  synthetic [barcode part1]
tctcaaggtgaacaag

SEQ ID NO: 23558 - DNA, 16 bp, Artificial Sequence
  synthetic [barcode part1]
aacttcggacggacag

SEQ ID NO: 23559 - DNA, 16 bp, Artificial Sequence
  synthetic [barcode part1]
gattattcgccaggtg

SEQ ID NO: 23560 - DNA, 16 bp, Artificial Sequence
  synthetic [barcode part1]
atccacaactgaagag

SEQ ID NO: 23561 - DNA, 16 bp, Artificial Sequence
  synthetic [barcode part1]
cgcagacgaacagtac

SEQ ID NO: 23562 - DNA, 16 bp, Artificial Sequence
  synthetic [barcode part1]
gtaaccgaatcgaagt

SEQ ID NO: 23563 - DNA, 16 bp, Artificial Sequence
  synthetic [barcode part1]
gtccggtattggattg

SEQ ID NO: 23564 - DNA, 16 bp, Artificial Sequence
  synthetic [barcode part1]
acacaggtaccaggtg

SEQ ID NO: 23565 - DNA, 16 bp, Artificial Sequence
  synthetic [barcode part1]
atacgcggactctagt

SEQ ID NO: 23566 - DNA, 16 bp, Artificial Sequence
  synthetic [barcode part1]
gtgttagtcctatcac

SEQ ID NO: 23567 - DNA, 16 bp, Artificial Sequence
  synthetic [barcode part1]
tcgtagttcctcttcg

SEQ ID NO: 23568 - DNA, 16 bp, Artificial Sequence
  synthetic [barcode part1]
taacttcggtcaaggc

SEQ ID NO: 23569 - DNA, 16 bp, Artificial Sequence
  synthetic [barcode part1]
gaccagaataatcacg

SEQ ID NO: 23570 - DNA, 16 bp, Artificial Sequence
  synthetic [barcode part1]
actagactgccaagtc

SEQ ID NO: 23571 - DNA, 16 bp, Artificial Sequence
  synthetic [barcode part1]
gatctctgtcgttcct

SEQ ID NO: 23572 - DNA, 16 bp, Artificial Sequence
  synthetic [barcode part1]
tcttgtgcggcagtct

SEQ ID NO: 23573 - DNA, 16 bp, Artificial Sequence
  synthetic [barcode part1]
tattgagtgcctctgt

SEQ ID NO: 23574 - DNA, 16 bp, Artificial Sequence
  synthetic [barcode part1]
agagagtcctgcaggt

SEQ ID NO: 23575 - DNA, 16 bp, Artificial Sequence
  synthetic [barcode part1]
ttaggtctgcgaggag

SEQ ID NO: 23576 - DNA, 16 bp, Artificial Sequence
  synthetic [barcode part1]
gagatcggacttatag

SEQ ID NO: 23577 - DNA, 16 bp, Artificial Sequence
  synthetic [barcode part1]
tgtaacctgtgccaag

SEQ ID NO: 23578 - DNA, 16 bp, Artificial Sequence
  synthetic [barcode part1]
actgagtacttggcac

SEQ ID NO: 23579 - DNA, 16 bp, Artificial Sequence
  synthetic [barcode part1]
acgtctctggcagttc

SEQ ID NO: 23580 - DNA, 16 bp, Artificial Sequence
  synthetic [barcode part1]
tcttagtaggacggtc

SEQ ID NO: 23581 - DNA, 16 bp, Artificial Sequence
  synthetic [barcode part1]
gacaatcactatcggc

SEQ ID NO: 23582 - DNA, 16 bp, Artificial Sequence
  synthetic [barcode part1]
agtgtggagtacgaag

SEQ ID NO: 23583 - DNA, 16 bp, Artificial Sequence
  synthetic [barcode part1]
tgaccttcacgtagtt

SEQ ID NO: 23584 - DNA, 16 bp, Artificial Sequence
  synthetic [barcode part1]
agataccagtagaacc

SEQ ID NO: 23585 - DNA, 16 bp, Artificial Sequence
  synthetic [barcode part1]
caacacgatacctggt

SEQ ID NO: 23586 - DNA, 16 bp, Artificial Sequence
  synthetic [barcode part1]
tcaactgcaactggtg

SEQ ID NO: 23587 - DNA, 16 bp, Artificial Sequence
  synthetic [barcode part1]
aaggtgaccacttcgt

SEQ ID NO: 23588 - DNA, 16 bp, Artificial Sequence
  synthetic [barcode part1]
cactggcctaatcctg

SEQ ID NO: 23589 - DNA, 16 bp, Artificial Sequence
  synthetic [barcode part1]
accagtatcacgtgac

SEQ ID NO: 23590 - DNA, 16 bp, Artificial Sequence
  synthetic [barcode part1]
tgacggcaagagtgtc

SEQ ID NO: 23591 - DNA, 16 bp, Artificial Sequence
  synthetic [barcode part1]
gaggtgagaacgatac

SEQ ID NO: 23592 - DNA, 16 bp, Artificial Sequence
  synthetic [barcode part1]
cacagtggagtaagtt

SEQ ID NO: 23593 - DNA, 16 bp, Artificial Sequence
  synthetic [barcode part1]
aattatctggaccgcg

SEQ ID NO: 23594 - DNA, 16 bp, Artificial Sequence
  synthetic [barcode part1]
tctaatcgcgtactac

SEQ ID NO: 23595 - DNA, 16 bp, Artificial Sequence
  synthetic [barcode part1]
ccacttcagagatcag

SEQ ID NO: 23596 - DNA, 16 bp, Artificial Sequence
  synthetic [barcode part1]
tagaccgtgtatctct

SEQ ID NO: 23597 - DNA, 16 bp, Artificial Sequence
  synthetic [barcode part1]
actctgttccacaagt

SEQ ID NO: 23598 - DNA, 16 bp, Artificial Sequence
  synthetic [barcode part1]
cgactattggaggacg

SEQ ID NO: 23599 - DNA, 16 bp, Artificial Sequence
  synthetic [barcode part1]
accggaatagtcgcag

SEQ ID NO: 23600 - DNA, 16 bp, Artificial Sequence
  synthetic [barcode part1]
ccgtctggtaatactt

SEQ ID NO: 23601 - DNA, 16 bp, Artificial Sequence
  synthetic [barcode part1]
cacgtaacaggtctac

SEQ ID NO: 23602 - DNA, 16 bp, Artificial Sequence
  synthetic [barcode part1]
cgagactagtcaacct

SEQ ID NO: 23603 - DNA, 16 bp, Artificial Sequence
  synthetic [barcode part1]
cgtggtctgatcttcg

SEQ ID NO: 23604 - DNA, 16 bp, Artificial Sequence
  synthetic [barcode part1]
tacggtgatccgcctt

SEQ ID NO: 23605 - DNA, 16 bp, Artificial Sequence
  synthetic [barcode part1]
cacttgaacgcagttg

SEQ ID NO: 23606 - DNA, 16 bp, Artificial Sequence
  synthetic [barcode part1]
tacgtagttactgtcc

SEQ ID NO: 23607 - DNA, 16 bp, Artificial Sequence
  synthetic [barcode part1]
gtaccttattggacct

SEQ ID NO: 23608 - DNA, 16 bp, Artificial Sequence
  synthetic [barcode part1]
atctatctccgtctgc

SEQ ID NO: 23609 - DNA, 16 bp, Artificial Sequence
  synthetic [barcode part1]
tcctaatcggcagaac

SEQ ID NO: 23610 - DNA, 16 bp, Artificial Sequence
  synthetic [barcode part1]
ccaatcacggtatcag

SEQ ID NO: 23611 - DNA, 16 bp, Artificial Sequence
  synthetic [barcode part1]
cacgatacggaacttc

SEQ ID NO: 23612 - DNA, 16 bp, Artificial Sequence
  synthetic [barcode part1]
ccaggatcacctacct

SEQ ID NO: 23613 - DNA, 16 bp, Artificial Sequence
  synthetic [barcode part1]
tcgtcgccaagtgtct

SEQ ID NO: 23614 - DNA, 16 bp, Artificial Sequence
  synthetic [barcode part1]
tccaccaagtcacgtc

SEQ ID NO: 23615 - DNA, 16 bp, Artificial Sequence
  synthetic [barcode part1]
gaactacaccttcgcc

SEQ ID NO: 23616 - DNA, 16 bp, Artificial Sequence
  synthetic [barcode part1]
gtactacacggtactg

SEQ ID NO: 23617 - DNA, 16 bp, Artificial Sequence
  synthetic [barcode part1]
atactgcgtaggtaag

SEQ ID NO: 23618 - DNA, 16 bp, Artificial Sequence
  synthetic [barcode part1]
tggagtgtatcagtag

SEQ ID NO: 23619 - DNA, 16 bp, Artificial Sequence
  synthetic [barcode part1]
tggttaggaccaatcc

SEQ ID NO: 23620 - DNA, 16 bp, Artificial Sequence
  synthetic [barcode part1]
tctggtcttagaggac

SEQ ID NO: 23621 - DNA, 16 bp, Artificial Sequence
  synthetic [barcode part1]
gcacgtcttcaatccg

SEQ ID NO: 23622 - DNA, 16 bp, Artificial Sequence
  synthetic [barcode part1]
tgtacgtactgcagtg

SEQ ID NO: 23623 - DNA, 16 bp, Artificial Sequence
  synthetic [barcode part1]
taacggcgactactgt

SEQ ID NO: 23624 - DNA, 16 bp, Artificial Sequence
  synthetic [barcode part1]
aacgatacaggtatcg

SEQ ID NO: 23625 - DNA, 16 bp, Artificial Sequence
  synthetic [barcode part1]
gtgcaaggagtcactg

SEQ ID NO: 23626 - DNA, 16 bp, Artificial Sequence
  synthetic [barcode part1]
ccagaaccagacaggt

SEQ ID NO: 23627 - DNA, 16 bp, Artificial Sequence
  synthetic [barcode part1]
caaggtgagatcgaag

SEQ ID NO: 23628 - DNA, 16 bp, Artificial Sequence
  synthetic [barcode part1]
actgcgagtctcaagt

SEQ ID NO: 23629 - DNA, 16 bp, Artificial Sequence
  synthetic [barcode part1]
attcttcacgcgttag

SEQ ID NO: 23630 - DNA, 16 bp, Artificial Sequence
  synthetic [barcode part1]
tgtgtggcactaacgt

SEQ ID NO: 23631 - DNA, 16 bp, Artificial Sequence
  synthetic [barcode part1]
agattgacggtgtgcg

SEQ ID NO: 23632 - DNA, 16 bp, Artificial Sequence
  synthetic [barcode part1]
attcgaggtaacgaac

SEQ ID NO: 23633 - DNA, 16 bp, Artificial Sequence
  synthetic [barcode part1]
attatccacggtaggc

SEQ ID NO: 23634 - DNA, 16 bp, Artificial Sequence
  synthetic [barcode part1]
gtgcaacttctaacct

SEQ ID NO: 23635 - DNA, 16 bp, Artificial Sequence
  synthetic [barcode part1]
ccgtagatcgtgtagt

SEQ ID NO: 23636 - DNA, 16 bp, Artificial Sequence
  synthetic [barcode part1]
taaggcctggtcaact

SEQ ID NO: 23637 - DNA, 16 bp, Artificial Sequence
  synthetic [barcode part1]
acgaaggtaactcggc

SEQ ID NO: 23638 - DNA, 16 bp, Artificial Sequence
  synthetic [barcode part1]
tacacacggttgatcg

SEQ ID NO: 23639 - DNA, 16 bp, Artificial Sequence
  synthetic [barcode part1]
gtctggatactatcct

SEQ ID NO: 23640 - DNA, 16 bp, Artificial Sequence
  synthetic [barcode part1]
ttctactgcggactcg

SEQ ID NO: 23641 - DNA, 16 bp, Artificial Sequence
  synthetic [barcode part1]
gatcgccacaacttag

SEQ ID NO: 23642 - DNA, 16 bp, Artificial Sequence
  synthetic [barcode part1]
tgtacagtgaggaatc

SEQ ID NO: 23643 - DNA, 16 bp, Artificial Sequence
  synthetic [barcode part1]
cctactaaccgttcct

SEQ ID NO: 23644 - DNA, 16 bp, Artificial Sequence
  synthetic [barcode part1]
gtcggaatcctaactg

SEQ ID NO: 23645 - DNA, 16 bp, Artificial Sequence
  synthetic [barcode part1]
atatacggactggcct

SEQ ID NO: 23646 - DNA, 16 bp, Artificial Sequence
  synthetic [barcode part1]
tgccttgaagtctgcc

SEQ ID NO: 23647 - DNA, 16 bp, Artificial Sequence
  synthetic [barcode part1]
taggcgcacacaattc

SEQ ID NO: 23648 - DNA, 16 bp, Artificial Sequence
  synthetic [barcode part1]
aggataaggatctgtc

SEQ ID NO: 23649 - DNA, 16 bp, Artificial Sequence
  synthetic [barcode part1]
tgactacctacgcaag

SEQ ID NO: 23650 - DNA, 16 bp, Artificial Sequence
  synthetic [barcode part1]
gatcctcttggtgtgc

SEQ ID NO: 23651 - DNA, 16 bp, Artificial Sequence
  synthetic [barcode part1]
acgaacgaggtctcag

SEQ ID NO: 23652 - DNA, 16 bp, Artificial Sequence
  synthetic [barcode part1]
aggttacgcaattcgc

SEQ ID NO: 23653 - DNA, 16 bp, Artificial Sequence
  synthetic [barcode part1]
aatctcttcggcgtgc

SEQ ID NO: 23654 - DNA, 16 bp, Artificial Sequence
  synthetic [barcode part1]
gtactagtcgaacgtc

SEQ ID NO: 23655 - DNA, 16 bp, Artificial Sequence
  synthetic [barcode part1]
aacgatcctccgtgtc

SEQ ID NO: 23656 - DNA, 16 bp, Artificial Sequence
  synthetic [barcode part1]
ttgcgtcgagtcgttc

SEQ ID NO: 23657 - DNA, 16 bp, Artificial Sequence
  synthetic [barcode part1]
gattggtaccaatcgc

SEQ ID NO: 23658 - DNA, 16 bp, Artificial Sequence
  synthetic [barcode part1]
actgacgcctacaagt

SEQ ID NO: 23659 - DNA, 16 bp, Artificial Sequence
  synthetic [barcode part1]
gatctgtcctattacg

SEQ ID NO: 23660 - DNA, 16 bp, Artificial Sequence
  synthetic [barcode part1]
tctctagtgcacagtt

SEQ ID NO: 23661 - DNA, 16 bp, Artificial Sequence
  synthetic [barcode part1]
tcttgacacacaacct

SEQ ID NO: 23662 - DNA, 16 bp, Artificial Sequence
  synthetic [barcode part1]
gtctagataaggcggc

SEQ ID NO: 23663 - DNA, 16 bp, Artificial Sequence
  synthetic [barcode part1]
ataccacacgataccg

SEQ ID NO: 23664 - DNA, 16 bp, Artificial Sequence
  synthetic [barcode part1]
tgactgagttgatcgc

SEQ ID NO: 23665 - DNA, 16 bp, Artificial Sequence
  synthetic [barcode part1]
ttgtgcagttgcacag

SEQ ID NO: 23666 - DNA, 16 bp, Artificial Sequence
  synthetic [barcode part1]
ttccagactgcgatag

SEQ ID NO: 23667 - DNA, 16 bp, Artificial Sequence
  synthetic [barcode part1]
agtgatctcttgtacc

SEQ ID NO: 23668 - DNA, 16 bp, Artificial Sequence
  synthetic [barcode part1]
ccaacgaggatatagt

SEQ ID NO: 23669 - DNA, 16 bp, Artificial Sequence
  synthetic [barcode part1]
tctacgaattcgcgag

SEQ ID NO: 23670 - DNA, 16 bp, Artificial Sequence
  synthetic [barcode part1]
gttgtctacctgtagt

SEQ ID NO: 23671 - DNA, 16 bp, Artificial Sequence
  synthetic [barcode part1]
taagaacgagtgcgag

SEQ ID NO: 23672 - DNA, 16 bp, Artificial Sequence
  synthetic [barcode part1]
accaataggcgacggt

SEQ ID NO: 23673 - DNA, 16 bp, Artificial Sequence
  synthetic [barcode part1]
gactgccacttagtag

SEQ ID NO: 23674 - DNA, 16 bp, Artificial Sequence
  synthetic [barcode part1]
ataccagtaacgagac

SEQ ID NO: 23675 - DNA, 16 bp, Artificial Sequence
  synthetic [barcode part1]
cgcctagtcttaccag

SEQ ID NO: 23676 - DNA, 16 bp, Artificial Sequence
  synthetic [barcode part1]
tcctcggcaatcacgt

SEQ ID NO: 23677 - DNA, 16 bp, Artificial Sequence
  synthetic [barcode part1]
gtacgactgtacggtt

SEQ ID NO: 23678 - DNA, 16 bp, Artificial Sequence
  synthetic [barcode part1]
tagtcggtagtcggtt

SEQ ID NO: 23679 - DNA, 16 bp, Artificial Sequence
  synthetic [barcode part1]
tgtcacaacgtgtgtg

SEQ ID NO: 23680 - DNA, 16 bp, Artificial Sequence
  synthetic [barcode part1]
tcttggatatccgccg

SEQ ID NO: 23681 - DNA, 16 bp, Artificial Sequence
  synthetic [barcode part1]
atcgttgtcttacacg

SEQ ID NO: 23682 - DNA, 16 bp, Artificial Sequence
  synthetic [barcode part1]
tggtggttaatccggt

SEQ ID NO: 23683 - DNA, 16 bp, Artificial Sequence
  synthetic [barcode part1]
tcacaacacgtacgtg

SEQ ID NO: 23684 - DNA, 16 bp, Artificial Sequence
  synthetic [barcode part1]
actagtggtagaacac

SEQ ID NO: 23685 - DNA, 16 bp, Artificial Sequence
  synthetic [barcode part1]
cggatacaccgaaggt

SEQ ID NO: 23686 - DNA, 16 bp, Artificial Sequence
  synthetic [barcode part1]
gatcgataaccttggc

SEQ ID NO: 23687 - DNA, 16 bp, Artificial Sequence
  synthetic [barcode part1]
tgcacttctcgacggt

SEQ ID NO: 23688 - DNA, 16 bp, Artificial Sequence
  synthetic [barcode part1]
gaagtgcaccgttgag

SEQ ID NO: 23689 - DNA, 16 bp, Artificial Sequence
  synthetic [barcode part1]
ccttaccgatacttag

SEQ ID NO: 23690 - DNA, 16 bp, Artificial Sequence
  synthetic [barcode part1]
actctccttggaagag

SEQ ID NO: 23691 - DNA, 16 bp, Artificial Sequence
  synthetic [barcode part1]
gtctgattgcgttccg

SEQ ID NO: 23692 - DNA, 16 bp, Artificial Sequence
  synthetic [barcode part1]
agataggagtgtcact

SEQ ID NO: 23693 - DNA, 16 bp, Artificial Sequence
  synthetic [barcode part1]
tctggtatatcctcag

SEQ ID NO: 23694 - DNA, 16 bp, Artificial Sequence
  synthetic [barcode part1]
gtcgcagtacctatcc

SEQ ID NO: 23695 - DNA, 16 bp, Artificial Sequence
  synthetic [barcode part1]
cgcagtctgtgttaag

SEQ ID NO: 23696 - DNA, 16 bp, Artificial Sequence
  synthetic [barcode part1]
gttgaggaccagtacg

SEQ ID NO: 23697 - DNA, 16 bp, Artificial Sequence
  synthetic [barcode part1]
tccgattggtcaaggt

SEQ ID NO: 23698 - DNA, 16 bp, Artificial Sequence
  synthetic [barcode part1]
gtgaactggaagttac

SEQ ID NO: 23699 - DNA, 16 bp, Artificial Sequence
  synthetic [barcode part1]
ccgcgtccagattatc

SEQ ID NO: 23700 - DNA, 16 bp, Artificial Sequence
  synthetic [barcode part1]
ccaatacgagactaag

SEQ ID NO: 23701 - DNA, 16 bp, Artificial Sequence
  synthetic [barcode part1]
agatattgcgacagac

SEQ ID NO: 23702 - DNA, 16 bp, Artificial Sequence
  synthetic [barcode part1]
aggtcgaactggtgtg

SEQ ID NO: 23703 - DNA, 16 bp, Artificial Sequence
  synthetic [barcode part1]
aactggtactgactgc

SEQ ID NO: 23704 - DNA, 16 bp, Artificial Sequence
  synthetic [barcode part1]
gtacacgcgactaact

SEQ ID NO: 23705 - DNA, 16 bp, Artificial Sequence
  synthetic [barcode part1]
cgtcttggcgaatctc

SEQ ID NO: 23706 - DNA, 16 bp, Artificial Sequence
  synthetic [barcode part1]
atccggatcgtgaact

SEQ ID NO: 23707 - DNA, 16 bp, Artificial Sequence
  synthetic [barcode part1]
gagagtaacggtccgt

SEQ ID NO: 23708 - DNA, 16 bp, Artificial Sequence
  synthetic [barcode part1]
cactcacaacaccgtc

SEQ ID NO: 23709 - DNA, 16 bp, Artificial Sequence
  synthetic [barcode part1]
atccaaccgcgttctg

SEQ ID NO: 23710 - DNA, 16 bp, Artificial Sequence
  synthetic [barcode part1]
ttgaccaggttgatcg

SEQ ID NO: 23711 - DNA, 16 bp, Artificial Sequence
  synthetic [barcode part1]
aggccgtaatagtctc

SEQ ID NO: 23712 - DNA, 16 bp, Artificial Sequence
  synthetic [barcode part1]
tctatcaccttcgacc

SEQ ID NO: 23713 - DNA, 16 bp, Artificial Sequence
  synthetic [barcode part1]
agaggtgttgccagac

SEQ ID NO: 23714 - DNA, 16 bp, Artificial Sequence
  synthetic [barcode part1]
cgtaacaaggcggatc

SEQ ID NO: 23715 - DNA, 16 bp, Artificial Sequence
  synthetic [barcode part1]
tggcacactagacact

SEQ ID NO: 23716 - DNA, 16 bp, Artificial Sequence
  synthetic [barcode part1]
tgcaacacaggtaggc

SEQ ID NO: 23717 - DNA, 16 bp, Artificial Sequence
  synthetic [barcode part1]
gagagatcggagaact

SEQ ID NO: 23718 - DNA, 16 bp, Artificial Sequence
  synthetic [barcode part1]
acgttgacgtggattc

SEQ ID NO: 23719 - DNA, 16 bp, Artificial Sequence
  synthetic [barcode part1]
ttacttcaccgaggag

SEQ ID NO: 23720 - DNA, 16 bp, Artificial Sequence
  synthetic [barcode part1]
gtggcacgttagttac

SEQ ID NO: 23721 - DNA, 16 bp, Artificial Sequence
  synthetic [barcode part1]
gttcgccacggtatct

SEQ ID NO: 23722 - DNA, 16 bp, Artificial Sequence
  synthetic [barcode part1]
tctgcgtgttatcggc

SEQ ID NO: 23723 - DNA, 16 bp, Artificial Sequence
  synthetic [barcode part1]
attaccggcgtaggag

SEQ ID NO: 23724 - DNA, 16 bp, Artificial Sequence
  synthetic [barcode part1]
cacttaccgtcgcagt

SEQ ID NO: 23725 - DNA, 16 bp, Artificial Sequence
  synthetic [barcode part1]
cgaagtgaacgcgttg

SEQ ID NO: 23726 - DNA, 16 bp, Artificial Sequence
  synthetic [barcode part1]
tcacagtgaggaagag

SEQ ID NO: 23727 - DNA, 16 bp, Artificial Sequence
  synthetic [barcode part1]
taaggcgttcagtctg

SEQ ID NO: 23728 - DNA, 16 bp, Artificial Sequence
  synthetic [barcode part1]
aaggacaggcgtaagt

SEQ ID NO: 23729 - DNA, 16 bp, Artificial Sequence
  synthetic [barcode part1]
ttgtaggacttcttgc

SEQ ID NO: 23730 - DNA, 16 bp, Artificial Sequence
  synthetic [barcode part1]
gcgttgcgaattctag

SEQ ID NO: 23731 - DNA, 16 bp, Artificial Sequence
  synthetic [barcode part1]
gttgatctcagagtcg

SEQ ID NO: 23732 - DNA, 16 bp, Artificial Sequence
  synthetic [barcode part1]
actacactacggatcg

SEQ ID NO: 23733 - DNA, 16 bp, Artificial Sequence
  synthetic [barcode part1]
gtgtcggcaatctctc

SEQ ID NO: 23734 - DNA, 16 bp, Artificial Sequence
  synthetic [barcode part1]
caccgccaagtattcc

SEQ ID NO: 23735 - DNA, 16 bp, Artificial Sequence
  synthetic [barcode part1]
gtgagacttactccag

SEQ ID NO: 23736 - DNA, 16 bp, Artificial Sequence
  synthetic [barcode part1]
ccttcgtagtacgaag

SEQ ID NO: 23737 - DNA, 16 bp, Artificial Sequence
  synthetic [barcode part1]
ccagaacacagtgtct

SEQ ID NO: 23738 - DNA, 16 bp, Artificial Sequence
  synthetic [barcode part1]
cgtaaggagttgccag

SEQ ID NO: 23739 - DNA, 16 bp, Artificial Sequence
  synthetic [barcode part1]
aagaccgagagtagtg

SEQ ID NO: 23740 - DNA, 16 bp, Artificial Sequence
  synthetic [barcode part1]
tgatcggtctcagagt

SEQ ID NO: 23741 - DNA, 16 bp, Artificial Sequence
  synthetic [barcode part1]
cctggttctccttaac

SEQ ID NO: 23742 - DNA, 16 bp, Artificial Sequence
  synthetic [barcode part1]
cggaccgactattagt

SEQ ID NO: 23743 - DNA, 16 bp, Artificial Sequence
  synthetic [barcode part1]
attgcgtaaggtagtg

SEQ ID NO: 23744 - DNA, 16 bp, Artificial Sequence
  synthetic [barcode part1]
gaatcacaacacagac

SEQ ID NO: 23745 - DNA, 16 bp, Artificial Sequence
  synthetic [barcode part1]
ataaccgtggcgtatc

SEQ ID NO: 23746 - DNA, 16 bp, Artificial Sequence
  synthetic [barcode part1]
agtacctcgttgacag

SEQ ID NO: 23747 - DNA, 16 bp, Artificial Sequence
  synthetic [barcode part1]
gactcctgtattcggc

SEQ ID NO: 23748 - DNA, 16 bp, Artificial Sequence
  synthetic [barcode part1]
aaggcggttactctgt

SEQ ID NO: 23749 - DNA, 16 bp, Artificial Sequence
  synthetic [barcode part1]
acgagagaatcgtcgc

SEQ ID NO: 23750 - DNA, 16 bp, Artificial Sequence
  synthetic [barcode part1]
gtcagaggattctctg

SEQ ID NO: 23751 - DNA, 16 bp, Artificial Sequence
  synthetic [barcode part1]
agttagtgcgtgcact

SEQ ID NO: 23752 - DNA, 16 bp, Artificial Sequence
  synthetic [barcode part1]
aatacgcctctccgac

SEQ ID NO: 23753 - DNA, 16 bp, Artificial Sequence
  synthetic [barcode part1]
ccttaccgttcgtgag

SEQ ID NO: 23754 - DNA, 16 bp, Artificial Sequence
  synthetic [barcode part1]
tagacgttgtggactc

SEQ ID NO: 23755 - DNA, 16 bp, Artificial Sequence
  synthetic [barcode part1]
acgaataagacggacg

SEQ ID NO: 23756 - DNA, 16 bp, Artificial Sequence
  synthetic [barcode part1]
cactctcaccgaatcg

SEQ ID NO: 23757 - DNA, 16 bp, Artificial Sequence
  synthetic [barcode part1]
ccgtcttcaacaagag

SEQ ID NO: 23758 - DNA, 16 bp, Artificial Sequence
  synthetic [barcode part1]
gagaataggcggttcc

SEQ ID NO: 23759 - DNA, 16 bp, Artificial Sequence
  synthetic [barcode part1]
tcacacttcactgagt

SEQ ID NO: 23760 - DNA, 16 bp, Artificial Sequence
  synthetic [barcode part1]
atatcgaatcgcctct

SEQ ID NO: 23761 - DNA, 16 bp, Artificial Sequence
  synthetic [barcode part1]
gatataggcgagaacg

SEQ ID NO: 23762 - DNA, 16 bp, Artificial Sequence
  synthetic [barcode part1]
caatcagaccagtcac

SEQ ID NO: 23763 - DNA, 16 bp, Artificial Sequence
  synthetic [barcode part1]
aactgactgacgttgc

SEQ ID NO: 23764 - DNA, 16 bp, Artificial Sequence
  synthetic [barcode part1]
cgaagttcgacgttac

SEQ ID NO: 23765 - DNA, 16 bp, Artificial Sequence
  synthetic [barcode part1]
actactgcaacaaccg

SEQ ID NO: 23766 - DNA, 16 bp, Artificial Sequence
  synthetic [barcode part1]
ttgttcggacgagtgt

SEQ ID NO: 23767 - DNA, 16 bp, Artificial Sequence
  synthetic [barcode part1]
agtcagtacaccacac

SEQ ID NO: 23768 - DNA, 16 bp, Artificial Sequence
  synthetic [barcode part1]
acgaaggactattgac

SEQ ID NO: 23769 - DNA, 16 bp, Artificial Sequence
  synthetic [barcode part1]
gtggtcagtcaacact

SEQ ID NO: 23770 - DNA, 16 bp, Artificial Sequence
  synthetic [barcode part1]
taagacacaccaacag

SEQ ID NO: 23771 - DNA, 16 bp, Artificial Sequence
  synthetic [barcode part1]
cacgagactggtaacg

SEQ ID NO: 23772 - DNA, 16 bp, Artificial Sequence
  synthetic [barcode part1]
atcgcaaggattccac

SEQ ID NO: 23773 - DNA, 16 bp, Artificial Sequence
  synthetic [barcode part1]
gttaccttcgtgagtt

SEQ ID NO: 23774 - DNA, 16 bp, Artificial Sequence
  synthetic [barcode part1]
gatacctacctgagtg

SEQ ID NO: 23775 - DNA, 16 bp, Artificial Sequence
  synthetic [barcode part1]
accgtgagagtagatt

SEQ ID NO: 23776 - DNA, 16 bp, Artificial Sequence
  synthetic [barcode part1]
cggactgagtctaatc

SEQ ID NO: 23777 - DNA, 16 bp, Artificial Sequence
  synthetic [barcode part1]
gtccgttgttcacttc

SEQ ID NO: 23778 - DNA, 16 bp, Artificial Sequence
  synthetic [barcode part1]
acggtaggcaagatag

SEQ ID NO: 23779 - DNA, 16 bp, Artificial Sequence
  synthetic [barcode part1]
aggcaagaacgttatc

SEQ ID NO: 23780 - DNA, 16 bp, Artificial Sequence
  synthetic [barcode part1]
tacggttcgtatcgag

SEQ ID NO: 23781 - DNA, 16 bp, Artificial Sequence
  synthetic [barcode part1]
tgtgcaactatcactc

SEQ ID NO: 23782 - DNA, 16 bp, Artificial Sequence
  synthetic [barcode part1]
tgtgccttgagtcacc

SEQ ID NO: 23783 - DNA, 16 bp, Artificial Sequence
  synthetic [barcode part1]
acaactgcctcaattc

SEQ ID NO: 23784 - DNA, 16 bp, Artificial Sequence
  synthetic [barcode part1]
tgtctgtgaatctcgt

SEQ ID NO: 23785 - DNA, 16 bp, Artificial Sequence
  synthetic [barcode part1]
cgtaactgccagagag

SEQ ID NO: 23786 - DNA, 16 bp, Artificial Sequence
  synthetic [barcode part1]
caacgagtgtccagag

SEQ ID NO: 23787 - DNA, 16 bp, Artificial Sequence
  synthetic [barcode part1]
gagacaatcgtgagtt

SEQ ID NO: 23788 - DNA, 16 bp, Artificial Sequence
  synthetic [barcode part1]
gcagagattgagttac

SEQ ID NO: 23789 - DNA, 16 bp, Artificial Sequence
  synthetic [barcode part1]
agataactctccggtg

SEQ ID NO: 23790 - DNA, 16 bp, Artificial Sequence
  synthetic [barcode part1]
gacctgacgatctagt

SEQ ID NO: 23791 - DNA, 16 bp, Artificial Sequence
  synthetic [barcode part1]
tataatctgcggaccg

SEQ ID NO: 23792 - DNA, 16 bp, Artificial Sequence
  synthetic [barcode part1]
atcaccaatcggatcg

SEQ ID NO: 23793 - DNA, 16 bp, Artificial Sequence
  synthetic [barcode part1]
gtcttagtgtaacgcg

SEQ ID NO: 23794 - DNA, 16 bp, Artificial Sequence
  synthetic [barcode part1]
gactcagttggcaact

SEQ ID NO: 23795 - DNA, 16 bp, Artificial Sequence
  synthetic [barcode part1]
cctggtctagtcacgt

SEQ ID NO: 23796 - DNA, 16 bp, Artificial Sequence
  synthetic [barcode part1]
taggccgcgtattctc

SEQ ID NO: 23797 - DNA, 16 bp, Artificial Sequence
  synthetic [barcode part1]
cacgtctctcaacgac

SEQ ID NO: 23798 - DNA, 16 bp, Artificial Sequence
  synthetic [barcode part1]
gccaccagttgttaag

SEQ ID NO: 23799 - DNA, 16 bp, Artificial Sequence
  synthetic [barcode part1]
gcgcaggtgaattacg

SEQ ID NO: 23800 - DNA, 16 bp, Artificial Sequence
  synthetic [barcode part1]
cggatactaacttcct

SEQ ID NO: 23801 - DNA, 16 bp, Artificial Sequence
  synthetic [barcode part1]
gagacaaggtgagact

SEQ ID NO: 23802 - DNA, 16 bp, Artificial Sequence
  synthetic [barcode part1]
tcgactcgaattggac

SEQ ID NO: 23803 - DNA, 16 bp, Artificial Sequence
  synthetic [barcode part1]
ttcacgatactatccg

SEQ ID NO: 23804 - DNA, 16 bp, Artificial Sequence
  synthetic [barcode part1]
cagttccgtcgtacac

SEQ ID NO: 23805 - DNA, 16 bp, Artificial Sequence
  synthetic [barcode part1]
tgtcctgagtgtctgc

SEQ ID NO: 23806 - DNA, 16 bp, Artificial Sequence
  synthetic [barcode part1]
tgcagatcgttcgaac

SEQ ID NO: 23807 - DNA, 16 bp, Artificial Sequence
  synthetic [barcode part1]
taccagtcacaaccag

SEQ ID NO: 23808 - DNA, 16 bp, Artificial Sequence
  synthetic [barcode part1]
aacctctctctaccgt

SEQ ID NO: 23809 - DNA, 16 bp, Artificial Sequence
  synthetic [barcode part1]
aacgagagaaggtcgt

SEQ ID NO: 23810 - DNA, 16 bp, Artificial Sequence
  synthetic [barcode part1]
tactggattcacactc

SEQ ID NO: 23811 - DNA, 16 bp, Artificial Sequence
  synthetic [barcode part1]
aattcaattccgtgcc

SEQ ID NO: 23812 - DNA, 16 bp, Artificial Sequence
  synthetic [barcode part1]
caagattccgaggtct

SEQ ID NO: 23813 - DNA, 16 bp, Artificial Sequence
  synthetic [barcode part1]
cgtaggttgttgtctt

SEQ ID NO: 23814 - DNA, 16 bp, Artificial Sequence
  synthetic [barcode part1]
gttgtacacacgatcg

SEQ ID NO: 23815 - DNA, 16 bp, Artificial Sequence
  synthetic [barcode part1]
actatccggacttgtt

SEQ ID NO: 23816 - DNA, 16 bp, Artificial Sequence
  synthetic [barcode part1]
aacggagtcagtatac

SEQ ID NO: 23817 - DNA, 16 bp, Artificial Sequence
  synthetic [barcode part1]
acctagtaatccgacg

SEQ ID NO: 23818 - DNA, 16 bp, Artificial Sequence
  synthetic [barcode part1]
ttaatccttcggcctc

SEQ ID NO: 23819 - DNA, 16 bp, Artificial Sequence
  synthetic [barcode part1]
agactcagtctcctgc

SEQ ID NO: 23820 - DNA, 16 bp, Artificial Sequence
  synthetic [barcode part1]
gtgtctcgtcgaatcc

SEQ ID NO: 23821 - DNA, 16 bp, Artificial Sequence
  synthetic [barcode part1]
cgacaaggaacttgcg

SEQ ID NO: 23822 - DNA, 16 bp, Artificial Sequence
  synthetic [barcode part1]
tccagtataaggacag

SEQ ID NO: 23823 - DNA, 16 bp, Artificial Sequence
  synthetic [barcode part1]
agaacggtgaagtgac

SEQ ID NO: 23824 - DNA, 16 bp, Artificial Sequence
  synthetic [barcode part1]
tcaggcgcctgttatc

SEQ ID NO: 23825 - DNA, 16 bp, Artificial Sequence
  synthetic [barcode part1]
ttggacgtaccgtcct

SEQ ID NO: 23826 - DNA, 16 bp, Artificial Sequence
  synthetic [barcode part1]
accacaatattcgtcc

SEQ ID NO: 23827 - DNA, 16 bp, Artificial Sequence
  synthetic [barcode part1]
tatccagactatctcg

SEQ ID NO: 23828 - DNA, 16 bp, Artificial Sequence
  synthetic [barcode part1]
aacgataacctcgtcg

SEQ ID NO: 23829 - DNA, 16 bp, Artificial Sequence
  synthetic [barcode part1]
tcctgaccagtagaac

SEQ ID NO: 23830 - DNA, 16 bp, Artificial Sequence
  synthetic [barcode part1]
gtgccaggagaactac

SEQ ID NO: 23831 - DNA, 16 bp, Artificial Sequence
  synthetic [barcode part1]
gtgatcacttcagttc

SEQ ID NO: 23832 - DNA, 16 bp, Artificial Sequence
  synthetic [barcode part1]
ccggatcttctgtgtg

SEQ ID NO: 23833 - DNA, 16 bp, Artificial Sequence
  synthetic [barcode part1]
atctactccacgacgc

SEQ ID NO: 23834 - DNA, 16 bp, Artificial Sequence
  synthetic [barcode part1]
ttccagtccggtacgt

SEQ ID NO: 23835 - DNA, 16 bp, Artificial Sequence
  synthetic [barcode part1]
gccgacgagatatctt

SEQ ID NO: 23836 - DNA, 16 bp, Artificial Sequence
  synthetic [barcode part1]
ccttgcgccagtgatt

SEQ ID NO: 23837 - DNA, 16 bp, Artificial Sequence
  synthetic [barcode part1]
tagtgcgtaacgaagt

SEQ ID NO: 23838 - DNA, 16 bp, Artificial Sequence
  synthetic [barcode part1]
tgtagactgagtgtcc

SEQ ID NO: 23839 - DNA, 16 bp, Artificial Sequence
  synthetic [barcode part1]
gacctagttggcagtt

SEQ ID NO: 23840 - DNA, 16 bp, Artificial Sequence
  synthetic [barcode part1]
cgttagatctggcaac

SEQ ID NO: 23841 - DNA, 16 bp, Artificial Sequence
  synthetic [barcode part1]
atcacctaggcagtgt

SEQ ID NO: 23842 - DNA, 16 bp, Artificial Sequence
  synthetic [barcode part1]
gcgacctgttcttacg

SEQ ID NO: 23843 - DNA, 16 bp, Artificial Sequence
  synthetic [barcode part1]
aggtccactgttgcct

SEQ ID NO: 23844 - DNA, 16 bp, Artificial Sequence
  synthetic [barcode part1]
gacgagttcgcgatag

SEQ ID NO: 23845 - DNA, 16 bp, Artificial Sequence
  synthetic [barcode part1]
tgcaggttgaggcagt

SEQ ID NO: 23846 - DNA, 16 bp, Artificial Sequence
  synthetic [barcode part1]
ttgtcgagtcaagtcg

SEQ ID NO: 23847 - DNA, 16 bp, Artificial Sequence
  synthetic [barcode part1]
acctcggattgatcag

SEQ ID NO: 23848 - DNA, 16 bp, Artificial Sequence
  synthetic [barcode part1]
aggtctgcctaatctt

SEQ ID NO: 23849 - DNA, 16 bp, Artificial Sequence
  synthetic [barcode part1]
cgaaggtgaacacaag

SEQ ID NO: 23850 - DNA, 16 bp, Artificial Sequence
  synthetic [barcode part1]
tcttgtactggatcac

SEQ ID NO: 23851 - DNA, 16 bp, Artificial Sequence
  synthetic [barcode part1]
aacactgcagtcaacc

SEQ ID NO: 23852 - DNA, 16 bp, Artificial Sequence
  synthetic [barcode part1]
cgaaggtattcggcag

SEQ ID NO: 23853 - DNA, 16 bp, Artificial Sequence
  synthetic [barcode part1]
gacgagttaggatccg

SEQ ID NO: 23854 - DNA, 16 bp, Artificial Sequence
  synthetic [barcode part1]
gcgtagttctcggtct

SEQ ID NO: 23855 - DNA, 16 bp, Artificial Sequence
  synthetic [barcode part1]
tgttgccacaggatac

SEQ ID NO: 23856 - DNA, 16 bp, Artificial Sequence
  synthetic [barcode part1]
gcagtcacgcgtaatt

SEQ ID NO: 23857 - DNA, 16 bp, Artificial Sequence
  synthetic [barcode part1]
cactaggcagatcgtt

SEQ ID NO: 23858 - DNA, 16 bp, Artificial Sequence
  synthetic [barcode part1]
tagacgccttcgtcgt

SEQ ID NO: 23859 - DNA, 16 bp, Artificial Sequence
  synthetic [barcode part1]
aaggacaagtggtctt

SEQ ID NO: 23860 - DNA, 16 bp, Artificial Sequence
  synthetic [barcode part1]
tacgcgacactccgtt

SEQ ID NO: 23861 - DNA, 16 bp, Artificial Sequence
  synthetic [barcode part1]
gtcctggttgaagttg

SEQ ID NO: 23862 - DNA, 16 bp, Artificial Sequence
  synthetic [barcode part1]
aagttcgactctccgc

SEQ ID NO: 23863 - DNA, 16 bp, Artificial Sequence
  synthetic [barcode part1]
gagtacgtcgaaccag

SEQ ID NO: 23864 - DNA, 16 bp, Artificial Sequence
  synthetic [barcode part1]
tctgagtaacgacaag

SEQ ID NO: 23865 - DNA, 16 bp, Artificial Sequence
  synthetic [barcode part1]
gtcttgcgtctagacc

SEQ ID NO: 23866 - DNA, 16 bp, Artificial Sequence
  synthetic [barcode part1]
tggtgatccgaactac

SEQ ID NO: 23867 - DNA, 16 bp, Artificial Sequence
  synthetic [barcode part1]
tagtattcaggcgaag

SEQ ID NO: 23868 - DNA, 16 bp, Artificial Sequence
  synthetic [barcode part1]
aaggtattggcaatcg

SEQ ID NO: 23869 - DNA, 16 bp, Artificial Sequence
  synthetic [barcode part1]
gcgaattccggatatc

SEQ ID NO: 23870 - DNA, 16 bp, Artificial Sequence
  synthetic [barcode part1]
tgaactcgttcgtgag

SEQ ID NO: 23871 - DNA, 16 bp, Artificial Sequence
  synthetic [barcode part1]
actgaatcactcctgt

SEQ ID NO: 23872 - DNA, 16 bp, Artificial Sequence
  synthetic [barcode part1]
actctacggaccaagt

SEQ ID NO: 23873 - DNA, 16 bp, Artificial Sequence
  synthetic [barcode part1]
agtactggatctcgac

SEQ ID NO: 23874 - DNA, 16 bp, Artificial Sequence
  synthetic [barcode part1]
gttcgcctattgtagt

SEQ ID NO: 23875 - DNA, 16 bp, Artificial Sequence
  synthetic [barcode part1]
agactcgacgactgtt

SEQ ID NO: 23876 - DNA, 16 bp, Artificial Sequence
  synthetic [barcode part1]
gaatcctcaatcgacg

SEQ ID NO: 23877 - DNA, 16 bp, Artificial Sequence
  synthetic [barcode part1]
gttcctcacgtcaacg

SEQ ID NO: 23878 - DNA, 16 bp, Artificial Sequence
  synthetic [barcode part1]
tggtgccagtgaacag

SEQ ID NO: 23879 - DNA, 16 bp, Artificial Sequence
  synthetic [barcode part1]
acgtggaataacctag

SEQ ID NO: 23880 - DNA, 16 bp, Artificial Sequence
  synthetic [barcode part1]
gttatcgacactcttg

SEQ ID NO: 23881 - DNA, 16 bp, Artificial Sequence
  synthetic [barcode part1]
tctggaatctctctcc

SEQ ID NO: 23882 - DNA, 16 bp, Artificial Sequence
  synthetic [barcode part1]
gacggattctaggacg

SEQ ID NO: 23883 - DNA, 16 bp, Artificial Sequence
  synthetic [barcode part1]
tatactaccgatcctg

SEQ ID NO: 23884 - DNA, 16 bp, Artificial Sequence
  synthetic [barcode part1]
ttacttgtaccgtgac

SEQ ID NO: 23885 - DNA, 16 bp, Artificial Sequence
  synthetic [barcode part1]
gtattgccttgaggtg

SEQ ID NO: 23886 - DNA, 16 bp, Artificial Sequence
  synthetic [barcode part1]
gagtatagaggcgtag

SEQ ID NO: 23887 - DNA, 16 bp, Artificial Sequence
  synthetic [barcode part1]
tataggcctcaagtgc

SEQ ID NO: 23888 - DNA, 16 bp, Artificial Sequence
  synthetic [barcode part1]
aacctagtcgaatcgc

SEQ ID NO: 23889 - DNA, 16 bp, Artificial Sequence
  synthetic [barcode part1]
gttcctagaatcgtct

SEQ ID NO: 23890 - DNA, 16 bp, Artificial Sequence
  synthetic [barcode part1]
acacggtgagatcggt

SEQ ID NO: 23891 - DNA, 16 bp, Artificial Sequence
  synthetic [barcode part1]
aacaacagtctcaccg

SEQ ID NO: 23892 - DNA, 16 bp, Artificial Sequence
  synthetic [barcode part1]
atcaataccgtcactc

SEQ ID NO: 23893 - DNA, 16 bp, Artificial Sequence
  synthetic [barcode part1]
gcaggagttctgtact

SEQ ID NO: 23894 - DNA, 16 bp, Artificial Sequence
  synthetic [barcode part1]
aggcgatagaacagtg

SEQ ID NO: 23895 - DNA, 16 bp, Artificial Sequence
  synthetic [barcode part1]
gaagacgtaagaacgc

SEQ ID NO: 23896 - DNA, 16 bp, Artificial Sequence
  synthetic [barcode part1]
tggccacgtagaacag

SEQ ID NO: 23897 - DNA, 16 bp, Artificial Sequence
  synthetic [barcode part1]
tagactcggcaagacg

SEQ ID NO: 23898 - DNA, 16 bp, Artificial Sequence
  synthetic [barcode part1]
aaccaacgtcagtcac

SEQ ID NO: 23899 - DNA, 16 bp, Artificial Sequence
  synthetic [barcode part1]
gagtgtctcacagact

SEQ ID NO: 23900 - DNA, 16 bp, Artificial Sequence
  synthetic [barcode part1]
gagacgtactgccaag

SEQ ID NO: 23901 - DNA, 16 bp, Artificial Sequence
  synthetic [barcode part1]
gttaacggcggttatc

SEQ ID NO: 23902 - DNA, 16 bp, Artificial Sequence
  synthetic [barcode part1]
acaacgcgaagttcct

SEQ ID NO: 23903 - DNA, 16 bp, Artificial Sequence
  synthetic [barcode part1]
accgcctacaggttct

SEQ ID NO: 23904 - DNA, 16 bp, Artificial Sequence
  synthetic [barcode part1]
agtgcgtggaaccagt

SEQ ID NO: 23905 - DNA, 16 bp, Artificial Sequence
  synthetic [barcode part1]
atatccttctccgcac

SEQ ID NO: 23906 - DNA, 16 bp, Artificial Sequence
  synthetic [barcode part1]
acgtatcaggtgttcg

SEQ ID NO: 23907 - DNA, 16 bp, Artificial Sequence
  synthetic [barcode part1]
cgtcctagaatagtgc

SEQ ID NO: 23908 - DNA, 16 bp, Artificial Sequence
  synthetic [barcode part1]
gcagtacgtacacact

SEQ ID NO: 23909 - DNA, 16 bp, Artificial Sequence
  synthetic [barcode part1]
tcggtatccagtctcg

SEQ ID NO: 23910 - DNA, 16 bp, Artificial Sequence
  synthetic [barcode part1]
gtcagagagagaatcg

SEQ ID NO: 23911 - DNA, 16 bp, Artificial Sequence
  synthetic [barcode part1]
ttgttgtgtgacaggc

SEQ ID NO: 23912 - DNA, 16 bp, Artificial Sequence
  synthetic [barcode part1]
gacgtacagaaggcct

SEQ ID NO: 23913 - DNA, 16 bp, Artificial Sequence
  synthetic [barcode part1]
cgccactaagtgcctt

SEQ ID NO: 23914 - DNA, 16 bp, Artificial Sequence
  synthetic [barcode part1]
tcctgcgttagtagtt

SEQ ID NO: 23915 - DNA, 16 bp, Artificial Sequence
  synthetic [barcode part1]
atagattaccgaaggc

SEQ ID NO: 23916 - DNA, 16 bp, Artificial Sequence
  synthetic [barcode part1]
aggataactgcaagtc

SEQ ID NO: 23917 - DNA, 16 bp, Artificial Sequence
  synthetic [barcode part1]
gaccgactgatactac

SEQ ID NO: 23918 - DNA, 16 bp, Artificial Sequence
  synthetic [barcode part1]
atctaccacctcaagt

SEQ ID NO: 23919 - DNA, 16 bp, Artificial Sequence
  synthetic [barcode part1]
cgactggtagttagtc

SEQ ID NO: 23920 - DNA, 16 bp, Artificial Sequence
  synthetic [barcode part1]
tcagacaacttgtggc

SEQ ID NO: 23921 - DNA, 16 bp, Artificial Sequence
  synthetic [barcode part1]
atcacgtggagtgacg

SEQ ID NO: 23922 - DNA, 16 bp, Artificial Sequence
  synthetic [barcode part1]
tagtgtgacgtgactc

SEQ ID NO: 23923 - DNA, 16 bp, Artificial Sequence
  synthetic [barcode part1]
aggtgactcagacgtg

SEQ ID NO: 23924 - DNA, 16 bp, Artificial Sequence
  synthetic [barcode part1]
tatcaccaacgacggt

SEQ ID NO: 23925 - DNA, 16 bp, Artificial Sequence
  synthetic [barcode part1]
gccttaattggaaccg

SEQ ID NO: 23926 - DNA, 16 bp, Artificial Sequence
  synthetic [barcode part1]
caggtgaggtactacg

SEQ ID NO: 23927 - DNA, 16 bp, Artificial Sequence
  synthetic [barcode part1]
ccgcgtcttcagtaac

SEQ ID NO: 23928 - DNA, 16 bp, Artificial Sequence
  synthetic [barcode part1]
gcacgtgaactgattc

SEQ ID NO: 23929 - DNA, 16 bp, Artificial Sequence
  synthetic [barcode part1]
gcactgaccaagtgtt

SEQ ID NO: 23930 - DNA, 16 bp, Artificial Sequence
  synthetic [barcode part1]
cgttactaggtcgagt

SEQ ID NO: 23931 - DNA, 16 bp, Artificial Sequence
  synthetic [barcode part1]
gcaggtaacttatccg

SEQ ID NO: 23932 - DNA, 16 bp, Artificial Sequence
  synthetic [barcode part1]
tagactatcctcacgt

SEQ ID NO: 23933 - DNA, 16 bp, Artificial Sequence
  synthetic [barcode part1]
tccttggcgattacgc

SEQ ID NO: 23934 - DNA, 16 bp, Artificial Sequence
  synthetic [barcode part1]
cgacgcaaggacaatc

SEQ ID NO: 23935 - DNA, 16 bp, Artificial Sequence
  synthetic [barcode part1]
aagtgcctccgtcgtt

SEQ ID NO: 23936 - DNA, 16 bp, Artificial Sequence
  synthetic [barcode part1]
tcaatcctcaccgtct

SEQ ID NO: 23937 - DNA, 16 bp, Artificial Sequence
  synthetic [barcode part1]
caacttggcgaaggtg

SEQ ID NO: 23938 - DNA, 16 bp, Artificial Sequence
  synthetic [barcode part1]
attggcagttcgagtc

SEQ ID NO: 23939 - DNA, 16 bp, Artificial Sequence
  synthetic [barcode part1]
gtaagattcgtgaacg

SEQ ID NO: 23940 - DNA, 16 bp, Artificial Sequence
  synthetic [barcode part1]
cacgtgccaatatcag

SEQ ID NO: 23941 - DNA, 16 bp, Artificial Sequence
  synthetic [barcode part1]
gttgttgtacgtcttg

SEQ ID NO: 23942 - DNA, 16 bp, Artificial Sequence
  synthetic [barcode part1]
acaccttgcactctct

SEQ ID NO: 23943 - DNA, 16 bp, Artificial Sequence
  synthetic [barcode part1]
aataaggcacgagttc

SEQ ID NO: 23944 - DNA, 16 bp, Artificial Sequence
  synthetic [barcode part1]
caccttaccacagatt

SEQ ID NO: 23945 - DNA, 16 bp, Artificial Sequence
  synthetic [barcode part1]
aggagtccacaattag

SEQ ID NO: 23946 - DNA, 16 bp, Artificial Sequence
  synthetic [barcode part1]
agaactattaggcacg

SEQ ID NO: 23947 - DNA, 16 bp, Artificial Sequence
  synthetic [barcode part1]
gcgagtctcttcgatc

SEQ ID NO: 23948 - DNA, 16 bp, Artificial Sequence
  synthetic [barcode part1]
gttatccacctcgtct

SEQ ID NO: 23949 - DNA, 16 bp, Artificial Sequence
  synthetic [barcode part1]
ttggcgaacggagact

SEQ ID NO: 23950 - DNA, 16 bp, Artificial Sequence
  synthetic [barcode part1]
agagaagaggaccttg

SEQ ID NO: 23951 - DNA, 16 bp, Artificial Sequence
  synthetic [barcode part1]
cgttccggacaagatt

SEQ ID NO: 23952 - DNA, 16 bp, Artificial Sequence
  synthetic [barcode part1]
gtctaaccgtgttccg

SEQ ID NO: 23953 - DNA, 16 bp, Artificial Sequence
  synthetic [barcode part1]
taatcggcggtactac

SEQ ID NO: 23954 - DNA, 16 bp, Artificial Sequence
  synthetic [barcode part1]
ttggcggtgttctcac

SEQ ID NO: 23955 - DNA, 16 bp, Artificial Sequence
  synthetic [barcode part1]
gcgaatcaaggtaact

SEQ ID NO: 23956 - DNA, 16 bp, Artificial Sequence
  synthetic [barcode part1]
tgttcacggtgttact

SEQ ID NO: 23957 - DNA, 16 bp, Artificial Sequence
  synthetic [barcode part1]
cgtaacggtagtacct

SEQ ID NO: 23958 - DNA, 16 bp, Artificial Sequence
  synthetic [barcode part1]
gttcgccgataagtgt

SEQ ID NO: 23959 - DNA, 16 bp, Artificial Sequence
  synthetic [barcode part1]
actacttgtgagtctc

SEQ ID NO: 23960 - DNA, 16 bp, Artificial Sequence
  synthetic [barcode part1]
ttccggttagtccttc

SEQ ID NO: 23961 - DNA, 16 bp, Artificial Sequence
  synthetic [barcode part1]
tgtaggtccacaagtc

SEQ ID NO: 23962 - DNA, 16 bp, Artificial Sequence
  synthetic [barcode part1]
ttctgtactctgcgtc

SEQ ID NO: 23963 - DNA, 16 bp, Artificial Sequence
  synthetic [barcode part1]
taagtcacctccgcgt

SEQ ID NO: 23964 - DNA, 16 bp, Artificial Sequence
  synthetic [barcode part1]
actcagtacacctccg

SEQ ID NO: 23965 - DNA, 16 bp, Artificial Sequence
  synthetic [barcode part1]
attacctgcagatctc

SEQ ID NO: 23966 - DNA, 16 bp, Artificial Sequence
  synthetic [barcode part1]
ttaacctactcgagtc

SEQ ID NO: 23967 - DNA, 16 bp, Artificial Sequence
  synthetic [barcode part1]
gttctactaccaacgt

SEQ ID NO: 23968 - DNA, 16 bp, Artificial Sequence
  synthetic [barcode part1]
aaccgttagtacagag

SEQ ID NO: 23969 - DNA, 16 bp, Artificial Sequence
  synthetic [barcode part1]
ttgacggtaccgagtt

SEQ ID NO: 23970 - DNA, 16 bp, Artificial Sequence
  synthetic [barcode part1]
caagttaggtccggtt

SEQ ID NO: 23971 - DNA, 16 bp, Artificial Sequence
  synthetic [barcode part1]
agtgcgaggactatcg

SEQ ID NO: 23972 - DNA, 16 bp, Artificial Sequence
  synthetic [barcode part1]
acacgaggaatcaccg

SEQ ID NO: 23973 - DNA, 16 bp, Artificial Sequence
  synthetic [barcode part1]
ttatacaccttgaccg

SEQ ID NO: 23974 - DNA, 16 bp, Artificial Sequence
  synthetic [barcode part1]
gagatctagacaagtc

SEQ ID NO: 23975 - DNA, 16 bp, Artificial Sequence
  synthetic [barcode part1]
gatactgcagtatcgc

SEQ ID NO: 23976 - DNA, 16 bp, Artificial Sequence
  synthetic [barcode part1]
ttccttcttgaccgac

SEQ ID NO: 23977 - DNA, 16 bp, Artificial Sequence
  synthetic [barcode part1]
caatctgactcggtag

SEQ ID NO: 23978 - DNA, 16 bp, Artificial Sequence
  synthetic [barcode part1]
aagtctgagtaacgac

SEQ ID NO: 23979 - DNA, 16 bp, Artificial Sequence
  synthetic [barcode part1]
ccaacggtaagttgtc

SEQ ID NO: 23980 - DNA, 16 bp, Artificial Sequence
  synthetic [barcode part1]
gtaccagtgcgaactt

SEQ ID NO: 23981 - DNA, 16 bp, Artificial Sequence
  synthetic [barcode part1]
aagacttgcggcactt

SEQ ID NO: 23982 - DNA, 16 bp, Artificial Sequence
  synthetic [barcode part1]
gactgtgtgacacact

SEQ ID NO: 23983 - DNA, 16 bp, Artificial Sequence
  synthetic [barcode part1]
acggtcgaatcgagac

SEQ ID NO: 23984 - DNA, 16 bp, Artificial Sequence
  synthetic [barcode part1]
acttctgacggtccgt

SEQ ID NO: 23985 - DNA, 16 bp, Artificial Sequence
  synthetic [barcode part1]
ccagagatccttagtg

SEQ ID NO: 23986 - DNA, 16 bp, Artificial Sequence
  synthetic [barcode part1]
tacgcggcaagaagtc

SEQ ID NO: 23987 - DNA, 16 bp, Artificial Sequence
  synthetic [barcode part1]
acttcagacacacgtg

SEQ ID NO: 23988 - DNA, 16 bp, Artificial Sequence
  synthetic [barcode part1]
aagtcctccgatcaag

SEQ ID NO: 23989 - DNA, 16 bp, Artificial Sequence
  synthetic [barcode part1]
atcctagttaaggccg

SEQ ID NO: 23990 - DNA, 16 bp, Artificial Sequence
  synthetic [barcode part1]
ccgataggcagaggtt

SEQ ID NO: 23991 - DNA, 16 bp, Artificial Sequence
  synthetic [barcode part1]
actcaccagtgtcgtc

SEQ ID NO: 23992 - DNA, 16 bp, Artificial Sequence
  synthetic [barcode part1]
gacgttgtggtcagtt

SEQ ID NO: 23993 - DNA, 16 bp, Artificial Sequence
  synthetic [barcode part1]
cgagtgtctgatacgt

SEQ ID NO: 23994 - DNA, 16 bp, Artificial Sequence
  synthetic [barcode part1]
gttgacaggatcggac

SEQ ID NO: 23995 - DNA, 16 bp, Artificial Sequence
  synthetic [barcode part1]
acactcttcaagtcgt

SEQ ID NO: 23996 - DNA, 16 bp, Artificial Sequence
  synthetic [barcode part1]
ccacctataccacgac

SEQ ID NO: 23997 - DNA, 16 bp, Artificial Sequence
  synthetic [barcode part1]
cgcgaggcaacttaag

SEQ ID NO: 23998 - DNA, 16 bp, Artificial Sequence
  synthetic [barcode part1]
tgcgttacgcaatcag

SEQ ID NO: 23999 - DNA, 16 bp, Artificial Sequence
  synthetic [barcode part1]
acgattctaggaacag

SEQ ID NO: 24000 - DNA, 16 bp, Artificial Sequence
  synthetic [barcode part1]
tatctgttaccgtgac

SEQ ID NO: 24001 - DNA, 16 bp, Artificial Sequence
  synthetic [barcode part1]
gcgaatcagttcacgt

SEQ ID NO: 24002 - DNA, 16 bp, Artificial Sequence
  synthetic [barcode part1]
acgtcaactctcgacc

SEQ ID NO: 24003 - DNA, 16 bp, Artificial Sequence
  synthetic [barcode part1]
gccagactacttctgc

SEQ ID NO: 24004 - DNA, 16 bp, Artificial Sequence
  synthetic [barcode part1]
caagttgaacctggtc

SEQ ID NO: 24005 - DNA, 16 bp, Artificial Sequence
  synthetic [barcode part1]
caacggactgtgagtg

SEQ ID NO: 24006 - DNA, 16 bp, Artificial Sequence
  synthetic [barcode part1]
tcactcgaatatcgtc

SEQ ID NO: 24007 - DNA, 16 bp, Artificial Sequence
  synthetic [barcode part1]
taccaagtaggtcgtc

SEQ ID NO: 24008 - DNA, 16 bp, Artificial Sequence
  synthetic [barcode part1]
caagtaccgatcctcc

SEQ ID NO: 24009 - DNA, 16 bp, Artificial Sequence
  synthetic [barcode part1]
ttacgaatccgcgagt

SEQ ID NO: 24010 - DNA, 16 bp, Artificial Sequence
  synthetic [barcode part1]
agttcagtgacagtcc

SEQ ID NO: 24011 - DNA, 16 bp, Artificial Sequence
  synthetic [barcode part1]
tctatacctggtgatc

SEQ ID NO: 24012 - DNA, 16 bp, Artificial Sequence
  synthetic [barcode part1]
agtagagttgacacgt

SEQ ID NO: 24013 - DNA, 16 bp, Artificial Sequence
  synthetic [barcode part1]
gtgcacaggttagtct

SEQ ID NO: 24014 - DNA, 16 bp, Artificial Sequence
  synthetic [barcode part1]
ccttcgagtaccagtc

SEQ ID NO: 24015 - DNA, 16 bp, Artificial Sequence
  synthetic [barcode part1]
gcaggaagtcgaactc

SEQ ID NO: 24016 - DNA, 16 bp, Artificial Sequence
  synthetic [barcode part1]
ttgcaagagtgacaac

SEQ ID NO: 24017 - DNA, 16 bp, Artificial Sequence
  synthetic [barcode part1]
gccagaccaaggatac

SEQ ID NO: 24018 - DNA, 16 bp, Artificial Sequence
  synthetic [barcode part1]
aggccgtgagttattc

SEQ ID NO: 24019 - DNA, 16 bp, Artificial Sequence
  synthetic [barcode part1]
acgtacagtcgattgc

SEQ ID NO: 24020 - DNA, 16 bp, Artificial Sequence
  synthetic [barcode part1]
tctgtattggcagttc

SEQ ID NO: 24021 - DNA, 16 bp, Artificial Sequence
  synthetic [barcode part1]
tccgcgaaccttactg

SEQ ID NO: 24022 - DNA, 16 bp, Artificial Sequence
  synthetic [barcode part1]
cgtagtggtccgttct

SEQ ID NO: 24023 - DNA, 16 bp, Artificial Sequence
  synthetic [barcode part1]
cacttgacttccgacg

SEQ ID NO: 24024 - DNA, 16 bp, Artificial Sequence
  synthetic [barcode part1]
ttggaaccaagacctc

SEQ ID NO: 24025 - DNA, 16 bp, Artificial Sequence
  synthetic [barcode part1]
tgagaggacaccaacc

SEQ ID NO: 24026 - DNA, 16 bp, Artificial Sequence
  synthetic [barcode part1]
ttaccagtggcaactg

SEQ ID NO: 24027 - DNA, 16 bp, Artificial Sequence
  synthetic [barcode part1]
gcctgaactgtaggtt

SEQ ID NO: 24028 - DNA, 16 bp, Artificial Sequence
  synthetic [barcode part1]
atagaacggcgaagtg

SEQ ID NO: 24029 - DNA, 16 bp, Artificial Sequence
  synthetic [barcode part1]
accacgcgttaggaag

SEQ ID NO: 24030 - DNA, 16 bp, Artificial Sequence
  synthetic [barcode part1]
ttgagtgtggaacaac

SEQ ID NO: 24031 - DNA, 16 bp, Artificial Sequence
  synthetic [barcode part1]
ttccttctgcgtacac

SEQ ID NO: 24032 - DNA, 16 bp, Artificial Sequence
  synthetic [barcode part1]
ccagacagtcctgtct

SEQ ID NO: 24033 - DNA, 16 bp, Artificial Sequence
  synthetic [barcode part1]
gactagtccttggaac

SEQ ID NO: 24034 - DNA, 16 bp, Artificial Sequence
  synthetic [barcode part1]
tcaacacggaggactg

SEQ ID NO: 24035 - DNA, 16 bp, Artificial Sequence
  synthetic [barcode part1]
actgtctcgagtgcct

SEQ ID NO: 24036 - DNA, 16 bp, Artificial Sequence
  synthetic [barcode part1]
tgattctccggtcttc

SEQ ID NO: 24037 - DNA, 16 bp, Artificial Sequence
  synthetic [barcode part1]
aggacttgagtctcac

SEQ ID NO: 24038 - DNA, 16 bp, Artificial Sequence
  synthetic [barcode part1]
acttgccgacactgtc

SEQ ID NO: 24039 - DNA, 16 bp, Artificial Sequence
  synthetic [barcode part1]
tagtgactgcaagaac

SEQ ID NO: 24040 - DNA, 16 bp, Artificial Sequence
  synthetic [barcode part1]
gaacgtgtgataatcg

SEQ ID NO: 24041 - DNA, 16 bp, Artificial Sequence
  synthetic [barcode part1]
agagtctaagtagacc

SEQ ID NO: 24042 - DNA, 16 bp, Artificial Sequence
  synthetic [barcode part1]
caccactacaaggtac

SEQ ID NO: 24043 - DNA, 16 bp, Artificial Sequence
  synthetic [barcode part1]
tgaataggacgttgtg

SEQ ID NO: 24044 - DNA, 16 bp, Artificial Sequence
  synthetic [barcode part1]
tccaaccgttgcgtac

SEQ ID NO: 24045 - DNA, 16 bp, Artificial Sequence
  synthetic [barcode part1]
attcctgagtgcaggt

SEQ ID NO: 24046 - DNA, 16 bp, Artificial Sequence
  synthetic [barcode part1]
atagtcaggagaacct

SEQ ID NO: 24047 - DNA, 16 bp, Artificial Sequence
  synthetic [barcode part1]
gtgtcgcctattcgtg

SEQ ID NO: 24048 - DNA, 16 bp, Artificial Sequence
  synthetic [barcode part1]
cagtagtccgaactac

SEQ ID NO: 24049 - DNA, 16 bp, Artificial Sequence
  synthetic [barcode part1]
gactgttccacactcg

SEQ ID NO: 24050 - DNA, 16 bp, Artificial Sequence
  synthetic [barcode part1]
tgtaatagacaccgcc

SEQ ID NO: 24051 - DNA, 16 bp, Artificial Sequence
  synthetic [barcode part1]
gtacagtagaaccaac

SEQ ID NO: 24052 - DNA, 16 bp, Artificial Sequence
  synthetic [barcode part1]
ttcaccgatcactctc

SEQ ID NO: 24053 - DNA, 16 bp, Artificial Sequence
  synthetic [barcode part1]
cgtggtctctcgttag

SEQ ID NO: 24054 - DNA, 16 bp, Artificial Sequence
  synthetic [barcode part1]
tgccagacagactact

SEQ ID NO: 24055 - DNA, 16 bp, Artificial Sequence
  synthetic [barcode part1]
tagacctctgtaggtg

SEQ ID NO: 24056 - DNA, 16 bp, Artificial Sequence
  synthetic [barcode part1]
cgttcgtcgttataac

SEQ ID NO: 24057 - DNA, 16 bp, Artificial Sequence
  synthetic [barcode part1]
gtggcaactcgtgaag

SEQ ID NO: 24058 - DNA, 16 bp, Artificial Sequence
  synthetic [barcode part1]
agttgacacgttgcac

SEQ ID NO: 24059 - DNA, 16 bp, Artificial Sequence
  synthetic [barcode part1]
accacctggtgttcac

SEQ ID NO: 24060 - DNA, 16 bp, Artificial Sequence
  synthetic [barcode part1]
gtcaaggaatctctcg

SEQ ID NO: 24061 - DNA, 16 bp, Artificial Sequence
  synthetic [barcode part1]
tgagaggactgcacac

SEQ ID NO: 24062 - DNA, 16 bp, Artificial Sequence
  synthetic [barcode part1]
caacgatagtcgtcac

SEQ ID NO: 24063 - DNA, 16 bp, Artificial Sequence
  synthetic [barcode part1]
tccggacactcttcag

SEQ ID NO: 24064 - DNA, 16 bp, Artificial Sequence
  synthetic [barcode part1]
atagacctccttggcc

SEQ ID NO: 24065 - DNA, 16 bp, Artificial Sequence
  synthetic [barcode part1]
ccacagattaccactt

SEQ ID NO: 24066 - DNA, 16 bp, Artificial Sequence
  synthetic [barcode part1]
acgatactctccttcc

SEQ ID NO: 24067 - DNA, 16 bp, Artificial Sequence
  synthetic [barcode part1]
tgagaggatcgcgtac

SEQ ID NO: 24068 - DNA, 16 bp, Artificial Sequence
  synthetic [barcode part1]
gacttggttcttacgt

SEQ ID NO: 24069 - DNA, 16 bp, Artificial Sequence
  synthetic [barcode part1]
aagtaggcagagttct

SEQ ID NO: 24070 - DNA, 16 bp, Artificial Sequence
  synthetic [barcode part1]
gttctgtgttcaggtt

SEQ ID NO: 24071 - DNA, 16 bp, Artificial Sequence
  synthetic [barcode part1]
taggttctagacgtcg

SEQ ID NO: 24072 - DNA, 16 bp, Artificial Sequence
  synthetic [barcode part1]
cggtatacagtgaggc

SEQ ID NO: 24073 - DNA, 16 bp, Artificial Sequence
  synthetic [barcode part1]
gagaagatcgactgag

SEQ ID NO: 24074 - DNA, 16 bp, Artificial Sequence
  synthetic [barcode part1]
attccttaccgcgcag

SEQ ID NO: 24075 - DNA, 16 bp, Artificial Sequence
  synthetic [barcode part1]
gaccgcaagttctctc

SEQ ID NO: 24076 - DNA, 16 bp, Artificial Sequence
  synthetic [barcode part1]
cgtattgcgactacag

SEQ ID NO: 24077 - DNA, 16 bp, Artificial Sequence
  synthetic [barcode part1]
tacggatcttatcgtc

SEQ ID NO: 24078 - DNA, 16 bp, Artificial Sequence
  synthetic [barcode part1]
gcgaaggtcaacggtt

SEQ ID NO: 24079 - DNA, 16 bp, Artificial Sequence
  synthetic [barcode part1]
gtccttccacgtagtg

SEQ ID NO: 24080 - DNA, 16 bp, Artificial Sequence
  synthetic [barcode part1]
ccggcagtattagact

SEQ ID NO: 24081 - DNA, 16 bp, Artificial Sequence
  synthetic [barcode part1]
cactgagagtgactct

SEQ ID NO: 24082 - DNA, 16 bp, Artificial Sequence
  synthetic [barcode part1]
gacgtgactattagag

SEQ ID NO: 24083 - DNA, 16 bp, Artificial Sequence
  synthetic [barcode part1]
atcgcgaggacagact

SEQ ID NO: 24084 - DNA, 16 bp, Artificial Sequence
  synthetic [barcode part1]
gcgtctggatagaacg

SEQ ID NO: 24085 - DNA, 16 bp, Artificial Sequence
  synthetic [barcode part1]
atcgaaccacctccac

SEQ ID NO: 24086 - DNA, 16 bp, Artificial Sequence
  synthetic [barcode part1]
gttgacgcctaattct

SEQ ID NO: 24087 - DNA, 16 bp, Artificial Sequence
  synthetic [barcode part1]
taggtgtccaagtacc

SEQ ID NO: 24088 - DNA, 16 bp, Artificial Sequence
  synthetic [barcode part1]
atcaggtcttacactc

SEQ ID NO: 24089 - DNA, 16 bp, Artificial Sequence
  synthetic [barcode part1]
taattaccacctcgtg

SEQ ID NO: 24090 - DNA, 16 bp, Artificial Sequence
  synthetic [barcode part1]
ttcagactgagtccag

SEQ ID NO: 24091 - DNA, 16 bp, Artificial Sequence
  synthetic [barcode part1]
tggccagagttaactc

SEQ ID NO: 24092 - DNA, 16 bp, Artificial Sequence
  synthetic [barcode part1]
tgtgcgagttcgaact

SEQ ID NO: 24093 - DNA, 16 bp, Artificial Sequence
  synthetic [barcode part1]
tcctcagtacgactgc

SEQ ID NO: 24094 - DNA, 16 bp, Artificial Sequence
  synthetic [barcode part1]
ttaacgcaaggagttg

SEQ ID NO: 24095 - DNA, 16 bp, Artificial Sequence
  synthetic [barcode part1]
gtctgccgacactgtt

SEQ ID NO: 24096 - DNA, 16 bp, Artificial Sequence
  synthetic [barcode part1]
aacaagtggcaccacg

SEQ ID NO: 24097 - DNA, 16 bp, Artificial Sequence
  synthetic [barcode part1]
gacgaacgaacctcag

SEQ ID NO: 24098 - DNA, 16 bp, Artificial Sequence
  synthetic [barcode part1]
acttgactatacctcg

SEQ ID NO: 24099 - DNA, 16 bp, Artificial Sequence
  synthetic [barcode part1]
cgagagtgtccgatag

SEQ ID NO: 24100 - DNA, 16 bp, Artificial Sequence
  synthetic [barcode part1]
gatcgcaggaaggtct

SEQ ID NO: 24101 - DNA, 16 bp, Artificial Sequence
  synthetic [barcode part1]
gtctgagagactcact

SEQ ID NO: 24102 - DNA, 16 bp, Artificial Sequence
  synthetic [barcode part1]
acctacagattgtgcg

SEQ ID NO: 24103 - DNA, 16 bp, Artificial Sequence
  synthetic [barcode part1]
gacgcacgagactaac

SEQ ID NO: 24104 - DNA, 16 bp, Artificial Sequence
  synthetic [barcode part1]
gtcgattataccgcag

SEQ ID NO: 24105 - DNA, 16 bp, Artificial Sequence
  synthetic [barcode part1]
gaagataatccggtac

SEQ ID NO: 24106 - DNA, 16 bp, Artificial Sequence
  synthetic [barcode part1]
gtaactgagaattggc

SEQ ID NO: 24107 - DNA, 16 bp, Artificial Sequence
  synthetic [barcode part1]
taatcctgtcgatacc

SEQ ID NO: 24108 - DNA, 16 bp, Artificial Sequence
  synthetic [barcode part1]
atagtcctaggagtag

SEQ ID NO: 24109 - DNA, 16 bp, Artificial Sequence
  synthetic [barcode part1]
cactctaggtatctgt

SEQ ID NO: 24110 - DNA, 16 bp, Artificial Sequence
  synthetic [barcode part1]
gacgatcctagactgt

SEQ ID NO: 24111 - DNA, 16 bp, Artificial Sequence
  synthetic [barcode part1]
aggtaccgtggtgagt

SEQ ID NO: 24112 - DNA, 16 bp, Artificial Sequence
  synthetic [barcode part1]
cacgtatcttccttcg

SEQ ID NO: 24113 - DNA, 16 bp, Artificial Sequence
  synthetic [barcode part1]
tgccggataaggacac

SEQ ID NO: 24114 - DNA, 16 bp, Artificial Sequence
  synthetic [barcode part1]
cgttaagaagtgcggc

SEQ ID NO: 24115 - DNA, 16 bp, Artificial Sequence
  synthetic [barcode part1]
accagtgaggtgtctt

SEQ ID NO: 24116 - DNA, 16 bp, Artificial Sequence
  synthetic [barcode part1]
gttacgtgatcgtgtg

SEQ ID NO: 24117 - DNA, 16 bp, Artificial Sequence
  synthetic [barcode part1]
accaggtacttgacgt

SEQ ID NO: 24118 - DNA, 16 bp, Artificial Sequence
  synthetic [barcode part1]
agtcagtaccaaccac

SEQ ID NO: 24119 - DNA, 16 bp, Artificial Sequence
  synthetic [barcode part1]
ttatctgagtaccgtc

SEQ ID NO: 24120 - DNA, 16 bp, Artificial Sequence
  synthetic [barcode part1]
acaacgcgcgtgtatt

SEQ ID NO: 24121 - DNA, 16 bp, Artificial Sequence
  synthetic [barcode part1]
tagagtctggttgacc

SEQ ID NO: 24122 - DNA, 16 bp, Artificial Sequence
  synthetic [barcode part1]
tactgacggccttctg

SEQ ID NO: 24123 - DNA, 16 bp, Artificial Sequence
  synthetic [barcode part1]
aatcacacgcggttgt

SEQ ID NO: 24124 - DNA, 16 bp, Artificial Sequence
  synthetic [barcode part1]
cgacctcacactgact

SEQ ID NO: 24125 - DNA, 16 bp, Artificial Sequence
  synthetic [barcode part1]
gagtctacgaattcgc

SEQ ID NO: 24126 - DNA, 16 bp, Artificial Sequence
  synthetic [barcode part1]
cacaggagaagtgtag

SEQ ID NO: 24127 - DNA, 16 bp, Artificial Sequence
  synthetic [barcode part1]
agtgttctaaggagtg

SEQ ID NO: 24128 - DNA, 16 bp, Artificial Sequence
  synthetic [barcode part1]
atacagactgcacctg

SEQ ID NO: 24129 - DNA, 16 bp, Artificial Sequence
  synthetic [barcode part1]
acctcgcagactaagt

SEQ ID NO: 24130 - DNA, 16 bp, Artificial Sequence
  synthetic [barcode part1]
gacgtacgtcaacact

SEQ ID NO: 24131 - DNA, 16 bp, Artificial Sequence
  synthetic [barcode part1]
ttaacggcgttctcgc

SEQ ID NO: 24132 - DNA, 16 bp, Artificial Sequence
  synthetic [barcode part1]
cagtaggtccggatag

SEQ ID NO: 24133 - DNA, 16 bp, Artificial Sequence
  synthetic [barcode part1]
taggacgtattccacg

SEQ ID NO: 24134 - DNA, 16 bp, Artificial Sequence
  synthetic [barcode part1]
ttcacttgtccacctg

SEQ ID NO: 24135 - DNA, 16 bp, Artificial Sequence
  synthetic [barcode part1]
gtgtagtgagatcaac

SEQ ID NO: 24136 - DNA, 16 bp, Artificial Sequence
  synthetic [barcode part1]
tgagacgtaagaggtg

SEQ ID NO: 24137 - DNA, 16 bp, Artificial Sequence
  synthetic [barcode part1]
cgtgaactactatcct

SEQ ID NO: 24138 - DNA, 16 bp, Artificial Sequence
  synthetic [barcode part1]
caggtatcgcaagttc

SEQ ID NO: 24139 - DNA, 16 bp, Artificial Sequence
  synthetic [barcode part1]
taggcgtgcgtaactt

SEQ ID NO: 24140 - DNA, 16 bp, Artificial Sequence
  synthetic [barcode part1]
acactgacagtagaac

SEQ ID NO: 24141 - DNA, 16 bp, Artificial Sequence
  synthetic [barcode part1]
gcgccgatctctgatt

SEQ ID NO: 24142 - DNA, 16 bp, Artificial Sequence
  synthetic [barcode part1]
ttgcaagtatcctacc

SEQ ID NO: 24143 - DNA, 16 bp, Artificial Sequence
  synthetic [barcode part1]
aggtgtctaaggtagt

SEQ ID NO: 24144 - DNA, 16 bp, Artificial Sequence
  synthetic [barcode part1]
tcggaacaacgtcgtt

SEQ ID NO: 24145 - DNA, 16 bp, Artificial Sequence
  synthetic [barcode part1]
cgtagtagaatagacc

SEQ ID NO: 24146 - DNA, 16 bp, Artificial Sequence
  synthetic [barcode part1]
cgaatacctctgccac

SEQ ID NO: 24147 - DNA, 16 bp, Artificial Sequence
  synthetic [barcode part1]
acgtcggtcctatcac

SEQ ID NO: 24148 - DNA, 16 bp, Artificial Sequence
  synthetic [barcode part1]
gccggtaatctcctac

SEQ ID NO: 24149 - DNA, 16 bp, Artificial Sequence
  synthetic [barcode part1]
gatagagtgcgtcggt

SEQ ID NO: 24150 - DNA, 16 bp, Artificial Sequence
  synthetic [barcode part1]
gtggcaatctagtctg

SEQ ID NO: 24151 - DNA, 16 bp, Artificial Sequence
  synthetic [barcode part1]
caccttgtcacagacc

SEQ ID NO: 24152 - DNA, 16 bp, Artificial Sequence
  synthetic [barcode part1]
gcagttacttcaactc

SEQ ID NO: 24153 - DNA, 16 bp, Artificial Sequence
  synthetic [barcode part1]
gccgaattgaaggcgt

SEQ ID NO: 24154 - DNA, 16 bp, Artificial Sequence
  synthetic [barcode part1]
gcacttcagttcggtc

SEQ ID NO: 24155 - DNA, 16 bp, Artificial Sequence
  synthetic [barcode part1]
agttggccaatcgact

SEQ ID NO: 24156 - DNA, 16 bp, Artificial Sequence
  synthetic [barcode part1]
agtgtggataggagtg

SEQ ID NO: 24157 - DNA, 16 bp, Artificial Sequence
  synthetic [barcode part1]
gaccagagtaggatag

SEQ ID NO: 24158 - DNA, 16 bp, Artificial Sequence
  synthetic [barcode part1]
gtccaagataacgagt

SEQ ID NO: 24159 - DNA, 16 bp, Artificial Sequence
  synthetic [barcode part1]
agtggacctcagagtg

SEQ ID NO: 24160 - DNA, 16 bp, Artificial Sequence
  synthetic [barcode part1]
tcgttgcaacacctgc

SEQ ID NO: 24161 - DNA, 16 bp, Artificial Sequence
  synthetic [barcode part1]
agaggtcaggactaag

SEQ ID NO: 24162 - DNA, 16 bp, Artificial Sequence
  synthetic [barcode part1]
cgatctcttgaggaac

SEQ ID NO: 24163 - DNA, 16 bp, Artificial Sequence
  synthetic [barcode part1]
cggtaattcgacgatc

SEQ ID NO: 24164 - DNA, 16 bp, Artificial Sequence
  synthetic [barcode part1]
tcgttattaaggcggc

SEQ ID NO: 24165 - DNA, 16 bp, Artificial Sequence
  synthetic [barcode part1]
cctcgtggattattgt

SEQ ID NO: 24166 - DNA, 16 bp, Artificial Sequence
  synthetic [barcode part1]
ttgtgttctgccggac

SEQ ID NO: 24167 - DNA, 16 bp, Artificial Sequence
  synthetic [barcode part1]
aactcgacacaagaac

SEQ ID NO: 24168 - DNA, 16 bp, Artificial Sequence
  synthetic [barcode part1]
acgcgtggtattacac

SEQ ID NO: 24169 - DNA, 16 bp, Artificial Sequence
  synthetic [barcode part1]
tggaatcggaatcctc

SEQ ID NO: 24170 - DNA, 16 bp, Artificial Sequence
  synthetic [barcode part1]
gtgagtggtgaacaag

SEQ ID NO: 24171 - DNA, 16 bp, Artificial Sequence
  synthetic [barcode part1]
gcgccgagaagattgt

SEQ ID NO: 24172 - DNA, 16 bp, Artificial Sequence
  synthetic [barcode part1]
agttgtctctgtgccg

SEQ ID NO: 24173 - DNA, 16 bp, Artificial Sequence
  synthetic [barcode part1]
ccttcgttaccagacg

SEQ ID NO: 24174 - DNA, 16 bp, Artificial Sequence
  synthetic [barcode part1]
ttctgagttgttcacg

SEQ ID NO: 24175 - DNA, 16 bp, Artificial Sequence
  synthetic [barcode part1]
agaccgttgccagatt

SEQ ID NO: 24176 - DNA, 16 bp, Artificial Sequence
  synthetic [barcode part1]
taattctactgcgcgt

SEQ ID NO: 24177 - DNA, 16 bp, Artificial Sequence
  synthetic [barcode part1]
tagtcgtgacgacgag

SEQ ID NO: 24178 - DNA, 16 bp, Artificial Sequence
  synthetic [barcode part1]
tgtcacttcaccacct

SEQ ID NO: 24179 - DNA, 16 bp, Artificial Sequence
  synthetic [barcode part1]
tacagatcctaccact

SEQ ID NO: 24180 - DNA, 16 bp, Artificial Sequence
  synthetic [barcode part1]
agttgactgcaacgtc

SEQ ID NO: 24181 - DNA, 16 bp, Artificial Sequence
  synthetic [barcode part1]
gactgttatcttcacg

SEQ ID NO: 24182 - DNA, 16 bp, Artificial Sequence
  synthetic [barcode part1]
acgcgaccttcaactc

SEQ ID NO: 24183 - DNA, 16 bp, Artificial Sequence
  synthetic [barcode part1]
cctagaggcgtatact

SEQ ID NO: 24184 - DNA, 16 bp, Artificial Sequence
  synthetic [barcode part1]
gtccttcgcgtactag

SEQ ID NO: 24185 - DNA, 16 bp, Artificial Sequence
  synthetic [barcode part1]
gcagattgtcgaggac

SEQ ID NO: 24186 - DNA, 16 bp, Artificial Sequence
  synthetic [barcode part1]
gttgacagacagtaac

SEQ ID NO: 24187 - DNA, 16 bp, Artificial Sequence
  synthetic [barcode part1]
tcaagacggcgagtac

SEQ ID NO: 24188 - DNA, 16 bp, Artificial Sequence
  synthetic [barcode part1]
cctattagactacacc

SEQ ID NO: 24189 - DNA, 16 bp, Artificial Sequence
  synthetic [barcode part1]
cacacttcagagacgt

SEQ ID NO: 24190 - DNA, 16 bp, Artificial Sequence
  synthetic [barcode part1]
caggtcggattattgc

SEQ ID NO: 24191 - DNA, 16 bp, Artificial Sequence
  synthetic [barcode part1]
agttggcctaaggtct

SEQ ID NO: 24192 - DNA, 16 bp, Artificial Sequence
  synthetic [barcode part1]
actgagtacgatccac

SEQ ID NO: 24193 - DNA, 16 bp, Artificial Sequence
  synthetic [barcode part1]
gtacacggattctggt

SEQ ID NO: 24194 - DNA, 16 bp, Artificial Sequence
  synthetic [barcode part1]
gagacggtcgtgaact

SEQ ID NO: 24195 - DNA, 16 bp, Artificial Sequence
  synthetic [barcode part1]
taggtggaacaccacg

SEQ ID NO: 24196 - DNA, 16 bp, Artificial Sequence
  synthetic [barcode part1]
actgatccgtagtgtg

SEQ ID NO: 24197 - DNA, 16 bp, Artificial Sequence
  synthetic [barcode part1]
cgccgagttcgtatct

SEQ ID NO: 24198 - DNA, 16 bp, Artificial Sequence
  synthetic [barcode part1]
tctattggccagagac

SEQ ID NO: 24199 - DNA, 16 bp, Artificial Sequence
  synthetic [barcode part1]
agattaggtatcggtg

SEQ ID NO: 24200 - DNA, 16 bp, Artificial Sequence
  synthetic [barcode part1]
gtccgtcttcagaatt

SEQ ID NO: 24201 - DNA, 16 bp, Artificial Sequence
  synthetic [barcode part1]
taaggcgagacgtctg

SEQ ID NO: 24202 - DNA, 16 bp, Artificial Sequence
  synthetic [barcode part1]
tctgccgtaatctcct

SEQ ID NO: 24203 - DNA, 16 bp, Artificial Sequence
  synthetic [barcode part1]
cctactaaccgagagt

SEQ ID NO: 24204 - DNA, 16 bp, Artificial Sequence
  synthetic [barcode part1]
gtaagaagatccagtc

SEQ ID NO: 24205 - DNA, 16 bp, Artificial Sequence
  synthetic [barcode part1]
taggatcgtgtacgtc

SEQ ID NO: 24206 - DNA, 16 bp, Artificial Sequence
  synthetic [barcode part1]
tcgtattcgaggacac

SEQ ID NO: 24207 - DNA, 16 bp, Artificial Sequence
  synthetic [barcode part1]
atcttacggcggtaac

SEQ ID NO: 24208 - DNA, 16 bp, Artificial Sequence
  synthetic [barcode part1]
acacaacttctggttc

SEQ ID NO: 24209 - DNA, 16 bp, Artificial Sequence
  synthetic [barcode part1]
cgtcttcggtcactag

SEQ ID NO: 24210 - DNA, 16 bp, Artificial Sequence
  synthetic [barcode part1]
gtccagagtgagtctt

SEQ ID NO: 24211 - DNA, 16 bp, Artificial Sequence
  synthetic [barcode part1]
atccaccacttcaggc

SEQ ID NO: 24212 - DNA, 16 bp, Artificial Sequence
  synthetic [barcode part1]
gtaaggcgtaagtccg

SEQ ID NO: 24213 - DNA, 16 bp, Artificial Sequence
  synthetic [barcode part1]
tgcgcagataggacac

SEQ ID NO: 24214 - DNA, 16 bp, Artificial Sequence
  synthetic [barcode part1]
tctccggtggttacgt

SEQ ID NO: 24215 - DNA, 16 bp, Artificial Sequence
  synthetic [barcode part1]
aagaggtagtggtggt

SEQ ID NO: 24216 - DNA, 16 bp, Artificial Sequence
  synthetic [barcode part1]
gcaccgactctatcac

SEQ ID NO: 24217 - DNA, 16 bp, Artificial Sequence
  synthetic [barcode part1]
tggtgattagtggtcc

SEQ ID NO: 24218 - DNA, 16 bp, Artificial Sequence
  synthetic [barcode part1]
ttgaggccgagtgagt

SEQ ID NO: 24219 - DNA, 16 bp, Artificial Sequence
  synthetic [barcode part1]
gagacggatcctatct

SEQ ID NO: 24220 - DNA, 16 bp, Artificial Sequence
  synthetic [barcode part1]
acgttgaactaggaac

SEQ ID NO: 24221 - DNA, 16 bp, Artificial Sequence
  synthetic [barcode part1]
gttactccgcctaggt

SEQ ID NO: 24222 - DNA, 16 bp, Artificial Sequence
  synthetic [barcode part1]
tgtacactgcagtgtg

SEQ ID NO: 24223 - DNA, 16 bp, Artificial Sequence
  synthetic [barcode part1]
cagaggtctatcggag

SEQ ID NO: 24224 - DNA, 16 bp, Artificial Sequence
  synthetic [barcode part1]
gactgagataactgtg

SEQ ID NO: 24225 - DNA, 16 bp, Artificial Sequence
  synthetic [barcode part1]
attgtcgacgcctctg

SEQ ID NO: 24226 - DNA, 16 bp, Artificial Sequence
  synthetic [barcode part1]
cgagttatcggtgatc

SEQ ID NO: 24227 - DNA, 16 bp, Artificial Sequence
  synthetic [barcode part1]
cagtgtagtcgtctcc

SEQ ID NO: 24228 - DNA, 16 bp, Artificial Sequence
  synthetic [barcode part1]
accgtaggtagatagt

SEQ ID NO: 24229 - DNA, 16 bp, Artificial Sequence
  synthetic [barcode part1]
gaagacgacaacctgc

SEQ ID NO: 24230 - DNA, 16 bp, Artificial Sequence
  synthetic [barcode part1]
ccaactccggattcac

SEQ ID NO: 24231 - DNA, 16 bp, Artificial Sequence
  synthetic [barcode part1]
cggtctgaagtgtgag

SEQ ID NO: 24232 - DNA, 16 bp, Artificial Sequence
  synthetic [barcode part1]
acaatccggcacgaag

SEQ ID NO: 24233 - DNA, 16 bp, Artificial Sequence
  synthetic [barcode part1]
tgacgttatccacttg

SEQ ID NO: 24234 - DNA, 16 bp, Artificial Sequence
  synthetic [barcode part1]
attgcgactgttcgcc

SEQ ID NO: 24235 - DNA, 16 bp, Artificial Sequence
  synthetic [barcode part1]
gaggagtgtagttgcc

SEQ ID NO: 24236 - DNA, 16 bp, Artificial Sequence
  synthetic [barcode part1]
gttccacggtatattc

SEQ ID NO: 24237 - DNA, 16 bp, Artificial Sequence
  synthetic [barcode part1]
ttacttcctaacgcag

SEQ ID NO: 24238 - DNA, 16 bp, Artificial Sequence
  synthetic [barcode part1]
cggtaccacctacttg

SEQ ID NO: 24239 - DNA, 16 bp, Artificial Sequence
  synthetic [barcode part1]
atcaagaacacaccag

SEQ ID NO: 24240 - DNA, 16 bp, Artificial Sequence
  synthetic [barcode part1]
aaccacgactacgtgt

SEQ ID NO: 24241 - DNA, 16 bp, Artificial Sequence
  synthetic [barcode part1]
acctaagtgtctaggc

SEQ ID NO: 24242 - DNA, 16 bp, Artificial Sequence
  synthetic [barcode part1]
cacgatactacaacgc

SEQ ID NO: 24243 - DNA, 16 bp, Artificial Sequence
  synthetic [barcode part1]
tgaattgtcctcgtgt

SEQ ID NO: 24244 - DNA, 16 bp, Artificial Sequence
  synthetic [barcode part1]
atccaacaaccaccag

SEQ ID NO: 24245 - DNA, 16 bp, Artificial Sequence
  synthetic [barcode part1]
gatctgtctcaggtag

SEQ ID NO: 24246 - DNA, 16 bp, Artificial Sequence
  synthetic [barcode part1]
agtcaacgtcacaacc

SEQ ID NO: 24247 - DNA, 16 bp, Artificial Sequence
  synthetic [barcode part1]
acggtagtcgcgtaag

SEQ ID NO: 24248 - DNA, 16 bp, Artificial Sequence
  synthetic [barcode part1]
gattcttgaggatcgc

SEQ ID NO: 24249 - DNA, 16 bp, Artificial Sequence
  synthetic [barcode part1]
ccaacttacgagacgt

SEQ ID NO: 24250 - DNA, 16 bp, Artificial Sequence
  synthetic [barcode part1]
actcggcaagacgtag

SEQ ID NO: 24251 - DNA, 16 bp, Artificial Sequence
  synthetic [barcode part1]
ttctccgaacgtattg

SEQ ID NO: 24252 - DNA, 16 bp, Artificial Sequence
  synthetic [barcode part1]
tcgcgttacaatctac

SEQ ID NO: 24253 - DNA, 16 bp, Artificial Sequence
  synthetic [barcode part1]
aagacttgtgacgcct

SEQ ID NO: 24254 - DNA, 16 bp, Artificial Sequence
  synthetic [barcode part1]
cgtgtaagaatcgaac

SEQ ID NO: 24255 - DNA, 16 bp, Artificial Sequence
  synthetic [barcode part1]
atcttctatcgcacag

SEQ ID NO: 24256 - DNA, 16 bp, Artificial Sequence
  synthetic [barcode part1]
taaccgtgtagaacag

SEQ ID NO: 24257 - DNA, 16 bp, Artificial Sequence
  synthetic [barcode part1]
tgactctgtcgcacgt

SEQ ID NO: 24258 - DNA, 16 bp, Artificial Sequence
  synthetic [barcode part1]
cgcactcagattgcct

SEQ ID NO: 24259 - DNA, 16 bp, Artificial Sequence
  synthetic [barcode part1]
tattggcgattcttcg

SEQ ID NO: 24260 - DNA, 16 bp, Artificial Sequence
  synthetic [barcode part1]
gtctgagagacctgtt

SEQ ID NO: 24261 - DNA, 16 bp, Artificial Sequence
  synthetic [barcode part1]
aacacaacggaccgtg

SEQ ID NO: 24262 - DNA, 16 bp, Artificial Sequence
  synthetic [barcode part1]
tcggcagatccttacc

SEQ ID NO: 24263 - DNA, 16 bp, Artificial Sequence
  synthetic [barcode part1]
gcaacgtagaactcct

SEQ ID NO: 24264 - DNA, 16 bp, Artificial Sequence
  synthetic [barcode part1]
cgacgacgtataggac

SEQ ID NO: 24265 - DNA, 16 bp, Artificial Sequence
  synthetic [barcode part1]
actgcaaggatctcac

SEQ ID NO: 24266 - DNA, 16 bp, Artificial Sequence
  synthetic [barcode part1]
caatcggtcaatcggt

SEQ ID NO: 24267 - DNA, 16 bp, Artificial Sequence
  synthetic [barcode part1]
agtctactctgttgtg

SEQ ID NO: 24268 - DNA, 16 bp, Artificial Sequence
  synthetic [barcode part1]
cctgttgcagtaagac

SEQ ID NO: 24269 - DNA, 16 bp, Artificial Sequence
  synthetic [barcode part1]
actcaactcttcacag

SEQ ID NO: 24270 - DNA, 16 bp, Artificial Sequence
  synthetic [barcode part1]
aattctcgaccgtatc

SEQ ID NO: 24271 - DNA, 16 bp, Artificial Sequence
  synthetic [barcode part1]
ttactcgcagagttct

SEQ ID NO: 24272 - DNA, 16 bp, Artificial Sequence
  synthetic [barcode part1]
ttcgccacacgtcaac

SEQ ID NO: 24273 - DNA, 16 bp, Artificial Sequence
  synthetic [barcode part1]
aacgatcacacaagac

SEQ ID NO: 24274 - DNA, 16 bp, Artificial Sequence
  synthetic [barcode part1]
tgatacgccggtatac

SEQ ID NO: 24275 - DNA, 16 bp, Artificial Sequence
  synthetic [barcode part1]
cgcggactgaatatct

SEQ ID NO: 24276 - DNA, 16 bp, Artificial Sequence
  synthetic [barcode part1]
ttcaactggtcctctc

SEQ ID NO: 24277 - DNA, 16 bp, Artificial Sequence
  synthetic [barcode part1]
gttcaagtatcacctc

SEQ ID NO: 24278 - DNA, 16 bp, Artificial Sequence
  synthetic [barcode part1]
caaccgcggcaataag

SEQ ID NO: 24279 - DNA, 16 bp, Artificial Sequence
  synthetic [barcode part1]
gaggtgtatatctccg

SEQ ID NO: 24280 - DNA, 16 bp, Artificial Sequence
  synthetic [barcode part1]
tgattaactgaccggc

SEQ ID NO: 24281 - DNA, 16 bp, Artificial Sequence
  synthetic [barcode part1]
aactcgacctcgtacc

SEQ ID NO: 24282 - DNA, 16 bp, Artificial Sequence
  synthetic [barcode part1]
gcaaggagattactac

SEQ ID NO: 24283 - DNA, 16 bp, Artificial Sequence
  synthetic [barcode part1]
accaggtgtagagatt

SEQ ID NO: 24284 - DNA, 16 bp, Artificial Sequence
  synthetic [barcode part1]
gaggatacgccaggtt

SEQ ID NO: 24285 - DNA, 16 bp, Artificial Sequence
  synthetic [barcode part1]
tcgtagtaccgtaacg

SEQ ID NO: 24286 - DNA, 16 bp, Artificial Sequence
  synthetic [barcode part1]
ccttaccactcacgag

SEQ ID NO: 24287 - DNA, 16 bp, Artificial Sequence
  synthetic [barcode part1]
ttaaccgtacacgcag

SEQ ID NO: 24288 - DNA, 16 bp, Artificial Sequence
  synthetic [barcode part1]
gcgactaggaagacct

SEQ ID NO: 24289 - DNA, 16 bp, Artificial Sequence
  synthetic [barcode part1]
tacaaccacgtgactg

SEQ ID NO: 24290 - DNA, 16 bp, Artificial Sequence
  synthetic [barcode part1]
acctggaacagtaagt

SEQ ID NO: 24291 - DNA, 16 bp, Artificial Sequence
  synthetic [barcode part1]
ttggagtgccttagac

SEQ ID NO: 24292 - DNA, 16 bp, Artificial Sequence
  synthetic [barcode part1]
gtagagagattcgact

SEQ ID NO: 24293 - DNA, 16 bp, Artificial Sequence
  synthetic [barcode part1]
ccacttcgtgcaactg

SEQ ID NO: 24294 - DNA, 16 bp, Artificial Sequence
  synthetic [barcode part1]
tggatcagtcgaactc

SEQ ID NO: 24295 - DNA, 16 bp, Artificial Sequence
  synthetic [barcode part1]
gtatcaggaggcgatc

SEQ ID NO: 24296 - DNA, 16 bp, Artificial Sequence
  synthetic [barcode part1]
accaggtgtccttatt

SEQ ID NO: 24297 - DNA, 16 bp, Artificial Sequence
  synthetic [barcode part1]
cactattgtctaggtc

SEQ ID NO: 24298 - DNA, 16 bp, Artificial Sequence
  synthetic [barcode part1]
acgaaccaaccgtact

SEQ ID NO: 24299 - DNA, 16 bp, Artificial Sequence
  synthetic [barcode part1]
ttgcaactcaggactg

SEQ ID NO: 24300 - DNA, 16 bp, Artificial Sequence
  synthetic [barcode part1]
attcgtcgacactgtt

SEQ ID NO: 24301 - DNA, 16 bp, Artificial Sequence
  synthetic [barcode part1]
gcaagacttcactacg

SEQ ID NO: 24302 - DNA, 16 bp, Artificial Sequence
  synthetic [barcode part1]
cgtcagaaggtcactt

SEQ ID NO: 24303 - DNA, 16 bp, Artificial Sequence
  synthetic [barcode part1]
actgacaagtgcgttc

SEQ ID NO: 24304 - DNA, 16 bp, Artificial Sequence
  synthetic [barcode part1]
acctattcgccacgac

SEQ ID NO: 24305 - DNA, 16 bp, Artificial Sequence
  synthetic [barcode part1]
tgtcgaagagtgcgac

SEQ ID NO: 24306 - DNA, 16 bp, Artificial Sequence
  synthetic [barcode part1]
aacctagttctacgtc

SEQ ID NO: 24307 - DNA, 16 bp, Artificial Sequence
  synthetic [barcode part1]
cgagtgagtagtattg

SEQ ID NO: 24308 - DNA, 16 bp, Artificial Sequence
  synthetic [barcode part1]
atcgcgacactacagt

SEQ ID NO: 24309 - DNA, 16 bp, Artificial Sequence
  synthetic [barcode part1]
ttatctctgtaccgag

SEQ ID NO: 24310 - DNA, 16 bp, Artificial Sequence
  synthetic [barcode part1]
aggacaccgtaagaag

SEQ ID NO: 24311 - DNA, 16 bp, Artificial Sequence
  synthetic [barcode part1]
gcaactgcagtacgtt

SEQ ID NO: 24312 - DNA, 16 bp, Artificial Sequence
  synthetic [barcode part1]
tggtcctgtatcggtc

SEQ ID NO: 24313 - DNA, 16 bp, Artificial Sequence
  synthetic [barcode part1]
atcgtccggtaagatc

SEQ ID NO: 24314 - DNA, 16 bp, Artificial Sequence
  synthetic [barcode part1]
tgtgtacaccaaccag

SEQ ID NO: 24315 - DNA, 16 bp, Artificial Sequence
  synthetic [barcode part1]
gatctgaggagacgtc

SEQ ID NO: 24316 - DNA, 16 bp, Artificial Sequence
  synthetic [barcode part1]
cacggtaatctactct

SEQ ID NO: 24317 - DNA, 16 bp, Artificial Sequence
  synthetic [barcode part1]
tgaaggaccagttcct

SEQ ID NO: 24318 - DNA, 16 bp, Artificial Sequence
  synthetic [barcode part1]
gtgtcgagaggtggtt

SEQ ID NO: 24319 - DNA, 16 bp, Artificial Sequence
  synthetic [barcode part1]
acctattacctgcctc

SEQ ID NO: 24320 - DNA, 16 bp, Artificial Sequence
  synthetic [barcode part1]
agtctgtacctgtgag

SEQ ID NO: 24321 - DNA, 16 bp, Artificial Sequence
  synthetic [barcode part1]
atctcacacctctcgt

SEQ ID NO: 24322 - DNA, 16 bp, Artificial Sequence
  synthetic [barcode part1]
gccaagttaccggatt

SEQ ID NO: 24323 - DNA, 16 bp, Artificial Sequence
  synthetic [barcode part1]
tacacgtactgtggtg

SEQ ID NO: 24324 - DNA, 16 bp, Artificial Sequence
  synthetic [barcode part1]
tctcaatatactcggc

SEQ ID NO: 24325 - DNA, 16 bp, Artificial Sequence
  synthetic [barcode part1]
gtggagtgcaatagag

SEQ ID NO: 24326 - DNA, 16 bp, Artificial Sequence
  synthetic [barcode part1]
ttctgcgattgaactc

SEQ ID NO: 24327 - DNA, 16 bp, Artificial Sequence
  synthetic [barcode part1]
tccttccagagttcct

SEQ ID NO: 24328 - DNA, 16 bp, Artificial Sequence
  synthetic [barcode part1]
gatctgtgtcttactg

SEQ ID NO: 24329 - DNA, 16 bp, Artificial Sequence
  synthetic [barcode part1]
tccttattaccgaacg

SEQ ID NO: 24330 - DNA, 16 bp, Artificial Sequence
  synthetic [barcode part1]
cacggtaattcacctt

SEQ ID NO: 24331 - DNA, 16 bp, Artificial Sequence
  synthetic [barcode part1]
ttagacgtccaccacc

SEQ ID NO: 24332 - DNA, 16 bp, Artificial Sequence
  synthetic [barcode part1]
ttacgtgaatctcctg

SEQ ID NO: 24333 - DNA, 16 bp, Artificial Sequence
  synthetic [barcode part1]
aacttcttacgccggc

SEQ ID NO: 24334 - DNA, 16 bp, Artificial Sequence
  synthetic [barcode part1]
tcttactctgcctcag

SEQ ID NO: 24335 - DNA, 16 bp, Artificial Sequence
  synthetic [barcode part1]
gtacgactctcaatct

SEQ ID NO: 24336 - DNA, 16 bp, Artificial Sequence
  synthetic [barcode part1]
agtctaagtgcaaggt

SEQ ID NO: 24337 - DNA, 16 bp, Artificial Sequence
  synthetic [barcode part1]
cctcggtgaagattgt

SEQ ID NO: 24338 - DNA, 16 bp, Artificial Sequence
  synthetic [barcode part1]
agatacactggtagtg

SEQ ID NO: 24339 - DNA, 16 bp, Artificial Sequence
  synthetic [barcode part1]
gtgcgcaattgtaacc

SEQ ID NO: 24340 - DNA, 16 bp, Artificial Sequence
  synthetic [barcode part1]
tactccacacttgagt

SEQ ID NO: 24341 - DNA, 16 bp, Artificial Sequence
  synthetic [barcode part1]
gagtatcttacctcac

SEQ ID NO: 24342 - DNA, 16 bp, Artificial Sequence
  synthetic [barcode part1]
cggtaccttattcgcg

SEQ ID NO: 24343 - DNA, 16 bp, Artificial Sequence
  synthetic [barcode part1]
cctatcagattgcact

SEQ ID NO: 24344 - DNA, 16 bp, Artificial Sequence
  synthetic [barcode part1]
caactcaacctctgcg

SEQ ID NO: 24345 - DNA, 16 bp, Artificial Sequence
  synthetic [barcode part1]
aggattaggcctatag

SEQ ID NO: 24346 - DNA, 16 bp, Artificial Sequence
  synthetic [barcode part1]
tactgtgcagtaccag

SEQ ID NO: 24347 - DNA, 16 bp, Artificial Sequence
  synthetic [barcode part1]
ccttcagatcgtatac

SEQ ID NO: 24348 - DNA, 16 bp, Artificial Sequence
  synthetic [barcode part1]
caatcgagtcagtcac

SEQ ID NO: 24349 - DNA, 16 bp, Artificial Sequence
  synthetic [barcode part1]
atagaagtcctcacgc

SEQ ID NO: 24350 - DNA, 16 bp, Artificial Sequence
  synthetic [barcode part1]
aattccggagtctcag

SEQ ID NO: 24351 - DNA, 16 bp, Artificial Sequence
  synthetic [barcode part1]
tataacacactgcggc

SEQ ID NO: 24352 - DNA, 16 bp, Artificial Sequence
  synthetic [barcode part1]
gtccggtcaattcaag

SEQ ID NO: 24353 - DNA, 16 bp, Artificial Sequence
  synthetic [barcode part1]
tgttaggcgaagacgc

SEQ ID NO: 24354 - DNA, 16 bp, Artificial Sequence
  synthetic [barcode part1]
tgacaacctcctatac

SEQ ID NO: 24355 - DNA, 16 bp, Artificial Sequence
  synthetic [barcode part1]
tactcgagttgagaag

SEQ ID NO: 24356 - DNA, 16 bp, Artificial Sequence
  synthetic [barcode part1]
cagactgaccagatct

SEQ ID NO: 24357 - DNA, 16 bp, Artificial Sequence
  synthetic [barcode part1]
acaccagaaggtagtt

SEQ ID NO: 24358 - DNA, 16 bp, Artificial Sequence
  synthetic [barcode part1]
gtagtacggccaattc

SEQ ID NO: 24359 - DNA, 16 bp, Artificial Sequence
  synthetic [barcode part1]
caatctgttcgcgtcg

SEQ ID NO: 24360 - DNA, 16 bp, Artificial Sequence
  synthetic [barcode part1]
tgcctctgttattgag

SEQ ID NO: 24361 - DNA, 16 bp, Artificial Sequence
  synthetic [barcode part1]
cactcggaggataacg

SEQ ID NO: 24362 - DNA, 16 bp, Artificial Sequence
  synthetic [barcode part1]
atagacctcaacacgc

SEQ ID NO: 24363 - DNA, 16 bp, Artificial Sequence
  synthetic [barcode part1]
ttcgcacctaagttac

SEQ ID NO: 24364 - DNA, 16 bp, Artificial Sequence
  synthetic [barcode part1]
acaaccagttgacacc

SEQ ID NO: 24365 - DNA, 16 bp, Artificial Sequence
  synthetic [barcode part1]
ccagtccaacgatagt

SEQ ID NO: 24366 - DNA, 16 bp, Artificial Sequence
  synthetic [barcode part1]
attgtattccttggcg

SEQ ID NO: 24367 - DNA, 16 bp, Artificial Sequence
  synthetic [barcode part1]
gaatctgcgccttacc

SEQ ID NO: 24368 - DNA, 16 bp, Artificial Sequence
  synthetic [barcode part1]
ttcgcacgacctaacc

SEQ ID NO: 24369 - DNA, 16 bp, Artificial Sequence
  synthetic [barcode part1]
agtcctctataagtcc

SEQ ID NO: 24370 - DNA, 16 bp, Artificial Sequence
  synthetic [barcode part1]
actcctacctaacagt

SEQ ID NO: 24371 - DNA, 16 bp, Artificial Sequence
  synthetic [barcode part1]
aactgtccgaggacag

SEQ ID NO: 24372 - DNA, 16 bp, Artificial Sequence
  synthetic [barcode part1]
aggtgtcgaatagtgt

SEQ ID NO: 24373 - DNA, 16 bp, Artificial Sequence
  synthetic [barcode part1]
gttgttgcagtgactg

SEQ ID NO: 24374 - DNA, 16 bp, Artificial Sequence
  synthetic [barcode part1]
caagaccggaattcct

SEQ ID NO: 24375 - DNA, 16 bp, Artificial Sequence
  synthetic [barcode part1]
tgcaacacctaagacc

SEQ ID NO: 24376 - DNA, 16 bp, Artificial Sequence
  synthetic [barcode part1]
taggtacgtacgactc

SEQ ID NO: 24377 - DNA, 16 bp, Artificial Sequence
  synthetic [barcode part1]
aacctgtaagtccacg

SEQ ID NO: 24378 - DNA, 16 bp, Artificial Sequence
  synthetic [barcode part1]
gtctccgacaggaatt

SEQ ID NO: 24379 - DNA, 16 bp, Artificial Sequence
  synthetic [barcode part1]
cactgcgtcaatcaag

SEQ ID NO: 24380 - DNA, 16 bp, Artificial Sequence
  synthetic [barcode part1]
caccagactcgatagt

SEQ ID NO: 24381 - DNA, 16 bp, Artificial Sequence
  synthetic [barcode part1]
gtacgttgacgataag

SEQ ID NO: 24382 - DNA, 16 bp, Artificial Sequence
  synthetic [barcode part1]
ccaagttctcttacag

SEQ ID NO: 24383 - DNA, 16 bp, Artificial Sequence
  synthetic [barcode part1]
cggttatctgtgcaag

SEQ ID NO: 24384 - DNA, 16 bp, Artificial Sequence
  synthetic [barcode part1]
ttggcaactgcgtctc

SEQ ID NO: 24385 - DNA, 16 bp, Artificial Sequence
  synthetic [barcode part1]
gttccgcgcgattact

SEQ ID NO: 24386 - DNA, 16 bp, Artificial Sequence
  synthetic [barcode part1]
gttcgagttcgttgtt

SEQ ID NO: 24387 - DNA, 16 bp, Artificial Sequence
  synthetic [barcode part1]
tgttaccggtgtatct

SEQ ID NO: 24388 - DNA, 16 bp, Artificial Sequence
  synthetic [barcode part1]
gcgtaccactctctag

SEQ ID NO: 24389 - DNA, 16 bp, Artificial Sequence
  synthetic [barcode part1]
agtcctatattcaccg

SEQ ID NO: 24390 - DNA, 16 bp, Artificial Sequence
  synthetic [barcode part1]
agtgacgtattgtccg

SEQ ID NO: 24391 - DNA, 16 bp, Artificial Sequence
  synthetic [barcode part1]
caggagacacgatcac

SEQ ID NO: 24392 - DNA, 16 bp, Artificial Sequence
  synthetic [barcode part1]
agtgttgtatacgcgc

SEQ ID NO: 24393 - DNA, 16 bp, Artificial Sequence
  synthetic [barcode part1]
cgtagttgaagactag

SEQ ID NO: 24394 - DNA, 16 bp, Artificial Sequence
  synthetic [barcode part1]
tatcgccttcgtaggc

SEQ ID NO: 24395 - DNA, 16 bp, Artificial Sequence
  synthetic [barcode part1]
gatcgacttccttcct

SEQ ID NO: 24396 - DNA, 16 bp, Artificial Sequence
  synthetic [barcode part1]
acacaacagaatcgac

SEQ ID NO: 24397 - DNA, 16 bp, Artificial Sequence
  synthetic [barcode part1]
aggaacgatctggcac

SEQ ID NO: 24398 - DNA, 16 bp, Artificial Sequence
  synthetic [barcode part1]
cacgagttgagtgtct

SEQ ID NO: 24399 - DNA, 16 bp, Artificial Sequence
  synthetic [barcode part1]
aggatagacaagtcct

SEQ ID NO: 24400 - DNA, 16 bp, Artificial Sequence
  synthetic [barcode part1]
cgtaggcaccttatcc

SEQ ID NO: 24401 - DNA, 16 bp, Artificial Sequence
  synthetic [barcode part1]
gacaccgatacgtatc

SEQ ID NO: 24402 - DNA, 16 bp, Artificial Sequence
  synthetic [barcode part1]
gatatcgcagtactgc

SEQ ID NO: 24403 - DNA, 16 bp, Artificial Sequence
  synthetic [barcode part1]
gcaaccacctctcagt

SEQ ID NO: 24404 - DNA, 16 bp, Artificial Sequence
  synthetic [barcode part1]
ttcactgccggatatt

SEQ ID NO: 24405 - DNA, 16 bp, Artificial Sequence
  synthetic [barcode part1]
taagtatctggcgcac

SEQ ID NO: 24406 - DNA, 16 bp, Artificial Sequence
  synthetic [barcode part1]
gcagagttctaagtag

SEQ ID NO: 24407 - DNA, 16 bp, Artificial Sequence
  synthetic [barcode part1]
gtgtccgcaagtattg

SEQ ID NO: 24408 - DNA, 16 bp, Artificial Sequence
  synthetic [barcode part1]
ttgtcgcgtagtagac

SEQ ID NO: 24409 - DNA, 16 bp, Artificial Sequence
  synthetic [barcode part1]
ttcgaaccacctcacg

SEQ ID NO: 24410 - DNA, 16 bp, Artificial Sequence
  synthetic [barcode part1]
gaacttcaactggtcg

SEQ ID NO: 24411 - DNA, 16 bp, Artificial Sequence
  synthetic [barcode part1]
acgaccaatcggtact

SEQ ID NO: 24412 - DNA, 16 bp, Artificial Sequence
  synthetic [barcode part1]
gcgagagaactgtcgt

SEQ ID NO: 24413 - DNA, 16 bp, Artificial Sequence
  synthetic [barcode part1]
ttaatccgcgaccgtc

SEQ ID NO: 24414 - DNA, 16 bp, Artificial Sequence
  synthetic [barcode part1]
ataggagtggttcagt

SEQ ID NO: 24415 - DNA, 16 bp, Artificial Sequence
  synthetic [barcode part1]
gtactaacgtgtcggt

SEQ ID NO: 24416 - DNA, 16 bp, Artificial Sequence
  synthetic [barcode part1]
taactgcacttcctag

SEQ ID NO: 24417 - DNA, 16 bp, Artificial Sequence
  synthetic [barcode part1]
tcaatctggatcaggc

SEQ ID NO: 24418 - DNA, 16 bp, Artificial Sequence
  synthetic [barcode part1]
agattcgaacagtgac

SEQ ID NO: 24419 - DNA, 16 bp, Artificial Sequence
  synthetic [barcode part1]
gtgtacgtcgactagt

SEQ ID NO: 24420 - DNA, 16 bp, Artificial Sequence
  synthetic [barcode part1]
cgttctggataggatc

SEQ ID NO: 24421 - DNA, 16 bp, Artificial Sequence
  synthetic [barcode part1]
ccagattagaggtgcg

SEQ ID NO: 24422 - DNA, 16 bp, Artificial Sequence
  synthetic [barcode part1]
actggtgtaccagtgt

SEQ ID NO: 24423 - DNA, 16 bp, Artificial Sequence
  synthetic [barcode part1]
tcttctctcggaatcc

SEQ ID NO: 24424 - DNA, 16 bp, Artificial Sequence
  synthetic [barcode part1]
cgtggcagatactatc

SEQ ID NO: 24425 - DNA, 16 bp, Artificial Sequence
  synthetic [barcode part1]
ttagtatcggtgcacg

SEQ ID NO: 24426 - DNA, 16 bp, Artificial Sequence
  synthetic [barcode part1]
ttgtacgtacgtgacg

SEQ ID NO: 24427 - DNA, 16 bp, Artificial Sequence
  synthetic [barcode part1]
agagtcgactatctcg

SEQ ID NO: 24428 - DNA, 16 bp, Artificial Sequence
  synthetic [barcode part1]
cgcgactattatcttg

SEQ ID NO: 24429 - DNA, 16 bp, Artificial Sequence
  synthetic [barcode part1]
tccaacttgcgtgatt

SEQ ID NO: 24430 - DNA, 16 bp, Artificial Sequence
  synthetic [barcode part1]
agtgtacactggtgtc

SEQ ID NO: 24431 - DNA, 16 bp, Artificial Sequence
  synthetic [barcode part1]
tccagaagaggtcttc

SEQ ID NO: 24432 - DNA, 16 bp, Artificial Sequence
  synthetic [barcode part1]
cctgtctgtctattcg

SEQ ID NO: 24433 - DNA, 16 bp, Artificial Sequence
  synthetic [barcode part1]
tagttgcggtggtgag

SEQ ID NO: 24434 - DNA, 16 bp, Artificial Sequence
  synthetic [barcode part1]
atcgtggttcgaggtt

SEQ ID NO: 24435 - DNA, 16 bp, Artificial Sequence
  synthetic [barcode part1]
tctggcctgtgtgact

SEQ ID NO: 24436 - DNA, 16 bp, Artificial Sequence
  synthetic [barcode part1]
gcgttgaccgaatact

SEQ ID NO: 24437 - DNA, 16 bp, Artificial Sequence
  synthetic [barcode part1]
agacctagacggcaac

SEQ ID NO: 24438 - DNA, 16 bp, Artificial Sequence
  synthetic [barcode part1]
tcacagagtccagatc

SEQ ID NO: 24439 - DNA, 16 bp, Artificial Sequence
  synthetic [barcode part1]
gaggagtgaacgttcc

SEQ ID NO: 24440 - DNA, 16 bp, Artificial Sequence
  synthetic [barcode part1]
gagacacaagacgtag

SEQ ID NO: 24441 - DNA, 16 bp, Artificial Sequence
  synthetic [barcode part1]
tgtatcgttaacctcg

SEQ ID NO: 24442 - DNA, 16 bp, Artificial Sequence
  synthetic [barcode part1]
tgatacgtataccggc

SEQ ID NO: 24443 - DNA, 16 bp, Artificial Sequence
  synthetic [barcode part1]
caacgcacgacgaagt

SEQ ID NO: 24444 - DNA, 16 bp, Artificial Sequence
  synthetic [barcode part1]
gcggcgttagttgatt

SEQ ID NO: 24445 - DNA, 16 bp, Artificial Sequence
  synthetic [barcode part1]
actccaagaggttctg

SEQ ID NO: 24446 - DNA, 16 bp, Artificial Sequence
  synthetic [barcode part1]
aagtctaggtaacggt

SEQ ID NO: 24447 - DNA, 16 bp, Artificial Sequence
  synthetic [barcode part1]
acaacgcgtcgtaact

SEQ ID NO: 24448 - DNA, 16 bp, Artificial Sequence
  synthetic [barcode part1]
aggcacttcacggatt

SEQ ID NO: 24449 - DNA, 16 bp, Artificial Sequence
  synthetic [barcode part1]
tcgcctgatctactct

SEQ ID NO: 24450 - DNA, 16 bp, Artificial Sequence
  synthetic [barcode part1]
cgtaggatacaggaag

SEQ ID NO: 24451 - DNA, 16 bp, Artificial Sequence
  synthetic [barcode part1]
ttataggcgtctcgtt

SEQ ID NO: 24452 - DNA, 16 bp, Artificial Sequence
  synthetic [barcode part1]
atagttacgtgcggtc

SEQ ID NO: 24453 - DNA, 16 bp, Artificial Sequence
  synthetic [barcode part1]
tctcggttagtaggac

SEQ ID NO: 24454 - DNA, 16 bp, Artificial Sequence
  synthetic [barcode part1]
tagatcgtggttcgac

SEQ ID NO: 24455 - DNA, 16 bp, Artificial Sequence
  synthetic [barcode part1]
aacctacgtggtggag

SEQ ID NO: 24456 - DNA, 16 bp, Artificial Sequence
  synthetic [barcode part1]
ccagacaaggttcact

SEQ ID NO: 24457 - DNA, 16 bp, Artificial Sequence
  synthetic [barcode part1]
caagaggcctcttaac

SEQ ID NO: 24458 - DNA, 16 bp, Artificial Sequence
  synthetic [barcode part1]
tcgacttggtagtggt

SEQ ID NO: 24459 - DNA, 16 bp, Artificial Sequence
  synthetic [barcode part1]
ccggaatctcaagact

SEQ ID NO: 24460 - DNA, 16 bp, Artificial Sequence
  synthetic [barcode part1]
acaatcaggtcgaagt

SEQ ID NO: 24461 - DNA, 16 bp, Artificial Sequence
  synthetic [barcode part1]
aacggaacgtgttagt

SEQ ID NO: 24462 - DNA, 16 bp, Artificial Sequence
  synthetic [barcode part1]
gttctgtacggccact

SEQ ID NO: 24463 - DNA, 16 bp, Artificial Sequence
  synthetic [barcode part1]
gcgatatacgttgcac

SEQ ID NO: 24464 - DNA, 16 bp, Artificial Sequence
  synthetic [barcode part1]
cgagagactaatcctc

SEQ ID NO: 24465 - DNA, 16 bp, Artificial Sequence
  synthetic [barcode part1]
tctatcgcagtcctct

SEQ ID NO: 24466 - DNA, 16 bp, Artificial Sequence
  synthetic [barcode part1]
tcaacgacagattgcc

SEQ ID NO: 24467 - DNA, 16 bp, Artificial Sequence
  synthetic [barcode part1]
tacgagtctcggatac

SEQ ID NO: 24468 - DNA, 16 bp, Artificial Sequence
  synthetic [barcode part1]
atcagtcggttctgag

SEQ ID NO: 24469 - DNA, 16 bp, Artificial Sequence
  synthetic [barcode part1]
aattacaaccggcacc

SEQ ID NO: 24470 - DNA, 16 bp, Artificial Sequence
  synthetic [barcode part1]
tgtcgccgataacagt

SEQ ID NO: 24471 - DNA, 16 bp, Artificial Sequence
  synthetic [barcode part1]
caggtacgatctgtgt

SEQ ID NO: 24472 - DNA, 16 bp, Artificial Sequence
  synthetic [barcode part1]
atagtacgccggttgt

SEQ ID NO: 24473 - DNA, 16 bp, Artificial Sequence
  synthetic [barcode part1]
acagttctcactggag

SEQ ID NO: 24474 - DNA, 16 bp, Artificial Sequence
  synthetic [barcode part1]
actccgttggactcac

SEQ ID NO: 24475 - DNA, 16 bp, Artificial Sequence
  synthetic [barcode part1]
ccttaactcggtgcgt

SEQ ID NO: 24476 - DNA, 16 bp, Artificial Sequence
  synthetic [barcode part1]
ccttccaactctctag

SEQ ID NO: 24477 - DNA, 16 bp, Artificial Sequence
  synthetic [barcode part1]
atcagaaccggagaag

SEQ ID NO: 24478 - DNA, 16 bp, Artificial Sequence
  synthetic [barcode part1]
attctgtatcctccgc

SEQ ID NO: 24479 - DNA, 16 bp, Artificial Sequence
  synthetic [barcode part1]
caacaatcgacctggt

SEQ ID NO: 24480 - DNA, 16 bp, Artificial Sequence
  synthetic [barcode part1]
gcgtcctccagtgatt

SEQ ID NO: 24481 - DNA, 16 bp, Artificial Sequence
  synthetic [barcode part1]
ttgacttggcgtattc

SEQ ID NO: 24482 - DNA, 16 bp, Artificial Sequence
  synthetic [barcode part1]
cgatcaacttcaggac

SEQ ID NO: 24483 - DNA, 16 bp, Artificial Sequence
  synthetic [barcode part1]
gccgttgtcgaattag

SEQ ID NO: 24484 - DNA, 16 bp, Artificial Sequence
  synthetic [barcode part1]
gtgtaggtaggttgcg

SEQ ID NO: 24485 - DNA, 16 bp, Artificial Sequence
  synthetic [barcode part1]
actagtgtccgactcc

SEQ ID NO: 24486 - DNA, 16 bp, Artificial Sequence
  synthetic [barcode part1]
cggtcctcacgtagtt

SEQ ID NO: 24487 - DNA, 16 bp, Artificial Sequence
  synthetic [barcode part1]
gaattcaggcgtgtct

SEQ ID NO: 24488 - DNA, 16 bp, Artificial Sequence
  synthetic [barcode part1]
gtggtatctaatcggc

SEQ ID NO: 24489 - DNA, 16 bp, Artificial Sequence
  synthetic [barcode part1]
gttggtgaacacgtct

SEQ ID NO: 24490 - DNA, 16 bp, Artificial Sequence
  synthetic [barcode part1]
acttaagtgtcgtcct

SEQ ID NO: 24491 - DNA, 16 bp, Artificial Sequence
  synthetic [barcode part1]
atcgaactgccaagtc

SEQ ID NO: 24492 - DNA, 16 bp, Artificial Sequence
  synthetic [barcode part1]
acctgagtatccaggt

SEQ ID NO: 24493 - DNA, 16 bp, Artificial Sequence
  synthetic [barcode part1]
gacacgaatcttcacg

SEQ ID NO: 24494 - DNA, 16 bp, Artificial Sequence
  synthetic [barcode part1]
ttgcgaatctaacctc

SEQ ID NO: 24495 - DNA, 16 bp, Artificial Sequence
  synthetic [barcode part1]
tgactcttctcgacct

SEQ ID NO: 24496 - DNA, 16 bp, Artificial Sequence
  synthetic [barcode part1]
actgacagtcctccac

SEQ ID NO: 24497 - DNA, 16 bp, Artificial Sequence
  synthetic [barcode part1]
ccaacaattcggcaac

SEQ ID NO: 24498 - DNA, 16 bp, Artificial Sequence
  synthetic [barcode part1]
aataaccgatcgccgt

SEQ ID NO: 24499 - DNA, 16 bp, Artificial Sequence
  synthetic [barcode part1]
atacagtgaggccggt

SEQ ID NO: 24500 - DNA, 16 bp, Artificial Sequence
  synthetic [barcode part1]
gttagattccacacct

SEQ ID NO: 24501 - DNA, 16 bp, Artificial Sequence
  synthetic [barcode part1]
tatcaatccgatctcg

SEQ ID NO: 24502 - DNA, 16 bp, Artificial Sequence
  synthetic [barcode part1]
acagatcgtacctgac

SEQ ID NO: 24503 - DNA, 16 bp, Artificial Sequence
  synthetic [barcode part1]
attggaacgtgcgacg

SEQ ID NO: 24504 - DNA, 16 bp, Artificial Sequence
  synthetic [barcode part1]
gattacgttctctgac

SEQ ID NO: 24505 - DNA, 16 bp, Artificial Sequence
  synthetic [barcode part1]
tgacggatcgtcttag

SEQ ID NO: 24506 - DNA, 16 bp, Artificial Sequence
  synthetic [barcode part1]
accggacgtaagaacc

SEQ ID NO: 24507 - DNA, 16 bp, Artificial Sequence
  synthetic [barcode part1]
cctatagaccttgccg

SEQ ID NO: 24508 - DNA, 16 bp, Artificial Sequence
  synthetic [barcode part1]
agagacactgccgagt

SEQ ID NO: 24509 - DNA, 16 bp, Artificial Sequence
  synthetic [barcode part1]
gagtaaggacgagtgt

SEQ ID NO: 24510 - DNA, 16 bp, Artificial Sequence
  synthetic [barcode part1]
ttgttcgactcgcctt

SEQ ID NO: 24511 - DNA, 16 bp, Artificial Sequence
  synthetic [barcode part1]
agacgaagacactgtt

SEQ ID NO: 24512 - DNA, 16 bp, Artificial Sequence
  synthetic [barcode part1]
agaggtaacgacttgt

SEQ ID NO: 24513 - DNA, 16 bp, Artificial Sequence
  synthetic [barcode part1]
gttcctccacacaacg

SEQ ID NO: 24514 - DNA, 16 bp, Artificial Sequence
  synthetic [barcode part1]
gacactgacacacgtt

SEQ ID NO: 24515 - DNA, 16 bp, Artificial Sequence
  synthetic [barcode part1]
attgcctccacggact

SEQ ID NO: 24516 - DNA, 16 bp, Artificial Sequence
  synthetic [barcode part1]
cggcgactgtatcctt

SEQ ID NO: 24517 - DNA, 16 bp, Artificial Sequence
  synthetic [barcode part1]
gtcgaactggactgtt

SEQ ID NO: 24518 - DNA, 16 bp, Artificial Sequence
  synthetic [barcode part1]
gaccagttcagagtct

SEQ ID NO: 24519 - DNA, 16 bp, Artificial Sequence
  synthetic [barcode part1]
acgtccgtactatccg

SEQ ID NO: 24520 - DNA, 16 bp, Artificial Sequence
  synthetic [barcode part1]
gccgtgaatctgttcc

SEQ ID NO: 24521 - DNA, 16 bp, Artificial Sequence
  synthetic [barcode part1]
tgttcaccttggagtt

SEQ ID NO: 24522 - DNA, 16 bp, Artificial Sequence
  synthetic [barcode part1]
gtcaacgagacacctt

SEQ ID NO: 24523 - DNA, 16 bp, Artificial Sequence
  synthetic [barcode part1]
aacactccgccttgtg

SEQ ID NO: 24524 - DNA, 16 bp, Artificial Sequence
  synthetic [barcode part1]
tgacgccgatattgtg

SEQ ID NO: 24525 - DNA, 16 bp, Artificial Sequence
  synthetic [barcode part1]
accgttagaaggcacg

SEQ ID NO: 24526 - DNA, 16 bp, Artificial Sequence
  synthetic [barcode part1]
aagagtacaggtcgcc

SEQ ID NO: 24527 - DNA, 16 bp, Artificial Sequence
  synthetic [barcode part1]
aggtcagtgtgcagtg

SEQ ID NO: 24528 - DNA, 16 bp, Artificial Sequence
  synthetic [barcode part1]
ccacactaagttgttc

SEQ ID NO: 24529 - DNA, 16 bp, Artificial Sequence
  synthetic [barcode part1]
gttactggatccagtg

SEQ ID NO: 24530 - DNA, 16 bp, Artificial Sequence
  synthetic [barcode part1]
tgtccacttacggtgc

SEQ ID NO: 24531 - DNA, 16 bp, Artificial Sequence
  synthetic [barcode part1]
cgatagtcttcgcgtc

SEQ ID NO: 24532 - DNA, 16 bp, Artificial Sequence
  synthetic [barcode part1]
atcactggaggcgtag

SEQ ID NO: 24533 - DNA, 16 bp, Artificial Sequence
  synthetic [barcode part1]
tcgtaccgatacgaac

SEQ ID NO: 24534 - DNA, 16 bp, Artificial Sequence
  synthetic [barcode part1]
ccacaggtgtcctatc

SEQ ID NO: 24535 - DNA, 16 bp, Artificial Sequence
  synthetic [barcode part1]
tgacggtagttaccgt

SEQ ID NO: 24536 - DNA, 16 bp, Artificial Sequence
  synthetic [barcode part1]
ccttgacacacaattc

SEQ ID NO: 24537 - DNA, 16 bp, Artificial Sequence
  synthetic [barcode part1]
aggttgtctgcacctc

SEQ ID NO: 24538 - DNA, 16 bp, Artificial Sequence
  synthetic [barcode part1]
gcacttcaccgaactc

SEQ ID NO: 24539 - DNA, 16 bp, Artificial Sequence
  synthetic [barcode part1]
gttcgtctgagacctc

SEQ ID NO: 24540 - DNA, 16 bp, Artificial Sequence
  synthetic [barcode part1]
gtctcctgtatatcag

SEQ ID NO: 24541 - DNA, 16 bp, Artificial Sequence
  synthetic [barcode part1]
taaccacgtgactacg

SEQ ID NO: 24542 - DNA, 16 bp, Artificial Sequence
  synthetic [barcode part1]
caagtatcgacaaggt

SEQ ID NO: 24543 - DNA, 16 bp, Artificial Sequence
  synthetic [barcode part1]
actcaccgagttccac

SEQ ID NO: 24544 - DNA, 16 bp, Artificial Sequence
  synthetic [barcode part1]
ttgcctgaatattgcc

SEQ ID NO: 24545 - DNA, 16 bp, Artificial Sequence
  synthetic [barcode part1]
cctcacagtactcttc

SEQ ID NO: 24546 - DNA, 16 bp, Artificial Sequence
  synthetic [barcode part1]
acagttagaccttcct

SEQ ID NO: 24547 - DNA, 16 bp, Artificial Sequence
  synthetic [barcode part1]
gttgcgatctgtccgt

SEQ ID NO: 24548 - DNA, 16 bp, Artificial Sequence
  synthetic [barcode part1]
caagataactcgaacg

SEQ ID NO: 24549 - DNA, 16 bp, Artificial Sequence
  synthetic [barcode part1]
caattcgtagatcgcg

SEQ ID NO: 24550 - DNA, 16 bp, Artificial Sequence
  synthetic [barcode part1]
gattgtctaagtcgcg

SEQ ID NO: 24551 - DNA, 16 bp, Artificial Sequence
  synthetic [barcode part1]
tactgaaggacacagt

SEQ ID NO: 24552 - DNA, 16 bp, Artificial Sequence
  synthetic [barcode part1]
aggccaataattgcag

SEQ ID NO: 24553 - DNA, 16 bp, Artificial Sequence
  synthetic [barcode part1]
gaactactcgttggac

SEQ ID NO: 24554 - DNA, 16 bp, Artificial Sequence
  synthetic [barcode part1]
tgtgcaaccactattc

SEQ ID NO: 24555 - DNA, 16 bp, Artificial Sequence
  synthetic [barcode part1]
tatccgcaagtaggtc

SEQ ID NO: 24556 - DNA, 16 bp, Artificial Sequence
  synthetic [barcode part1]
cctacacaccaggttc

SEQ ID NO: 24557 - DNA, 16 bp, Artificial Sequence
  synthetic [barcode part1]
tgaatccggcacttag

SEQ ID NO: 24558 - DNA, 16 bp, Artificial Sequence
  synthetic [barcode part1]
acaagaacggcgactc

SEQ ID NO: 24559 - DNA, 16 bp, Artificial Sequence
  synthetic [barcode part1]
acggattcgtggattc

SEQ ID NO: 24560 - DNA, 16 bp, Artificial Sequence
  synthetic [barcode part1]
gtagtgtccaagactc

SEQ ID NO: 24561 - DNA, 16 bp, Artificial Sequence
  synthetic [barcode part1]
tcaccgtccacaagtc

SEQ ID NO: 24562 - DNA, 16 bp, Artificial Sequence
  synthetic [barcode part1]
tagtctgtcgtgcctg

SEQ ID NO: 24563 - DNA, 16 bp, Artificial Sequence
  synthetic [barcode part1]
aactgtacttcctggt

SEQ ID NO: 24564 - DNA, 16 bp, Artificial Sequence
  synthetic [barcode part1]
taggttccgttatctg

SEQ ID NO: 24565 - DNA, 16 bp, Artificial Sequence
  synthetic [barcode part1]
actgtaacgttcacct

SEQ ID NO: 24566 - DNA, 16 bp, Artificial Sequence
  synthetic [barcode part1]
agacacgtggcctaag

SEQ ID NO: 24567 - DNA, 16 bp, Artificial Sequence
  synthetic [barcode part1]
cctggcaacaatctag

SEQ ID NO: 24568 - DNA, 16 bp, Artificial Sequence
  synthetic [barcode part1]
gacagaccagaactcg

SEQ ID NO: 24569 - DNA, 16 bp, Artificial Sequence
  synthetic [barcode part1]
tcgtcaacgtgtctcg

SEQ ID NO: 24570 - DNA, 16 bp, Artificial Sequence
  synthetic [barcode part1]
cggtaagtaaggcaag

SEQ ID NO: 24571 - DNA, 16 bp, Artificial Sequence
  synthetic [barcode part1]
tcaggacggtgttgtt

SEQ ID NO: 24572 - DNA, 16 bp, Artificial Sequence
  synthetic [barcode part1]
aagaacttacacgacg

SEQ ID NO: 24573 - DNA, 16 bp, Artificial Sequence
  synthetic [barcode part1]
cgcgtagaacggtaac

SEQ ID NO: 24574 - DNA, 16 bp, Artificial Sequence
  synthetic [barcode part1]
acttcaccgagagact

SEQ ID NO: 24575 - DNA, 16 bp, Artificial Sequence
  synthetic [barcode part1]
tggtcctgttatacac

SEQ ID NO: 24576 - DNA, 16 bp, Artificial Sequence
  synthetic [barcode part1]
caactctctggtcctt

SEQ ID NO: 24577 - DNA, 16 bp, Artificial Sequence
  synthetic [barcode part1]
atcacggttcgcctgt

SEQ ID NO: 24578 - DNA, 16 bp, Artificial Sequence
  synthetic [barcode part1]
cgacggcaagagtact

SEQ ID NO: 24579 - DNA, 16 bp, Artificial Sequence
  synthetic [barcode part1]
agattcaggcgtacct

SEQ ID NO: 24580 - DNA, 16 bp, Artificial Sequence
  synthetic [barcode part1]
aggcacacaacaaccg

SEQ ID NO: 24581 - DNA, 16 bp, Artificial Sequence
  synthetic [barcode part1]
acgacttgtgactcag

SEQ ID NO: 24582 - DNA, 16 bp, Artificial Sequence
  synthetic [barcode part1]
aatcgtggcaccaatc

SEQ ID NO: 24583 - DNA, 16 bp, Artificial Sequence
  synthetic [barcode part1]
agtggagtcgatatac

SEQ ID NO: 24584 - DNA, 16 bp, Artificial Sequence
  synthetic [barcode part1]
agaacaatcgtgagtc

SEQ ID NO: 24585 - DNA, 16 bp, Artificial Sequence
  synthetic [barcode part1]
gactgcgaactctctc

SEQ ID NO: 24586 - DNA, 16 bp, Artificial Sequence
  synthetic [barcode part1]
tggaactctctaaggc

SEQ ID NO: 24587 - DNA, 16 bp, Artificial Sequence
  synthetic [barcode part1]
actacgagtagtgtcc

SEQ ID NO: 24588 - DNA, 16 bp, Artificial Sequence
  synthetic [barcode part1]
aagacgcgccagattg

SEQ ID NO: 24589 - DNA, 16 bp, Artificial Sequence
  synthetic [barcode part1]
agtcagtcagtcagtc

SEQ ID NO: 24590 - DNA, 16 bp, Artificial Sequence
  synthetic [barcode part1]
tgttggagtgacctac

SEQ ID NO: 24591 - DNA, 16 bp, Artificial Sequence
  synthetic [barcode part1]
cgaagaccagagatag

SEQ ID NO: 24592 - DNA, 16 bp, Artificial Sequence
  synthetic [barcode part1]
gaggcaagtagtgaac

SEQ ID NO: 24593 - DNA, 16 bp, Artificial Sequence
  synthetic [barcode part1]
tcgaacgttcactgtt

SEQ ID NO: 24594 - DNA, 16 bp, Artificial Sequence
  synthetic [barcode part1]
atctgaggtgaacctc

SEQ ID NO: 24595 - DNA, 16 bp, Artificial Sequence
  synthetic [barcode part1]
gtcaggtgacacgagt

SEQ ID NO: 24596 - DNA, 16 bp, Artificial Sequence
  synthetic [barcode part1]
aacttggacactcttc

SEQ ID NO: 24597 - DNA, 16 bp, Artificial Sequence
  synthetic [barcode part1]
cgatctccggtatacc

SEQ ID NO: 24598 - DNA, 16 bp, Artificial Sequence
  synthetic [barcode part1]
cgtctgttaccgcaac

SEQ ID NO: 24599 - DNA, 16 bp, Artificial Sequence
  synthetic [barcode part1]
caggacttcttgaggt

SEQ ID NO: 24600 - DNA, 16 bp, Artificial Sequence
  synthetic [barcode part1]
actcgaagaacgacgc

SEQ ID NO: 24601 - DNA, 16 bp, Artificial Sequence
  synthetic [barcode part1]
gaccagataggaagtg

SEQ ID NO: 24602 - DNA, 16 bp, Artificial Sequence
  synthetic [barcode part1]
agtgtacgttgcacac

SEQ ID NO: 24603 - DNA, 16 bp, Artificial Sequence
  synthetic [barcode part1]
caatcggtcaaggtct

SEQ ID NO: 24604 - DNA, 16 bp, Artificial Sequence
  synthetic [barcode part1]
gacactggatcctagt

SEQ ID NO: 24605 - DNA, 16 bp, Artificial Sequence
  synthetic [barcode part1]
gtgttcagagtggcag

SEQ ID NO: 24606 - DNA, 16 bp, Artificial Sequence
  synthetic [barcode part1]
ccggatattattccgt

SEQ ID NO: 24607 - DNA, 16 bp, Artificial Sequence
  synthetic [barcode part1]
cctcctaatagtcgcg

SEQ ID NO: 24608 - DNA, 16 bp, Artificial Sequence
  synthetic [barcode part1]
cctaatccggtgtatt

SEQ ID NO: 24609 - DNA, 16 bp, Artificial Sequence
  synthetic [barcode part1]
ttgattcggcggtaac

SEQ ID NO: 24610 - DNA, 16 bp, Artificial Sequence
  synthetic [barcode part1]
gcgaatccggttctct

SEQ ID NO: 24611 - DNA, 16 bp, Artificial Sequence
  synthetic [barcode part1]
gaaggtaacagttcgt

SEQ ID NO: 24612 - DNA, 16 bp, Artificial Sequence
  synthetic [barcode part1]
cgactcttgtagttac

SEQ ID NO: 24613 - DNA, 16 bp, Artificial Sequence
  synthetic [barcode part1]
gtcgcagttgcctatc

SEQ ID NO: 24614 - DNA, 16 bp, Artificial Sequence
  synthetic [barcode part1]
ttctgtgaccaggcct

SEQ ID NO: 24615 - DNA, 16 bp, Artificial Sequence
  synthetic [barcode part1]
tactgaggcaaggacc

SEQ ID NO: 24616 - DNA, 16 bp, Artificial Sequence
  synthetic [barcode part1]
tcgaatcgaccactag

SEQ ID NO: 24617 - DNA, 16 bp, Artificial Sequence
  synthetic [barcode part1]
atcacagtggagtctc

SEQ ID NO: 24618 - DNA, 16 bp, Artificial Sequence
  synthetic [barcode part1]
cgatagtgtataggac

SEQ ID NO: 24619 - DNA, 16 bp, Artificial Sequence
  synthetic [barcode part1]
gttcgatctccacacg

SEQ ID NO: 24620 - DNA, 16 bp, Artificial Sequence
  synthetic [barcode part1]
cactgttggatcgagt

SEQ ID NO: 24621 - DNA, 16 bp, Artificial Sequence
  synthetic [barcode part1]
gaggatcagtcaagag

SEQ ID NO: 24622 - DNA, 16 bp, Artificial Sequence
  synthetic [barcode part1]
ccaacgatatccttgt

SEQ ID NO: 24623 - DNA, 16 bp, Artificial Sequence
  synthetic [barcode part1]
cctgcgttgtactctt

SEQ ID NO: 24624 - DNA, 16 bp, Artificial Sequence
  synthetic [barcode part1]
ccaaggattccactag

SEQ ID NO: 24625 - DNA, 16 bp, Artificial Sequence
  synthetic [barcode part1]
tctgttgcgtagactt

SEQ ID NO: 24626 - DNA, 16 bp, Artificial Sequence
  synthetic [barcode part1]
gtgttgagattcacgc

SEQ ID NO: 24627 - DNA, 16 bp, Artificial Sequence
  synthetic [barcode part1]
gtgaggaatactctcc

SEQ ID NO: 24628 - DNA, 16 bp, Artificial Sequence
  synthetic [barcode part1]
aggttgcgttcttgtt

SEQ ID NO: 24629 - DNA, 16 bp, Artificial Sequence
  synthetic [barcode part1]
cctgtgttggttcgac

SEQ ID NO: 24630 - DNA, 16 bp, Artificial Sequence
  synthetic [barcode part1]
atccgcggttgttctg

SEQ ID NO: 24631 - DNA, 16 bp, Artificial Sequence
  synthetic [barcode part1]
agtaagtcttgaggtg

SEQ ID NO: 24632 - DNA, 16 bp, Artificial Sequence
  synthetic [barcode part1]
gtctgaagatacctgc

SEQ ID NO: 24633 - DNA, 16 bp, Artificial Sequence
  synthetic [barcode part1]
ttgattagtgtgcgcg

SEQ ID NO: 24634 - DNA, 16 bp, Artificial Sequence
  synthetic [barcode part1]
agagaacaacgtacct

SEQ ID NO: 24635 - DNA, 16 bp, Artificial Sequence
  synthetic [barcode part1]
tctcagttcagtgtgt

SEQ ID NO: 24636 - DNA, 16 bp, Artificial Sequence
  synthetic [barcode part1]
gccacgatctatctgc

SEQ ID NO: 24637 - DNA, 16 bp, Artificial Sequence
  synthetic [barcode part1]
agtctgtggtgagacg

SEQ ID NO: 24638 - DNA, 16 bp, Artificial Sequence
  synthetic [barcode part1]
atcgaggtcgatcttg

SEQ ID NO: 24639 - DNA, 16 bp, Artificial Sequence
  synthetic [barcode part1]
aactgtcggactgttg

SEQ ID NO: 24640 - DNA, 16 bp, Artificial Sequence
  synthetic [barcode part1]
gacgatcggttcagtt

SEQ ID NO: 24641 - DNA, 16 bp, Artificial Sequence
  synthetic [barcode part1]
gcaacgactcgtagag

SEQ ID NO: 24642 - DNA, 16 bp, Artificial Sequence
  synthetic [barcode part1]
aagtcgtctaccgaac

SEQ ID NO: 24643 - DNA, 16 bp, Artificial Sequence
  synthetic [barcode part1]
aagtaagttcgagacc

SEQ ID NO: 24644 - DNA, 16 bp, Artificial Sequence
  synthetic [barcode part1]
cagtactacttactcg

SEQ ID NO: 24645 - DNA, 16 bp, Artificial Sequence
  synthetic [barcode part1]
ttaacctgcgactgcc

SEQ ID NO: 24646 - DNA, 16 bp, Artificial Sequence
  synthetic [barcode part1]
gcacgacgtattgatc

SEQ ID NO: 24647 - DNA, 16 bp, Artificial Sequence
  synthetic [barcode part1]
tctgaagtggcactac

SEQ ID NO: 24648 - DNA, 16 bp, Artificial Sequence
  synthetic [barcode part1]
aattgcgccgacttcc

SEQ ID NO: 24649 - DNA, 16 bp, Artificial Sequence
  synthetic [barcode part1]
aaccgtgtgcgcaatt

SEQ ID NO: 24650 - DNA, 16 bp, Artificial Sequence
  synthetic [barcode part1]
tgtggattccgtcacc

SEQ ID NO: 24651 - DNA, 16 bp, Artificial Sequence
  synthetic [barcode part1]
cacaatcgtcgtcctg

SEQ ID NO: 24652 - DNA, 16 bp, Artificial Sequence
  synthetic [barcode part1]
tcaagataggcgaact

SEQ ID NO: 24653 - DNA, 16 bp, Artificial Sequence
  synthetic [barcode part1]
tggcagatacttagag

SEQ ID NO: 24654 - DNA, 16 bp, Artificial Sequence
  synthetic [barcode part1]
gtcagtacgttaacgc

SEQ ID NO: 24655 - DNA, 16 bp, Artificial Sequence
  synthetic [barcode part1]
aatccagtccttgtac

SEQ ID NO: 24656 - DNA, 16 bp, Artificial Sequence
  synthetic [barcode part1]
ataacacgtgtcgcgt

SEQ ID NO: 24657 - DNA, 16 bp, Artificial Sequence
  synthetic [barcode part1]
gttctgccttagttcc

SEQ ID NO: 24658 - DNA, 16 bp, Artificial Sequence
  synthetic [barcode part1]
ccacttcttgatacag

SEQ ID NO: 24659 - DNA, 16 bp, Artificial Sequence
  synthetic [barcode part1]
gtcggatccgtacctt

SEQ ID NO: 24660 - DNA, 16 bp, Artificial Sequence
  synthetic [barcode part1]
gtacgtggaagttcct

SEQ ID NO: 24661 - DNA, 16 bp, Artificial Sequence
  synthetic [barcode part1]
ccttaatagtcgtgtc

SEQ ID NO: 24662 - DNA, 16 bp, Artificial Sequence
  synthetic [barcode part1]
atccggactacaggtt

SEQ ID NO: 24663 - DNA, 16 bp, Artificial Sequence
  synthetic [barcode part1]
tcacactcgttaggtt

SEQ ID NO: 24664 - DNA, 16 bp, Artificial Sequence
  synthetic [barcode part1]
agtagaagactcgcgc

SEQ ID NO: 24665 - DNA, 16 bp, Artificial Sequence
  synthetic [barcode part1]
gtgtgtgtggttgact

SEQ ID NO: 24666 - DNA, 16 bp, Artificial Sequence
  synthetic [barcode part1]
gatcagtacaccgtac

SEQ ID NO: 24667 - DNA, 16 bp, Artificial Sequence
  synthetic [barcode part1]
ataggatacgagtctg

SEQ ID NO: 24668 - DNA, 16 bp, Artificial Sequence
  synthetic [barcode part1]
cagagaacgattacgt

SEQ ID NO: 24669 - DNA, 16 bp, Artificial Sequence
  synthetic [barcode part1]
tacacagtaggaagtc

SEQ ID NO: 24670 - DNA, 16 bp, Artificial Sequence
  synthetic [barcode part1]
cgtggcaagattctac

SEQ ID NO: 24671 - DNA, 16 bp, Artificial Sequence
  synthetic [barcode part1]
taaggcggagtactcg

SEQ ID NO: 24672 - DNA, 16 bp, Artificial Sequence
  synthetic [barcode part1]
cctcggttgatctctt

SEQ ID NO: 24673 - DNA, 16 bp, Artificial Sequence
  synthetic [barcode part1]
tgcactaccttaactg

SEQ ID NO: 24674 - DNA, 16 bp, Artificial Sequence
  synthetic [barcode part1]
attgtgcactatcctg

SEQ ID NO: 24675 - DNA, 16 bp, Artificial Sequence
  synthetic [barcode part1]
caatcttgtgtgttgc

SEQ ID NO: 24676 - DNA, 16 bp, Artificial Sequence
  synthetic [barcode part1]
tctcgaactattcacg

SEQ ID NO: 24677 - DNA, 16 bp, Artificial Sequence
  synthetic [barcode part1]
atccagaatctgcgac

SEQ ID NO: 24678 - DNA, 16 bp, Artificial Sequence
  synthetic [barcode part1]
ccggttcttgcgtagt

SEQ ID NO: 24679 - DNA, 16 bp, Artificial Sequence
  synthetic [barcode part1]
acgattaggttcctct

SEQ ID NO: 24680 - DNA, 16 bp, Artificial Sequence
  synthetic [barcode part1]
ttgacgaagtggtctc

SEQ ID NO: 24681 - DNA, 16 bp, Artificial Sequence
  synthetic [barcode part1]
cggcaacagaacgtac

SEQ ID NO: 24682 - DNA, 16 bp, Artificial Sequence
  synthetic [barcode part1]
gcctggtcgataattg

SEQ ID NO: 24683 - DNA, 16 bp, Artificial Sequence
  synthetic [barcode part1]
tgaccgaggaactctt

SEQ ID NO: 24684 - DNA, 16 bp, Artificial Sequence
  synthetic [barcode part1]
atctcgtatccgagtt

SEQ ID NO: 24685 - DNA, 16 bp, Artificial Sequence
  synthetic [barcode part1]
agactaacgaccgcag

SEQ ID NO: 24686 - DNA, 16 bp, Artificial Sequence
  synthetic [barcode part1]
aatagacaggtcctag

SEQ ID NO: 24687 - DNA, 16 bp, Artificial Sequence
  synthetic [barcode part1]
cgtgcacgattctaag

SEQ ID NO: 24688 - DNA, 16 bp, Artificial Sequence
  synthetic [barcode part1]
gtaagaagttgccggc

SEQ ID NO: 24689 - DNA, 16 bp, Artificial Sequence
  synthetic [barcode part1]
tgcggatattccgcct

SEQ ID NO: 24690 - DNA, 16 bp, Artificial Sequence
  synthetic [barcode part1]
gcaacgtctagttggt

SEQ ID NO: 24691 - DNA, 16 bp, Artificial Sequence
  synthetic [barcode part1]
gatatcgtcgaccaac

SEQ ID NO: 24692 - DNA, 16 bp, Artificial Sequence
  synthetic [barcode part1]
tccacgttgacgatcc

SEQ ID NO: 24693 - DNA, 16 bp, Artificial Sequence
  synthetic [barcode part1]
ttcggagtgtggtact

SEQ ID NO: 24694 - DNA, 16 bp, Artificial Sequence
  synthetic [barcode part1]
gagtgccgaacgatac

SEQ ID NO: 24695 - DNA, 16 bp, Artificial Sequence
  synthetic [barcode part1]
acaagtagttccgaag

SEQ ID NO: 24696 - DNA, 16 bp, Artificial Sequence
  synthetic [barcode part1]
agaagtggcaaggact

SEQ ID NO: 24697 - DNA, 16 bp, Artificial Sequence
  synthetic [barcode part1]
ccttgtattgaaccgt

SEQ ID NO: 24698 - DNA, 16 bp, Artificial Sequence
  synthetic [barcode part1]
tctcctcagtcgatct

SEQ ID NO: 24699 - DNA, 16 bp, Artificial Sequence
  synthetic [barcode part1]
tagacacgactgtgtc

SEQ ID NO: 24700 - DNA, 16 bp, Artificial Sequence
  synthetic [barcode part1]
agaagttattgacgcg

SEQ ID NO: 24701 - DNA, 16 bp, Artificial Sequence
  synthetic [barcode part1]
tcggaactatcgtggt

SEQ ID NO: 24702 - DNA, 16 bp, Artificial Sequence
  synthetic [barcode part1]
tacctacaccttgagt

SEQ ID NO: 24703 - DNA, 16 bp, Artificial Sequence
  synthetic [barcode part1]
caatcacggtgacgag

SEQ ID NO: 24704 - DNA, 16 bp, Artificial Sequence
  synthetic [barcode part1]
actacgtattacctcg

SEQ ID NO: 24705 - DNA, 16 bp, Artificial Sequence
  synthetic [barcode part1]
tactcgtgcgacgtct

SEQ ID NO: 24706 - DNA, 16 bp, Artificial Sequence
  synthetic [barcode part1]
gtgagtcttctgccgt

SEQ ID NO: 24707 - DNA, 16 bp, Artificial Sequence
  synthetic [barcode part1]
taagtacttggcgcgt

SEQ ID NO: 24708 - DNA, 16 bp, Artificial Sequence
  synthetic [barcode part1]
caaggacgtctggtag

SEQ ID NO: 24709 - DNA, 16 bp, Artificial Sequence
  synthetic [barcode part1]
ccgttcgactccaagt

SEQ ID NO: 24710 - DNA, 16 bp, Artificial Sequence
  synthetic [barcode part1]
gtcacgcaactatacg

SEQ ID NO: 24711 - DNA, 16 bp, Artificial Sequence
  synthetic [barcode part1]
gacacaccacaactgt

SEQ ID NO: 24712 - DNA, 16 bp, Artificial Sequence
  synthetic [barcode part1]
agtctctgattcgtgt

SEQ ID NO: 24713 - DNA, 16 bp, Artificial Sequence
  synthetic [barcode part1]
tgcctgcgaactctgt

SEQ ID NO: 24714 - DNA, 16 bp, Artificial Sequence
  synthetic [barcode part1]
actatctcgtcgttcc

SEQ ID NO: 24715 - DNA, 16 bp, Artificial Sequence
  synthetic [barcode part1]
gcgtgtagaagtcctt

SEQ ID NO: 24716 - DNA, 16 bp, Artificial Sequence
  synthetic [barcode part1]
ccgtaattggttggtg

SEQ ID NO: 24717 - DNA, 16 bp, Artificial Sequence
  synthetic [barcode part1]
acctggacagaatagt

SEQ ID NO: 24718 - DNA, 16 bp, Artificial Sequence
  synthetic [barcode part1]
attcttcctggttccg

SEQ ID NO: 24719 - DNA, 16 bp, Artificial Sequence
  synthetic [barcode part1]
aggcagagaaccttgc

SEQ ID NO: 24720 - DNA, 16 bp, Artificial Sequence
  synthetic [barcode part1]
tccagtctgtgtggtc

SEQ ID NO: 24721 - DNA, 16 bp, Artificial Sequence
  synthetic [barcode part1]
gccttctaaccttctg

SEQ ID NO: 24722 - DNA, 16 bp, Artificial Sequence
  synthetic [barcode part1]
tgcctggatacaactg

SEQ ID NO: 24723 - DNA, 16 bp, Artificial Sequence
  synthetic [barcode part1]
gtattccagaggcact

SEQ ID NO: 24724 - DNA, 16 bp, Artificial Sequence
  synthetic [barcode part1]
agattcgcggaaggtc

SEQ ID NO: 24725 - DNA, 16 bp, Artificial Sequence
  synthetic [barcode part1]
gagaggtagtggtaac

SEQ ID NO: 24726 - DNA, 16 bp, Artificial Sequence
  synthetic [barcode part1]
gacggagtcttcgatt

SEQ ID NO: 24727 - DNA, 16 bp, Artificial Sequence
  synthetic [barcode part1]
agtctacctgtgagtg

SEQ ID NO: 24728 - DNA, 16 bp, Artificial Sequence
  synthetic [barcode part1]
agacgtgttgaactag

SEQ ID NO: 24729 - DNA, 16 bp, Artificial Sequence
  synthetic [barcode part1]
ttaagatataggcggc

SEQ ID NO: 24730 - DNA, 16 bp, Artificial Sequence
  synthetic [barcode part1]
cacaacggtgaatagt

SEQ ID NO: 24731 - DNA, 16 bp, Artificial Sequence
  synthetic [barcode part1]
cactccgattcacggt

SEQ ID NO: 24732 - DNA, 16 bp, Artificial Sequence
  synthetic [barcode part1]
cacagtggtgaacggt

SEQ ID NO: 24733 - DNA, 16 bp, Artificial Sequence
  synthetic [barcode part1]
atcctcgttgtgttcc

SEQ ID NO: 24734 - DNA, 16 bp, Artificial Sequence
  synthetic [barcode part1]
taacggtatacgagac

SEQ ID NO: 24735 - DNA, 16 bp, Artificial Sequence
  synthetic [barcode part1]
agttgcaacaccaacc

SEQ ID NO: 24736 - DNA, 16 bp, Artificial Sequence
  synthetic [barcode part1]
gttgcgacacttactt

SEQ ID NO: 24737 - DNA, 16 bp, Artificial Sequence
  synthetic [barcode part1]
gcacgtcctatacaag

SEQ ID NO: 24738 - DNA, 16 bp, Artificial Sequence
  synthetic [barcode part1]
ttgacgtcctctcgag

SEQ ID NO: 24739 - DNA, 16 bp, Artificial Sequence
  synthetic [barcode part1]
aagaggtagaccaggt

SEQ ID NO: 24740 - DNA, 16 bp, Artificial Sequence
  synthetic [barcode part1]
gtctcacacaactatc

SEQ ID NO: 24741 - DNA, 16 bp, Artificial Sequence
  synthetic [barcode part1]
tctaatctagtacgcc

SEQ ID NO: 24742 - DNA, 16 bp, Artificial Sequence
  synthetic [barcode part1]
gtgccttcaatccgac

SEQ ID NO: 24743 - DNA, 16 bp, Artificial Sequence
  synthetic [barcode part1]
tggaatcgccaactac

SEQ ID NO: 24744 - DNA, 16 bp, Artificial Sequence
  synthetic [barcode part1]
ccggcaacaagagtac

SEQ ID NO: 24745 - DNA, 16 bp, Artificial Sequence
  synthetic [barcode part1]
tgcaaggtagtggtcg

SEQ ID NO: 24746 - DNA, 16 bp, Artificial Sequence
  synthetic [barcode part1]
tattcctcggtaatcg

SEQ ID NO: 24747 - DNA, 16 bp, Artificial Sequence
  synthetic [barcode part1]
gtgtatcacttggacg

SEQ ID NO: 24748 - DNA, 16 bp, Artificial Sequence
  synthetic [barcode part1]
gttggcagtctgagtt

SEQ ID NO: 24749 - DNA, 16 bp, Artificial Sequence
  synthetic [barcode part1]
tcagtggactcctatt

SEQ ID NO: 24750 - DNA, 16 bp, Artificial Sequence
  synthetic [barcode part1]
ccgatagatccttact

SEQ ID NO: 24751 - DNA, 16 bp, Artificial Sequence
  synthetic [barcode part1]
gcactgaagaagttgt

SEQ ID NO: 24752 - DNA, 16 bp, Artificial Sequence
  synthetic [barcode part1]
atagaggcacagaggt

SEQ ID NO: 24753 - DNA, 16 bp, Artificial Sequence
  synthetic [barcode part1]
ccagttcagatcgaac

SEQ ID NO: 24754 - DNA, 16 bp, Artificial Sequence
  synthetic [barcode part1]
caccgtggattaactg

SEQ ID NO: 24755 - DNA, 16 bp, Artificial Sequence
  synthetic [barcode part1]
gttgccgaagagtacg

SEQ ID NO: 24756 - DNA, 16 bp, Artificial Sequence
  synthetic [barcode part1]
gaggtaatcacagact

SEQ ID NO: 24757 - DNA, 16 bp, Artificial Sequence
  synthetic [barcode part1]
cgttggatactggact

SEQ ID NO: 24758 - DNA, 16 bp, Artificial Sequence
  synthetic [barcode part1]
atctcacctaccacct

SEQ ID NO: 24759 - DNA, 16 bp, Artificial Sequence
  synthetic [barcode part1]
tggatcagtataaggc

SEQ ID NO: 24760 - DNA, 16 bp, Artificial Sequence
  synthetic [barcode part1]
tagacgtcacaagtcc

SEQ ID NO: 24761 - DNA, 16 bp, Artificial Sequence
  synthetic [barcode part1]
agaacgcgttaggtcg

SEQ ID NO: 24762 - DNA, 16 bp, Artificial Sequence
  synthetic [barcode part1]
gaggactgttggtacg

SEQ ID NO: 24763 - DNA, 16 bp, Artificial Sequence
  synthetic [barcode part1]
aacgattcggttcggt

SEQ ID NO: 24764 - DNA, 16 bp, Artificial Sequence
  synthetic [barcode part1]
gactcagaattgccgt

SEQ ID NO: 24765 - DNA, 16 bp, Artificial Sequence
  synthetic [barcode part1]
caacttcctggaaggt

SEQ ID NO: 24766 - DNA, 16 bp, Artificial Sequence
  synthetic [barcode part1]
aactgtagtcggcgtt

SEQ ID NO: 24767 - DNA, 16 bp, Artificial Sequence
  synthetic [barcode part1]
gtcaggaccttaactg

SEQ ID NO: 24768 - DNA, 16 bp, Artificial Sequence
  synthetic [barcode part1]
caaccaggcgtatact

SEQ ID NO: 24769 - DNA, 16 bp, Artificial Sequence
  synthetic [barcode part1]
cgtcgtcgagttaagt

SEQ ID NO: 24770 - DNA, 16 bp, Artificial Sequence
  synthetic [barcode part1]
cggttcttaatacgtc

SEQ ID NO: 24771 - DNA, 16 bp, Artificial Sequence
  synthetic [barcode part1]
ttccagagtaggtaag

SEQ ID NO: 24772 - DNA, 16 bp, Artificial Sequence
  synthetic [barcode part1]
cgaaggatacaactac

SEQ ID NO: 24773 - DNA, 16 bp, Artificial Sequence
  synthetic [barcode part1]
atcggtacgtcctgtc

SEQ ID NO: 24774 - DNA, 16 bp, Artificial Sequence
  synthetic [barcode part1]
aggacgtgtgttcttg

SEQ ID NO: 24775 - DNA, 16 bp, Artificial Sequence
  synthetic [barcode part1]
gagaggtccacacaac

SEQ ID NO: 24776 - DNA, 16 bp, Artificial Sequence
  synthetic [barcode part1]
tgtagacagacctacc

SEQ ID NO: 24777 - DNA, 16 bp, Artificial Sequence
  synthetic [barcode part1]
tgtgcggacttctcac

SEQ ID NO: 24778 - DNA, 16 bp, Artificial Sequence
  synthetic [barcode part1]
cgagagatcaatctcc

SEQ ID NO: 24779 - DNA, 16 bp, Artificial Sequence
  synthetic [barcode part1]
tgtcactggacgtcct

SEQ ID NO: 24780 - DNA, 16 bp, Artificial Sequence
  synthetic [barcode part1]
gttctactattggcgt

SEQ ID NO: 24781 - DNA, 16 bp, Artificial Sequence
  synthetic [barcode part1]
ccactacgcagattcc

SEQ ID NO: 24782 - DNA, 16 bp, Artificial Sequence
  synthetic [barcode part1]
agttaatcggcgtcac

SEQ ID NO: 24783 - DNA, 16 bp, Artificial Sequence
  synthetic [barcode part1]
tagacaacaggcagag

SEQ ID NO: 24784 - DNA, 16 bp, Artificial Sequence
  synthetic [barcode part1]
tcgatagtaaggacac

SEQ ID NO: 24785 - DNA, 16 bp, Artificial Sequence
  synthetic [barcode part1]
gaacgtcgccttgtct

SEQ ID NO: 24786 - DNA, 16 bp, Artificial Sequence
  synthetic [barcode part1]
tggtggcaggagtatc

SEQ ID NO: 24787 - DNA, 16 bp, Artificial Sequence
  synthetic [barcode part1]
acaggaccttggacag

SEQ ID NO: 24788 - DNA, 16 bp, Artificial Sequence
  synthetic [barcode part1]
tgaagaacgatcgtac

SEQ ID NO: 24789 - DNA, 16 bp, Artificial Sequence
  synthetic [barcode part1]
tgataccagtaccacg

SEQ ID NO: 24790 - DNA, 16 bp, Artificial Sequence
  synthetic [barcode part1]
tcctgtataacgacct

SEQ ID NO: 24791 - DNA, 16 bp, Artificial Sequence
  synthetic [barcode part1]
cctgaagttgaggtct

SEQ ID NO: 24792 - DNA, 16 bp, Artificial Sequence
  synthetic [barcode part1]
gattcgtcggaacgag

SEQ ID NO: 24793 - DNA, 16 bp, Artificial Sequence
  synthetic [barcode part1]
caacacttattcaccg

SEQ ID NO: 24794 - DNA, 16 bp, Artificial Sequence
  synthetic [barcode part1]
tgtacgtaaccgatcg

SEQ ID NO: 24795 - DNA, 16 bp, Artificial Sequence
  synthetic [barcode part1]
gaatatcctgccttgt

SEQ ID NO: 24796 - DNA, 16 bp, Artificial Sequence
  synthetic [barcode part1]
aacgaccggtctagtt

SEQ ID NO: 24797 - DNA, 16 bp, Artificial Sequence
  synthetic [barcode part1]
aaccactctcaacgag

SEQ ID NO: 24798 - DNA, 16 bp, Artificial Sequence
  synthetic [barcode part1]
gatactcctgtcgtcg

SEQ ID NO: 24799 - DNA, 16 bp, Artificial Sequence
  synthetic [barcode part1]
tcctacggtgttcttc

SEQ ID NO: 24800 - DNA, 16 bp, Artificial Sequence
  synthetic [barcode part1]
tgtcgattcttaaccg

SEQ ID NO: 24801 - DNA, 16 bp, Artificial Sequence
  synthetic [barcode part1]
taggtctcgagtatcg

SEQ ID NO: 24802 - DNA, 16 bp, Artificial Sequence
  synthetic [barcode part1]
cgaacgtagaacaact

SEQ ID NO: 24803 - DNA, 16 bp, Artificial Sequence
  synthetic [barcode part1]
gtgtggagagtgtaag

SEQ ID NO: 24804 - DNA, 16 bp, Artificial Sequence
  synthetic [barcode part1]
gcaagtgacttgtctg

SEQ ID NO: 24805 - DNA, 16 bp, Artificial Sequence
  synthetic [barcode part1]
tggttggaccacgatt

SEQ ID NO: 24806 - DNA, 16 bp, Artificial Sequence
  synthetic [barcode part1]
attggtgtctgatctc

SEQ ID NO: 24807 - DNA, 16 bp, Artificial Sequence
  synthetic [barcode part1]
gttagtgagacgttcc

SEQ ID NO: 24808 - DNA, 16 bp, Artificial Sequence
  synthetic [barcode part1]
tcctgcacggcaattc

SEQ ID NO: 24809 - DNA, 16 bp, Artificial Sequence
  synthetic [barcode part1]
tgaccaacaaccagtc

SEQ ID NO: 24810 - DNA, 16 bp, Artificial Sequence
  synthetic [barcode part1]
agacgacaatcgcgtg

SEQ ID NO: 24811 - DNA, 16 bp, Artificial Sequence
  synthetic [barcode part1]
gtcttgaagagtctcg

SEQ ID NO: 24812 - DNA, 16 bp, Artificial Sequence
  synthetic [barcode part1]
cctgagactaagacct

SEQ ID NO: 24813 - DNA, 16 bp, Artificial Sequence
  synthetic [barcode part1]
cacgattgttattccg

SEQ ID NO: 24814 - DNA, 16 bp, Artificial Sequence
  synthetic [barcode part1]
cgagagaaccgatacc

SEQ ID NO: 24815 - DNA, 16 bp, Artificial Sequence
  synthetic [barcode part1]
tctgtcactaggtgtt

SEQ ID NO: 24816 - DNA, 16 bp, Artificial Sequence
  synthetic [barcode part1]
atctacgactgttctg

SEQ ID NO: 24817 - DNA, 16 bp, Artificial Sequence
  synthetic [barcode part1]
gcaagtccgtagatct

SEQ ID NO: 24818 - DNA, 16 bp, Artificial Sequence
  synthetic [barcode part1]
gtcggtggaattaggc

SEQ ID NO: 24819 - DNA, 16 bp, Artificial Sequence
  synthetic [barcode part1]
tgtcactgttctccgt

SEQ ID NO: 24820 - DNA, 16 bp, Artificial Sequence
  synthetic [barcode part1]
taatcgcgcctctcag

SEQ ID NO: 24821 - DNA, 16 bp, Artificial Sequence
  synthetic [barcode part1]
aagttagtgtacgacg

SEQ ID NO: 24822 - DNA, 16 bp, Artificial Sequence
  synthetic [barcode part1]
agtgttcaccttctag

SEQ ID NO: 24823 - DNA, 16 bp, Artificial Sequence
  synthetic [barcode part1]
gtgacttaggtcactg

SEQ ID NO: 24824 - DNA, 16 bp, Artificial Sequence
  synthetic [barcode part1]
agttgcacagtcacac

SEQ ID NO: 24825 - DNA, 16 bp, Artificial Sequence
  synthetic [barcode part1]
gttgaacaggtgtggc

SEQ ID NO: 24826 - DNA, 16 bp, Artificial Sequence
  synthetic [barcode part1]
agacctgttgtcactt

SEQ ID NO: 24827 - DNA, 16 bp, Artificial Sequence
  synthetic [barcode part1]
cgtctacgcgatactc

SEQ ID NO: 24828 - DNA, 16 bp, Artificial Sequence
  synthetic [barcode part1]
tgaagaaggttgaggc

SEQ ID NO: 24829 - DNA, 16 bp, Artificial Sequence
  synthetic [barcode part1]
acgagagttaggccac

SEQ ID NO: 24830 - DNA, 16 bp, Artificial Sequence
  synthetic [barcode part1]
gtccgaacttactact

SEQ ID NO: 24831 - DNA, 16 bp, Artificial Sequence
  synthetic [barcode part1]
tagtggcgagacgtgt

SEQ ID NO: 24832 - DNA, 16 bp, Artificial Sequence
  synthetic [barcode part1]
gacttgacgtgtctcc

SEQ ID NO: 24833 - DNA, 16 bp, Artificial Sequence
  synthetic [barcode part1]
cggccagtagttagtt

SEQ ID NO: 24834 - DNA, 16 bp, Artificial Sequence
  synthetic [barcode part1]
gtctcacgatatactc

SEQ ID NO: 24835 - DNA, 16 bp, Artificial Sequence
  synthetic [barcode part1]
cgttgcctacttcact

SEQ ID NO: 24836 - DNA, 16 bp, Artificial Sequence
  synthetic [barcode part1]
agaggactgaattcac

SEQ ID NO: 24837 - DNA, 16 bp, Artificial Sequence
  synthetic [barcode part1]
cactggccaattacag

SEQ ID NO: 24838 - DNA, 16 bp, Artificial Sequence
  synthetic [barcode part1]
actcctagtctccact

SEQ ID NO: 24839 - DNA, 16 bp, Artificial Sequence
  synthetic [barcode part1]
gactgttgaacgtaag

SEQ ID NO: 24840 - DNA, 16 bp, Artificial Sequence
  synthetic [barcode part1]
ccgtaagtagacctgt

SEQ ID NO: 24841 - DNA, 16 bp, Artificial Sequence
  synthetic [barcode part1]
tggatcgactgagtct

SEQ ID NO: 24842 - DNA, 16 bp, Artificial Sequence
  synthetic [barcode part1]
cgaaccgaaggtgtac

SEQ ID NO: 24843 - DNA, 16 bp, Artificial Sequence
  synthetic [barcode part1]
aaccacagtgtgttgc

SEQ ID NO: 24844 - DNA, 16 bp, Artificial Sequence
  synthetic [barcode part1]
gaattgcgtctccgtc

SEQ ID NO: 24845 - DNA, 16 bp, Artificial Sequence
  synthetic [barcode part1]
cgatactgtccacctg

SEQ ID NO: 24846 - DNA, 16 bp, Artificial Sequence
  synthetic [barcode part1]
tccaggcagtaataag

SEQ ID NO: 24847 - DNA, 16 bp, Artificial Sequence
  synthetic [barcode part1]
ttaactccgccaatac

SEQ ID NO: 24848 - DNA, 16 bp, Artificial Sequence
  synthetic [barcode part1]
gaacggaactctggac

SEQ ID NO: 24849 - DNA, 16 bp, Artificial Sequence
  synthetic [barcode part1]
atcggacgtctaacgt

SEQ ID NO: 24850 - DNA, 16 bp, Artificial Sequence
  synthetic [barcode part1]
gattctctcctcggtt

SEQ ID NO: 24851 - DNA, 16 bp, Artificial Sequence
  synthetic [barcode part1]
tctcgacgattgcgtc

SEQ ID NO: 24852 - DNA, 16 bp, Artificial Sequence
  synthetic [barcode part1]
tgacctaataggagtg

SEQ ID NO: 24853 - DNA, 16 bp, Artificial Sequence
  synthetic [barcode part1]
ttatctgtcacggcgc

SEQ ID NO: 24854 - DNA, 16 bp, Artificial Sequence
  synthetic [barcode part1]
gccaggttctatattc

SEQ ID NO: 24855 - DNA, 16 bp, Artificial Sequence
  synthetic [barcode part1]
tccacaccaacttggc

SEQ ID NO: 24856 - DNA, 16 bp, Artificial Sequence
  synthetic [barcode part1]
taccagaattcctacc

SEQ ID NO: 24857 - DNA, 16 bp, Artificial Sequence
  synthetic [barcode part1]
ttacgcctattcctgc

SEQ ID NO: 24858 - DNA, 16 bp, Artificial Sequence
  synthetic [barcode part1]
gatcgacggtcaatct

SEQ ID NO: 24859 - DNA, 16 bp, Artificial Sequence
  synthetic [barcode part1]
tccgtaagtggacttg

SEQ ID NO: 24860 - DNA, 16 bp, Artificial Sequence
  synthetic [barcode part1]
acgatcggccgatatt

SEQ ID NO: 24861 - DNA, 16 bp, Artificial Sequence
  synthetic [barcode part1]
taagtccgtagacctg

SEQ ID NO: 24862 - DNA, 16 bp, Artificial Sequence
  synthetic [barcode part1]
gcaattctccgcactg

SEQ ID NO: 24863 - DNA, 16 bp, Artificial Sequence
  synthetic [barcode part1]
tcgataccttcctaag

SEQ ID NO: 24864 - DNA, 16 bp, Artificial Sequence
  synthetic [barcode part1]
gcgatcaagttagagt

SEQ ID NO: 24865 - DNA, 16 bp, Artificial Sequence
  synthetic [barcode part1]
tcaactgtgtgtgcag

SEQ ID NO: 24866 - DNA, 16 bp, Artificial Sequence
  synthetic [barcode part1]
agttagtccgactggt

SEQ ID NO: 24867 - DNA, 16 bp, Artificial Sequence
  synthetic [barcode part1]
acttccggtccagtac

SEQ ID NO: 24868 - DNA, 16 bp, Artificial Sequence
  synthetic [barcode part1]
tctgtcgttgaacgcc

SEQ ID NO: 24869 - DNA, 16 bp, Artificial Sequence
  synthetic [barcode part1]
actacaccacactgag

SEQ ID NO: 24870 - DNA, 16 bp, Artificial Sequence
  synthetic [barcode part1]
tgcagatactctgttc

SEQ ID NO: 24871 - DNA, 16 bp, Artificial Sequence
  synthetic [barcode part1]
aataccgtcggttgac

SEQ ID NO: 24872 - DNA, 16 bp, Artificial Sequence
  synthetic [barcode part1]
tatatacgcacgtgcg

SEQ ID NO: 24873 - DNA, 16 bp, Artificial Sequence
  synthetic [barcode part1]
agagagaaggaaggag

SEQ ID NO: 24874 - DNA, 16 bp, Artificial Sequence
  synthetic [barcode part1]
attctcacgttctcgc

SEQ ID NO: 24875 - DNA, 16 bp, Artificial Sequence
  synthetic [barcode part1]
agacggagataccacc

SEQ ID NO: 24876 - DNA, 16 bp, Artificial Sequence
  synthetic [barcode part1]
ttgcacaacactggtg

SEQ ID NO: 24877 - DNA, 16 bp, Artificial Sequence
  synthetic [barcode part1]
gtgtcgaggagtaatt

SEQ ID NO: 24878 - DNA, 16 bp, Artificial Sequence
  synthetic [barcode part1]
gtgtagtgtataccgc

SEQ ID NO: 24879 - DNA, 16 bp, Artificial Sequence
  synthetic [barcode part1]
cgtattccgtcttcgt

SEQ ID NO: 24880 - DNA, 16 bp, Artificial Sequence
  synthetic [barcode part1]
gcagagtcagacactg

SEQ ID NO: 24881 - DNA, 16 bp, Artificial Sequence
  synthetic [barcode part1]
tccaggaccgattagt

SEQ ID NO: 24882 - DNA, 16 bp, Artificial Sequence
  synthetic [barcode part1]
tgtacgacgtcctgtc

SEQ ID NO: 24883 - DNA, 16 bp, Artificial Sequence
  synthetic [barcode part1]
aatacacgccgtgtgt

SEQ ID NO: 24884 - DNA, 16 bp, Artificial Sequence
  synthetic [barcode part1]
aggagactatcagtac

SEQ ID NO: 24885 - DNA, 16 bp, Artificial Sequence
  synthetic [barcode part1]
caagttgtcgacaacc

SEQ ID NO: 24886 - DNA, 16 bp, Artificial Sequence
  synthetic [barcode part1]
ccgattcgacaacaac

SEQ ID NO: 24887 - DNA, 16 bp, Artificial Sequence
  synthetic [barcode part1]
gacggagtcagtacgt

SEQ ID NO: 24888 - DNA, 16 bp, Artificial Sequence
  synthetic [barcode part1]
ttatccgagtgtcact

SEQ ID NO: 24889 - DNA, 16 bp, Artificial Sequence
  synthetic [barcode part1]
cctatattcgacgatc

SEQ ID NO: 24890 - DNA, 16 bp, Artificial Sequence
  synthetic [barcode part1]
cagtggcaggatacac

SEQ ID NO: 24891 - DNA, 16 bp, Artificial Sequence
  synthetic [barcode part1]
gtgttaattggcgcgt

SEQ ID NO: 24892 - DNA, 16 bp, Artificial Sequence
  synthetic [barcode part1]
atatcggtagtctctc

SEQ ID NO: 24893 - DNA, 16 bp, Artificial Sequence
  synthetic [barcode part1]
ttctgttacaggttcg

SEQ ID NO: 24894 - DNA, 16 bp, Artificial Sequence
  synthetic [barcode part1]
gtaaccttcacgcctg

SEQ ID NO: 24895 - DNA, 16 bp, Artificial Sequence
  synthetic [barcode part1]
agttcctagttcgtgt

SEQ ID NO: 24896 - DNA, 16 bp, Artificial Sequence
  synthetic [barcode part1]
tctccttcaattggcc

SEQ ID NO: 24897 - DNA, 16 bp, Artificial Sequence
  synthetic [barcode part1]
aaggtccgaacagatt

SEQ ID NO: 24898 - DNA, 16 bp, Artificial Sequence
  synthetic [barcode part1]
ttaggtgactctactc

SEQ ID NO: 24899 - DNA, 16 bp, Artificial Sequence
  synthetic [barcode part1]
acacaggtgtccttag

SEQ ID NO: 24900 - DNA, 16 bp, Artificial Sequence
  synthetic [barcode part1]
aggcgttggcagagtt

SEQ ID NO: 24901 - DNA, 16 bp, Artificial Sequence
  synthetic [barcode part1]
taacgatcggcaacct

SEQ ID NO: 24902 - DNA, 16 bp, Artificial Sequence
  synthetic [barcode part1]
aggtacggtcagatcg

SEQ ID NO: 24903 - DNA, 16 bp, Artificial Sequence
  synthetic [barcode part1]
taccgccttgcgtagt

SEQ ID NO: 24904 - DNA, 16 bp, Artificial Sequence
  synthetic [barcode part1]
aactcttgactgtacc

SEQ ID NO: 24905 - DNA, 16 bp, Artificial Sequence
  synthetic [barcode part1]
ttacgccgatacgaac

SEQ ID NO: 24906 - DNA, 16 bp, Artificial Sequence
  synthetic [barcode part1]
cgtctgtatcctaggc

SEQ ID NO: 24907 - DNA, 16 bp, Artificial Sequence
  synthetic [barcode part1]
tccaagaagtcgatcc

SEQ ID NO: 24908 - DNA, 16 bp, Artificial Sequence
  synthetic [barcode part1]
gacgaggtataccggt

SEQ ID NO: 24909 - DNA, 16 bp, Artificial Sequence
  synthetic [barcode part1]
gtcaggtcgtcttcgt

SEQ ID NO: 24910 - DNA, 16 bp, Artificial Sequence
  synthetic [barcode part1]
gtagaccgagaattgt

SEQ ID NO: 24911 - DNA, 16 bp, Artificial Sequence
  synthetic [barcode part1]
taagtcgttagtggcc

SEQ ID NO: 24912 - DNA, 16 bp, Artificial Sequence
  synthetic [barcode part1]
tacgtggtctgtgagt

SEQ ID NO: 24913 - DNA, 16 bp, Artificial Sequence
  synthetic [barcode part1]
aggtcgatacgattag

SEQ ID NO: 24914 - DNA, 16 bp, Artificial Sequence
  synthetic [barcode part1]
cgcgatactcacctgt

SEQ ID NO: 24915 - DNA, 16 bp, Artificial Sequence
  synthetic [barcode part1]
taggcgtaaggtaact

SEQ ID NO: 24916 - DNA, 16 bp, Artificial Sequence
  synthetic [barcode part1]
gaacaatccaggtgcg

SEQ ID NO: 24917 - DNA, 16 bp, Artificial Sequence
  synthetic [barcode part1]
cggtcactagagagtg

SEQ ID NO: 24918 - DNA, 16 bp, Artificial Sequence
  synthetic [barcode part1]
cctgagagttagtcgt

SEQ ID NO: 24919 - DNA, 16 bp, Artificial Sequence
  synthetic [barcode part1]
tcttgcaggaggtact

SEQ ID NO: 24920 - DNA, 16 bp, Artificial Sequence
  synthetic [barcode part1]
aagataggacgttcac

SEQ ID NO: 24921 - DNA, 16 bp, Artificial Sequence
  synthetic [barcode part1]
acgactgttctgatct

SEQ ID NO: 24922 - DNA, 16 bp, Artificial Sequence
  synthetic [barcode part1]
cggtgcaacgtaattc

SEQ ID NO: 24923 - DNA, 16 bp, Artificial Sequence
  synthetic [barcode part1]
attgcgaaggcaggtc

SEQ ID NO: 24924 - DNA, 16 bp, Artificial Sequence
  synthetic [barcode part1]
gagtcgatacgcaacg

SEQ ID NO: 24925 - DNA, 16 bp, Artificial Sequence
  synthetic [barcode part1]
gatctaccttgtcgcg

SEQ ID NO: 24926 - DNA, 16 bp, Artificial Sequence
  synthetic [barcode part1]
aataactgcgtggaac

SEQ ID NO: 24927 - DNA, 16 bp, Artificial Sequence
  synthetic [barcode part1]
actaaccgactggttg

SEQ ID NO: 24928 - DNA, 16 bp, Artificial Sequence
  synthetic [barcode part1]
ttctcgcagtgtgaag

SEQ ID NO: 24929 - DNA, 16 bp, Artificial Sequence
  synthetic [barcode part1]
ttccaaggcggtattg

SEQ ID NO: 24930 - DNA, 16 bp, Artificial Sequence
  synthetic [barcode part1]
atcggagtcttagtcg

SEQ ID NO: 24931 - DNA, 16 bp, Artificial Sequence
  synthetic [barcode part1]
gttaccacaacgatcg

SEQ ID NO: 24932 - DNA, 16 bp, Artificial Sequence
  synthetic [barcode part1]
aaccgtacgtacagtc

SEQ ID NO: 24933 - DNA, 16 bp, Artificial Sequence
  synthetic [barcode part1]
ttgtatcgcctagtac

SEQ ID NO: 24934 - DNA, 16 bp, Artificial Sequence
  synthetic [barcode part1]
acggcctacttagtag

SEQ ID NO: 24935 - DNA, 16 bp, Artificial Sequence
  synthetic [barcode part1]
gtactgaccggtatac

SEQ ID NO: 24936 - DNA, 16 bp, Artificial Sequence
  synthetic [barcode part1]
cgacgcagttaaggac

SEQ ID NO: 24937 - DNA, 16 bp, Artificial Sequence
  synthetic [barcode part1]
tgttggtagaactgag

SEQ ID NO: 24938 - DNA, 16 bp, Artificial Sequence
  synthetic [barcode part1]
caactcaggactgttg

SEQ ID NO: 24939 - DNA, 16 bp, Artificial Sequence
  synthetic [barcode part1]
gttgagtaggtgtaac

SEQ ID NO: 24940 - DNA, 16 bp, Artificial Sequence
  synthetic [barcode part1]
agtcgtgaatcagagt

SEQ ID NO: 24941 - DNA, 16 bp, Artificial Sequence
  synthetic [barcode part1]
gcctcactgtcagtgt

SEQ ID NO: 24942 - DNA, 16 bp, Artificial Sequence
  synthetic [barcode part1]
gtccaatcgacctaag

SEQ ID NO: 24943 - DNA, 16 bp, Artificial Sequence
  synthetic [barcode part1]
actaagtacggtccgt

SEQ ID NO: 24944 - DNA, 16 bp, Artificial Sequence
  synthetic [barcode part1]
tagaacctacgcacac

SEQ ID NO: 24945 - DNA, 16 bp, Artificial Sequence
  synthetic [barcode part1]
gcctagaagtacctgt

SEQ ID NO: 24946 - DNA, 16 bp, Artificial Sequence
  synthetic [barcode part1]
taacggcagtctgact

SEQ ID NO: 24947 - DNA, 16 bp, Artificial Sequence
  synthetic [barcode part1]
ttgttctctaggtacg

SEQ ID NO: 24948 - DNA, 16 bp, Artificial Sequence
  synthetic [barcode part1]
tgtctattggacggac

SEQ ID NO: 24949 - DNA, 16 bp, Artificial Sequence
  synthetic [barcode part1]
gaatcctaactggtcg

SEQ ID NO: 24950 - DNA, 16 bp, Artificial Sequence
  synthetic [barcode part1]
atcacctgcagtgagt

SEQ ID NO: 24951 - DNA, 16 bp, Artificial Sequence
  synthetic [barcode part1]
gtagacctgattcctt

SEQ ID NO: 24952 - DNA, 16 bp, Artificial Sequence
  synthetic [barcode part1]
cgtctctgtcgaatcg

SEQ ID NO: 24953 - DNA, 16 bp, Artificial Sequence
  synthetic [barcode part1]
gtcagtactaccgtcc

SEQ ID NO: 24954 - DNA, 16 bp, Artificial Sequence
  synthetic [barcode part1]
tcgatacgcacactag

SEQ ID NO: 24955 - DNA, 16 bp, Artificial Sequence
  synthetic [barcode part1]
caatacgcctcgtcac

SEQ ID NO: 24956 - DNA, 16 bp, Artificial Sequence
  synthetic [barcode part1]
tgtcgcctcgttactt

SEQ ID NO: 24957 - DNA, 16 bp, Artificial Sequence
  synthetic [barcode part1]
ttcctagtgcagttgt

SEQ ID NO: 24958 - DNA, 16 bp, Artificial Sequence
  synthetic [barcode part1]
cgatcgacgtagtact

SEQ ID NO: 24959 - DNA, 16 bp, Artificial Sequence
  synthetic [barcode part1]
tggatacgtgcaactc

SEQ ID NO: 24960 - DNA, 16 bp, Artificial Sequence
  synthetic [barcode part1]
tgcgtatagagtctcg

SEQ ID NO: 24961 - DNA, 16 bp, Artificial Sequence
  synthetic [barcode part1]
aggccgttatcagatc

SEQ ID NO: 24962 - DNA, 16 bp, Artificial Sequence
  synthetic [barcode part1]
tagtagtgcacaaggt

SEQ ID NO: 24963 - DNA, 16 bp, Artificial Sequence
  synthetic [barcode part1]
tgcactagaagaatcg

SEQ ID NO: 24964 - DNA, 16 bp, Artificial Sequence
  synthetic [barcode part1]
ccagttagtatcgcag

SEQ ID NO: 24965 - DNA, 16 bp, Artificial Sequence
  synthetic [barcode part1]
gtagtgtacactacgc

SEQ ID NO: 24966 - DNA, 16 bp, Artificial Sequence
  synthetic [barcode part1]
ccaagttctaacgacg

SEQ ID NO: 24967 - DNA, 16 bp, Artificial Sequence
  synthetic [barcode part1]
agagttaaccgtctcg

SEQ ID NO: 24968 - DNA, 16 bp, Artificial Sequence
  synthetic [barcode part1]
cggtaattggtgatcc

SEQ ID NO: 24969 - DNA, 16 bp, Artificial Sequence
  synthetic [barcode part1]
gagatctggatcctac

SEQ ID NO: 24970 - DNA, 16 bp, Artificial Sequence
  synthetic [barcode part1]
gcggttgtataactgc

SEQ ID NO: 24971 - DNA, 16 bp, Artificial Sequence
  synthetic [barcode part1]
gtactactaaggtccg

SEQ ID NO: 24972 - DNA, 16 bp, Artificial Sequence
  synthetic [barcode part1]
atccaggcgttgtcct

SEQ ID NO: 24973 - DNA, 16 bp, Artificial Sequence
  synthetic [barcode part1]
actattctaggtgtcc

SEQ ID NO: 24974 - DNA, 16 bp, Artificial Sequence
  synthetic [barcode part1]
acgcctcttctgtgtt

SEQ ID NO: 24975 - DNA, 16 bp, Artificial Sequence
  synthetic [barcode part1]
ataaccgtcaaccttc

SEQ ID NO: 24976 - DNA, 16 bp, Artificial Sequence
  synthetic [barcode part1]
agatctaccactacct

SEQ ID NO: 24977 - DNA, 16 bp, Artificial Sequence
  synthetic [barcode part1]
gagacggtagatatct

SEQ ID NO: 24978 - DNA, 16 bp, Artificial Sequence
  synthetic [barcode part1]
ttaagtattcgtcgcc

SEQ ID NO: 24979 - DNA, 16 bp, Artificial Sequence
  synthetic [barcode part1]
acgatactcctaaggc

SEQ ID NO: 24980 - DNA, 16 bp, Artificial Sequence
  synthetic [barcode part1]
cgactctgtattggcc

SEQ ID NO: 24981 - DNA, 16 bp, Artificial Sequence
  synthetic [barcode part1]
acgattcgagtcactg

SEQ ID NO: 24982 - DNA, 16 bp, Artificial Sequence
  synthetic [barcode part1]
gaagacgtaagtcgcc

SEQ ID NO: 24983 - DNA, 16 bp, Artificial Sequence
  synthetic [barcode part1]
gagtacgtcagtgacg

SEQ ID NO: 24984 - DNA, 16 bp, Artificial Sequence
  synthetic [barcode part1]
ccagaccgttagattg

SEQ ID NO: 24985 - DNA, 16 bp, Artificial Sequence
  synthetic [barcode part1]
agaacaatacctaggc

SEQ ID NO: 24986 - DNA, 16 bp, Artificial Sequence
  synthetic [barcode part1]
gaggacggaatcgtct

SEQ ID NO: 24987 - DNA, 16 bp, Artificial Sequence
  synthetic [barcode part1]
ttggtgaacagagatc

SEQ ID NO: 24988 - DNA, 16 bp, Artificial Sequence
  synthetic [barcode part1]
cagtaggatctgcgag

SEQ ID NO: 24989 - DNA, 16 bp, Artificial Sequence
  synthetic [barcode part1]
ttgaacacactgtcct

SEQ ID NO: 24990 - DNA, 16 bp, Artificial Sequence
  synthetic [barcode part1]
gcgatacactacgact

SEQ ID NO: 24991 - DNA, 16 bp, Artificial Sequence
  synthetic [barcode part1]
cgatcttcgtagttgt

SEQ ID NO: 24992 - DNA, 16 bp, Artificial Sequence
  synthetic [barcode part1]
gttctaggactagtcg

SEQ ID NO: 24993 - DNA, 16 bp, Artificial Sequence
  synthetic [barcode part1]
cctcgagtacctactg

SEQ ID NO: 24994 - DNA, 16 bp, Artificial Sequence
  synthetic [barcode part1]
taacaatctggcggtc

SEQ ID NO: 24995 - DNA, 16 bp, Artificial Sequence
  synthetic [barcode part1]
gacacgttcttgatct

SEQ ID NO: 24996 - DNA, 16 bp, Artificial Sequence
  synthetic [barcode part1]
tggagaattctccggt

SEQ ID NO: 24997 - DNA, 16 bp, Artificial Sequence
  synthetic [barcode part1]
ccgcctgttacttatc

SEQ ID NO: 24998 - DNA, 16 bp, Artificial Sequence
  synthetic [barcode part1]
ccgtactacgacctac

SEQ ID NO: 24999 - DNA, 16 bp, Artificial Sequence
  synthetic [barcode part1]
gcacctgttcactacg

SEQ ID NO: 25000 - DNA, 16 bp, Artificial Sequence
  synthetic [barcode part1]
accttgaagagttccg

SEQ ID NO: 25001 - DNA, 16 bp, Artificial Sequence
  synthetic [barcode part1]
cacaggcacctataac

SEQ ID NO: 25002 - DNA, 16 bp, Artificial Sequence
  synthetic [barcode part1]
cctcgtgccagtaact

SEQ ID NO: 25003 - DNA, 16 bp, Artificial Sequence
  synthetic [barcode part1]
tcagtgtagtctcttg

SEQ ID NO: 25004 - DNA, 16 bp, Artificial Sequence
  synthetic [barcode part1]
agaagatactcggatc

SEQ ID NO: 25005 - DNA, 16 bp, Artificial Sequence
  synthetic [barcode part1]
aagtcaacgtgcggtg

SEQ ID NO: 25006 - DNA, 16 bp, Artificial Sequence
  synthetic [barcode part1]
caagtggacaatatcg

SEQ ID NO: 25007 - DNA, 16 bp, Artificial Sequence
  synthetic [barcode part1]
aagtgtattgacggtg

SEQ ID NO: 25008 - DNA, 16 bp, Artificial Sequence
  synthetic [barcode part1]
aatacgcagttggaac

SEQ ID NO: 25009 - DNA, 16 bp, Artificial Sequence
  synthetic [barcode part1]
gaatagacaggacttc

SEQ ID NO: 25010 - DNA, 16 bp, Artificial Sequence
  synthetic [barcode part1]
cgataggttactccag

SEQ ID NO: 25011 - DNA, 16 bp, Artificial Sequence
  synthetic [barcode part1]
caggaagatcagtgcc

SEQ ID NO: 25012 - DNA, 16 bp, Artificial Sequence
  synthetic [barcode part1]
cgaaggacttcaatcc

SEQ ID NO: 25013 - DNA, 16 bp, Artificial Sequence
  synthetic [barcode part1]
caccaccttcacaggt

SEQ ID NO: 25014 - DNA, 16 bp, Artificial Sequence
  synthetic [barcode part1]
gcgcgcagttatagtt

SEQ ID NO: 25015 - DNA, 16 bp, Artificial Sequence
  synthetic [barcode part1]
acttcgaggttagtcg

SEQ ID NO: 25016 - DNA, 16 bp, Artificial Sequence
  synthetic [barcode part1]
ccgtatctggaagtac

SEQ ID NO: 25017 - DNA, 16 bp, Artificial Sequence
  synthetic [barcode part1]
tcttagtcttctggcc

SEQ ID NO: 25018 - DNA, 16 bp, Artificial Sequence
  synthetic [barcode part1]
atcaattggccgatcg

SEQ ID NO: 25019 - DNA, 16 bp, Artificial Sequence
  synthetic [barcode part1]
ttcgtcgtaactctcc

SEQ ID NO: 25020 - DNA, 16 bp, Artificial Sequence
  synthetic [barcode part1]
cgacgcgagaacgatt

SEQ ID NO: 25021 - DNA, 16 bp, Artificial Sequence
  synthetic [barcode part1]
tgaggttccaagactc

SEQ ID NO: 25022 - DNA, 16 bp, Artificial Sequence
  synthetic [barcode part1]
tcgtccacggaacttc

SEQ ID NO: 25023 - DNA, 16 bp, Artificial Sequence
  synthetic [barcode part1]
cacttgccttgtctac

SEQ ID NO: 25024 - DNA, 16 bp, Artificial Sequence
  synthetic [barcode part1]
gatcgtgaccgatact

SEQ ID NO: 25025 - DNA, 16 bp, Artificial Sequence
  synthetic [barcode part1]
cgatacagagacaatc

SEQ ID NO: 25026 - DNA, 16 bp, Artificial Sequence
  synthetic [barcode part1]
cgttgtctcgttgttc

SEQ ID NO: 25027 - DNA, 16 bp, Artificial Sequence
  synthetic [barcode part1]
caatcttcagtcacac

SEQ ID NO: 25028 - DNA, 16 bp, Artificial Sequence
  synthetic [barcode part1]
gtacacttcactatcg

SEQ ID NO: 25029 - DNA, 16 bp, Artificial Sequence
  synthetic [barcode part1]
acgttcaagacgatag

SEQ ID NO: 25030 - DNA, 16 bp, Artificial Sequence
  synthetic [barcode part1]
aacgtaccagtgtacc

SEQ ID NO: 25031 - DNA, 16 bp, Artificial Sequence
  synthetic [barcode part1]
gaattaggacctcctg

SEQ ID NO: 25032 - DNA, 16 bp, Artificial Sequence
  synthetic [barcode part1]
ttggaggagtccgtag

SEQ ID NO: 25033 - DNA, 16 bp, Artificial Sequence
  synthetic [barcode part1]
agaagtaactcctgcc

SEQ ID NO: 25034 - DNA, 16 bp, Artificial Sequence
  synthetic [barcode part1]
tattcgtctgtctgcc

SEQ ID NO: 25035 - DNA, 16 bp, Artificial Sequence
  synthetic [barcode part1]
ccgtctaacttgttcc

SEQ ID NO: 25036 - DNA, 16 bp, Artificial Sequence
  synthetic [barcode part1]
caatacctctggagtg

SEQ ID NO: 25037 - DNA, 16 bp, Artificial Sequence
  synthetic [barcode part1]
agaacgaggcgaagtt

SEQ ID NO: 25038 - DNA, 16 bp, Artificial Sequence
  synthetic [barcode part1]
gcgcctacgttatctg

SEQ ID NO: 25039 - DNA, 16 bp, Artificial Sequence
  synthetic [barcode part1]
agtggagtcttatcgc

SEQ ID NO: 25040 - DNA, 16 bp, Artificial Sequence
  synthetic [barcode part1]
ttacggagttccttac

SEQ ID NO: 25041 - DNA, 16 bp, Artificial Sequence
  synthetic [barcode part1]
gatcctctatatcgac

SEQ ID NO: 25042 - DNA, 16 bp, Artificial Sequence
  synthetic [barcode part1]
cgaggatcttacactg

SEQ ID NO: 25043 - DNA, 16 bp, Artificial Sequence
  synthetic [barcode part1]
acctaggaacggaatt

SEQ ID NO: 25044 - DNA, 16 bp, Artificial Sequence
  synthetic [barcode part1]
tcttgcgttaggtcgc

SEQ ID NO: 25045 - DNA, 16 bp, Artificial Sequence
  synthetic [barcode part1]
gatagaaccggacacc

SEQ ID NO: 25046 - DNA, 16 bp, Artificial Sequence
  synthetic [barcode part1]
gtgtcggtacaagttc

SEQ ID NO: 25047 - DNA, 16 bp, Artificial Sequence
  synthetic [barcode part1]
gcctaagactctatct

SEQ ID NO: 25048 - DNA, 16 bp, Artificial Sequence
  synthetic [barcode part1]
gagttgtggatcgttc

SEQ ID NO: 25049 - DNA, 16 bp, Artificial Sequence
  synthetic [barcode part1]
ccaagactgttcactt

SEQ ID NO: 25050 - DNA, 16 bp, Artificial Sequence
  synthetic [barcode part1]
gttaacgagtgcgttc

SEQ ID NO: 25051 - DNA, 16 bp, Artificial Sequence
  synthetic [barcode part1]
tgcgagacaataatcg

SEQ ID NO: 25052 - DNA, 16 bp, Artificial Sequence
  synthetic [barcode part1]
tgtgtcactccagtcg

SEQ ID NO: 25053 - DNA, 16 bp, Artificial Sequence
  synthetic [barcode part1]
aacctaaccttcgtgt

SEQ ID NO: 25054 - DNA, 16 bp, Artificial Sequence
  synthetic [barcode part1]
gcagatccgtaagtct

SEQ ID NO: 25055 - DNA, 16 bp, Artificial Sequence
  synthetic [barcode part1]
gcagagatagtctaac

SEQ ID NO: 25056 - DNA, 16 bp, Artificial Sequence
  synthetic [barcode part1]
ttgagtgtccggatac

SEQ ID NO: 25057 - DNA, 16 bp, Artificial Sequence
  synthetic [barcode part1]
tcactcgttcacctac

SEQ ID NO: 25058 - DNA, 16 bp, Artificial Sequence
  synthetic [barcode part1]
caggagaactacgtgc

SEQ ID NO: 25059 - DNA, 16 bp, Artificial Sequence
  synthetic [barcode part1]
gtggtcagtacgttgt

SEQ ID NO: 25060 - DNA, 16 bp, Artificial Sequence
  synthetic [barcode part1]
caattgcgttcgagtg

SEQ ID NO: 25061 - DNA, 16 bp, Artificial Sequence
  synthetic [barcode part1]
tggccaccaagaagtg

SEQ ID NO: 25062 - DNA, 16 bp, Artificial Sequence
  synthetic [barcode part1]
gagtactcaagacggc

SEQ ID NO: 25063 - DNA, 16 bp, Artificial Sequence
  synthetic [barcode part1]
gacactgtgtggtgtt

SEQ ID NO: 25064 - DNA, 16 bp, Artificial Sequence
  synthetic [barcode part1]
aaccagtacgtacgtc

SEQ ID NO: 25065 - DNA, 16 bp, Artificial Sequence
  synthetic [barcode part1]
cacttattcacggtac

SEQ ID NO: 25066 - DNA, 16 bp, Artificial Sequence
  synthetic [barcode part1]
cgagtatcggtgagac

SEQ ID NO: 25067 - DNA, 16 bp, Artificial Sequence
  synthetic [barcode part1]
tcctcactgtcttcag

SEQ ID NO: 25068 - DNA, 16 bp, Artificial Sequence
  synthetic [barcode part1]
gtataagacctctgcg

SEQ ID NO: 25069 - DNA, 16 bp, Artificial Sequence
  synthetic [barcode part1]
aggttgtaacgactcc

SEQ ID NO: 25070 - DNA, 16 bp, Artificial Sequence
  synthetic [barcode part1]
tgtccgtaacggatac

SEQ ID NO: 25071 - DNA, 16 bp, Artificial Sequence
  synthetic [barcode part1]
taacgaccacgtcctc

SEQ ID NO: 25072 - DNA, 16 bp, Artificial Sequence
  synthetic [barcode part1]
cactacctattggtac

SEQ ID NO: 25073 - DNA, 16 bp, Artificial Sequence
  synthetic [barcode part1]
gtattccagttcggtt

SEQ ID NO: 25074 - DNA, 16 bp, Artificial Sequence
  synthetic [barcode part1]
acacacacgtacgtac

SEQ ID NO: 25075 - DNA, 16 bp, Artificial Sequence
  synthetic [barcode part1]
tgattatcgaggagtg

SEQ ID NO: 25076 - DNA, 16 bp, Artificial Sequence
  synthetic [barcode part1]
actgtacgccgttctg

SEQ ID NO: 25077 - DNA, 16 bp, Artificial Sequence
  synthetic [barcode part1]
atctagaacggtgagt

SEQ ID NO: 25078 - DNA, 16 bp, Artificial Sequence
  synthetic [barcode part1]
aacgaccgagacacgt

SEQ ID NO: 25079 - DNA, 16 bp, Artificial Sequence
  synthetic [barcode part1]
tacttcaccacctcac

SEQ ID NO: 25080 - DNA, 16 bp, Artificial Sequence
  synthetic [barcode part1]
aaccgcgtgtgtaatc

SEQ ID NO: 25081 - DNA, 16 bp, Artificial Sequence
  synthetic [barcode part1]
ttcttgaccttctggc

SEQ ID NO: 25082 - DNA, 16 bp, Artificial Sequence
  synthetic [barcode part1]
tctagtggtagtccag

SEQ ID NO: 25083 - DNA, 16 bp, Artificial Sequence
  synthetic [barcode part1]
gattgacctgatcgac

SEQ ID NO: 25084 - DNA, 16 bp, Artificial Sequence
  synthetic [barcode part1]
tataggccaggacgac

SEQ ID NO: 25085 - DNA, 16 bp, Artificial Sequence
  synthetic [barcode part1]
tggaatctcggaactc

SEQ ID NO: 25086 - DNA, 16 bp, Artificial Sequence
  synthetic [barcode part1]
accagattgaactgcc

SEQ ID NO: 25087 - DNA, 16 bp, Artificial Sequence
  synthetic [barcode part1]
gatcgacactacgact

SEQ ID NO: 25088 - DNA, 16 bp, Artificial Sequence
  synthetic [barcode part1]
cgtcagagtgaagatt

SEQ ID NO: 25089 - DNA, 16 bp, Artificial Sequence
  synthetic [barcode part1]
caataccaccttggag

SEQ ID NO: 25090 - DNA, 16 bp, Artificial Sequence
  synthetic [barcode part1]
tgtgtaactcagtcct

SEQ ID NO: 25091 - DNA, 16 bp, Artificial Sequence
  synthetic [barcode part1]
tccttcggtcttctag

SEQ ID NO: 25092 - DNA, 16 bp, Artificial Sequence
  synthetic [barcode part1]
tggatacagagatcac

SEQ ID NO: 25093 - DNA, 16 bp, Artificial Sequence
  synthetic [barcode part1]
cgcagaagactaccag

SEQ ID NO: 25094 - DNA, 16 bp, Artificial Sequence
  synthetic [barcode part1]
gacacaccgattacgt

SEQ ID NO: 25095 - DNA, 16 bp, Artificial Sequence
  synthetic [barcode part1]
tgcgccagttatacag

SEQ ID NO: 25096 - DNA, 16 bp, Artificial Sequence
  synthetic [barcode part1]
tgcagtgataagtggt

SEQ ID NO: 25097 - DNA, 16 bp, Artificial Sequence
  synthetic [barcode part1]
gacttaggattgtcgc

SEQ ID NO: 25098 - DNA, 16 bp, Artificial Sequence
  synthetic [barcode part1]
aggtcgttgtctccgt

SEQ ID NO: 25099 - DNA, 16 bp, Artificial Sequence
  synthetic [barcode part1]
gaagaattcgtgcggc

SEQ ID NO: 25100 - DNA, 16 bp, Artificial Sequence
  synthetic [barcode part1]
tcttggaccgttcgtg

SEQ ID NO: 25101 - DNA, 16 bp, Artificial Sequence
  synthetic [barcode part1]
ttgacacgaggaattg

SEQ ID NO: 25102 - DNA, 16 bp, Artificial Sequence
  synthetic [barcode part1]
cctgtcagactatatc

SEQ ID NO: 25103 - DNA, 16 bp, Artificial Sequence
  synthetic [barcode part1]
ttcactggtgtggcct

SEQ ID NO: 25104 - DNA, 16 bp, Artificial Sequence
  synthetic [barcode part1]
tggtacgttcttgact

SEQ ID NO: 25105 - DNA, 16 bp, Artificial Sequence
  synthetic [barcode part1]
cctcaacacactcgac

SEQ ID NO: 25106 - DNA, 16 bp, Artificial Sequence
  synthetic [barcode part1]
ttgccacggtagaatc

SEQ ID NO: 25107 - DNA, 16 bp, Artificial Sequence
  synthetic [barcode part1]
tgcactcaacacgaac

SEQ ID NO: 25108 - DNA, 16 bp, Artificial Sequence
  synthetic [barcode part1]
tgtagacagactcgtc

SEQ ID NO: 25109 - DNA, 16 bp, Artificial Sequence
  synthetic [barcode part1]
gtgtgattgatcgcac

SEQ ID NO: 25110 - DNA, 16 bp, Artificial Sequence
  synthetic [barcode part1]
accaggtattcctgtt

SEQ ID NO: 25111 - DNA, 16 bp, Artificial Sequence
  synthetic [barcode part1]
gacgaagatacctaac

SEQ ID NO: 25112 - DNA, 16 bp, Artificial Sequence
  synthetic [barcode part1]
cggagatactcttgtg

SEQ ID NO: 25113 - DNA, 16 bp, Artificial Sequence
  synthetic [barcode part1]
gtcgaatcaggagtgc

SEQ ID NO: 25114 - DNA, 16 bp, Artificial Sequence
  synthetic [barcode part1]
acacactcttgacttg

SEQ ID NO: 25115 - DNA, 16 bp, Artificial Sequence
  synthetic [barcode part1]
actgtgtggttacacg

SEQ ID NO: 25116 - DNA, 16 bp, Artificial Sequence
  synthetic [barcode part1]
gaacagagagtggact

SEQ ID NO: 25117 - DNA, 16 bp, Artificial Sequence
  synthetic [barcode part1]
ccacctactcacttac

SEQ ID NO: 25118 - DNA, 16 bp, Artificial Sequence
  synthetic [barcode part1]
aaggtcgagttatacg

SEQ ID NO: 25119 - DNA, 16 bp, Artificial Sequence
  synthetic [barcode part1]
tgatatagactgcgcc

SEQ ID NO: 25120 - DNA, 16 bp, Artificial Sequence
  synthetic [barcode part1]
acgtgacagaagatct

SEQ ID NO: 25121 - DNA, 16 bp, Artificial Sequence
  synthetic [barcode part1]
accaatacctgcgagt

SEQ ID NO: 25122 - DNA, 16 bp, Artificial Sequence
  synthetic [barcode part1]
gcgaagtcactcgaag

SEQ ID NO: 25123 - DNA, 16 bp, Artificial Sequence
  synthetic [barcode part1]
gtactgaacgtctgac

SEQ ID NO: 25124 - DNA, 16 bp, Artificial Sequence
  synthetic [barcode part1]
gacacttcaccttgcg

SEQ ID NO: 25125 - DNA, 16 bp, Artificial Sequence
  synthetic [barcode part1]
ttggacgcctattact

SEQ ID NO: 25126 - DNA, 16 bp, Artificial Sequence
  synthetic [barcode part1]
taactctcggtcacgc

SEQ ID NO: 25127 - DNA, 16 bp, Artificial Sequence
  synthetic [barcode part1]
tcgagacgtgaatagt

SEQ ID NO: 25128 - DNA, 16 bp, Artificial Sequence
  synthetic [barcode part1]
attattgtctcgcacg

SEQ ID NO: 25129 - DNA, 16 bp, Artificial Sequence
  synthetic [barcode part1]
atctctgtctggtagt

SEQ ID NO: 25130 - DNA, 16 bp, Artificial Sequence
  synthetic [barcode part1]
tagtgaaggtggaacg

SEQ ID NO: 25131 - DNA, 16 bp, Artificial Sequence
  synthetic [barcode part1]
cggattacaacttggc

SEQ ID NO: 25132 - DNA, 16 bp, Artificial Sequence
  synthetic [barcode part1]
tggtacgtgacttctt

SEQ ID NO: 25133 - DNA, 16 bp, Artificial Sequence
  synthetic [barcode part1]
aacacggtcactggag

SEQ ID NO: 25134 - DNA, 16 bp, Artificial Sequence
  synthetic [barcode part1]
attcgcagattgtgcg

SEQ ID NO: 25135 - DNA, 16 bp, Artificial Sequence
  synthetic [barcode part1]
tcgtggactattgtct

SEQ ID NO: 25136 - DNA, 16 bp, Artificial Sequence
  synthetic [barcode part1]
agatctctagtcgacg

SEQ ID NO: 25137 - DNA, 16 bp, Artificial Sequence
  synthetic [barcode part1]
tagaaggtgattgcgt

SEQ ID NO: 25138 - DNA, 16 bp, Artificial Sequence
  synthetic [barcode part1]
acaataggacgacgag

SEQ ID NO: 25139 - DNA, 16 bp, Artificial Sequence
  synthetic [barcode part1]
ttgtcacctacgaact

SEQ ID NO: 25140 - DNA, 16 bp, Artificial Sequence
  synthetic [barcode part1]
aatcaagttaccgccg

SEQ ID NO: 25141 - DNA, 16 bp, Artificial Sequence
  synthetic [barcode part1]
taccactcggagagtt

SEQ ID NO: 25142 - DNA, 16 bp, Artificial Sequence
  synthetic [barcode part1]
tggatcgcgtactcct

SEQ ID NO: 25143 - DNA, 16 bp, Artificial Sequence
  synthetic [barcode part1]
tgcaacggccttaagt

SEQ ID NO: 25144 - DNA, 16 bp, Artificial Sequence
  synthetic [barcode part1]
gaccgcgatatactgt

SEQ ID NO: 25145 - DNA, 16 bp, Artificial Sequence
  synthetic [barcode part1]
atcgagtagtgtagac

SEQ ID NO: 25146 - DNA, 16 bp, Artificial Sequence
  synthetic [barcode part1]
atctacgacacagtcg

SEQ ID NO: 25147 - DNA, 16 bp, Artificial Sequence
  synthetic [barcode part1]
agtaagaactgcctcc

SEQ ID NO: 25148 - DNA, 16 bp, Artificial Sequence
  synthetic [barcode part1]
agatagagttcgcctc

SEQ ID NO: 25149 - DNA, 16 bp, Artificial Sequence
  synthetic [barcode part1]
caatacctccaaggtg

SEQ ID NO: 25150 - DNA, 16 bp, Artificial Sequence
  synthetic [barcode part1]
tgagttgtgcacctcc

SEQ ID NO: 25151 - DNA, 16 bp, Artificial Sequence
  synthetic [barcode part1]
tcgttgagattcggtg

SEQ ID NO: 25152 - DNA, 16 bp, Artificial Sequence
  synthetic [barcode part1]
cgtcctagaatccgtc

SEQ ID NO: 25153 - DNA, 16 bp, Artificial Sequence
  synthetic [barcode part1]
gaaggaattgaccgag

SEQ ID NO: 25154 - DNA, 16 bp, Artificial Sequence
  synthetic [barcode part1]
tggcacgatcactctc

SEQ ID NO: 25155 - DNA, 16 bp, Artificial Sequence
  synthetic [barcode part1]
agtcgtagtgtatcgc

SEQ ID NO: 25156 - DNA, 16 bp, Artificial Sequence
  synthetic [barcode part1]
acgagtgattctgaag

SEQ ID NO: 25157 - DNA, 16 bp, Artificial Sequence
  synthetic [barcode part1]
cgtgacaacaggtggt

SEQ ID NO: 25158 - DNA, 16 bp, Artificial Sequence
  synthetic [barcode part1]
tacgatctgcaggttg

SEQ ID NO: 25159 - DNA, 16 bp, Artificial Sequence
  synthetic [barcode part1]
gtacgatacaccagtc

SEQ ID NO: 25160 - DNA, 16 bp, Artificial Sequence
  synthetic [barcode part1]
ttcaacgcgaatcgtg

SEQ ID NO: 25161 - DNA, 16 bp, Artificial Sequence
  synthetic [barcode part1]
atactcctcagtggtt

SEQ ID NO: 25162 - DNA, 16 bp, Artificial Sequence
  synthetic [barcode part1]
tctccacagtgatccg

SEQ ID NO: 25163 - DNA, 16 bp, Artificial Sequence
  synthetic [barcode part1]
aatcgcaactacgcac

SEQ ID NO: 25164 - DNA, 16 bp, Artificial Sequence
  synthetic [barcode part1]
tgttgtcgatacgtct

SEQ ID NO: 25165 - DNA, 16 bp, Artificial Sequence
  synthetic [barcode part1]
gtgcctcaattcagtt

SEQ ID NO: 25166 - DNA, 16 bp, Artificial Sequence
  synthetic [barcode part1]
ttctgagaggtctcag

SEQ ID NO: 25167 - DNA, 16 bp, Artificial Sequence
  synthetic [barcode part1]
tagtcgattaaccggc

SEQ ID NO: 25168 - DNA, 16 bp, Artificial Sequence
  synthetic [barcode part1]
tggcgcgtaatctcct

SEQ ID NO: 25169 - DNA, 16 bp, Artificial Sequence
  synthetic [barcode part1]
tgcagtacctactcgc

SEQ ID NO: 25170 - DNA, 16 bp, Artificial Sequence
  synthetic [barcode part1]
tgtcaccaggtacctc

SEQ ID NO: 25171 - DNA, 16 bp, Artificial Sequence
  synthetic [barcode part1]
gcgtcactacctgttg

SEQ ID NO: 25172 - DNA, 16 bp, Artificial Sequence
  synthetic [barcode part1]
aggactcgataccgtt

SEQ ID NO: 25173 - DNA, 16 bp, Artificial Sequence
  synthetic [barcode part1]
cgtacttaggttgtct

SEQ ID NO: 25174 - DNA, 16 bp, Artificial Sequence
  synthetic [barcode part1]
ataggtcacgcgattc

SEQ ID NO: 25175 - DNA, 16 bp, Artificial Sequence
  synthetic [barcode part1]
aactcttgaggtggtc

SEQ ID NO: 25176 - DNA, 16 bp, Artificial Sequence
  synthetic [barcode part1]
tgtaggtgaacaacac

SEQ ID NO: 25177 - DNA, 16 bp, Artificial Sequence
  synthetic [barcode part1]
tggattggttatcggc

SEQ ID NO: 25178 - DNA, 16 bp, Artificial Sequence
  synthetic [barcode part1]
agatctactgccactt

SEQ ID NO: 25179 - DNA, 16 bp, Artificial Sequence
  synthetic [barcode part1]
acttacttcgcggtgc

SEQ ID NO: 25180 - DNA, 16 bp, Artificial Sequence
  synthetic [barcode part1]
agtaattcctccacac

SEQ ID NO: 25181 - DNA, 16 bp, Artificial Sequence
  synthetic [barcode part1]
cgaagttgtatcgtgc

SEQ ID NO: 25182 - DNA, 16 bp, Artificial Sequence
  synthetic [barcode part1]
tcaacaacgccgaact

SEQ ID NO: 25183 - DNA, 16 bp, Artificial Sequence
  synthetic [barcode part1]
attggtgtcgtgcaac

SEQ ID NO: 25184 - DNA, 16 bp, Artificial Sequence
  synthetic [barcode part1]
gactacgcgtacaact

SEQ ID NO: 25185 - DNA, 16 bp, Artificial Sequence
  synthetic [barcode part1]
aagtccaatccggatc

SEQ ID NO: 25186 - DNA, 16 bp, Artificial Sequence
  synthetic [barcode part1]
atcctcgacgaagatc

SEQ ID NO: 25187 - DNA, 16 bp, Artificial Sequence
  synthetic [barcode part1]
gaggagttctatagac

SEQ ID NO: 25188 - DNA, 16 bp, Artificial Sequence
  synthetic [barcode part1]
cgataggttcactgtg

SEQ ID NO: 25189 - DNA, 16 bp, Artificial Sequence
  synthetic [barcode part1]
gtagaagtggcaatct

SEQ ID NO: 25190 - DNA, 16 bp, Artificial Sequence
  synthetic [barcode part1]
attcacgccttcgacg

SEQ ID NO: 25191 - DNA, 16 bp, Artificial Sequence
  synthetic [barcode part1]
acagttcactctcgcg

SEQ ID NO: 25192 - DNA, 16 bp, Artificial Sequence
  synthetic [barcode part1]
agtatcagtcggtcgt

SEQ ID NO: 25193 - DNA, 16 bp, Artificial Sequence
  synthetic [barcode part1]
cagatacctctcgacc

SEQ ID NO: 25194 - DNA, 16 bp, Artificial Sequence
  synthetic [barcode part1]
cggtagatcacgagtg

SEQ ID NO: 25195 - DNA, 16 bp, Artificial Sequence
  synthetic [barcode part1]
tatacggaggcacttc

SEQ ID NO: 25196 - DNA, 16 bp, Artificial Sequence
  synthetic [barcode part1]
tgtgtcaagtcaagag

SEQ ID NO: 25197 - DNA, 16 bp, Artificial Sequence
  synthetic [barcode part1]
acaatccacaagagtg

SEQ ID NO: 25198 - DNA, 16 bp, Artificial Sequence
  synthetic [barcode part1]
tgcgccagttaatacg

SEQ ID NO: 25199 - DNA, 16 bp, Artificial Sequence
  synthetic [barcode part1]
gttgcaaccacctacc

SEQ ID NO: 25200 - DNA, 16 bp, Artificial Sequence
  synthetic [barcode part1]
acaggttggttcgtac

SEQ ID NO: 25201 - DNA, 16 bp, Artificial Sequence
  synthetic [barcode part1]
ataggttcagtctcct

SEQ ID NO: 25202 - DNA, 16 bp, Artificial Sequence
  synthetic [barcode part1]
cactcggattgaggag

SEQ ID NO: 25203 - DNA, 16 bp, Artificial Sequence
  synthetic [barcode part1]
acgattccgtcaagtg

SEQ ID NO: 25204 - DNA, 16 bp, Artificial Sequence
  synthetic [barcode part1]
ccagttagattccgag

SEQ ID NO: 25205 - DNA, 16 bp, Artificial Sequence
  synthetic [barcode part1]
cctgtgtgtgtaagac

SEQ ID NO: 25206 - DNA, 16 bp, Artificial Sequence
  synthetic [barcode part1]
cctgagactctgaagt

SEQ ID NO: 25207 - DNA, 16 bp, Artificial Sequence
  synthetic [barcode part1]
gcagtattcaatcggc

SEQ ID NO: 25208 - DNA, 16 bp, Artificial Sequence
  synthetic [barcode part1]
ccaggaatacaagttg

SEQ ID NO: 25209 - DNA, 16 bp, Artificial Sequence
  synthetic [barcode part1]
tgttaggccgttagac

SEQ ID NO: 25210 - DNA, 16 bp, Artificial Sequence
  synthetic [barcode part1]
gttatctccacaagtc

SEQ ID NO: 25211 - DNA, 16 bp, Artificial Sequence
  synthetic [barcode part1]
gtgtccggagtagtag

SEQ ID NO: 25212 - DNA, 16 bp, Artificial Sequence
  synthetic [barcode part1]
ttagtgcgcactagtg

SEQ ID NO: 25213 - DNA, 16 bp, Artificial Sequence
  synthetic [barcode part1]
taacgtcctgcctgtg

SEQ ID NO: 25214 - DNA, 16 bp, Artificial Sequence
  synthetic [barcode part1]
gtcgcaatatccactt

SEQ ID NO: 25215 - DNA, 16 bp, Artificial Sequence
  synthetic [barcode part1]
tgtgtggcgttccgtt

SEQ ID NO: 25216 - DNA, 16 bp, Artificial Sequence
  synthetic [barcode part1]
gattcggtacacttct

SEQ ID NO: 25217 - DNA, 16 bp, Artificial Sequence
  synthetic [barcode part1]
acagacctagttcctt

SEQ ID NO: 25218 - DNA, 16 bp, Artificial Sequence
  synthetic [barcode part1]
agttcgtgcagatctg

SEQ ID NO: 25219 - DNA, 16 bp, Artificial Sequence
  synthetic [barcode part1]
gtgcacagttgactgt

SEQ ID NO: 25220 - DNA, 16 bp, Artificial Sequence
  synthetic [barcode part1]
gttaggttccgtattc

SEQ ID NO: 25221 - DNA, 16 bp, Artificial Sequence
  synthetic [barcode part1]
gcgtgacagaattaac

SEQ ID NO: 25222 - DNA, 16 bp, Artificial Sequence
  synthetic [barcode part1]
gaacttgtagaaggtc

SEQ ID NO: 25223 - DNA, 16 bp, Artificial Sequence
  synthetic [barcode part1]
ataggaacgacctaac

SEQ ID NO: 25224 - DNA, 16 bp, Artificial Sequence
  synthetic [barcode part1]
cgcctcgaatattcgc

SEQ ID NO: 25225 - DNA, 16 bp, Artificial Sequence
  synthetic [barcode part1]
atctcacgcgaagtgt

SEQ ID NO: 25226 - DNA, 16 bp, Artificial Sequence
  synthetic [barcode part1]
ccttaatacacgactc

SEQ ID NO: 25227 - DNA, 16 bp, Artificial Sequence
  synthetic [barcode part1]
agtaggagaaggtcgt

SEQ ID NO: 25228 - DNA, 16 bp, Artificial Sequence
  synthetic [barcode part1]
cacttcctgatagttg

SEQ ID NO: 25229 - DNA, 16 bp, Artificial Sequence
  synthetic [barcode part1]
tcttgccggatagtag

SEQ ID NO: 25230 - DNA, 16 bp, Artificial Sequence
  synthetic [barcode part1]
acttgttggtaccgcc

SEQ ID NO: 25231 - DNA, 16 bp, Artificial Sequence
  synthetic [barcode part1]
attcgttgcagtgttc

SEQ ID NO: 25232 - DNA, 16 bp, Artificial Sequence
  synthetic [barcode part1]
tgttggttcagagaag

SEQ ID NO: 25233 - DNA, 16 bp, Artificial Sequence
  synthetic [barcode part1]
cgttgagagtggttct

SEQ ID NO: 25234 - DNA, 16 bp, Artificial Sequence
  synthetic [barcode part1]
caatcgtgtaactgcg

SEQ ID NO: 25235 - DNA, 16 bp, Artificial Sequence
  synthetic [barcode part1]
taagtcggtgcgagac

SEQ ID NO: 25236 - DNA, 16 bp, Artificial Sequence
  synthetic [barcode part1]
tccgtgtcgattcgac

SEQ ID NO: 25237 - DNA, 16 bp, Artificial Sequence
  synthetic [barcode part1]
tgagtctctcagacag

SEQ ID NO: 25238 - DNA, 16 bp, Artificial Sequence
  synthetic [barcode part1]
aaccgttactcttacg

SEQ ID NO: 25239 - DNA, 16 bp, Artificial Sequence
  synthetic [barcode part1]
gtgacaggaacacctg

SEQ ID NO: 25240 - DNA, 16 bp, Artificial Sequence
  synthetic [barcode part1]
atctggtatcgccaag

SEQ ID NO: 25241 - DNA, 16 bp, Artificial Sequence
  synthetic [barcode part1]
acttggtaaccgtcag

SEQ ID NO: 25242 - DNA, 16 bp, Artificial Sequence
  synthetic [barcode part1]
ccgactcttcgcaagt

SEQ ID NO: 25243 - DNA, 16 bp, Artificial Sequence
  synthetic [barcode part1]
cgattggacactgtgt

SEQ ID NO: 25244 - DNA, 16 bp, Artificial Sequence
  synthetic [barcode part1]
gtactcttgcgttcct

SEQ ID NO: 25245 - DNA, 16 bp, Artificial Sequence
  synthetic [barcode part1]
atataggccacgttcg

SEQ ID NO: 25246 - DNA, 16 bp, Artificial Sequence
  synthetic [barcode part1]
tgactagtacgacacc

SEQ ID NO: 25247 - DNA, 16 bp, Artificial Sequence
  synthetic [barcode part1]
agttcctccaggcact

SEQ ID NO: 25248 - DNA, 16 bp, Artificial Sequence
  synthetic [barcode part1]
gcgtctgcaggataag

SEQ ID NO: 25249 - DNA, 16 bp, Artificial Sequence
  synthetic [barcode part1]
gataatctcggcgact

SEQ ID NO: 25250 - DNA, 16 bp, Artificial Sequence
  synthetic [barcode part1]
acaacgcaacttcggt

SEQ ID NO: 25251 - DNA, 16 bp, Artificial Sequence
  synthetic [barcode part1]
tatctgcctcgagatt

SEQ ID NO: 25252 - DNA, 16 bp, Artificial Sequence
  synthetic [barcode part1]
gtacctcagtcaccac

SEQ ID NO: 25253 - DNA, 16 bp, Artificial Sequence
  synthetic [barcode part1]
ccgtgacgtcaattag

SEQ ID NO: 25254 - DNA, 16 bp, Artificial Sequence
  synthetic [barcode part1]
tctgcctaataggcag

SEQ ID NO: 25255 - DNA, 16 bp, Artificial Sequence
  synthetic [barcode part1]
caagattccgatcggt

SEQ ID NO: 25256 - DNA, 16 bp, Artificial Sequence
  synthetic [barcode part1]
acttgccacagtgtcc

SEQ ID NO: 25257 - DNA, 16 bp, Artificial Sequence
  synthetic [barcode part1]
tagaccaacgtgaggc

SEQ ID NO: 25258 - DNA, 16 bp, Artificial Sequence
  synthetic [barcode part1]
tctgaaggaagtctcc

SEQ ID NO: 25259 - DNA, 16 bp, Artificial Sequence
  synthetic [barcode part1]
gcgttagaccgtcctt

SEQ ID NO: 25260 - DNA, 16 bp, Artificial Sequence
  synthetic [barcode part1]
gagatctgagtggacc

SEQ ID NO: 25261 - DNA, 16 bp, Artificial Sequence
  synthetic [barcode part1]
tgcaaggatcaggtcg

SEQ ID NO: 25262 - DNA, 16 bp, Artificial Sequence
  synthetic [barcode part1]
tgacgataagaacgtc

SEQ ID NO: 25263 - DNA, 16 bp, Artificial Sequence
  synthetic [barcode part1]
aataatccgcaggaac

SEQ ID NO: 25264 - DNA, 16 bp, Artificial Sequence
  synthetic [barcode part1]
cacgattgccactctg

SEQ ID NO: 25265 - DNA, 16 bp, Artificial Sequence
  synthetic [barcode part1]
gagttcaattctccac

SEQ ID NO: 25266 - DNA, 16 bp, Artificial Sequence
  synthetic [barcode part1]
gactactggtagttcg

SEQ ID NO: 25267 - DNA, 16 bp, Artificial Sequence
  synthetic [barcode part1]
tgccgaactcgtacct

SEQ ID NO: 25268 - DNA, 16 bp, Artificial Sequence
  synthetic [barcode part1]
gtcttacaacgtgtct

SEQ ID NO: 25269 - DNA, 16 bp, Artificial Sequence
  synthetic [barcode part1]
accggactattctcgc

SEQ ID NO: 25270 - DNA, 16 bp, Artificial Sequence
  synthetic [barcode part1]
ttaactcgcgactatc

SEQ ID NO: 25271 - DNA, 16 bp, Artificial Sequence
  synthetic [barcode part1]
acactagacacttggc

SEQ ID NO: 25272 - DNA, 16 bp, Artificial Sequence
  synthetic [barcode part1]
gagtgtccaggacagt

SEQ ID NO: 25273 - DNA, 16 bp, Artificial Sequence
  synthetic [barcode part1]
gattgtcgatacagag

SEQ ID NO: 25274 - DNA, 16 bp, Artificial Sequence
  synthetic [barcode part1]
atcggtgtagacctgt

SEQ ID NO: 25275 - DNA, 16 bp, Artificial Sequence
  synthetic [barcode part1]
tcgaatcaatcgccag

SEQ ID NO: 25276 - DNA, 16 bp, Artificial Sequence
  synthetic [barcode part1]
tcgtaccacaactcgc

SEQ ID NO: 25277 - DNA, 16 bp, Artificial Sequence
  synthetic [barcode part1]
ataccactacttgtcg

SEQ ID NO: 25278 - DNA, 16 bp, Artificial Sequence
  synthetic [barcode part1]
agagtgataggtgtct

SEQ ID NO: 25279 - DNA, 16 bp, Artificial Sequence
  synthetic [barcode part1]
gatactacggtcggtt

SEQ ID NO: 25280 - DNA, 16 bp, Artificial Sequence
  synthetic [barcode part1]
aagtgagtatcgtggt

SEQ ID NO: 25281 - DNA, 16 bp, Artificial Sequence
  synthetic [barcode part1]
tgaagaacacagtcac

SEQ ID NO: 25282 - DNA, 16 bp, Artificial Sequence
  synthetic [barcode part1]
attgattcacggcgtg

SEQ ID NO: 25283 - DNA, 16 bp, Artificial Sequence
  synthetic [barcode part1]
caggtataaggtgatc

SEQ ID NO: 25284 - DNA, 16 bp, Artificial Sequence
  synthetic [barcode part1]
tggcacgtcctattgc

SEQ ID NO: 25285 - DNA, 16 bp, Artificial Sequence
  synthetic [barcode part1]
tgacgcggactatatc

SEQ ID NO: 25286 - DNA, 16 bp, Artificial Sequence
  synthetic [barcode part1]
tcggattatacttccg

SEQ ID NO: 25287 - DNA, 16 bp, Artificial Sequence
  synthetic [barcode part1]
cagactatctccacgc

SEQ ID NO: 25288 - DNA, 16 bp, Artificial Sequence
  synthetic [barcode part1]
aactcagagtcgttgc

SEQ ID NO: 25289 - DNA, 16 bp, Artificial Sequence
  synthetic [barcode part1]
ataaccgcacggttac

SEQ ID NO: 25290 - DNA, 16 bp, Artificial Sequence
  synthetic [barcode part1]
tcaaggttactgcgac

SEQ ID NO: 25291 - DNA, 16 bp, Artificial Sequence
  synthetic [barcode part1]
agacaatccttcggtg

SEQ ID NO: 25292 - DNA, 16 bp, Artificial Sequence
  synthetic [barcode part1]
tggttaccttaacctg

SEQ ID NO: 25293 - DNA, 16 bp, Artificial Sequence
  synthetic [barcode part1]
acgaacgttgtctgtg

SEQ ID NO: 25294 - DNA, 16 bp, Artificial Sequence
  synthetic [barcode part1]
caagaggtatagttgc

SEQ ID NO: 25295 - DNA, 16 bp, Artificial Sequence
  synthetic [barcode part1]
ttcttacctcgcactg

SEQ ID NO: 25296 - DNA, 16 bp, Artificial Sequence
  synthetic [barcode part1]
agactctggtcttgag

SEQ ID NO: 25297 - DNA, 16 bp, Artificial Sequence
  synthetic [barcode part1]
tcagtctactcggatt

SEQ ID NO: 25298 - DNA, 16 bp, Artificial Sequence
  synthetic [barcode part1]
tccgccgtataccaac

SEQ ID NO: 25299 - DNA, 16 bp, Artificial Sequence
  synthetic [barcode part1]
agtccaggtcgttagt

SEQ ID NO: 25300 - DNA, 16 bp, Artificial Sequence
  synthetic [barcode part1]
aatcagtctgaggcct

SEQ ID NO: 25301 - DNA, 16 bp, Artificial Sequence
  synthetic [barcode part1]
acaccagtccttaact

SEQ ID NO: 25302 - DNA, 16 bp, Artificial Sequence
  synthetic [barcode part1]
tcttccgataatcgtg

SEQ ID NO: 25303 - DNA, 16 bp, Artificial Sequence
  synthetic [barcode part1]
tcgactactctgagag

SEQ ID NO: 25304 - DNA, 16 bp, Artificial Sequence
  synthetic [barcode part1]
gacctgacgtaggagt

SEQ ID NO: 25305 - DNA, 16 bp, Artificial Sequence
  synthetic [barcode part1]
gtcaacgtactctact

SEQ ID NO: 25306 - DNA, 16 bp, Artificial Sequence
  synthetic [barcode part1]
tggactaacgcgagac

SEQ ID NO: 25307 - DNA, 16 bp, Artificial Sequence
  synthetic [barcode part1]
acctcgtatagaacgc

SEQ ID NO: 25308 - DNA, 16 bp, Artificial Sequence
  synthetic [barcode part1]
aaggacaatctggtgt

SEQ ID NO: 25309 - DNA, 16 bp, Artificial Sequence
  synthetic [barcode part1]
tagtgcagtcagaggc

SEQ ID NO: 25310 - DNA, 16 bp, Artificial Sequence
  synthetic [barcode part1]
acacgtgtagtcggtt

SEQ ID NO: 25311 - DNA, 16 bp, Artificial Sequence
  synthetic [barcode part1]
acactctgaaggcgtt

SEQ ID NO: 25312 - DNA, 16 bp, Artificial Sequence
  synthetic [barcode part1]
tcacgagagtaacagt

SEQ ID NO: 25313 - DNA, 16 bp, Artificial Sequence
  synthetic [barcode part1]
tcctcgtaacaattcg

SEQ ID NO: 25314 - DNA, 16 bp, Artificial Sequence
  synthetic [barcode part1]
ccacgaaggtaacggt

SEQ ID NO: 25315 - DNA, 16 bp, Artificial Sequence
  synthetic [barcode part1]
actgtctccgcaggtt

SEQ ID NO: 25316 - DNA, 16 bp, Artificial Sequence
  synthetic [barcode part1]
tctggcgttactgaag

SEQ ID NO: 25317 - DNA, 16 bp, Artificial Sequence
  synthetic [barcode part1]
aacctcaacggtgttg

SEQ ID NO: 25318 - DNA, 16 bp, Artificial Sequence
  synthetic [barcode part1]
ccgacactcagtcttg

SEQ ID NO: 25319 - DNA, 16 bp, Artificial Sequence
  synthetic [barcode part1]
tgtattcaacgacctc

SEQ ID NO: 25320 - DNA, 16 bp, Artificial Sequence
  synthetic [barcode part1]
acttactctgcctgtc

SEQ ID NO: 25321 - DNA, 16 bp, Artificial Sequence
  synthetic [barcode part1]
ttagtgcaccgtgtag

SEQ ID NO: 25322 - DNA, 16 bp, Artificial Sequence
  synthetic [barcode part1]
aggcgaactcgaagtc

SEQ ID NO: 25323 - DNA, 16 bp, Artificial Sequence
  synthetic [barcode part1]
gtaatagtgtctcgcg

SEQ ID NO: 25324 - DNA, 16 bp, Artificial Sequence
  synthetic [barcode part1]
ttggagtccgtctacc

SEQ ID NO: 25325 - DNA, 16 bp, Artificial Sequence
  synthetic [barcode part1]
cgacttaacgactcag

SEQ ID NO: 25326 - DNA, 16 bp, Artificial Sequence
  synthetic [barcode part1]
attgcagacggtactc

SEQ ID NO: 25327 - DNA, 16 bp, Artificial Sequence
  synthetic [barcode part1]
cgaggtaacgatcgtg

SEQ ID NO: 25328 - DNA, 16 bp, Artificial Sequence
  synthetic [barcode part1]
attctgtactcgaacc

SEQ ID NO: 25329 - DNA, 16 bp, Artificial Sequence
  synthetic [barcode part1]
gttggatcagaggcac

SEQ ID NO: 25330 - DNA, 16 bp, Artificial Sequence
  synthetic [barcode part1]
aggataggtcttgcct

SEQ ID NO: 25331 - DNA, 16 bp, Artificial Sequence
  synthetic [barcode part1]
gcgtagagataattcg

SEQ ID NO: 25332 - DNA, 16 bp, Artificial Sequence
  synthetic [barcode part1]
agtacacacaccaacc

SEQ ID NO: 25333 - DNA, 16 bp, Artificial Sequence
  synthetic [barcode part1]
ccgcaagtgttctgtc

SEQ ID NO: 25334 - DNA, 16 bp, Artificial Sequence
  synthetic [barcode part1]
tgtgcagacctagact

SEQ ID NO: 25335 - DNA, 16 bp, Artificial Sequence
  synthetic [barcode part1]
aggcgttaacagaact

SEQ ID NO: 25336 - DNA, 16 bp, Artificial Sequence
  synthetic [barcode part1]
caccagacctgtgtct

SEQ ID NO: 25337 - DNA, 16 bp, Artificial Sequence
  synthetic [barcode part1]
ttctgttgtaggtctg

SEQ ID NO: 25338 - DNA, 16 bp, Artificial Sequence
  synthetic [barcode part1]
atacgtgtagtgtcgc

SEQ ID NO: 25339 - DNA, 16 bp, Artificial Sequence
  synthetic [barcode part1]
tcttcaatcggaaggc

SEQ ID NO: 25340 - DNA, 16 bp, Artificial Sequence
  synthetic [barcode part1]
aaggttctccaaggtc

SEQ ID NO: 25341 - DNA, 16 bp, Artificial Sequence
  synthetic [barcode part1]
acgcacactgatcagt

SEQ ID NO: 25342 - DNA, 16 bp, Artificial Sequence
  synthetic [barcode part1]
actctcagtaatccgt

SEQ ID NO: 25343 - DNA, 16 bp, Artificial Sequence
  synthetic [barcode part1]
gaattattagaggcgc

SEQ ID NO: 25344 - DNA, 16 bp, Artificial Sequence
  synthetic [barcode part1]
cggaagtctgtacttg

SEQ ID NO: 25345 - DNA, 16 bp, Artificial Sequence
  synthetic [barcode part1]
ccaactcaccttctac

SEQ ID NO: 25346 - DNA, 16 bp, Artificial Sequence
  synthetic [barcode part1]
atagacaggcgtcgtg

SEQ ID NO: 25347 - DNA, 16 bp, Artificial Sequence
  synthetic [barcode part1]
cacttcctcggtagtg

SEQ ID NO: 25348 - DNA, 16 bp, Artificial Sequence
  synthetic [barcode part1]
taactcttagttgcgc

SEQ ID NO: 25349 - DNA, 16 bp, Artificial Sequence
  synthetic [barcode part1]
cgaataaggataggcg

SEQ ID NO: 25350 - DNA, 16 bp, Artificial Sequence
  synthetic [barcode part1]
tcgaggttccgaagtt

SEQ ID NO: 25351 - DNA, 16 bp, Artificial Sequence
  synthetic [barcode part1]
aaggaccgaaggattg

SEQ ID NO: 25352 - DNA, 16 bp, Artificial Sequence
  synthetic [barcode part1]
tggtgataaggatacc

SEQ ID NO: 25353 - DNA, 16 bp, Artificial Sequence
  synthetic [barcode part1]
attgtctagattcgcc

SEQ ID NO: 25354 - DNA, 16 bp, Artificial Sequence
  synthetic [barcode part1]
acctaccacaatatcc

SEQ ID NO: 25355 - DNA, 16 bp, Artificial Sequence
  synthetic [barcode part1]
acttgtgaaccacgtg

SEQ ID NO: 25356 - DNA, 16 bp, Artificial Sequence
  synthetic [barcode part1]
caggtgcctctcaatc

SEQ ID NO: 25357 - DNA, 16 bp, Artificial Sequence
  synthetic [barcode part1]
tatcggagtctctatc

SEQ ID NO: 25358 - DNA, 16 bp, Artificial Sequence
  synthetic [barcode part1]
cacgccttgttcttgt

SEQ ID NO: 25359 - DNA, 16 bp, Artificial Sequence
  synthetic [barcode part1]
aaccacaccggaagac

SEQ ID NO: 25360 - DNA, 16 bp, Artificial Sequence
  synthetic [barcode part1]
actcaccaggtaagtc

SEQ ID NO: 25361 - DNA, 16 bp, Artificial Sequence
  synthetic [barcode part1]
tgactccaacctcttc

SEQ ID NO: 25362 - DNA, 16 bp, Artificial Sequence
  synthetic [barcode part1]
ttctacttgagtaccg

SEQ ID NO: 25363 - DNA, 16 bp, Artificial Sequence
  synthetic [barcode part1]
tcttcctgcgtgtatc

SEQ ID NO: 25364 - DNA, 16 bp, Artificial Sequence
  synthetic [barcode part1]
gtacttgcgttacttg

SEQ ID NO: 25365 - DNA, 16 bp, Artificial Sequence
  synthetic [barcode part1]
aacaagaccaagtgtc

SEQ ID NO: 25366 - DNA, 16 bp, Artificial Sequence
  synthetic [barcode part1]
taaggaacacggccac

SEQ ID NO: 25367 - DNA, 16 bp, Artificial Sequence
  synthetic [barcode part1]
cctctgacacacaacc

SEQ ID NO: 25368 - DNA, 16 bp, Artificial Sequence
  synthetic [barcode part1]
gaacctgacgatcact

SEQ ID NO: 25369 - DNA, 16 bp, Artificial Sequence
  synthetic [barcode part1]
ttcgaacggattgaag

SEQ ID NO: 25370 - DNA, 16 bp, Artificial Sequence
  synthetic [barcode part1]
aacacggagatcgtcg

SEQ ID NO: 25371 - DNA, 16 bp, Artificial Sequence
  synthetic [barcode part1]
tggatcagattgccac

SEQ ID NO: 25372 - DNA, 16 bp, Artificial Sequence
  synthetic [barcode part1]
gtacggtctctaactt

SEQ ID NO: 25373 - DNA, 16 bp, Artificial Sequence
  synthetic [barcode part1]
gaatctccggtgttag

SEQ ID NO: 25374 - DNA, 16 bp, Artificial Sequence
  synthetic [barcode part1]
tgcgacgtctgttcac

SEQ ID NO: 25375 - DNA, 16 bp, Artificial Sequence
  synthetic [barcode part1]
agaacgacttaggtgt

SEQ ID NO: 25376 - DNA, 16 bp, Artificial Sequence
  synthetic [barcode part1]
aatccacgccttgtcg

SEQ ID NO: 25377 - DNA, 16 bp, Artificial Sequence
  synthetic [barcode part1]
cgagtccaggtagtag

SEQ ID NO: 25378 - DNA, 16 bp, Artificial Sequence
  synthetic [barcode part1]
attgtctggtgcctgc

SEQ ID NO: 25379 - DNA, 16 bp, Artificial Sequence
  synthetic [barcode part1]
cgcgtaattgcacagt

SEQ ID NO: 25380 - DNA, 16 bp, Artificial Sequence
  synthetic [barcode part1]
agttctccacgaatct

SEQ ID NO: 25381 - DNA, 16 bp, Artificial Sequence
  synthetic [barcode part1]
attgtccggtaggact

SEQ ID NO: 25382 - DNA, 16 bp, Artificial Sequence
  synthetic [barcode part1]
aggtggaggtaagtac

SEQ ID NO: 25383 - DNA, 16 bp, Artificial Sequence
  synthetic [barcode part1]
atccggattgcctcgt

SEQ ID NO: 25384 - DNA, 16 bp, Artificial Sequence
  synthetic [barcode part1]
tggttcttcgaggagt

SEQ ID NO: 25385 - DNA, 16 bp, Artificial Sequence
  synthetic [barcode part1]
gttacaggaacgaatc

SEQ ID NO: 25386 - DNA, 16 bp, Artificial Sequence
  synthetic [barcode part1]
caggcacgaagtgatc

SEQ ID NO: 25387 - DNA, 16 bp, Artificial Sequence
  synthetic [barcode part1]
gcactggaaggcaatc

SEQ ID NO: 25388 - DNA, 16 bp, Artificial Sequence
  synthetic [barcode part1]
ttcgccacgcaagttc

SEQ ID NO: 25389 - DNA, 16 bp, Artificial Sequence
  synthetic [barcode part1]
gttattatacgcctcg

SEQ ID NO: 25390 - DNA, 16 bp, Artificial Sequence
  synthetic [barcode part1]
gtagtaccgatcaacc

SEQ ID NO: 25391 - DNA, 16 bp, Artificial Sequence
  synthetic [barcode part1]
tgaggtgtctgcgaag

SEQ ID NO: 25392 - DNA, 16 bp, Artificial Sequence
  synthetic [barcode part1]
ttctgagtactcgttg

SEQ ID NO: 25393 - DNA, 16 bp, Artificial Sequence
  synthetic [barcode part1]
acctctatctagtggt

SEQ ID NO: 25394 - DNA, 16 bp, Artificial Sequence
  synthetic [barcode part1]
ccacgtggagactaag

SEQ ID NO: 25395 - DNA, 16 bp, Artificial Sequence
  synthetic [barcode part1]
taggaccgaccttagt

SEQ ID NO: 25396 - DNA, 16 bp, Artificial Sequence
  synthetic [barcode part1]
aagagtggacacaggt

SEQ ID NO: 25397 - DNA, 16 bp, Artificial Sequence
  synthetic [barcode part1]
caggaggcagtgtact

SEQ ID NO: 25398 - DNA, 16 bp, Artificial Sequence
  synthetic [barcode part1]
tgaggcagatagtgag

SEQ ID NO: 25399 - DNA, 16 bp, Artificial Sequence
  synthetic [barcode part1]
ataggcgtgttgtaag

SEQ ID NO: 25400 - DNA, 16 bp, Artificial Sequence
  synthetic [barcode part1]
gtaagtcgaggaccac

SEQ ID NO: 25401 - DNA, 16 bp, Artificial Sequence
  synthetic [barcode part1]
tgcagatcgagataac

SEQ ID NO: 25402 - DNA, 16 bp, Artificial Sequence
  synthetic [barcode part1]
tgacgatctagtgacc

SEQ ID NO: 25403 - DNA, 16 bp, Artificial Sequence
  synthetic [barcode part1]
gaggtagaacgtccac

SEQ ID NO: 25404 - DNA, 16 bp, Artificial Sequence
  synthetic [barcode part1]
ttgttctggcctgcag

SEQ ID NO: 25405 - DNA, 16 bp, Artificial Sequence
  synthetic [barcode part1]
gttagtgccgttgtcc

SEQ ID NO: 25406 - DNA, 16 bp, Artificial Sequence
  synthetic [barcode part1]
gatcgcaattgtgcgt

SEQ ID NO: 25407 - DNA, 16 bp, Artificial Sequence
  synthetic [barcode part1]
tgtgaacttgttctgc

SEQ ID NO: 25408 - DNA, 16 bp, Artificial Sequence
  synthetic [barcode part1]
gtctgcgtagttctcg

SEQ ID NO: 25409 - DNA, 16 bp, Artificial Sequence
  synthetic [barcode part1]
ttcacgtgactatcgt

SEQ ID NO: 25410 - DNA, 16 bp, Artificial Sequence
  synthetic [barcode part1]
gcggtatccagaactt

SEQ ID NO: 25411 - DNA, 16 bp, Artificial Sequence
  synthetic [barcode part1]
tggaaggtgtacgacc

SEQ ID NO: 25412 - DNA, 16 bp, Artificial Sequence
  synthetic [barcode part1]
acaaccggtcgatact

SEQ ID NO: 25413 - DNA, 16 bp, Artificial Sequence
  synthetic [barcode part1]
agtcgaggtggttacg

SEQ ID NO: 25414 - DNA, 16 bp, Artificial Sequence
  synthetic [barcode part1]
gaccttacacctaccg

SEQ ID NO: 25415 - DNA, 16 bp, Artificial Sequence
  synthetic [barcode part1]
ttgtccaggtgccact

SEQ ID NO: 25416 - DNA, 16 bp, Artificial Sequence
  synthetic [barcode part1]
ttcgccaccagtacac

SEQ ID NO: 25417 - DNA, 16 bp, Artificial Sequence
  synthetic [barcode part1]
taattcctagtgcacc

SEQ ID NO: 25418 - DNA, 16 bp, Artificial Sequence
  synthetic [barcode part1]
cgtagtgttacctact

SEQ ID NO: 25419 - DNA, 16 bp, Artificial Sequence
  synthetic [barcode part1]
tagtcactgaagagtg

SEQ ID NO: 25420 - DNA, 16 bp, Artificial Sequence
  synthetic [barcode part1]
agactacacaagagtc

SEQ ID NO: 25421 - DNA, 16 bp, Artificial Sequence
  synthetic [barcode part1]
tcacgcgtcttaaccg

SEQ ID NO: 25422 - DNA, 16 bp, Artificial Sequence
  synthetic [barcode part1]
tctgattggaaccgac

SEQ ID NO: 25423 - DNA, 16 bp, Artificial Sequence
  synthetic [barcode part1]
tgtgtgttgtgcacag

SEQ ID NO: 25424 - DNA, 16 bp, Artificial Sequence
  synthetic [barcode part1]
taggtgtgatctgtgc

SEQ ID NO: 25425 - DNA, 16 bp, Artificial Sequence
  synthetic [barcode part1]
attgtgatcgcggtgt

SEQ ID NO: 25426 - DNA, 16 bp, Artificial Sequence
  synthetic [barcode part1]
aggccgtattcagtac

SEQ ID NO: 25427 - DNA, 16 bp, Artificial Sequence
  synthetic [barcode part1]
ttaggaacgaccttcg

SEQ ID NO: 25428 - DNA, 16 bp, Artificial Sequence
  synthetic [barcode part1]
agtgtcagaggaagac

SEQ ID NO: 25429 - DNA, 16 bp, Artificial Sequence
  synthetic [barcode part1]
gaagtctgataagtgc

SEQ ID NO: 25430 - DNA, 16 bp, Artificial Sequence
  synthetic [barcode part1]
caccacctctaatcct

SEQ ID NO: 25431 - DNA, 16 bp, Artificial Sequence
  synthetic [barcode part1]
caataagacggtggag

SEQ ID NO: 25432 - DNA, 16 bp, Artificial Sequence
  synthetic [barcode part1]
tcgtcgtagtaaggtc

SEQ ID NO: 25433 - DNA, 16 bp, Artificial Sequence
  synthetic [barcode part1]
ccggtacgttgtatag

SEQ ID NO: 25434 - DNA, 16 bp, Artificial Sequence
  synthetic [barcode part1]
cactaacttgaggaag

SEQ ID NO: 25435 - DNA, 16 bp, Artificial Sequence
  synthetic [barcode part1]
gtaagtcttctcaacc

SEQ ID NO: 25436 - DNA, 16 bp, Artificial Sequence
  synthetic [barcode part1]
atagaagactactggc

SEQ ID NO: 25437 - DNA, 16 bp, Artificial Sequence
  synthetic [barcode part1]
attctgttcgtgcggc

SEQ ID NO: 25438 - DNA, 16 bp, Artificial Sequence
  synthetic [barcode part1]
acgcaagtactcctag

SEQ ID NO: 25439 - DNA, 16 bp, Artificial Sequence
  synthetic [barcode part1]
gcacagtctagttctt

SEQ ID NO: 25440 - DNA, 16 bp, Artificial Sequence
  synthetic [barcode part1]
cagatctcaagacaag

SEQ ID NO: 25441 - DNA, 16 bp, Artificial Sequence
  synthetic [barcode part1]
gttggagtatagtcag

SEQ ID NO: 25442 - DNA, 16 bp, Artificial Sequence
  synthetic [barcode part1]
cgacacgatacagttc

SEQ ID NO: 25443 - DNA, 16 bp, Artificial Sequence
  synthetic [barcode part1]
gcgtatatcgaagtcc

SEQ ID NO: 25444 - DNA, 16 bp, Artificial Sequence
  synthetic [barcode part1]
agtacgtcacagttgc

SEQ ID NO: 25445 - DNA, 16 bp, Artificial Sequence
  synthetic [barcode part1]
ttcacgttggttcagt

SEQ ID NO: 25446 - DNA, 16 bp, Artificial Sequence
  synthetic [barcode part1]
cctcagtcgtattaac

SEQ ID NO: 25447 - DNA, 16 bp, Artificial Sequence
  synthetic [barcode part1]
cctggacagtaataag

SEQ ID NO: 25448 - DNA, 16 bp, Artificial Sequence
  synthetic [barcode part1]
cgtagatcgaggtgac

SEQ ID NO: 25449 - DNA, 16 bp, Artificial Sequence
  synthetic [barcode part1]
atcggactgtcctcgt

SEQ ID NO: 25450 - DNA, 16 bp, Artificial Sequence
  synthetic [barcode part1]
tggaaggcgtgtgatc

SEQ ID NO: 25451 - DNA, 16 bp, Artificial Sequence
  synthetic [barcode part1]
tcaacctctgtacagt

SEQ ID NO: 25452 - DNA, 16 bp, Artificial Sequence
  synthetic [barcode part1]
agaatctggcggacgt

SEQ ID NO: 25453 - DNA, 16 bp, Artificial Sequence
  synthetic [barcode part1]
gtggttaagttgagac

SEQ ID NO: 25454 - DNA, 16 bp, Artificial Sequence
  synthetic [barcode part1]
ccttacactaagtcgt

SEQ ID NO: 25455 - DNA, 16 bp, Artificial Sequence
  synthetic [barcode part1]
ttgttctcacaggttg

SEQ ID NO: 25456 - DNA, 16 bp, Artificial Sequence
  synthetic [barcode part1]
agtgtgcctggtcctt

SEQ ID NO: 25457 - DNA, 16 bp, Artificial Sequence
  synthetic [barcode part1]
tggcgtggagaatcac

SEQ ID NO: 25458 - DNA, 16 bp, Artificial Sequence
  synthetic [barcode part1]
tactgcagttgtggtg

SEQ ID NO: 25459 - DNA, 16 bp, Artificial Sequence
  synthetic [barcode part1]
aaccacaggagttaac

SEQ ID NO: 25460 - DNA, 16 bp, Artificial Sequence
  synthetic [barcode part1]
taagtgcactagagac

SEQ ID NO: 25461 - DNA, 16 bp, Artificial Sequence
  synthetic [barcode part1]
accaggattaggagag

SEQ ID NO: 25462 - DNA, 16 bp, Artificial Sequence
  synthetic [barcode part1]
tgccgagtgtctctac

SEQ ID NO: 25463 - DNA, 16 bp, Artificial Sequence
  synthetic [barcode part1]
cagaccagatccagtt

SEQ ID NO: 25464 - DNA, 16 bp, Artificial Sequence
  synthetic [barcode part1]
ttgtccacttggaact

SEQ ID NO: 25465 - DNA, 16 bp, Artificial Sequence
  synthetic [barcode part1]
acacgcggttgtaatc

SEQ ID NO: 25466 - DNA, 16 bp, Artificial Sequence
  synthetic [barcode part1]
ttatcctgcacaactg

SEQ ID NO: 25467 - DNA, 16 bp, Artificial Sequence
  synthetic [barcode part1]
cacgagtcctgtcgtt

SEQ ID NO: 25468 - DNA, 16 bp, Artificial Sequence
  synthetic [barcode part1]
gtcaccgagagtgtag

SEQ ID NO: 25469 - DNA, 16 bp, Artificial Sequence
  synthetic [barcode part1]
tctatcgcgtaggcct

SEQ ID NO: 25470 - DNA, 16 bp, Artificial Sequence
  synthetic [barcode part1]
tctagttaccggtatc

SEQ ID NO: 25471 - DNA, 16 bp, Artificial Sequence
  synthetic [barcode part1]
accggataggttacct

SEQ ID NO: 25472 - DNA, 16 bp, Artificial Sequence
  synthetic [barcode part1]
cggttgatctcagagt

SEQ ID NO: 25473 - DNA, 16 bp, Artificial Sequence
  synthetic [barcode part1]
cgtgaacgcaataagt

SEQ ID NO: 25474 - DNA, 16 bp, Artificial Sequence
  synthetic [barcode part1]
gtgttgagagagtcgc

SEQ ID NO: 25475 - DNA, 16 bp, Artificial Sequence
  synthetic [barcode part1]
cagatcaaccggattc

SEQ ID NO: 25476 - DNA, 16 bp, Artificial Sequence
  synthetic [barcode part1]
atagtgccacgtgtac

SEQ ID NO: 25477 - DNA, 16 bp, Artificial Sequence
  synthetic [barcode part1]
cacacgcgattagttg

SEQ ID NO: 25478 - DNA, 16 bp, Artificial Sequence
  synthetic [barcode part1]
gtatagacgccgagtg

SEQ ID NO: 25479 - DNA, 16 bp, Artificial Sequence
  synthetic [barcode part1]
ccttgtcttatagacg

SEQ ID NO: 25480 - DNA, 16 bp, Artificial Sequence
  synthetic [barcode part1]
ccgactgtcagaattg

SEQ ID NO: 25481 - DNA, 16 bp, Artificial Sequence
  synthetic [barcode part1]
caacagttcagaccac

SEQ ID NO: 25482 - DNA, 16 bp, Artificial Sequence
  synthetic [barcode part1]
aacagtagacggagtg

SEQ ID NO: 25483 - DNA, 16 bp, Artificial Sequence
  synthetic [barcode part1]
tgtacgatactctgtc

SEQ ID NO: 25484 - DNA, 16 bp, Artificial Sequence
  synthetic [barcode part1]
tgttgtgtggtcaacg

SEQ ID NO: 25485 - DNA, 16 bp, Artificial Sequence
  synthetic [barcode part1]
gagactgccaagtacg

SEQ ID NO: 25486 - DNA, 16 bp, Artificial Sequence
  synthetic [barcode part1]
tgccttcttgaactag

SEQ ID NO: 25487 - DNA, 16 bp, Artificial Sequence
  synthetic [barcode part1]
caaggtcgtcgtagtt

SEQ ID NO: 25488 - DNA, 16 bp, Artificial Sequence
  synthetic [barcode part1]
gaagtgagtaggtctt

SEQ ID NO: 25489 - DNA, 16 bp, Artificial Sequence
  synthetic [barcode part1]
tcggtatcgcaatcag

SEQ ID NO: 25490 - DNA, 16 bp, Artificial Sequence
  synthetic [barcode part1]
ttgccgtgtccgtaac

SEQ ID NO: 25491 - DNA, 16 bp, Artificial Sequence
  synthetic [barcode part1]
gaagtcgatacaatcg

SEQ ID NO: 25492 - DNA, 16 bp, Artificial Sequence
  synthetic [barcode part1]
attctaagtgcacgcg

SEQ ID NO: 25493 - DNA, 16 bp, Artificial Sequence
  synthetic [barcode part1]
aacgaccacgcagagt

SEQ ID NO: 25494 - DNA, 16 bp, Artificial Sequence
  synthetic [barcode part1]
acctctaggcggtctt

SEQ ID NO: 25495 - DNA, 16 bp, Artificial Sequence
  synthetic [barcode part1]
gcggagaccagtaact

SEQ ID NO: 25496 - DNA, 16 bp, Artificial Sequence
  synthetic [barcode part1]
aagagtagttcctgcc

SEQ ID NO: 25497 - DNA, 16 bp, Artificial Sequence
  synthetic [barcode part1]
gatagaacgcgtcgac

SEQ ID NO: 25498 - DNA, 16 bp, Artificial Sequence
  synthetic [barcode part1]
aaccagtacgtgtacc

SEQ ID NO: 25499 - DNA, 16 bp, Artificial Sequence
  synthetic [barcode part1]
gtagaatcttgccacg

SEQ ID NO: 25500 - DNA, 16 bp, Artificial Sequence
  synthetic [barcode part1]
gcctctgaagtcgtct

SEQ ID NO: 25501 - DNA, 16 bp, Artificial Sequence
  synthetic [barcode part1]
tagtgtaaggacgact

SEQ ID NO: 25502 - DNA, 16 bp, Artificial Sequence
  synthetic [barcode part1]
tgcggtgacaatactc

SEQ ID NO: 25503 - DNA, 16 bp, Artificial Sequence
  synthetic [barcode part1]
acggccgttaactcct

SEQ ID NO: 25504 - DNA, 16 bp, Artificial Sequence
  synthetic [barcode part1]
cgttattgtaaccacc

SEQ ID NO: 25505 - DNA, 16 bp, Artificial Sequence
  synthetic [barcode part1]
cgcggttgtgtaattg

SEQ ID NO: 25506 - DNA, 16 bp, Artificial Sequence
  synthetic [barcode part1]
agacctgagacgtctt

SEQ ID NO: 25507 - DNA, 16 bp, Artificial Sequence
  synthetic [barcode part1]
ccagattggaacgcag

SEQ ID NO: 25508 - DNA, 16 bp, Artificial Sequence
  synthetic [barcode part1]
tggttgagagatcctc

SEQ ID NO: 25509 - DNA, 16 bp, Artificial Sequence
  synthetic [barcode part1]
acctcactagatctac

SEQ ID NO: 25510 - DNA, 16 bp, Artificial Sequence
  synthetic [barcode part1]
aacggaacacgaactt

SEQ ID NO: 25511 - DNA, 16 bp, Artificial Sequence
  synthetic [barcode part1]
acttgaggagtctgtc

SEQ ID NO: 25512 - DNA, 16 bp, Artificial Sequence
  synthetic [barcode part1]
aaggatacggagacac

SEQ ID NO: 25513 - DNA, 16 bp, Artificial Sequence
  synthetic [barcode part1]
ttaagtggagtgacgt

SEQ ID NO: 25514 - DNA, 16 bp, Artificial Sequence
  synthetic [barcode part1]
ttgaacaggtggagtt

SEQ ID NO: 25515 - DNA, 16 bp, Artificial Sequence
  synthetic [barcode part1]
cacaagtggtgttcac

SEQ ID NO: 25516 - DNA, 16 bp, Artificial Sequence
  synthetic [barcode part1]
gagatctaacgttgcc

SEQ ID NO: 25517 - DNA, 16 bp, Artificial Sequence
  synthetic [barcode part1]
tgcgaagattgagttg

SEQ ID NO: 25518 - DNA, 16 bp, Artificial Sequence
  synthetic [barcode part1]
tcaacgagacagttcc

SEQ ID NO: 25519 - DNA, 16 bp, Artificial Sequence
  synthetic [barcode part1]
ccttcagttctctgac

SEQ ID NO: 25520 - DNA, 16 bp, Artificial Sequence
  synthetic [barcode part1]
tcgtggaggatacctt

SEQ ID NO: 25521 - DNA, 16 bp, Artificial Sequence
  synthetic [barcode part1]
cagaatcaggaggaac

SEQ ID NO: 25522 - DNA, 16 bp, Artificial Sequence
  synthetic [barcode part1]
gcacgatagtcgaggt

SEQ ID NO: 25523 - DNA, 16 bp, Artificial Sequence
  synthetic [barcode part1]
actacttagacctgtc

SEQ ID NO: 25524 - DNA, 16 bp, Artificial Sequence
  synthetic [barcode part1]
ttctcaatagttgcgc

SEQ ID NO: 25525 - DNA, 16 bp, Artificial Sequence
  synthetic [barcode part1]
tgtgtaggacagtggc

SEQ ID NO: 25526 - DNA, 16 bp, Artificial Sequence
  synthetic [barcode part1]
cgatcctgtgccaatc

SEQ ID NO: 25527 - DNA, 16 bp, Artificial Sequence
  synthetic [barcode part1]
ttggaggtcaggtgtg

SEQ ID NO: 25528 - DNA, 16 bp, Artificial Sequence
  synthetic [barcode part1]
ataacgaacgaggcag

SEQ ID NO: 25529 - DNA, 16 bp, Artificial Sequence
  synthetic [barcode part1]
atctcgccgaatctgc

SEQ ID NO: 25530 - DNA, 16 bp, Artificial Sequence
  synthetic [barcode part1]
tctggtctaaccacgc

SEQ ID NO: 25531 - DNA, 16 bp, Artificial Sequence
  synthetic [barcode part1]
aggtggacttacctac

SEQ ID NO: 25532 - DNA, 16 bp, Artificial Sequence
  synthetic [barcode part1]
cctaactatcacacgt

SEQ ID NO: 25533 - DNA, 16 bp, Artificial Sequence
  synthetic [barcode part1]
gaagaaggagacttcg

SEQ ID NO: 25534 - DNA, 16 bp, Artificial Sequence
  synthetic [barcode part1]
cgaacgtcgtactagt

SEQ ID NO: 25535 - DNA, 16 bp, Artificial Sequence
  synthetic [barcode part1]
gttccgttccgtagac

SEQ ID NO: 25536 - DNA, 16 bp, Artificial Sequence
  synthetic [barcode part1]
tgcacggtattaacgc

SEQ ID NO: 25537 - DNA, 16 bp, Artificial Sequence
  synthetic [barcode part1]
ttggtagagactgtcc

SEQ ID NO: 25538 - DNA, 16 bp, Artificial Sequence
  synthetic [barcode part1]
tgcaactgcacaactg

SEQ ID NO: 25539 - DNA, 16 bp, Artificial Sequence
  synthetic [barcode part1]
ttcggtaagtggtctg

SEQ ID NO: 25540 - DNA, 16 bp, Artificial Sequence
  synthetic [barcode part1]
taccgcgtaattggtg

SEQ ID NO: 25541 - DNA, 16 bp, Artificial Sequence
  synthetic [barcode part1]
agatcactgtcttcac

SEQ ID NO: 25542 - DNA, 16 bp, Artificial Sequence
  synthetic [barcode part1]
tgcaaggtgtattccg

SEQ ID NO: 25543 - DNA, 16 bp, Artificial Sequence
  synthetic [barcode part1]
acaattgtcctccagt

SEQ ID NO: 25544 - DNA, 16 bp, Artificial Sequence
  synthetic [barcode part1]
tctccgattgaggaac

SEQ ID NO: 25545 - DNA, 16 bp, Artificial Sequence
  synthetic [barcode part1]
gagtaccgcgacaagt

SEQ ID NO: 25546 - DNA, 16 bp, Artificial Sequence
  synthetic [barcode part1]
cggaagttattagacg

SEQ ID NO: 25547 - DNA, 16 bp, Artificial Sequence
  synthetic [barcode part1]
aacagtcgaggatatc

SEQ ID NO: 25548 - DNA, 16 bp, Artificial Sequence
  synthetic [barcode part1]
aattcagacacggagt

SEQ ID NO: 25549 - DNA, 16 bp, Artificial Sequence
  synthetic [barcode part1]
tggacacaacctgtgt

SEQ ID NO: 25550 - DNA, 16 bp, Artificial Sequence
  synthetic [barcode part1]
cctgacctagtcgtgt

SEQ ID NO: 25551 - DNA, 16 bp, Artificial Sequence
  synthetic [barcode part1]
tcttaatctgacgcgt

SEQ ID NO: 25552 - DNA, 16 bp, Artificial Sequence
  synthetic [barcode part1]
tcgttccgtgcaactg

SEQ ID NO: 25553 - DNA, 16 bp, Artificial Sequence
  synthetic [barcode part1]
acaagtagataccacg

SEQ ID NO: 25554 - DNA, 16 bp, Artificial Sequence
  synthetic [barcode part1]
atcacaccgtaagtcg

SEQ ID NO: 25555 - DNA, 16 bp, Artificial Sequence
  synthetic [barcode part1]
aacttctggagtggtc

SEQ ID NO: 25556 - DNA, 16 bp, Artificial Sequence
  synthetic [barcode part1]
cctccgaagttaaggt

SEQ ID NO: 25557 - DNA, 16 bp, Artificial Sequence
  synthetic [barcode part1]
gtctcctgaagttgag

SEQ ID NO: 25558 - DNA, 16 bp, Artificial Sequence
  synthetic [barcode part1]
cgcgatctatatcgag

SEQ ID NO: 25559 - DNA, 16 bp, Artificial Sequence
  synthetic [barcode part1]
gaccaacgtgtgtgtt

SEQ ID NO: 25560 - DNA, 16 bp, Artificial Sequence
  synthetic [barcode part1]
taggattccaggacct

SEQ ID NO: 25561 - DNA, 16 bp, Artificial Sequence
  synthetic [barcode part1]
aacgttgcgatcgatc

SEQ ID NO: 25562 - DNA, 16 bp, Artificial Sequence
  synthetic [barcode part1]
cacaacaggcaagtgc

SEQ ID NO: 25563 - DNA, 16 bp, Artificial Sequence
  synthetic [barcode part1]
actagaagaggccaag

SEQ ID NO: 25564 - DNA, 16 bp, Artificial Sequence
  synthetic [barcode part1]
aactattaggccaccg

SEQ ID NO: 25565 - DNA, 16 bp, Artificial Sequence
  synthetic [barcode part1]
cgtcaagacaggaatt

SEQ ID NO: 25566 - DNA, 16 bp, Artificial Sequence
  synthetic [barcode part1]
ttcgattccttctggc

SEQ ID NO: 25567 - DNA, 16 bp, Artificial Sequence
  synthetic [barcode part1]
tctgacctcctagttc

SEQ ID NO: 25568 - DNA, 16 bp, Artificial Sequence
  synthetic [barcode part1]
cctacgtaagaacgtc

SEQ ID NO: 25569 - DNA, 16 bp, Artificial Sequence
  synthetic [barcode part1]
gaagttaaccggagag

SEQ ID NO: 25570 - DNA, 16 bp, Artificial Sequence
  synthetic [barcode part1]
tgtctcgaacgtctgc

SEQ ID NO: 25571 - DNA, 16 bp, Artificial Sequence
  synthetic [barcode part1]
cagtcgccttaacctg

SEQ ID NO: 25572 - DNA, 16 bp, Artificial Sequence
  synthetic [barcode part1]
tagttcggcaggagtg

SEQ ID NO: 25573 - DNA, 16 bp, Artificial Sequence
  synthetic [barcode part1]
gaaggtcctctaatcg

SEQ ID NO: 25574 - DNA, 16 bp, Artificial Sequence
  synthetic [barcode part1]
tatcgtgcgtgtgtag

SEQ ID NO: 25575 - DNA, 16 bp, Artificial Sequence
  synthetic [barcode part1]
tgaaccaactggatcc

SEQ ID NO: 25576 - DNA, 16 bp, Artificial Sequence
  synthetic [barcode part1]
attccgcacggaatac

SEQ ID NO: 25577 - DNA, 16 bp, Artificial Sequence
  synthetic [barcode part1]
tgagtacgtgtagtcc

SEQ ID NO: 25578 - DNA, 16 bp, Artificial Sequence
  synthetic [barcode part1]
gaagtgcgaccactag

SEQ ID NO: 25579 - DNA, 16 bp, Artificial Sequence
  synthetic [barcode part1]
tcaagaccaagacctc

SEQ ID NO: 25580 - DNA, 16 bp, Artificial Sequence
  synthetic [barcode part1]
ttcgagtctcggttcg

SEQ ID NO: 25581 - DNA, 16 bp, Artificial Sequence
  synthetic [barcode part1]
accacgcagttatacg

SEQ ID NO: 25582 - DNA, 16 bp, Artificial Sequence
  synthetic [barcode part1]
ttaagtaaggcctgcc

SEQ ID NO: 25583 - DNA, 16 bp, Artificial Sequence
  synthetic [barcode part1]
tgtatcttgttggacc

SEQ ID NO: 25584 - DNA, 16 bp, Artificial Sequence
  synthetic [barcode part1]
cggattgccttgcgtt

SEQ ID NO: 25585 - DNA, 16 bp, Artificial Sequence
  synthetic [barcode part1]
tcctcttacaccgtac

SEQ ID NO: 25586 - DNA, 16 bp, Artificial Sequence
  synthetic [barcode part1]
actctccgtgtcagtg

SEQ ID NO: 25587 - DNA, 16 bp, Artificial Sequence
  synthetic [barcode part1]
ttctggagagtaagtg

SEQ ID NO: 25588 - DNA, 16 bp, Artificial Sequence
  synthetic [barcode part1]
aattccttcggcgcac

SEQ ID NO: 25589 - DNA, 16 bp, Artificial Sequence
  synthetic [barcode part1]
gttctgtgtggttact

SEQ ID NO: 25590 - DNA, 16 bp, Artificial Sequence
  synthetic [barcode part1]
agaacagtctaggtgt

SEQ ID NO: 25591 - DNA, 16 bp, Artificial Sequence
  synthetic [barcode part1]
ttagtatctctgaccg

SEQ ID NO: 25592 - DNA, 16 bp, Artificial Sequence
  synthetic [barcode part1]
ccggttcgtctagact

SEQ ID NO: 25593 - DNA, 16 bp, Artificial Sequence
  synthetic [barcode part1]
gagttcgcgccttact

SEQ ID NO: 25594 - DNA, 16 bp, Artificial Sequence
  synthetic [barcode part1]
cacgcggttgtatagt

SEQ ID NO: 25595 - DNA, 16 bp, Artificial Sequence
  synthetic [barcode part1]
acttccgttgtacctc

SEQ ID NO: 25596 - DNA, 16 bp, Artificial Sequence
  synthetic [barcode part1]
ttccgacctctgttac

SEQ ID NO: 25597 - DNA, 16 bp, Artificial Sequence
  synthetic [barcode part1]
accactcgatactcgc

SEQ ID NO: 25598 - DNA, 16 bp, Artificial Sequence
  synthetic [barcode part1]
atcaagagttgacacg

SEQ ID NO: 25599 - DNA, 16 bp, Artificial Sequence
  synthetic [barcode part1]
tcttgccgagttcgtg

SEQ ID NO: 25600 - DNA, 16 bp, Artificial Sequence
  synthetic [barcode part1]
gtgtctcaactcaatc

SEQ ID NO: 25601 - DNA, 16 bp, Artificial Sequence
  synthetic [barcode part1]
agaggcgccactaagt

SEQ ID NO: 25602 - DNA, 16 bp, Artificial Sequence
  synthetic [barcode part1]
gtcaccgtagtaactg

SEQ ID NO: 25603 - DNA, 16 bp, Artificial Sequence
  synthetic [barcode part1]
aactcggatacttcct

SEQ ID NO: 25604 - DNA, 16 bp, Artificial Sequence
  synthetic [barcode part1]
cagaacttaaccggtc

SEQ ID NO: 25605 - DNA, 16 bp, Artificial Sequence
  synthetic [barcode part1]
aaggacgagattactc

SEQ ID NO: 25606 - DNA, 16 bp, Artificial Sequence
  synthetic [barcode part1]
gagagacgtccagatc

SEQ ID NO: 25607 - DNA, 16 bp, Artificial Sequence
  synthetic [barcode part1]
gccaacgttgtcgttc

SEQ ID NO: 25608 - DNA, 16 bp, Artificial Sequence
  synthetic [barcode part1]
gcctcagtataacacg

SEQ ID NO: 25609 - DNA, 16 bp, Artificial Sequence
  synthetic [barcode part1]
cgtaagtggcagagtc

SEQ ID NO: 25610 - DNA, 16 bp, Artificial Sequence
  synthetic [barcode part1]
cggaactataccacgt

SEQ ID NO: 25611 - DNA, 16 bp, Artificial Sequence
  synthetic [barcode part1]
aaccagtctagagtcc

SEQ ID NO: 25612 - DNA, 16 bp, Artificial Sequence
  synthetic [barcode part1]
acactggtgattctct

SEQ ID NO: 25613 - DNA, 16 bp, Artificial Sequence
  synthetic [barcode part1]
actatctctgcaagtc

SEQ ID NO: 25614 - DNA, 16 bp, Artificial Sequence
  synthetic [barcode part1]
ttccacgagaggtatc

SEQ ID NO: 25615 - DNA, 16 bp, Artificial Sequence
  synthetic [barcode part1]
caattgccttgcgaag

SEQ ID NO: 25616 - DNA, 16 bp, Artificial Sequence
  synthetic [barcode part1]
aatacgaagacgcgag

SEQ ID NO: 25617 - DNA, 16 bp, Artificial Sequence
  synthetic [barcode part1]
agacgagagatagacc

SEQ ID NO: 25618 - DNA, 16 bp, Artificial Sequence
  synthetic [barcode part1]
gacttagatactcctc

SEQ ID NO: 25619 - DNA, 16 bp, Artificial Sequence
  synthetic [barcode part1]
cgagtgacgtcacaag

SEQ ID NO: 25620 - DNA, 16 bp, Artificial Sequence
  synthetic [barcode part1]
aaggttaccaggcgtg

SEQ ID NO: 25621 - DNA, 16 bp, Artificial Sequence
  synthetic [barcode part1]
attccacaggtgtctt

SEQ ID NO: 25622 - DNA, 16 bp, Artificial Sequence
  synthetic [barcode part1]
aacttcctacaggtct

SEQ ID NO: 25623 - DNA, 16 bp, Artificial Sequence
  synthetic [barcode part1]
tctgactatcggtgtt

SEQ ID NO: 25624 - DNA, 16 bp, Artificial Sequence
  synthetic [barcode part1]
gtcacgaaggtggact

SEQ ID NO: 25625 - DNA, 16 bp, Artificial Sequence
  synthetic [barcode part1]
cggttaggaccaactt

SEQ ID NO: 25626 - DNA, 16 bp, Artificial Sequence
  synthetic [barcode part1]
tggtcggttgaagttc

SEQ ID NO: 25627 - DNA, 16 bp, Artificial Sequence
  synthetic [barcode part1]
ccaactagttacgacg

SEQ ID NO: 25628 - DNA, 16 bp, Artificial Sequence
  synthetic [barcode part1]
agtacgtgttggtacc

SEQ ID NO: 25629 - DNA, 16 bp, Artificial Sequence
  synthetic [barcode part1]
tccagaagtgtacgtc

SEQ ID NO: 25630 - DNA, 16 bp, Artificial Sequence
  synthetic [barcode part1]
gacacgtcaacgtact

SEQ ID NO: 25631 - DNA, 16 bp, Artificial Sequence
  synthetic [barcode part1]
ttggacgcactatctt

SEQ ID NO: 25632 - DNA, 16 bp, Artificial Sequence
  synthetic [barcode part1]
tccactctaccgcaag

SEQ ID NO: 25633 - DNA, 16 bp, Artificial Sequence
  synthetic [barcode part1]
tgactcactaccgaag

SEQ ID NO: 25634 - DNA, 16 bp, Artificial Sequence
  synthetic [barcode part1]
cctaattgccgtacgc

SEQ ID NO: 25635 - DNA, 16 bp, Artificial Sequence
  synthetic [barcode part1]
gatcacaccaattctc

SEQ ID NO: 25636 - DNA, 16 bp, Artificial Sequence
  synthetic [barcode part1]
gacgactatcgttggt

SEQ ID NO: 25637 - DNA, 16 bp, Artificial Sequence
  synthetic [barcode part1]
gcaagttgaagtggcc

SEQ ID NO: 25638 - DNA, 16 bp, Artificial Sequence
  synthetic [barcode part1]
cacacctatccttgtc

SEQ ID NO: 25639 - DNA, 16 bp, Artificial Sequence
  synthetic [barcode part1]
agtacgtacactgacc

SEQ ID NO: 25640 - DNA, 16 bp, Artificial Sequence
  synthetic [barcode part1]
caggtcaatcgaacct

SEQ ID NO: 25641 - DNA, 16 bp, Artificial Sequence
  synthetic [barcode part1]
tgtctaggtgtgactg

SEQ ID NO: 25642 - DNA, 16 bp, Artificial Sequence
  synthetic [barcode part1]
tgcaagtctacctcgc

SEQ ID NO: 25643 - DNA, 16 bp, Artificial Sequence
  synthetic [barcode part1]
ttcactatctcgccac

SEQ ID NO: 25644 - DNA, 16 bp, Artificial Sequence
  synthetic [barcode part1]
ccttgacgttgaagac

SEQ ID NO: 25645 - DNA, 16 bp, Artificial Sequence
  synthetic [barcode part1]
tccgatcacgtgtcac

SEQ ID NO: 25646 - DNA, 16 bp, Artificial Sequence
  synthetic [barcode part1]
gtctagacgaggcaac

SEQ ID NO: 25647 - DNA, 16 bp, Artificial Sequence
  synthetic [barcode part1]
gtgcgactgtagttac

SEQ ID NO: 25648 - DNA, 16 bp, Artificial Sequence
  synthetic [barcode part1]
agatcaaccttggtcg

SEQ ID NO: 25649 - DNA, 16 bp, Artificial Sequence
  synthetic [barcode part1]
cagtgcgatcaaggac

SEQ ID NO: 25650 - DNA, 16 bp, Artificial Sequence
  synthetic [barcode part1]
aatcgaccacgatacc

SEQ ID NO: 25651 - DNA, 16 bp, Artificial Sequence
  synthetic [barcode part1]
gtgttggcgtattggt

SEQ ID NO: 25652 - DNA, 16 bp, Artificial Sequence
  synthetic [barcode part1]
aacaccaggttgatcc

SEQ ID NO: 25653 - DNA, 16 bp, Artificial Sequence
  synthetic [barcode part1]
acttacggaggtggtg

SEQ ID NO: 25654 - DNA, 16 bp, Artificial Sequence
  synthetic [barcode part1]
acttgcctggagttcc

SEQ ID NO: 25655 - DNA, 16 bp, Artificial Sequence
  synthetic [barcode part1]
tgcagacgtgataagt

SEQ ID NO: 25656 - DNA, 16 bp, Artificial Sequence
  synthetic [barcode part1]
acgttgaagttcgcac

SEQ ID NO: 25657 - DNA, 16 bp, Artificial Sequence
  synthetic [barcode part1]
acgttgactctgtcgc

SEQ ID NO: 25658 - DNA, 16 bp, Artificial Sequence
  synthetic [barcode part1]
gtcgttaaggagtgcg

SEQ ID NO: 25659 - DNA, 16 bp, Artificial Sequence
  synthetic [barcode part1]
gtcctcacgagttgtc

SEQ ID NO: 25660 - DNA, 16 bp, Artificial Sequence
  synthetic [barcode part1]
atctgagttgtcttgc

SEQ ID NO: 25661 - DNA, 16 bp, Artificial Sequence
  synthetic [barcode part1]
tatcctaaggcaacgc

SEQ ID NO: 25662 - DNA, 16 bp, Artificial Sequence
  synthetic [barcode part1]
aggaattctccgactg

SEQ ID NO: 25663 - DNA, 16 bp, Artificial Sequence
  synthetic [barcode part1]
ccgtacgaaccttctg

SEQ ID NO: 25664 - DNA, 16 bp, Artificial Sequence
  synthetic [barcode part1]
acgtcctcgacaactc

SEQ ID NO: 25665 - DNA, 16 bp, Artificial Sequence
  synthetic [barcode part1]
agtggaattaggcact

SEQ ID NO: 25666 - DNA, 16 bp, Artificial Sequence
  synthetic [barcode part1]
cacgtaatattccgtc

SEQ ID NO: 25667 - DNA, 16 bp, Artificial Sequence
  synthetic [barcode part1]
agataacctctgccag

SEQ ID NO: 25668 - DNA, 16 bp, Artificial Sequence
  synthetic [barcode part1]
tcgccgagttactaag

SEQ ID NO: 25669 - DNA, 16 bp, Artificial Sequence
  synthetic [barcode part1]
gtcggaataactgtag

SEQ ID NO: 25670 - DNA, 16 bp, Artificial Sequence
  synthetic [barcode part1]
actcttgtagaccgtt

SEQ ID NO: 25671 - DNA, 16 bp, Artificial Sequence
  synthetic [barcode part1]
gttctcacaggccact

SEQ ID NO: 25672 - DNA, 16 bp, Artificial Sequence
  synthetic [barcode part1]
caaggtgtaagaggtg

SEQ ID NO: 25673 - DNA, 16 bp, Artificial Sequence
  synthetic [barcode part1]
agtcaacgtgtgtgtc

SEQ ID NO: 25674 - DNA, 16 bp, Artificial Sequence
  synthetic [barcode part1]
cctatacctctcacgt

SEQ ID NO: 25675 - DNA, 16 bp, Artificial Sequence
  synthetic [barcode part1]
taccgagtctgtatct

SEQ ID NO: 25676 - DNA, 16 bp, Artificial Sequence
  synthetic [barcode part1]
gccaataagtgcgttc

SEQ ID NO: 25677 - DNA, 16 bp, Artificial Sequence
  synthetic [barcode part1]
tctgttaggaacggtc

SEQ ID NO: 25678 - DNA, 16 bp, Artificial Sequence
  synthetic [barcode part1]
gactctcgaagattgc

SEQ ID NO: 25679 - DNA, 16 bp, Artificial Sequence
  synthetic [barcode part1]
tgatcgtgtctgagtg

SEQ ID NO: 25680 - DNA, 16 bp, Artificial Sequence
  synthetic [barcode part1]
aggtcaggtaccagtg

SEQ ID NO: 25681 - DNA, 16 bp, Artificial Sequence
  synthetic [barcode part1]
cacagttaaggatcag

SEQ ID NO: 25682 - DNA, 16 bp, Artificial Sequence
  synthetic [barcode part1]
accgtgccttcgttag

SEQ ID NO: 25683 - DNA, 16 bp, Artificial Sequence
  synthetic [barcode part1]
gatactgactgatcgc

SEQ ID NO: 25684 - DNA, 16 bp, Artificial Sequence
  synthetic [barcode part1]
tgtctgagaggaccag

SEQ ID NO: 25685 - DNA, 16 bp, Artificial Sequence
  synthetic [barcode part1]
tcagtgaccgtactcc

SEQ ID NO: 25686 - DNA, 16 bp, Artificial Sequence
  synthetic [barcode part1]
cctcacgttaggtcgt

SEQ ID NO: 25687 - DNA, 16 bp, Artificial Sequence
  synthetic [barcode part1]
gcagtcaagaactagt

SEQ ID NO: 25688 - DNA, 16 bp, Artificial Sequence
  synthetic [barcode part1]
atcaacgatctctcac

SEQ ID NO: 25689 - DNA, 16 bp, Artificial Sequence
  synthetic [barcode part1]
gaggtagtactgttcc

SEQ ID NO: 25690 - DNA, 16 bp, Artificial Sequence
  synthetic [barcode part1]
cgactattaggaggcg

SEQ ID NO: 25691 - DNA, 16 bp, Artificial Sequence
  synthetic [barcode part1]
accaggttacttctgt

SEQ ID NO: 25692 - DNA, 16 bp, Artificial Sequence
  synthetic [barcode part1]
cgacttaagaccgttg

SEQ ID NO: 25693 - DNA, 16 bp, Artificial Sequence
  synthetic [barcode part1]
atacctcgttggatct

SEQ ID NO: 25694 - DNA, 16 bp, Artificial Sequence
  synthetic [barcode part1]
gtgcgatctgactcct

SEQ ID NO: 25695 - DNA, 16 bp, Artificial Sequence
  synthetic [barcode part1]
actagaattggcctcg

SEQ ID NO: 25696 - DNA, 16 bp, Artificial Sequence
  synthetic [barcode part1]
tctagtggaacgcgag

SEQ ID NO: 25697 - DNA, 16 bp, Artificial Sequence
  synthetic [barcode part1]
acctggcctcttgtag

SEQ ID NO: 25698 - DNA, 16 bp, Artificial Sequence
  synthetic [barcode part1]
gtggttggtcaacgtt

SEQ ID NO: 25699 - DNA, 16 bp, Artificial Sequence
  synthetic [barcode part1]
aggtccgattctctgc

SEQ ID NO: 25700 - DNA, 16 bp, Artificial Sequence
  synthetic [barcode part1]
ttgaagatacgaaccg

SEQ ID NO: 25701 - DNA, 16 bp, Artificial Sequence
  synthetic [barcode part1]
gtatcgattctcggcc

SEQ ID NO: 25702 - DNA, 16 bp, Artificial Sequence
  synthetic [barcode part1]
tcgttgaagttcgacg

SEQ ID NO: 25703 - DNA, 16 bp, Artificial Sequence
  synthetic [barcode part1]
tctcgaacgtcacaag

SEQ ID NO: 25704 - DNA, 16 bp, Artificial Sequence
  synthetic [barcode part1]
tgtgagtacttcactc

SEQ ID NO: 25705 - DNA, 16 bp, Artificial Sequence
  synthetic [barcode part1]
gtgtgcgttagttgac

SEQ ID NO: 25706 - DNA, 16 bp, Artificial Sequence
  synthetic [barcode part1]
tggttgagtcgcaatc

SEQ ID NO: 25707 - DNA, 16 bp, Artificial Sequence
  synthetic [barcode part1]
gttcggcaagagtacg

SEQ ID NO: 25708 - DNA, 16 bp, Artificial Sequence
  synthetic [barcode part1]
acttgtgcggcagaag

SEQ ID NO: 25709 - DNA, 16 bp, Artificial Sequence
  synthetic [barcode part1]
gtgccggtatagatct

SEQ ID NO: 25710 - DNA, 16 bp, Artificial Sequence
  synthetic [barcode part1]
ttatctgtgtcgcggc

SEQ ID NO: 25711 - DNA, 16 bp, Artificial Sequence
  synthetic [barcode part1]
caactaagtgcgcgtt

SEQ ID NO: 25712 - DNA, 16 bp, Artificial Sequence
  synthetic [barcode part1]
gcgccaattctaccac

SEQ ID NO: 25713 - DNA, 16 bp, Artificial Sequence
  synthetic [barcode part1]
caaggtctcggaatct

SEQ ID NO: 25714 - DNA, 16 bp, Artificial Sequence
  synthetic [barcode part1]
aggtgcaagaacgtag

SEQ ID NO: 25715 - DNA, 16 bp, Artificial Sequence
  synthetic [barcode part1]
gcgagaagatctggtc

SEQ ID NO: 25716 - DNA, 16 bp, Artificial Sequence
  synthetic [barcode part1]
ttcctagaccaacact

SEQ ID NO: 25717 - DNA, 16 bp, Artificial Sequence
  synthetic [barcode part1]
taggtaagtggtgccg

SEQ ID NO: 25718 - DNA, 16 bp, Artificial Sequence
  synthetic [barcode part1]
ttatcggatacctctg

SEQ ID NO: 25719 - DNA, 16 bp, Artificial Sequence
  synthetic [barcode part1]
cgtcaggactcaatac

SEQ ID NO: 25720 - DNA, 16 bp, Artificial Sequence
  synthetic [barcode part1]
gcaggttcagtgaggt

SEQ ID NO: 25721 - DNA, 16 bp, Artificial Sequence
  synthetic [barcode part1]
acagtcggagaccagt

SEQ ID NO: 25722 - DNA, 16 bp, Artificial Sequence
  synthetic [barcode part1]
agtacgcgagaccagt

SEQ ID NO: 25723 - DNA, 16 bp, Artificial Sequence
  synthetic [barcode part1]
tcctaatagtctacgc

SEQ ID NO: 25724 - DNA, 16 bp, Artificial Sequence
  synthetic [barcode part1]
tgcggatagtgtctgt

SEQ ID NO: 25725 - DNA, 16 bp, Artificial Sequence
  synthetic [barcode part1]
agtacgtcaactgtgc

SEQ ID NO: 25726 - DNA, 16 bp, Artificial Sequence
  synthetic [barcode part1]
tggacgtgtactcagt

SEQ ID NO: 25727 - DNA, 16 bp, Artificial Sequence
  synthetic [barcode part1]
tacgcctaacggtctc

SEQ ID NO: 25728 - DNA, 16 bp, Artificial Sequence
  synthetic [barcode part1]
gcacagtcgtaatcgt

SEQ ID NO: 25729 - DNA, 16 bp, Artificial Sequence
  synthetic [barcode part1]
tgtctgcctattcgtc

SEQ ID NO: 25730 - DNA, 16 bp, Artificial Sequence
  synthetic [barcode part1]
agtgatcctcctgtgc

SEQ ID NO: 25731 - DNA, 16 bp, Artificial Sequence
  synthetic [barcode part1]
tccgaagaactggtct

SEQ ID NO: 25732 - DNA, 16 bp, Artificial Sequence
  synthetic [barcode part1]
gcgagatcactcagag

SEQ ID NO: 25733 - DNA, 16 bp, Artificial Sequence
  synthetic [barcode part1]
cggagaactgatcttc

SEQ ID NO: 25734 - DNA, 16 bp, Artificial Sequence
  synthetic [barcode part1]
cacgcacagttaactg

SEQ ID NO: 25735 - DNA, 16 bp, Artificial Sequence
  synthetic [barcode part1]
tggaacgtactctgtg

SEQ ID NO: 25736 - DNA, 16 bp, Artificial Sequence
  synthetic [barcode part1]
aagtgttacgacgagt

SEQ ID NO: 25737 - DNA, 16 bp, Artificial Sequence
  synthetic [barcode part1]
gactcctgtataactc

SEQ ID NO: 25738 - DNA, 16 bp, Artificial Sequence
  synthetic [barcode part1]
gccgtgtggagattag

SEQ ID NO: 25739 - DNA, 16 bp, Artificial Sequence
  synthetic [barcode part1]
atctgaacgaggtagt

SEQ ID NO: 25740 - DNA, 16 bp, Artificial Sequence
  synthetic [barcode part1]
tccgccggatctatac

SEQ ID NO: 25741 - DNA, 16 bp, Artificial Sequence
  synthetic [barcode part1]
tcttggtgtacctagt

SEQ ID NO: 25742 - DNA, 16 bp, Artificial Sequence
  synthetic [barcode part1]
aacctgtacaacagag

SEQ ID NO: 25743 - DNA, 16 bp, Artificial Sequence
  synthetic [barcode part1]
tctgactgccgtgtgt

SEQ ID NO: 25744 - DNA, 16 bp, Artificial Sequence
  synthetic [barcode part1]
caacttccacgattgt

SEQ ID NO: 25745 - DNA, 16 bp, Artificial Sequence
  synthetic [barcode part1]
caactcaagtacgaag

SEQ ID NO: 25746 - DNA, 16 bp, Artificial Sequence
  synthetic [barcode part1]
tgcctcaggtgtctac

SEQ ID NO: 25747 - DNA, 16 bp, Artificial Sequence
  synthetic [barcode part1]
ccaggtattacttcgt

SEQ ID NO: 25748 - DNA, 16 bp, Artificial Sequence
  synthetic [barcode part1]
cctctagacaccaacc

SEQ ID NO: 25749 - DNA, 16 bp, Artificial Sequence
  synthetic [barcode part1]
ttgagaccgaacggac

SEQ ID NO: 25750 - DNA, 16 bp, Artificial Sequence
  synthetic [barcode part1]
tcgttaggaagatacg

SEQ ID NO: 25751 - DNA, 16 bp, Artificial Sequence
  synthetic [barcode part1]
tactcgagaggaccag

SEQ ID NO: 25752 - DNA, 16 bp, Artificial Sequence
  synthetic [barcode part1]
aggagtgattcgacgc

SEQ ID NO: 25753 - DNA, 16 bp, Artificial Sequence
  synthetic [barcode part1]
cactctgcgagataac

SEQ ID NO: 25754 - DNA, 16 bp, Artificial Sequence
  synthetic [barcode part1]
tctgtattaactcggc

SEQ ID NO: 25755 - DNA, 16 bp, Artificial Sequence
  synthetic [barcode part1]
accgaaggtcgatacg

SEQ ID NO: 25756 - DNA, 16 bp, Artificial Sequence
  synthetic [barcode part1]
ccgtctgtaaggtcct

SEQ ID NO: 25757 - DNA, 16 bp, Artificial Sequence
  synthetic [barcode part1]
caccgaccttcttgag

SEQ ID NO: 25758 - DNA, 16 bp, Artificial Sequence
  synthetic [barcode part1]
agacaggagatctcgc

SEQ ID NO: 25759 - DNA, 16 bp, Artificial Sequence
  synthetic [barcode part1]
acgaaggagttgttac

SEQ ID NO: 25760 - DNA, 16 bp, Artificial Sequence
  synthetic [barcode part1]
ttgtgttcaccttcgc

SEQ ID NO: 25761 - DNA, 16 bp, Artificial Sequence
  synthetic [barcode part1]
gcaactggtcaacgtt

SEQ ID NO: 25762 - DNA, 16 bp, Artificial Sequence
  synthetic [barcode part1]
tgtagtacaggtaggt

SEQ ID NO: 25763 - DNA, 16 bp, Artificial Sequence
  synthetic [barcode part1]
acgactaattggcgtc

SEQ ID NO: 25764 - DNA, 16 bp, Artificial Sequence
  synthetic [barcode part1]
ttccgtagttgttggt

SEQ ID NO: 25765 - DNA, 16 bp, Artificial Sequence
  synthetic [barcode part1]
cctaagtactccttag

SEQ ID NO: 25766 - DNA, 16 bp, Artificial Sequence
  synthetic [barcode part1]
tcctggtgactgtacc

SEQ ID NO: 25767 - DNA, 16 bp, Artificial Sequence
  synthetic [barcode part1]
gtgtcggttcctaacc

SEQ ID NO: 25768 - DNA, 16 bp, Artificial Sequence
  synthetic [barcode part1]
tcacaggtctgtgagt

SEQ ID NO: 25769 - DNA, 16 bp, Artificial Sequence
  synthetic [barcode part1]
taccaccgcaatcacc

SEQ ID NO: 25770 - DNA, 16 bp, Artificial Sequence
  synthetic [barcode part1]
agaagactcgcgcagt

SEQ ID NO: 25771 - DNA, 16 bp, Artificial Sequence
  synthetic [barcode part1]
aggacacgtactcttg

SEQ ID NO: 25772 - DNA, 16 bp, Artificial Sequence
  synthetic [barcode part1]
atcctgttcactgcct

SEQ ID NO: 25773 - DNA, 16 bp, Artificial Sequence
  synthetic [barcode part1]
tgcagtggcctacctt

SEQ ID NO: 25774 - DNA, 16 bp, Artificial Sequence
  synthetic [barcode part1]
ttgatctcacctcgtc

SEQ ID NO: 25775 - DNA, 16 bp, Artificial Sequence
  synthetic [barcode part1]
aacactagaccgacct

SEQ ID NO: 25776 - DNA, 16 bp, Artificial Sequence
  synthetic [barcode part1]
aggcgagaagtgagtt

SEQ ID NO: 25777 - DNA, 16 bp, Artificial Sequence
  synthetic [barcode part1]
taattcctgattgcgc

SEQ ID NO: 25778 - DNA, 16 bp, Artificial Sequence
  synthetic [barcode part1]
aataggtggtaggcag

SEQ ID NO: 25779 - DNA, 16 bp, Artificial Sequence
  synthetic [barcode part1]
aacggttccaagttgc

SEQ ID NO: 25780 - DNA, 16 bp, Artificial Sequence
  synthetic [barcode part1]
gtctgagacgagttct

SEQ ID NO: 25781 - DNA, 16 bp, Artificial Sequence
  synthetic [barcode part1]
cgttaggaatacaggt

SEQ ID NO: 25782 - DNA, 16 bp, Artificial Sequence
  synthetic [barcode part1]
gtcacttccacggact

SEQ ID NO: 25783 - DNA, 16 bp, Artificial Sequence
  synthetic [barcode part1]
ttcctggcaatcgtgc

SEQ ID NO: 25784 - DNA, 16 bp, Artificial Sequence
  synthetic [barcode part1]
cgagtaccacaagtct

SEQ ID NO: 25785 - DNA, 16 bp, Artificial Sequence
  synthetic [barcode part1]
tcgaggattagatacg

SEQ ID NO: 25786 - DNA, 16 bp, Artificial Sequence
  synthetic [barcode part1]
actcttgtcgtgtcct

SEQ ID NO: 25787 - DNA, 16 bp, Artificial Sequence
  synthetic [barcode part1]
attgtattggccttcg

SEQ ID NO: 25788 - DNA, 16 bp, Artificial Sequence
  synthetic [barcode part1]
tcagagtcaagacctc

SEQ ID NO: 25789 - DNA, 16 bp, Artificial Sequence
  synthetic [barcode part1]
ccagtcgtgattaacg

SEQ ID NO: 25790 - DNA, 16 bp, Artificial Sequence
  synthetic [barcode part1]
tgtaatactcgtccac

SEQ ID NO: 25791 - DNA, 16 bp, Artificial Sequence
  synthetic [barcode part1]
acttgttcgaacggac

SEQ ID NO: 25792 - DNA, 16 bp, Artificial Sequence
  synthetic [barcode part1]
caatcttacgtgtcac

SEQ ID NO: 25793 - DNA, 16 bp, Artificial Sequence
  synthetic [barcode part1]
gtggatctcagacgtt

SEQ ID NO: 25794 - DNA, 16 bp, Artificial Sequence
  synthetic [barcode part1]
acactctgacctaact

SEQ ID NO: 25795 - DNA, 16 bp, Artificial Sequence
  synthetic [barcode part1]
tgtgcgcaattggttg

SEQ ID NO: 25796 - DNA, 16 bp, Artificial Sequence
  synthetic [barcode part1]
cgacaatccttgcgtc

SEQ ID NO: 25797 - DNA, 16 bp, Artificial Sequence
  synthetic [barcode part1]
tcctacacggttcggt

SEQ ID NO: 25798 - DNA, 16 bp, Artificial Sequence
  synthetic [barcode part1]
tggtatcagtgagtag

SEQ ID NO: 25799 - DNA, 16 bp, Artificial Sequence
  synthetic [barcode part1]
attagtaggtggtgac

SEQ ID NO: 25800 - DNA, 16 bp, Artificial Sequence
  synthetic [barcode part1]
atcggactaccagact

SEQ ID NO: 25801 - DNA, 16 bp, Artificial Sequence
  synthetic [barcode part1]
gccgacagtgattatc

SEQ ID NO: 25802 - DNA, 16 bp, Artificial Sequence
  synthetic [barcode part1]
tacctccgttgttaag

SEQ ID NO: 25803 - DNA, 16 bp, Artificial Sequence
  synthetic [barcode part1]
gtcaatcaccgtaacg

SEQ ID NO: 25804 - DNA, 16 bp, Artificial Sequence
  synthetic [barcode part1]
tcctaccgataagacg

SEQ ID NO: 25805 - DNA, 16 bp, Artificial Sequence
  synthetic [barcode part1]
acctgatctggactag

SEQ ID NO: 25806 - DNA, 16 bp, Artificial Sequence
  synthetic [barcode part1]
gataaggtctccgact

SEQ ID NO: 25807 - DNA, 16 bp, Artificial Sequence
  synthetic [barcode part1]
ttacggtctctggaag

SEQ ID NO: 25808 - DNA, 16 bp, Artificial Sequence
  synthetic [barcode part1]
gagatctgacactgtc

SEQ ID NO: 25809 - DNA, 16 bp, Artificial Sequence
  synthetic [barcode part1]
tcacgcctcgttaggt

SEQ ID NO: 25810 - DNA, 16 bp, Artificial Sequence
  synthetic [barcode part1]
gacctctatcaccttc

SEQ ID NO: 25811 - DNA, 16 bp, Artificial Sequence
  synthetic [barcode part1]
ttggttctctgtgagt

SEQ ID NO: 25812 - DNA, 16 bp, Artificial Sequence
  synthetic [barcode part1]
aaccaactcagagtcc

SEQ ID NO: 25813 - DNA, 16 bp, Artificial Sequence
  synthetic [barcode part1]
agtcacaacacgtcac

SEQ ID NO: 25814 - DNA, 16 bp, Artificial Sequence
  synthetic [barcode part1]
gattgaatcaccgtcg

SEQ ID NO: 25815 - DNA, 16 bp, Artificial Sequence
  synthetic [barcode part1]
tctgaagttgactggc

SEQ ID NO: 25816 - DNA, 16 bp, Artificial Sequence
  synthetic [barcode part1]
ttgtatcgcaattcgc

SEQ ID NO: 25817 - DNA, 16 bp, Artificial Sequence
  synthetic [barcode part1]
acgaggagtatctctc

SEQ ID NO: 25818 - DNA, 16 bp, Artificial Sequence
  synthetic [barcode part1]
gtattccactactggt

SEQ ID NO: 25819 - DNA, 16 bp, Artificial Sequence
  synthetic [barcode part1]
gtcgtgaacagtgtct

SEQ ID NO: 25820 - DNA, 16 bp, Artificial Sequence
  synthetic [barcode part1]
gataatcgaagtgcgt

SEQ ID NO: 25821 - DNA, 16 bp, Artificial Sequence
  synthetic [barcode part1]
gtgcgcgaattaacct

SEQ ID NO: 25822 - DNA, 16 bp, Artificial Sequence
  synthetic [barcode part1]
tcacgcgtcttggttg

SEQ ID NO: 25823 - DNA, 16 bp, Artificial Sequence
  synthetic [barcode part1]
tatatcacggtacgcg

SEQ ID NO: 25824 - DNA, 16 bp, Artificial Sequence
  synthetic [barcode part1]
gcaagtgcagaactcg

SEQ ID NO: 25825 - DNA, 16 bp, Artificial Sequence
  synthetic [barcode part1]
gtcgatagtctgagtc

SEQ ID NO: 25826 - DNA, 16 bp, Artificial Sequence
  synthetic [barcode part1]
tcgagagttgaatacg

SEQ ID NO: 25827 - DNA, 16 bp, Artificial Sequence
  synthetic [barcode part1]
caaccggatattgcac

SEQ ID NO: 25828 - DNA, 16 bp, Artificial Sequence
  synthetic [barcode part1]
tctcgtactgaatcgt

SEQ ID NO: 25829 - DNA, 16 bp, Artificial Sequence
  synthetic [barcode part1]
actcagaggcgagatc

SEQ ID NO: 25830 - DNA, 16 bp, Artificial Sequence
  synthetic [barcode part1]
accacaacctatctac

SEQ ID NO: 25831 - DNA, 16 bp, Artificial Sequence
  synthetic [barcode part1]
tccgccacgtgaactt

SEQ ID NO: 25832 - DNA, 16 bp, Artificial Sequence
  synthetic [barcode part1]
cgatataagtccgcgt

SEQ ID NO: 25833 - DNA, 16 bp, Artificial Sequence
  synthetic [barcode part1]
caacaatccaggtcgt

SEQ ID NO: 25834 - DNA, 16 bp, Artificial Sequence
  synthetic [barcode part1]
tcttatagtcaccggt

SEQ ID NO: 25835 - DNA, 16 bp, Artificial Sequence
  synthetic [barcode part1]
aagatcacgtgaactg

SEQ ID NO: 25836 - DNA, 16 bp, Artificial Sequence
  synthetic [barcode part1]
cggcaatatacctctt

SEQ ID NO: 25837 - DNA, 16 bp, Artificial Sequence
  synthetic [barcode part1]
aattcgagatcgccgt

SEQ ID NO: 25838 - DNA, 16 bp, Artificial Sequence
  synthetic [barcode part1]
tacacgacctggttcc

SEQ ID NO: 25839 - DNA, 16 bp, Artificial Sequence
  synthetic [barcode part1]
caatccactcagtgag

SEQ ID NO: 25840 - DNA, 16 bp, Artificial Sequence
  synthetic [barcode part1]
gcgaagataatccaac

SEQ ID NO: 25841 - DNA, 16 bp, Artificial Sequence
  synthetic [barcode part1]
cgcaggtaggtgatac

SEQ ID NO: 25842 - DNA, 16 bp, Artificial Sequence
  synthetic [barcode part1]
gtgacgtgttgactgt

SEQ ID NO: 25843 - DNA, 16 bp, Artificial Sequence
  synthetic [barcode part1]
gttgacgacctggatt

SEQ ID NO: 25844 - DNA, 16 bp, Artificial Sequence
  synthetic [barcode part1]
caagttatcctcgtgt

SEQ ID NO: 25845 - DNA, 16 bp, Artificial Sequence
  synthetic [barcode part1]
attcttccgcaatcag

SEQ ID NO: 25846 - DNA, 16 bp, Artificial Sequence
  synthetic [barcode part1]
tgtacacaaccgactg

SEQ ID NO: 25847 - DNA, 16 bp, Artificial Sequence
  synthetic [barcode part1]
aattcctctggcgtgc

SEQ ID NO: 25848 - DNA, 16 bp, Artificial Sequence
  synthetic [barcode part1]
tatctgtctgtggtac

SEQ ID NO: 25849 - DNA, 16 bp, Artificial Sequence
  synthetic [barcode part1]
tgtgtcacaacacacg

SEQ ID NO: 25850 - DNA, 16 bp, Artificial Sequence
  synthetic [barcode part1]
acctctgcggactatc

SEQ ID NO: 25851 - DNA, 16 bp, Artificial Sequence
  synthetic [barcode part1]
actggttctagagtcg

SEQ ID NO: 25852 - DNA, 16 bp, Artificial Sequence
  synthetic [barcode part1]
gccaacgtgagaagtc

SEQ ID NO: 25853 - DNA, 16 bp, Artificial Sequence
  synthetic [barcode part1]
cgattcaccactgaag

SEQ ID NO: 25854 - DNA, 16 bp, Artificial Sequence
  synthetic [barcode part1]
gccgtgatactcactc

SEQ ID NO: 25855 - DNA, 16 bp, Artificial Sequence
  synthetic [barcode part1]
tgttgttgccttccac

SEQ ID NO: 25856 - DNA, 16 bp, Artificial Sequence
  synthetic [barcode part1]
cctaaggcaatcgact

SEQ ID NO: 25857 - DNA, 16 bp, Artificial Sequence
  synthetic [barcode part1]
tcctatatcgagtcac

SEQ ID NO: 25858 - DNA, 16 bp, Artificial Sequence
  synthetic [barcode part1]
tattggcaggatcaag

SEQ ID NO: 25859 - DNA, 16 bp, Artificial Sequence
  synthetic [barcode part1]
agacgaaccactcgtt

SEQ ID NO: 25860 - DNA, 16 bp, Artificial Sequence
  synthetic [barcode part1]
gtaatcggccgatatc

SEQ ID NO: 25861 - DNA, 16 bp, Artificial Sequence
  synthetic [barcode part1]
ccagacgactctactc

SEQ ID NO: 25862 - DNA, 16 bp, Artificial Sequence
  synthetic [barcode part1]
cgtattcgcggttcgt

SEQ ID NO: 25863 - DNA, 16 bp, Artificial Sequence
  synthetic [barcode part1]
cacttcgagatagtgc

SEQ ID NO: 25864 - DNA, 16 bp, Artificial Sequence
  synthetic [barcode part1]
aggtagaatcctaggt

SEQ ID NO: 25865 - DNA, 16 bp, Artificial Sequence
  synthetic [barcode part1]
tgcaggagtatcttcg

SEQ ID NO: 25866 - DNA, 16 bp, Artificial Sequence
  synthetic [barcode part1]
tggagttctctccttc

SEQ ID NO: 25867 - DNA, 16 bp, Artificial Sequence
  synthetic [barcode part1]
gactcgactgacgatt

SEQ ID NO: 25868 - DNA, 16 bp, Artificial Sequence
  synthetic [barcode part1]
tgcggtctaaccttcg

SEQ ID NO: 25869 - DNA, 16 bp, Artificial Sequence
  synthetic [barcode part1]
attccaggaagttccg

SEQ ID NO: 25870 - DNA, 16 bp, Artificial Sequence
  synthetic [barcode part1]
ttcgccaagttcgcac

SEQ ID NO: 25871 - DNA, 16 bp, Artificial Sequence
  synthetic [barcode part1]
tgtcagtgaggtcgag

SEQ ID NO: 25872 - DNA, 16 bp, Artificial Sequence
  synthetic [barcode part1]
ccgtggtccaattaag

SEQ ID NO: 25873 - DNA, 16 bp, Artificial Sequence
  synthetic [barcode part1]
tctggagtgaccagtt

SEQ ID NO: 25874 - DNA, 16 bp, Artificial Sequence
  synthetic [barcode part1]
tgaccttcgacgtatt

SEQ ID NO: 25875 - DNA, 16 bp, Artificial Sequence
  synthetic [barcode part1]
gcgttatcacttgccg

SEQ ID NO: 25876 - DNA, 16 bp, Artificial Sequence
  synthetic [barcode part1]
acctagtaaggcgcag

SEQ ID NO: 25877 - DNA, 16 bp, Artificial Sequence
  synthetic [barcode part1]
caccaaggcaatctgt

SEQ ID NO: 25878 - DNA, 16 bp, Artificial Sequence
  synthetic [barcode part1]
aggtacgtatactccg

SEQ ID NO: 25879 - DNA, 16 bp, Artificial Sequence
  synthetic [barcode part1]
tgtcactcttgcaagt

SEQ ID NO: 25880 - DNA, 16 bp, Artificial Sequence
  synthetic [barcode part1]
tatcctggtgacgagt

SEQ ID NO: 25881 - DNA, 16 bp, Artificial Sequence
  synthetic [barcode part1]
gacgtacggccttctt

SEQ ID NO: 25882 - DNA, 16 bp, Artificial Sequence
  synthetic [barcode part1]
taaccgttcgccactg

SEQ ID NO: 25883 - DNA, 16 bp, Artificial Sequence
  synthetic [barcode part1]
ttggaggtacgttaag

SEQ ID NO: 25884 - DNA, 16 bp, Artificial Sequence
  synthetic [barcode part1]
gacaacttggcaactc

SEQ ID NO: 25885 - DNA, 16 bp, Artificial Sequence
  synthetic [barcode part1]
cagtgtacttcgttac

SEQ ID NO: 25886 - DNA, 16 bp, Artificial Sequence
  synthetic [barcode part1]
cgttcgccagataagt

SEQ ID NO: 25887 - DNA, 16 bp, Artificial Sequence
  synthetic [barcode part1]
taacgcacttcgttac

SEQ ID NO: 25888 - DNA, 16 bp, Artificial Sequence
  synthetic [barcode part1]
agtcggacgccaatag

SEQ ID NO: 25889 - DNA, 16 bp, Artificial Sequence
  synthetic [barcode part1]
tgattggtgtggtacc

SEQ ID NO: 25890 - DNA, 16 bp, Artificial Sequence
  synthetic [barcode part1]
gacgtagtaggtcacg

SEQ ID NO: 25891 - DNA, 16 bp, Artificial Sequence
  synthetic [barcode part1]
cgattggaccagttgt

SEQ ID NO: 25892 - DNA, 16 bp, Artificial Sequence
  synthetic [barcode part1]
cgacagtgttgagtct

SEQ ID NO: 25893 - DNA, 16 bp, Artificial Sequence
  synthetic [barcode part1]
actaagtcggaagtgt

SEQ ID NO: 25894 - DNA, 16 bp, Artificial Sequence
  synthetic [barcode part1]
caacacaccaacgtac

SEQ ID NO: 25895 - DNA, 16 bp, Artificial Sequence
  synthetic [barcode part1]
atacgtcacagagtag

SEQ ID NO: 25896 - DNA, 16 bp, Artificial Sequence
  synthetic [barcode part1]
ccggacagtagtagac

SEQ ID NO: 25897 - DNA, 16 bp, Artificial Sequence
  synthetic [barcode part1]
aacaagtctacgacag

SEQ ID NO: 25898 - DNA, 16 bp, Artificial Sequence
  synthetic [barcode part1]
gtgagacaggtctacg

SEQ ID NO: 25899 - DNA, 16 bp, Artificial Sequence
  synthetic [barcode part1]
gattgcgccgactctt

SEQ ID NO: 25900 - DNA, 16 bp, Artificial Sequence
  synthetic [barcode part1]
gtctctggaattactc

SEQ ID NO: 25901 - DNA, 16 bp, Artificial Sequence
  synthetic [barcode part1]
gttatccacggattct

SEQ ID NO: 25902 - DNA, 16 bp, Artificial Sequence
  synthetic [barcode part1]
gagaagattctcctcg

SEQ ID NO: 25903 - DNA, 16 bp, Artificial Sequence
  synthetic [barcode part1]
ttcagagtaaccgacc

SEQ ID NO: 25904 - DNA, 16 bp, Artificial Sequence
  synthetic [barcode part1]
gacaactccgataacc

SEQ ID NO: 25905 - DNA, 16 bp, Artificial Sequence
  synthetic [barcode part1]
agatacttccggacgt

SEQ ID NO: 25906 - DNA, 16 bp, Artificial Sequence
  synthetic [barcode part1]
tggtgataccgttgac

SEQ ID NO: 25907 - DNA, 16 bp, Artificial Sequence
  synthetic [barcode part1]
actggagtgcacagtg

SEQ ID NO: 25908 - DNA, 16 bp, Artificial Sequence
  synthetic [barcode part1]
attaggtagacgtggt

SEQ ID NO: 25909 - DNA, 16 bp, Artificial Sequence
  synthetic [barcode part1]
accagtaggactggac

SEQ ID NO: 25910 - DNA, 16 bp, Artificial Sequence
  synthetic [barcode part1]
aaggaccgtatcgacg

SEQ ID NO: 25911 - DNA, 16 bp, Artificial Sequence
  synthetic [barcode part1]
attgcagttcgaggtc

SEQ ID NO: 25912 - DNA, 16 bp, Artificial Sequence
  synthetic [barcode part1]
ttcgattatacgccac

SEQ ID NO: 25913 - DNA, 16 bp, Artificial Sequence
  synthetic [barcode part1]
gacgacaaggtctacg

SEQ ID NO: 25914 - DNA, 16 bp, Artificial Sequence
  synthetic [barcode part1]
taactgatacgcgcgt

SEQ ID NO: 25915 - DNA, 16 bp, Artificial Sequence
  synthetic [barcode part1]
gtgcgatagaagatct

SEQ ID NO: 25916 - DNA, 16 bp, Artificial Sequence
  synthetic [barcode part1]
gttggatccactagac

SEQ ID NO: 25917 - DNA, 16 bp, Artificial Sequence
  synthetic [barcode part1]
gttgcggtatctattc

SEQ ID NO: 25918 - DNA, 16 bp, Artificial Sequence
  synthetic [barcode part1]
tatccagattgaggag

SEQ ID NO: 25919 - DNA, 16 bp, Artificial Sequence
  synthetic [barcode part1]
tgtccaaggttgtacg

SEQ ID NO: 25920 - DNA, 16 bp, Artificial Sequence
  synthetic [barcode part1]
tcctcggcggtatact

SEQ ID NO: 25921 - DNA, 16 bp, Artificial Sequence
  synthetic [barcode part1]
acctattactccgaac

SEQ ID NO: 25922 - DNA, 16 bp, Artificial Sequence
  synthetic [barcode part1]
gtactgaagaacgatc

SEQ ID NO: 25923 - DNA, 16 bp, Artificial Sequence
  synthetic [barcode part1]
agaaccgtgcgaatcg

SEQ ID NO: 25924 - DNA, 16 bp, Artificial Sequence
  synthetic [barcode part1]
agataggcgtcgcagt

SEQ ID NO: 25925 - DNA, 16 bp, Artificial Sequence
  synthetic [barcode part1]
gcgtcctgattgtcgt

SEQ ID NO: 25926 - DNA, 16 bp, Artificial Sequence
  synthetic [barcode part1]
ataccttccagtaacc

SEQ ID NO: 25927 - DNA, 16 bp, Artificial Sequence
  synthetic [barcode part1]
gacgtataggaccgac

SEQ ID NO: 25928 - DNA, 16 bp, Artificial Sequence
  synthetic [barcode part1]
gttcaacttggaccag

SEQ ID NO: 25929 - DNA, 16 bp, Artificial Sequence
  synthetic [barcode part1]
tctactggcgcgatct

SEQ ID NO: 25930 - DNA, 16 bp, Artificial Sequence
  synthetic [barcode part1]
tggcgattgacagtct

SEQ ID NO: 25931 - DNA, 16 bp, Artificial Sequence
  synthetic [barcode part1]
gtctgttgcggatagt

SEQ ID NO: 25932 - DNA, 16 bp, Artificial Sequence
  synthetic [barcode part1]
cggaagttagaccacg

SEQ ID NO: 25933 - DNA, 16 bp, Artificial Sequence
  synthetic [barcode part1]
ttgtctaggtaggtgc

SEQ ID NO: 25934 - DNA, 16 bp, Artificial Sequence
  synthetic [barcode part1]
agtctcctgcagactc

SEQ ID NO: 25935 - DNA, 16 bp, Artificial Sequence
  synthetic [barcode part1]
tgtatctacgatctgc

SEQ ID NO: 25936 - DNA, 16 bp, Artificial Sequence
  synthetic [barcode part1]
cgcagtaggacgaact

SEQ ID NO: 25937 - DNA, 16 bp, Artificial Sequence
  synthetic [barcode part1]
actacgagaactctgc

SEQ ID NO: 25938 - DNA, 16 bp, Artificial Sequence
  synthetic [barcode part1]
atcctaggttgaccag

SEQ ID NO: 25939 - DNA, 16 bp, Artificial Sequence
  synthetic [barcode part1]
tccggaaggaattcct

SEQ ID NO: 25940 - DNA, 16 bp, Artificial Sequence
  synthetic [barcode part1]
agacgaggtaatatcc

SEQ ID NO: 25941 - DNA, 16 bp, Artificial Sequence
  synthetic [barcode part1]
tagtgtggactgtacc

SEQ ID NO: 25942 - DNA, 16 bp, Artificial Sequence
  synthetic [barcode part1]
gagtcgtctgtatctt

SEQ ID NO: 25943 - DNA, 16 bp, Artificial Sequence
  synthetic [barcode part1]
tccacaacggatatcg

SEQ ID NO: 25944 - DNA, 16 bp, Artificial Sequence
  synthetic [barcode part1]
cactaccgttcaggtc

SEQ ID NO: 25945 - DNA, 16 bp, Artificial Sequence
  synthetic [barcode part1]
ttggttcactcggatt

SEQ ID NO: 25946 - DNA, 16 bp, Artificial Sequence
  synthetic [barcode part1]
gttagtccacacacag

SEQ ID NO: 25947 - DNA, 16 bp, Artificial Sequence
  synthetic [barcode part1]
gtgcggttagtatacc

SEQ ID NO: 25948 - DNA, 16 bp, Artificial Sequence
  synthetic [barcode part1]
caccgttacctgaacc

SEQ ID NO: 25949 - DNA, 16 bp, Artificial Sequence
  synthetic [barcode part1]
attcctgcgaaggtgt

SEQ ID NO: 25950 - DNA, 16 bp, Artificial Sequence
  synthetic [barcode part1]
acacaattcggaaggt

SEQ ID NO: 25951 - DNA, 16 bp, Artificial Sequence
  synthetic [barcode part1]
gtgaggtaacgcctag

SEQ ID NO: 25952 - DNA, 16 bp, Artificial Sequence
  synthetic [barcode part1]
tcggcgttaactgtag

SEQ ID NO: 25953 - DNA, 16 bp, Artificial Sequence
  synthetic [barcode part1]
tctagttgtcgtgcgc

SEQ ID NO: 25954 - DNA, 16 bp, Artificial Sequence
  synthetic [barcode part1]
agactgttagatcgcc

SEQ ID NO: 25955 - DNA, 16 bp, Artificial Sequence
  synthetic [barcode part1]
tattcctacgcgagag

SEQ ID NO: 25956 - DNA, 16 bp, Artificial Sequence
  synthetic [barcode part1]
cgagaagtgtatagtc

SEQ ID NO: 25957 - DNA, 16 bp, Artificial Sequence
  synthetic [barcode part1]
gttacttctcgtcacc

SEQ ID NO: 25958 - DNA, 16 bp, Artificial Sequence
  synthetic [barcode part1]
tcgattcttacacggt

SEQ ID NO: 25959 - DNA, 16 bp, Artificial Sequence
  synthetic [barcode part1]
tcgaatacaccactct

SEQ ID NO: 25960 - DNA, 16 bp, Artificial Sequence
  synthetic [barcode part1]
ttaggcgtgttgttct

SEQ ID NO: 25961 - DNA, 16 bp, Artificial Sequence
  synthetic [barcode part1]
tcgccgcgaatctatc

SEQ ID NO: 25962 - DNA, 16 bp, Artificial Sequence
  synthetic [barcode part1]
gatcgtaacactgacc

SEQ ID NO: 25963 - DNA, 16 bp, Artificial Sequence
  synthetic [barcode part1]
tcgtgaacctacagac

SEQ ID NO: 25964 - DNA, 16 bp, Artificial Sequence
  synthetic [barcode part1]
ccaggacgttcacttc

SEQ ID NO: 25965 - DNA, 16 bp, Artificial Sequence
  synthetic [barcode part1]
gccgataacctggatt

SEQ ID NO: 25966 - DNA, 16 bp, Artificial Sequence
  synthetic [barcode part1]
cgccaacaaccaagag

SEQ ID NO: 25967 - DNA, 16 bp, Artificial Sequence
  synthetic [barcode part1]
caattcctgcgcaatt

SEQ ID NO: 25968 - DNA, 16 bp, Artificial Sequence
  synthetic [barcode part1]
gttgactcacacacag

SEQ ID NO: 25969 - DNA, 16 bp, Artificial Sequence
  synthetic [barcode part1]
cctatcggtacagtcc

SEQ ID NO: 25970 - DNA, 16 bp, Artificial Sequence
  synthetic [barcode part1]
gtccacggttagagag

SEQ ID NO: 25971 - DNA, 16 bp, Artificial Sequence
  synthetic [barcode part1]
ttcaaccgaggaacct

SEQ ID NO: 25972 - DNA, 16 bp, Artificial Sequence
  synthetic [barcode part1]
tattgataccgacgcg

SEQ ID NO: 25973 - DNA, 16 bp, Artificial Sequence
  synthetic [barcode part1]
tggagaccttaacaag

SEQ ID NO: 25974 - DNA, 16 bp, Artificial Sequence
  synthetic [barcode part1]
acgtcggtgataggac

SEQ ID NO: 25975 - DNA, 16 bp, Artificial Sequence
  synthetic [barcode part1]
tacggtatactcactc

SEQ ID NO: 25976 - DNA, 16 bp, Artificial Sequence
  synthetic [barcode part1]
gacgtataactcttcc

SEQ ID NO: 25977 - DNA, 16 bp, Artificial Sequence
  synthetic [barcode part1]
acgacttaggtgcgag

SEQ ID NO: 25978 - DNA, 16 bp, Artificial Sequence
  synthetic [barcode part1]
tagtgtgttctaccac

SEQ ID NO: 25979 - DNA, 16 bp, Artificial Sequence
  synthetic [barcode part1]
taagactactggccgt

SEQ ID NO: 25980 - DNA, 16 bp, Artificial Sequence
  synthetic [barcode part1]
gtataacggaaggtct

SEQ ID NO: 25981 - DNA, 16 bp, Artificial Sequence
  synthetic [barcode part1]
ttggtgtgtgttgacg

SEQ ID NO: 25982 - DNA, 16 bp, Artificial Sequence
  synthetic [barcode part1]
gacctgagatctggtt

SEQ ID NO: 25983 - DNA, 16 bp, Artificial Sequence
  synthetic [barcode part1]
cacgtgacgaacttgt

SEQ ID NO: 25984 - DNA, 16 bp, Artificial Sequence
  synthetic [barcode part1]
tagatccgtggcgaag

SEQ ID NO: 25985 - DNA, 16 bp, Artificial Sequence
  synthetic [barcode part1]
taccagatacttccac

SEQ ID NO: 25986 - DNA, 16 bp, Artificial Sequence
  synthetic [barcode part1]
acctgtcagtatcgcc

SEQ ID NO: 25987 - DNA, 16 bp, Artificial Sequence
  synthetic [barcode part1]
ttaggtgaacaggatc

SEQ ID NO: 25988 - DNA, 16 bp, Artificial Sequence
  synthetic [barcode part1]
taactcttgcgatcac

SEQ ID NO: 25989 - DNA, 16 bp, Artificial Sequence
  synthetic [barcode part1]
tagttgcctgtcaccg

SEQ ID NO: 25990 - DNA, 16 bp, Artificial Sequence
  synthetic [barcode part1]
gtgccgtaggtaagtg

SEQ ID NO: 25991 - DNA, 16 bp, Artificial Sequence
  synthetic [barcode part1]
attccgagtcgatcag

SEQ ID NO: 25992 - DNA, 16 bp, Artificial Sequence
  synthetic [barcode part1]
accgaatatccgacac

SEQ ID NO: 25993 - DNA, 16 bp, Artificial Sequence
  synthetic [barcode part1]
ttatctcgtcgaggag

SEQ ID NO: 25994 - DNA, 16 bp, Artificial Sequence
  synthetic [barcode part1]
ccttggtacactcgac

SEQ ID NO: 25995 - DNA, 16 bp, Artificial Sequence
  synthetic [barcode part1]
actcacaacgtggttg

SEQ ID NO: 25996 - DNA, 16 bp, Artificial Sequence
  synthetic [barcode part1]
ttcggtccgtgactac

SEQ ID NO: 25997 - DNA, 16 bp, Artificial Sequence
  synthetic [barcode part1]
tgcggaataactcaag

SEQ ID NO: 25998 - DNA, 16 bp, Artificial Sequence
  synthetic [barcode part1]
cgagtatccttgccac

SEQ ID NO: 25999 - DNA, 16 bp, Artificial Sequence
  synthetic [barcode part1]
tctggccacacgttgt

SEQ ID NO: 26000 - DNA, 16 bp, Artificial Sequence
  synthetic [barcode part1]
cctaaccggttagaac

SEQ ID NO: 26001 - DNA, 16 bp, Artificial Sequence
  synthetic [barcode part1]
gcgttgattaggcgtt

SEQ ID NO: 26002 - DNA, 16 bp, Artificial Sequence
  synthetic [barcode part1]
ttacttcgtcgttccg

SEQ ID NO: 26003 - DNA, 16 bp, Artificial Sequence
  synthetic [barcode part1]
tatctcactgtctcgc

SEQ ID NO: 26004 - DNA, 16 bp, Artificial Sequence
  synthetic [barcode part1]
tggtctctgtatagtc

SEQ ID NO: 26005 - DNA, 16 bp, Artificial Sequence
  synthetic [barcode part1]
gcaaggtcaaggtaag

SEQ ID NO: 26006 - DNA, 16 bp, Artificial Sequence
  synthetic [barcode part1]
cggactgacactcttc

SEQ ID NO: 26007 - DNA, 16 bp, Artificial Sequence
  synthetic [barcode part1]
gagattcacgacactc

SEQ ID NO: 26008 - DNA, 16 bp, Artificial Sequence
  synthetic [barcode part1]
tgttctaagacgacgc

SEQ ID NO: 26009 - DNA, 16 bp, Artificial Sequence
  synthetic [barcode part1]
gccagtgtatcaacac

SEQ ID NO: 26010 - DNA, 16 bp, Artificial Sequence
  synthetic [barcode part1]
aaccgacacgcgtatt

SEQ ID NO: 26011 - DNA, 16 bp, Artificial Sequence
  synthetic [barcode part1]
actctatcgtcaacac

SEQ ID NO: 26012 - DNA, 16 bp, Artificial Sequence
  synthetic [barcode part1]
tagtgacgtgtgaggc

SEQ ID NO: 26013 - DNA, 16 bp, Artificial Sequence
  synthetic [barcode part1]
tctactaaggaaccgc

SEQ ID NO: 26014 - DNA, 16 bp, Artificial Sequence
  synthetic [barcode part1]
agtagtagacgaggtg

SEQ ID NO: 26015 - DNA, 16 bp, Artificial Sequence
  synthetic [barcode part1]
tggttcctgcggttac

SEQ ID NO: 26016 - DNA, 16 bp, Artificial Sequence
  synthetic [barcode part1]
actaacgtatctcacc

SEQ ID NO: 26017 - DNA, 16 bp, Artificial Sequence
  synthetic [barcode part1]
tgagatattcggcctg

SEQ ID NO: 26018 - DNA, 16 bp, Artificial Sequence
  synthetic [barcode part1]
gaacgtgatacaggag

SEQ ID NO: 26019 - DNA, 16 bp, Artificial Sequence
  synthetic [barcode part1]
tgtgtgtgtaccacag

SEQ ID NO: 26020 - DNA, 16 bp, Artificial Sequence
  synthetic [barcode part1]
tgacctactgttggag

SEQ ID NO: 26021 - DNA, 16 bp, Artificial Sequence
  synthetic [barcode part1]
ttgagtgttgtcttgc

SEQ ID NO: 26022 - DNA, 16 bp, Artificial Sequence
  synthetic [barcode part1]
ttacaatcggtgccag

SEQ ID NO: 26023 - DNA, 16 bp, Artificial Sequence
  synthetic [barcode part1]
tccgttgttggacacc

SEQ ID NO: 26024 - DNA, 16 bp, Artificial Sequence
  synthetic [barcode part1]
tgttacgttggagtcg

SEQ ID NO: 26025 - DNA, 16 bp, Artificial Sequence
  synthetic [barcode part1]
atctgttgtaggtggc

SEQ ID NO: 26026 - DNA, 16 bp, Artificial Sequence
  synthetic [barcode part1]
gagaagttcaccgtct

SEQ ID NO: 26027 - DNA, 16 bp, Artificial Sequence
  synthetic [barcode part1]
ttcgcaacaagtaccg

SEQ ID NO: 26028 - DNA, 16 bp, Artificial Sequence
  synthetic [barcode part1]
taagaaggtcgtgtac

SEQ ID NO: 26029 - DNA, 16 bp, Artificial Sequence
  synthetic [barcode part1]
gaccaagtactctacg

SEQ ID NO: 26030 - DNA, 16 bp, Artificial Sequence
  synthetic [barcode part1]
tggtctaattcggcag

SEQ ID NO: 26031 - DNA, 16 bp, Artificial Sequence
  synthetic [barcode part1]
gtcttccgattctctg

SEQ ID NO: 26032 - DNA, 16 bp, Artificial Sequence
  synthetic [barcode part1]
actagtgtgttggtgc

SEQ ID NO: 26033 - DNA, 16 bp, Artificial Sequence
  synthetic [barcode part1]
ttgtgttgcggaagtc

SEQ ID NO: 26034 - DNA, 16 bp, Artificial Sequence
  synthetic [barcode part1]
gcgcggtgtatattgt

SEQ ID NO: 26035 - DNA, 16 bp, Artificial Sequence
  synthetic [barcode part1]
tatccgcctcaaggtc

SEQ ID NO: 26036 - DNA, 16 bp, Artificial Sequence
  synthetic [barcode part1]
gccgtctcgagtactt

SEQ ID NO: 26037 - DNA, 16 bp, Artificial Sequence
  synthetic [barcode part1]
acaggccagaacagtc

SEQ ID NO: 26038 - DNA, 16 bp, Artificial Sequence
  synthetic [barcode part1]
tgtgatcgtgtctgag

SEQ ID NO: 26039 - DNA, 16 bp, Artificial Sequence
  synthetic [barcode part1]
tccgccaggaataact

SEQ ID NO: 26040 - DNA, 16 bp, Artificial Sequence
  synthetic [barcode part1]
actctataggtcaggc

SEQ ID NO: 26041 - DNA, 16 bp, Artificial Sequence
  synthetic [barcode part1]
tccagttgccacacgt

SEQ ID NO: 26042 - DNA, 16 bp, Artificial Sequence
  synthetic [barcode part1]
gaacagacgtcgcagt

SEQ ID NO: 26043 - DNA, 16 bp, Artificial Sequence
  synthetic [barcode part1]
cgacaactggtgatct

SEQ ID NO: 26044 - DNA, 16 bp, Artificial Sequence
  synthetic [barcode part1]
cacagtgcagacaggt

SEQ ID NO: 26045 - DNA, 16 bp, Artificial Sequence
  synthetic [barcode part1]
gaactggtagttgtag

SEQ ID NO: 26046 - DNA, 16 bp, Artificial Sequence
  synthetic [barcode part1]
acaacctgttcctgcg

SEQ ID NO: 26047 - DNA, 16 bp, Artificial Sequence
  synthetic [barcode part1]
cgattgagagagagac

SEQ ID NO: 26048 - DNA, 16 bp, Artificial Sequence
  synthetic [barcode part1]
acaggagtcgataatc

SEQ ID NO: 26049 - DNA, 16 bp, Artificial Sequence
  synthetic [barcode part1]
gtctaacgattgccag

SEQ ID NO: 26050 - DNA, 16 bp, Artificial Sequence
  synthetic [barcode part1]
cacactcagtaatctc

SEQ ID NO: 26051 - DNA, 16 bp, Artificial Sequence
  synthetic [barcode part1]
gcaccttattgaatcc

SEQ ID NO: 26052 - DNA, 16 bp, Artificial Sequence
  synthetic [barcode part1]
aacggactgtcacgag

SEQ ID NO: 26053 - DNA, 16 bp, Artificial Sequence
  synthetic [barcode part1]
cgtgcggatctgaatt

SEQ ID NO: 26054 - DNA, 16 bp, Artificial Sequence
  synthetic [barcode part1]
cggacacaagaactgc

SEQ ID NO: 26055 - DNA, 16 bp, Artificial Sequence
  synthetic [barcode part1]
acacgaggatagtccg

SEQ ID NO: 26056 - DNA, 16 bp, Artificial Sequence
  synthetic [barcode part1]
cggatcgcgataattc

SEQ ID NO: 26057 - DNA, 16 bp, Artificial Sequence
  synthetic [barcode part1]
aacactgtcgaagtcc

SEQ ID NO: 26058 - DNA, 16 bp, Artificial Sequence
  synthetic [barcode part1]
aaggtaactcaccgtc

SEQ ID NO: 26059 - DNA, 16 bp, Artificial Sequence
  synthetic [barcode part1]
gttcctaggcagtcct

SEQ ID NO: 26060 - DNA, 16 bp, Artificial Sequence
  synthetic [barcode part1]
ttgataatcgcgtctc

SEQ ID NO: 26061 - DNA, 16 bp, Artificial Sequence
  synthetic [barcode part1]
gcagagagtatccttc

SEQ ID NO: 26062 - DNA, 16 bp, Artificial Sequence
  synthetic [barcode part1]
tccgaatatccaggtg

SEQ ID NO: 26063 - DNA, 16 bp, Artificial Sequence
  synthetic [barcode part1]
gttactcgttcgtagt

SEQ ID NO: 26064 - DNA, 16 bp, Artificial Sequence
  synthetic [barcode part1]
tagaacctcgaggttc

SEQ ID NO: 26065 - DNA, 16 bp, Artificial Sequence
  synthetic [barcode part1]
aacctacggacgacag

SEQ ID NO: 26066 - DNA, 16 bp, Artificial Sequence
  synthetic [barcode part1]
tcgagtaaccttgttc

SEQ ID NO: 26067 - DNA, 16 bp, Artificial Sequence
  synthetic [barcode part1]
tacacgatctacggac

SEQ ID NO: 26068 - DNA, 16 bp, Artificial Sequence
  synthetic [barcode part1]
tacaggtcacctgaac

SEQ ID NO: 26069 - DNA, 16 bp, Artificial Sequence
  synthetic [barcode part1]
gtccgtggttactctg

SEQ ID NO: 26070 - DNA, 16 bp, Artificial Sequence
  synthetic [barcode part1]
atctaagactctgcct

SEQ ID NO: 26071 - DNA, 16 bp, Artificial Sequence
  synthetic [barcode part1]
cgcgaatctacgagtt

SEQ ID NO: 26072 - DNA, 16 bp, Artificial Sequence
  synthetic [barcode part1]
tgaaggactctctggt

SEQ ID NO: 26073 - DNA, 16 bp, Artificial Sequence
  synthetic [barcode part1]
cgcctatacgagtaac

SEQ ID NO: 26074 - DNA, 16 bp, Artificial Sequence
  synthetic [barcode part1]
ataggtcaatcgcgtc

SEQ ID NO: 26075 - DNA, 16 bp, Artificial Sequence
  synthetic [barcode part1]
tcagaggaacctgcag

SEQ ID NO: 26076 - DNA, 16 bp, Artificial Sequence
  synthetic [barcode part1]
gagtacttcgcgaatc

SEQ ID NO: 26077 - DNA, 16 bp, Artificial Sequence
  synthetic [barcode part1]
tcttacagttatcggc

SEQ ID NO: 26078 - DNA, 16 bp, Artificial Sequence
  synthetic [barcode part1]
aataatcagagtgcgc

SEQ ID NO: 26079 - DNA, 16 bp, Artificial Sequence
  synthetic [barcode part1]
agacgcaagagtgtag

SEQ ID NO: 26080 - DNA, 16 bp, Artificial Sequence
  synthetic [barcode part1]
ccaattgaccggttag

SEQ ID NO: 26081 - DNA, 16 bp, Artificial Sequence
  synthetic [barcode part1]
aggtcacggcacaagt

SEQ ID NO: 26082 - DNA, 16 bp, Artificial Sequence
  synthetic [barcode part1]
taccgttacctagact

SEQ ID NO: 26083 - DNA, 16 bp, Artificial Sequence
  synthetic [barcode part1]
tctggcgattcctgtg

SEQ ID NO: 26084 - DNA, 16 bp, Artificial Sequence
  synthetic [barcode part1]
tgcaatcgccactctg

SEQ ID NO: 26085 - DNA, 16 bp, Artificial Sequence
  synthetic [barcode part1]
aggcctcgtactatag

SEQ ID NO: 26086 - DNA, 16 bp, Artificial Sequence
  synthetic [barcode part1]
tccaggatcggaactt

SEQ ID NO: 26087 - DNA, 16 bp, Artificial Sequence
  synthetic [barcode part1]
gacgtgtactgtgtgt

SEQ ID NO: 26088 - DNA, 16 bp, Artificial Sequence
  synthetic [barcode part1]
cctgaagtctcagagt

SEQ ID NO: 26089 - DNA, 16 bp, Artificial Sequence
  synthetic [barcode part1]
tctaattcgcggccgt

SEQ ID NO: 26090 - DNA, 16 bp, Artificial Sequence
  synthetic [barcode part1]
tcggttccgttggtac

SEQ ID NO: 26091 - DNA, 16 bp, Artificial Sequence
  synthetic [barcode part1]
gtcttgcggtgtatcc

SEQ ID NO: 26092 - DNA, 16 bp, Artificial Sequence
  synthetic [barcode part1]
tggttactccgacctg

SEQ ID NO: 26093 - DNA, 16 bp, Artificial Sequence
  synthetic [barcode part1]
cagtctccgtgatcac

SEQ ID NO: 26094 - DNA, 16 bp, Artificial Sequence
  synthetic [barcode part1]
tctgtaggaacaacag

SEQ ID NO: 26095 - DNA, 16 bp, Artificial Sequence
  synthetic [barcode part1]
tatacctcgagtcgcc

SEQ ID NO: 26096 - DNA, 16 bp, Artificial Sequence
  synthetic [barcode part1]
gtcgtcttgaatatcc

SEQ ID NO: 26097 - DNA, 16 bp, Artificial Sequence
  synthetic [barcode part1]
acggagaccagtagtc

SEQ ID NO: 26098 - DNA, 16 bp, Artificial Sequence
  synthetic [barcode part1]
gtgtgccagactgaag

SEQ ID NO: 26099 - DNA, 16 bp, Artificial Sequence
  synthetic [barcode part1]
aaggcctagacggact

SEQ ID NO: 26100 - DNA, 16 bp, Artificial Sequence
  synthetic [barcode part1]
gagtaccgtcttatct

SEQ ID NO: 26101 - DNA, 16 bp, Artificial Sequence
  synthetic [barcode part1]
gttcgaggttctactt

SEQ ID NO: 26102 - DNA, 16 bp, Artificial Sequence
  synthetic [barcode part1]
ttgttactgttcaggc

SEQ ID NO: 26103 - DNA, 16 bp, Artificial Sequence
  synthetic [barcode part1]
tatcactacaaccacc

SEQ ID NO: 26104 - DNA, 16 bp, Artificial Sequence
  synthetic [barcode part1]
agttctccggtgaagt

SEQ ID NO: 26105 - DNA, 16 bp, Artificial Sequence
  synthetic [barcode part1]
cacagtgtccggaatt

SEQ ID NO: 26106 - DNA, 16 bp, Artificial Sequence
  synthetic [barcode part1]
tgattggaccaactgc

SEQ ID NO: 26107 - DNA, 16 bp, Artificial Sequence
  synthetic [barcode part1]
agaatacaactcggtg

SEQ ID NO: 26108 - DNA, 16 bp, Artificial Sequence
  synthetic [barcode part1]
ccgcaacagaattctg

SEQ ID NO: 26109 - DNA, 16 bp, Artificial Sequence
  synthetic [barcode part1]
cgcacgttaattgacg

SEQ ID NO: 26110 - DNA, 16 bp, Artificial Sequence
  synthetic [barcode part1]
aaccggacgttaatag

SEQ ID NO: 26111 - DNA, 16 bp, Artificial Sequence
  synthetic [barcode part1]
gattcagactgtcgac

SEQ ID NO: 26112 - DNA, 16 bp, Artificial Sequence
  synthetic [barcode part1]
actgtggactctaggt

SEQ ID NO: 26113 - DNA, 16 bp, Artificial Sequence
  synthetic [barcode part1]
aggaggtcgtcttatc

SEQ ID NO: 26114 - DNA, 16 bp, Artificial Sequence
  synthetic [barcode part1]
tatcgagactcctgcc

SEQ ID NO: 26115 - DNA, 16 bp, Artificial Sequence
  synthetic [barcode part1]
cgttcaagtgcctaag

SEQ ID NO: 26116 - DNA, 16 bp, Artificial Sequence
  synthetic [barcode part1]
attggaatacacgacg

SEQ ID NO: 26117 - DNA, 16 bp, Artificial Sequence
  synthetic [barcode part1]
agtcgtattggagaac

SEQ ID NO: 26118 - DNA, 16 bp, Artificial Sequence
  synthetic [barcode part1]
ttatctcgtatccgag

SEQ ID NO: 26119 - DNA, 16 bp, Artificial Sequence
  synthetic [barcode part1]
actacagtaggtagac

SEQ ID NO: 26120 - DNA, 16 bp, Artificial Sequence
  synthetic [barcode part1]
agtattaacaccgcgc

SEQ ID NO: 26121 - DNA, 16 bp, Artificial Sequence
  synthetic [barcode part1]
attcctactcaacgac

SEQ ID NO: 26122 - DNA, 16 bp, Artificial Sequence
  synthetic [barcode part1]
tgaggacaacaatctg

SEQ ID NO: 26123 - DNA, 16 bp, Artificial Sequence
  synthetic [barcode part1]
atagaagaccgtcggc

SEQ ID NO: 26124 - DNA, 16 bp, Artificial Sequence
  synthetic [barcode part1]
cagtctcgcactaacc

SEQ ID NO: 26125 - DNA, 16 bp, Artificial Sequence
  synthetic [barcode part1]
gagtccggcaagatac

SEQ ID NO: 26126 - DNA, 16 bp, Artificial Sequence
  synthetic [barcode part1]
agtatcctccaattcg

SEQ ID NO: 26127 - DNA, 16 bp, Artificial Sequence
  synthetic [barcode part1]
tactcagttggcacag

SEQ ID NO: 26128 - DNA, 16 bp, Artificial Sequence
  synthetic [barcode part1]
gtaatccgcagagacg

SEQ ID NO: 26129 - DNA, 16 bp, Artificial Sequence
  synthetic [barcode part1]
gatcacgtacacggtt

SEQ ID NO: 26130 - DNA, 16 bp, Artificial Sequence
  synthetic [barcode part1]
tggtgtataactcctc

SEQ ID NO: 26131 - DNA, 16 bp, Artificial Sequence
  synthetic [barcode part1]
gtcacctctactctac

SEQ ID NO: 26132 - DNA, 16 bp, Artificial Sequence
  synthetic [barcode part1]
tcgtacagaccaggag

SEQ ID NO: 26133 - DNA, 16 bp, Artificial Sequence
  synthetic [barcode part1]
gagtgcaagaacacag

SEQ ID NO: 26134 - DNA, 16 bp, Artificial Sequence
  synthetic [barcode part1]
atacaccggattgaag

SEQ ID NO: 26135 - DNA, 16 bp, Artificial Sequence
  synthetic [barcode part1]
gaggaacgtgagatac

SEQ ID NO: 26136 - DNA, 16 bp, Artificial Sequence
  synthetic [barcode part1]
agagtctggacttcac

SEQ ID NO: 26137 - DNA, 16 bp, Artificial Sequence
  synthetic [barcode part1]
tcaagtagacgaggtt

SEQ ID NO: 26138 - DNA, 16 bp, Artificial Sequence
  synthetic [barcode part1]
gacttacgtgaactcg

SEQ ID NO: 26139 - DNA, 16 bp, Artificial Sequence
  synthetic [barcode part1]
tggtcctaactcttcc

SEQ ID NO: 26140 - DNA, 16 bp, Artificial Sequence
  synthetic [barcode part1]
cagatacgtcgccttc

SEQ ID NO: 26141 - DNA, 16 bp, Artificial Sequence
  synthetic [barcode part1]
tcaacacacacaccag

SEQ ID NO: 26142 - DNA, 16 bp, Artificial Sequence
  synthetic [barcode part1]
acggatcacacgactt

SEQ ID NO: 26143 - DNA, 16 bp, Artificial Sequence
  synthetic [barcode part1]
taatcctgtatcgacc

SEQ ID NO: 26144 - DNA, 16 bp, Artificial Sequence
  synthetic [barcode part1]
tgaacacacacgatcc

SEQ ID NO: 26145 - DNA, 16 bp, Artificial Sequence
  synthetic [barcode part1]
cggtacaagttgcgtt

SEQ ID NO: 26146 - DNA, 16 bp, Artificial Sequence
  synthetic [barcode part1]
tacgagtccgttccac

SEQ ID NO: 26147 - DNA, 16 bp, Artificial Sequence
  synthetic [barcode part1]
cgatacagttaccttc

SEQ ID NO: 26148 - DNA, 16 bp, Artificial Sequence
  synthetic [barcode part1]
acagtcttgaactgcg

SEQ ID NO: 26149 - DNA, 16 bp, Artificial Sequence
  synthetic [barcode part1]
aggcagaacttgtctc

SEQ ID NO: 26150 - DNA, 16 bp, Artificial Sequence
  synthetic [barcode part1]
tgtgtagagacgtctc

SEQ ID NO: 26151 - DNA, 16 bp, Artificial Sequence
  synthetic [barcode part1]
gttatcgacacaagag

SEQ ID NO: 26152 - DNA, 16 bp, Artificial Sequence
  synthetic [barcode part1]
gacgacagtgagtctg

SEQ ID NO: 26153 - DNA, 16 bp, Artificial Sequence
  synthetic [barcode part1]
gtctcctagttgagag

SEQ ID NO: 26154 - DNA, 16 bp, Artificial Sequence
  synthetic [barcode part1]
ttgaacgcgtcactcc

SEQ ID NO: 26155 - DNA, 16 bp, Artificial Sequence
  synthetic [barcode part1]
gaagtagaggtggtgt

SEQ ID NO: 26156 - DNA, 16 bp, Artificial Sequence
  synthetic [barcode part1]
tacaggtcaagacaac

SEQ ID NO: 26157 - DNA, 16 bp, Artificial Sequence
  synthetic [barcode part1]
cgtattcgaacgcagt

SEQ ID NO: 26158 - DNA, 16 bp, Artificial Sequence
  synthetic [barcode part1]
gtagatccgtactgac

SEQ ID NO: 26159 - DNA, 16 bp, Artificial Sequence
  synthetic [barcode part1]
gacgtgttcttgactt

SEQ ID NO: 26160 - DNA, 16 bp, Artificial Sequence
  synthetic [barcode part1]
gcctaattgcactccg

SEQ ID NO: 26161 - DNA, 16 bp, Artificial Sequence
  synthetic [barcode part1]
tccagtcttctctgac

SEQ ID NO: 26162 - DNA, 16 bp, Artificial Sequence
  synthetic [barcode part1]
acgtcgatcagacact

SEQ ID NO: 26163 - DNA, 16 bp, Artificial Sequence
  synthetic [barcode part1]
ccgcaagtgagaagtc

SEQ ID NO: 26164 - DNA, 16 bp, Artificial Sequence
  synthetic [barcode part1]
aggtattaggcggcgt

SEQ ID NO: 26165 - DNA, 16 bp, Artificial Sequence
  synthetic [barcode part1]
tcactacacctcacct

SEQ ID NO: 26166 - DNA, 16 bp, Artificial Sequence
  synthetic [barcode part1]
actcaggtcacggatt

SEQ ID NO: 26167 - DNA, 16 bp, Artificial Sequence
  synthetic [barcode part1]
cgacaataatctggcc

SEQ ID NO: 26168 - DNA, 16 bp, Artificial Sequence
  synthetic [barcode part1]
taagacacgtcagtag

SEQ ID NO: 26169 - DNA, 16 bp, Artificial Sequence
  synthetic [barcode part1]
ttcttagtagtcgtgc

SEQ ID NO: 26170 - DNA, 16 bp, Artificial Sequence
  synthetic [barcode part1]
aagtctggttcttcac

SEQ ID NO: 26171 - DNA, 16 bp, Artificial Sequence
  synthetic [barcode part1]
gttcacaaccaagaag

SEQ ID NO: 26172 - DNA, 16 bp, Artificial Sequence
  synthetic [barcode part1]
gcgcaacgtactaatc

SEQ ID NO: 26173 - DNA, 16 bp, Artificial Sequence
  synthetic [barcode part1]
gaatcctgccaactag

SEQ ID NO: 26174 - DNA, 16 bp, Artificial Sequence
  synthetic [barcode part1]
caacgtgtgataaggt

SEQ ID NO: 26175 - DNA, 16 bp, Artificial Sequence
  synthetic [barcode part1]
tgtcctctggtctgag

SEQ ID NO: 26176 - DNA, 16 bp, Artificial Sequence
  synthetic [barcode part1]
gtgaatcactactctc

SEQ ID NO: 26177 - DNA, 16 bp, Artificial Sequence
  synthetic [barcode part1]
gaatcggtctctcaag

SEQ ID NO: 26178 - DNA, 16 bp, Artificial Sequence
  synthetic [barcode part1]
atcgaactgagtcacc

SEQ ID NO: 26179 - DNA, 16 bp, Artificial Sequence
  synthetic [barcode part1]
ccaagtggaactcact

SEQ ID NO: 26180 - DNA, 16 bp, Artificial Sequence
  synthetic [barcode part1]
atcgtccgaactcacc

SEQ ID NO: 26181 - DNA, 16 bp, Artificial Sequence
  synthetic [barcode part1]
taatctcgccacacgc

SEQ ID NO: 26182 - DNA, 16 bp, Artificial Sequence
  synthetic [barcode part1]
ttccacgaaggatacc

SEQ ID NO: 26183 - DNA, 16 bp, Artificial Sequence
  synthetic [barcode part1]
tgaggaatcggttcct

SEQ ID NO: 26184 - DNA, 16 bp, Artificial Sequence
  synthetic [barcode part1]
cgtactaccgaaggag

SEQ ID NO: 26185 - DNA, 16 bp, Artificial Sequence
  synthetic [barcode part1]
gttgatcggagttctg

SEQ ID NO: 26186 - DNA, 16 bp, Artificial Sequence
  synthetic [barcode part1]
tgaaggaggtccttct

SEQ ID NO: 26187 - DNA, 16 bp, Artificial Sequence
  synthetic [barcode part1]
atcagacggatacggc

SEQ ID NO: 26188 - DNA, 16 bp, Artificial Sequence
  synthetic [barcode part1]
gataagtactccgaag

SEQ ID NO: 26189 - DNA, 16 bp, Artificial Sequence
  synthetic [barcode part1]
tggtgcaacgtctagt

SEQ ID NO: 26190 - DNA, 16 bp, Artificial Sequence
  synthetic [barcode part1]
gaatctctcggaatcg

SEQ ID NO: 26191 - DNA, 16 bp, Artificial Sequence
  synthetic [barcode part1]
aacctcctgcaccaac

SEQ ID NO: 26192 - DNA, 16 bp, Artificial Sequence
  synthetic [barcode part1]
tacaccaccggaagag

SEQ ID NO: 26193 - DNA, 16 bp, Artificial Sequence
  synthetic [barcode part1]
aatcgaccggttgatc

SEQ ID NO: 26194 - DNA, 16 bp, Artificial Sequence
  synthetic [barcode part1]
gcctggttgcaagaag

SEQ ID NO: 26195 - DNA, 16 bp, Artificial Sequence
  synthetic [barcode part1]
tctcacaagtcgccgt

SEQ ID NO: 26196 - DNA, 16 bp, Artificial Sequence
  synthetic [barcode part1]
ttgcgaactatcactc

SEQ ID NO: 26197 - DNA, 16 bp, Artificial Sequence
  synthetic [barcode part1]
cctaaggccttgaagt

SEQ ID NO: 26198 - DNA, 16 bp, Artificial Sequence
  synthetic [barcode part1]
cagtcctaactaggac

SEQ ID NO: 26199 - DNA, 16 bp, Artificial Sequence
  synthetic [barcode part1]
cctgagaattgcgact

SEQ ID NO: 26200 - DNA, 16 bp, Artificial Sequence
  synthetic [barcode part1]
ccgataagagtgtaac

SEQ ID NO: 26201 - DNA, 16 bp, Artificial Sequence
  synthetic [barcode part1]
cacaacgacagtacct

SEQ ID NO: 26202 - DNA, 16 bp, Artificial Sequence
  synthetic [barcode part1]
gtgtgcacacagtgtt

SEQ ID NO: 26203 - DNA, 16 bp, Artificial Sequence
  synthetic [barcode part1]
tacagatctgtctcgt

SEQ ID NO: 26204 - DNA, 16 bp, Artificial Sequence
  synthetic [barcode part1]
ttcttcctgtaacgcc

SEQ ID NO: 26205 - DNA, 16 bp, Artificial Sequence
  synthetic [barcode part1]
tgccgccttatataac

SEQ ID NO: 26206 - DNA, 16 bp, Artificial Sequence
  synthetic [barcode part1]
aaggaagttgagaccg

SEQ ID NO: 26207 - DNA, 16 bp, Artificial Sequence
  synthetic [barcode part1]
aaggacgtattgaacc

SEQ ID NO: 26208 - DNA, 16 bp, Artificial Sequence
  synthetic [barcode part1]
tcaactgcagttgacg

SEQ ID NO: 26209 - DNA, 16 bp, Artificial Sequence
  synthetic [barcode part1]
tgtcaggaacagtcct

SEQ ID NO: 26210 - DNA, 16 bp, Artificial Sequence
  synthetic [barcode part1]
tgacgtgaatccgtgt

SEQ ID NO: 26211 - DNA, 16 bp, Artificial Sequence
  synthetic [barcode part1]
gtgaactgttatctcc

SEQ ID NO: 26212 - DNA, 16 bp, Artificial Sequence
  synthetic [barcode part1]
aacaccagatctcgac

SEQ ID NO: 26213 - DNA, 16 bp, Artificial Sequence
  synthetic [barcode part1]
agaattcacaggtggt

SEQ ID NO: 26214 - DNA, 16 bp, Artificial Sequence
  synthetic [barcode part1]
gatacggttgccagag

SEQ ID NO: 26215 - DNA, 16 bp, Artificial Sequence
  synthetic [barcode part1]
ttcctctgttacgacc

SEQ ID NO: 26216 - DNA, 16 bp, Artificial Sequence
  synthetic [barcode part1]
tctcgtctgagtattg

SEQ ID NO: 26217 - DNA, 16 bp, Artificial Sequence
  synthetic [barcode part1]
tactaccttgcacagt

SEQ ID NO: 26218 - DNA, 16 bp, Artificial Sequence
  synthetic [barcode part1]
aactaccttcgtgttg

SEQ ID NO: 26219 - DNA, 16 bp, Artificial Sequence
  synthetic [barcode part1]
ccgcgtatcgaagaag

SEQ ID NO: 26220 - DNA, 16 bp, Artificial Sequence
  synthetic [barcode part1]
taagtccaacgaggcg

SEQ ID NO: 26221 - DNA, 16 bp, Artificial Sequence
  synthetic [barcode part1]
gaagtccggcgttatt

SEQ ID NO: 26222 - DNA, 16 bp, Artificial Sequence
  synthetic [barcode part1]
tggcgaacttaggcag

SEQ ID NO: 26223 - DNA, 16 bp, Artificial Sequence
  synthetic [barcode part1]
gaggtctctacttgtt

SEQ ID NO: 26224 - DNA, 16 bp, Artificial Sequence
  synthetic [barcode part1]
ttgccgtgagttcgtc

SEQ ID NO: 26225 - DNA, 16 bp, Artificial Sequence
  synthetic [barcode part1]
aactgtggactaagac

SEQ ID NO: 26226 - DNA, 16 bp, Artificial Sequence
  synthetic [barcode part1]
tcacttgtcgtccgtt

SEQ ID NO: 26227 - DNA, 16 bp, Artificial Sequence
  synthetic [barcode part1]
acctagttcggtaacg

SEQ ID NO: 26228 - DNA, 16 bp, Artificial Sequence
  synthetic [barcode part1]
acctcggttagaactg

SEQ ID NO: 26229 - DNA, 16 bp, Artificial Sequence
  synthetic [barcode part1]
taactccacgttggtt

SEQ ID NO: 26230 - DNA, 16 bp, Artificial Sequence
  synthetic [barcode part1]
attccgatcggaatcg

SEQ ID NO: 26231 - DNA, 16 bp, Artificial Sequence
  synthetic [barcode part1]
ttggtgtgtcagtgtg

SEQ ID NO: 26232 - DNA, 16 bp, Artificial Sequence
  synthetic [barcode part1]
cgactgacgtagtgtt

SEQ ID NO: 26233 - DNA, 16 bp, Artificial Sequence
  synthetic [barcode part1]
tcgaataccaccttgt

SEQ ID NO: 26234 - DNA, 16 bp, Artificial Sequence
  synthetic [barcode part1]
gttaggccaggaacgt

SEQ ID NO: 26235 - DNA, 16 bp, Artificial Sequence
  synthetic [barcode part1]
tggtcgcggattagag

SEQ ID NO: 26236 - DNA, 16 bp, Artificial Sequence
  synthetic [barcode part1]
gattagtaccgcggtt

SEQ ID NO: 26237 - DNA, 16 bp, Artificial Sequence
  synthetic [barcode part1]
gataggcaacagacag

SEQ ID NO: 26238 - DNA, 16 bp, Artificial Sequence
  synthetic [barcode part1]
cctacgtattaccaac

SEQ ID NO: 26239 - DNA, 16 bp, Artificial Sequence
  synthetic [barcode part1]
taagaacagtgatccg

SEQ ID NO: 26240 - DNA, 16 bp, Artificial Sequence
  synthetic [barcode part1]
cctgcacagttcggtt

SEQ ID NO: 26241 - DNA, 16 bp, Artificial Sequence
  synthetic [barcode part1]
aggacttacaggtaac

SEQ ID NO: 26242 - DNA, 16 bp, Artificial Sequence
  synthetic [barcode part1]
aacctctgaccgcgtt

SEQ ID NO: 26243 - DNA, 16 bp, Artificial Sequence
  synthetic [barcode part1]
agtccttcgacaaggt

SEQ ID NO: 26244 - DNA, 16 bp, Artificial Sequence
  synthetic [barcode part1]
tgcggacaacaggatc

SEQ ID NO: 26245 - DNA, 16 bp, Artificial Sequence
  synthetic [barcode part1]
gaaggcgtctaatagt

SEQ ID NO: 26246 - DNA, 16 bp, Artificial Sequence
  synthetic [barcode part1]
gtgacgtcagtgttgt

SEQ ID NO: 26247 - DNA, 16 bp, Artificial Sequence
  synthetic [barcode part1]
aagacggaagtagtgc

SEQ ID NO: 26248 - DNA, 16 bp, Artificial Sequence
  synthetic [barcode part1]
ttcggtcagttccttc

SEQ ID NO: 26249 - DNA, 16 bp, Artificial Sequence
  synthetic [barcode part1]
tcactaccgagtatct

SEQ ID NO: 26250 - DNA, 16 bp, Artificial Sequence
  synthetic [barcode part1]
cctcacgcggtaatct

SEQ ID NO: 26251 - DNA, 16 bp, Artificial Sequence
  synthetic [barcode part1]
cgccactctgttatct

SEQ ID NO: 26252 - DNA, 16 bp, Artificial Sequence
  synthetic [barcode part1]
taccggacctacacct

SEQ ID NO: 26253 - DNA, 16 bp, Artificial Sequence
  synthetic [barcode part1]
cgagtattctcgttac

SEQ ID NO: 26254 - DNA, 16 bp, Artificial Sequence
  synthetic [barcode part1]
cggcgatatcgaattc

SEQ ID NO: 26255 - DNA, 16 bp, Artificial Sequence
  synthetic [barcode part1]
cagtacagagaactac

SEQ ID NO: 26256 - DNA, 16 bp, Artificial Sequence
  synthetic [barcode part1]
gagttggtggtgtgtg

SEQ ID NO: 26257 - DNA, 16 bp, Artificial Sequence
  synthetic [barcode part1]
tagtctctgattgcgt

SEQ ID NO: 26258 - DNA, 16 bp, Artificial Sequence
  synthetic [barcode part1]
gacctgccttatcacg

SEQ ID NO: 26259 - DNA, 16 bp, Artificial Sequence
  synthetic [barcode part1]
taattaggtcgaccgc

SEQ ID NO: 26260 - DNA, 16 bp, Artificial Sequence
  synthetic [barcode part1]
ttaacggacaagaacc

SEQ ID NO: 26261 - DNA, 16 bp, Artificial Sequence
  synthetic [barcode part1]
gacgcaatctagtaag

SEQ ID NO: 26262 - DNA, 16 bp, Artificial Sequence
  synthetic [barcode part1]
cgtgtaggaacactct

SEQ ID NO: 26263 - DNA, 16 bp, Artificial Sequence
  synthetic [barcode part1]
tctgaagaggactctc

SEQ ID NO: 26264 - DNA, 16 bp, Artificial Sequence
  synthetic [barcode part1]
caggttgtcttcgcgt

SEQ ID NO: 26265 - DNA, 16 bp, Artificial Sequence
  synthetic [barcode part1]
cgtaccggaaggattg

SEQ ID NO: 26266 - DNA, 16 bp, Artificial Sequence
  synthetic [barcode part1]
actgtgactcgttcgc

SEQ ID NO: 26267 - DNA, 16 bp, Artificial Sequence
  synthetic [barcode part1]
tctgtagtctattgcg

SEQ ID NO: 26268 - DNA, 16 bp, Artificial Sequence
  synthetic [barcode part1]
gcaaggagaccgttac

SEQ ID NO: 26269 - DNA, 16 bp, Artificial Sequence
  synthetic [barcode part1]
ttctggcgcgtaatcc

SEQ ID NO: 26270 - DNA, 16 bp, Artificial Sequence
  synthetic [barcode part1]
aactgatcacgcgtgt

SEQ ID NO: 26271 - DNA, 16 bp, Artificial Sequence
  synthetic [barcode part1]
tgcaggaaccgaactg

SEQ ID NO: 26272 - DNA, 16 bp, Artificial Sequence
  synthetic [barcode part1]
aggcacagttgtcgag

SEQ ID NO: 26273 - DNA, 16 bp, Artificial Sequence
  synthetic [barcode part1]
cctcgactagtgaagt

SEQ ID NO: 26274 - DNA, 16 bp, Artificial Sequence
  synthetic [barcode part1]
tgtacgttcaggactg

SEQ ID NO: 26275 - DNA, 16 bp, Artificial Sequence
  synthetic [barcode part1]
aacgagaggtccgtgt

SEQ ID NO: 26276 - DNA, 16 bp, Artificial Sequence
  synthetic [barcode part1]
ccggtaaggtgtaggt

SEQ ID NO: 26277 - DNA, 16 bp, Artificial Sequence
  synthetic [barcode part1]
cacaggcagtagaacc

SEQ ID NO: 26278 - DNA, 16 bp, Artificial Sequence
  synthetic [barcode part1]
gtatcacggtgaatag

SEQ ID NO: 26279 - DNA, 16 bp, Artificial Sequence
  synthetic [barcode part1]
cgactaagtatcacgc

SEQ ID NO: 26280 - DNA, 16 bp, Artificial Sequence
  synthetic [barcode part1]
atcttcacacctctgc

SEQ ID NO: 26281 - DNA, 16 bp, Artificial Sequence
  synthetic [barcode part1]
gacaccaacacgtgtt

SEQ ID NO: 26282 - DNA, 16 bp, Artificial Sequence
  synthetic [barcode part1]
gtatcgtactcgcctg

SEQ ID NO: 26283 - DNA, 16 bp, Artificial Sequence
  synthetic [barcode part1]
gaaggcaatagagacc

SEQ ID NO: 26284 - DNA, 16 bp, Artificial Sequence
  synthetic [barcode part1]
tctagttaccgcacgc

SEQ ID NO: 26285 - DNA, 16 bp, Artificial Sequence
  synthetic [barcode part1]
agaccgtacagttcgt

SEQ ID NO: 26286 - DNA, 16 bp, Artificial Sequence
  synthetic [barcode part1]
taccacctgaggaatc

SEQ ID NO: 26287 - DNA, 16 bp, Artificial Sequence
  synthetic [barcode part1]
gtcttatcggaggatc

SEQ ID NO: 26288 - DNA, 16 bp, Artificial Sequence
  synthetic [barcode part1]
ccggagtcttatctgc

SEQ ID NO: 26289 - DNA, 16 bp, Artificial Sequence
  synthetic [barcode part1]
tcacagtactggtcag

SEQ ID NO: 26290 - DNA, 16 bp, Artificial Sequence
  synthetic [barcode part1]
gactgacgtgtgtact

SEQ ID NO: 26291 - DNA, 16 bp, Artificial Sequence
  synthetic [barcode part1]
atatcctgttaccgac

SEQ ID NO: 26292 - DNA, 16 bp, Artificial Sequence
  synthetic [barcode part1]
cctaatcaccgatact

SEQ ID NO: 26293 - DNA, 16 bp, Artificial Sequence
  synthetic [barcode part1]
aaccgtaacgtcgatc

SEQ ID NO: 26294 - DNA, 16 bp, Artificial Sequence
  synthetic [barcode part1]
aacaagtaacaccgtg

SEQ ID NO: 26295 - DNA, 16 bp, Artificial Sequence
  synthetic [barcode part1]
cctcagttcaggtgtc

SEQ ID NO: 26296 - DNA, 16 bp, Artificial Sequence
  synthetic [barcode part1]
tccactcaagtgagtg

SEQ ID NO: 26297 - DNA, 16 bp, Artificial Sequence
  synthetic [barcode part1]
acactgaacacgactc

SEQ ID NO: 26298 - DNA, 16 bp, Artificial Sequence
  synthetic [barcode part1]
ccggagtgagtgaatc

SEQ ID NO: 26299 - DNA, 16 bp, Artificial Sequence
  synthetic [barcode part1]
gagatcgacacggttg

SEQ ID NO: 26300 - DNA, 16 bp, Artificial Sequence
  synthetic [barcode part1]
ttcttgtcgaattgcg

SEQ ID NO: 26301 - DNA, 16 bp, Artificial Sequence
  synthetic [barcode part1]
atagagtagtgcctag

SEQ ID NO: 26302 - DNA, 16 bp, Artificial Sequence
  synthetic [barcode part1]
cgttccacactacttc

SEQ ID NO: 26303 - DNA, 16 bp, Artificial Sequence
  synthetic [barcode part1]
aatataatccgcgccg

SEQ ID NO: 26304 - DNA, 16 bp, Artificial Sequence
  synthetic [barcode part1]
tcgtcctgcgtctaag

SEQ ID NO: 26305 - DNA, 16 bp, Artificial Sequence
  synthetic [barcode part1]
cgattcacgaactgtg

SEQ ID NO: 26306 - DNA, 16 bp, Artificial Sequence
  synthetic [barcode part1]
agatccagttcagacc

SEQ ID NO: 26307 - DNA, 16 bp, Artificial Sequence
  synthetic [barcode part1]
tgtctatccacgacgc

SEQ ID NO: 26308 - DNA, 16 bp, Artificial Sequence
  synthetic [barcode part1]
caacagtgaggcgtac

SEQ ID NO: 26309 - DNA, 16 bp, Artificial Sequence
  synthetic [barcode part1]
acacagtgtgtcagtc

SEQ ID NO: 26310 - DNA, 16 bp, Artificial Sequence
  synthetic [barcode part1]
tccttggcagttgtgc

SEQ ID NO: 26311 - DNA, 16 bp, Artificial Sequence
  synthetic [barcode part1]
attgacctgtacgcag

SEQ ID NO: 26312 - DNA, 16 bp, Artificial Sequence
  synthetic [barcode part1]
acgttgtgcggacaag

SEQ ID NO: 26313 - DNA, 16 bp, Artificial Sequence
  synthetic [barcode part1]
gccaacagacgacagt

SEQ ID NO: 26314 - DNA, 16 bp, Artificial Sequence
  synthetic [barcode part1]
gcaacgagagtactcg

SEQ ID NO: 26315 - DNA, 16 bp, Artificial Sequence
  synthetic [barcode part1]
caaccaactagtcgac

SEQ ID NO: 26316 - DNA, 16 bp, Artificial Sequence
  synthetic [barcode part1]
agattcgcgagagacc

SEQ ID NO: 26317 - DNA, 16 bp, Artificial Sequence
  synthetic [barcode part1]
caggcaattgttcacg

SEQ ID NO: 26318 - DNA, 16 bp, Artificial Sequence
  synthetic [barcode part1]
gttgtgtcagtagaag

SEQ ID NO: 26319 - DNA, 16 bp, Artificial Sequence
  synthetic [barcode part1]
cagattgagaggtgcc

SEQ ID NO: 26320 - DNA, 16 bp, Artificial Sequence
  synthetic [barcode part1]
cgataatctccgtact

SEQ ID NO: 26321 - DNA, 16 bp, Artificial Sequence
  synthetic [barcode part1]
cagtgtaagttcgcac

SEQ ID NO: 26322 - DNA, 16 bp, Artificial Sequence
  synthetic [barcode part1]
tggtgagtaggtaccg

SEQ ID NO: 26323 - DNA, 16 bp, Artificial Sequence
  synthetic [barcode part1]
cctgtgtaaccgttgc

SEQ ID NO: 26324 - DNA, 16 bp, Artificial Sequence
  synthetic [barcode part1]
cgatacgtacggactt

SEQ ID NO: 26325 - DNA, 16 bp, Artificial Sequence
  synthetic [barcode part1]
aagtgatccgatacag

SEQ ID NO: 26326 - DNA, 16 bp, Artificial Sequence
  synthetic [barcode part1]
ttctcctctctggaac

SEQ ID NO: 26327 - DNA, 16 bp, Artificial Sequence
  synthetic [barcode part1]
gccacagttacagtac

SEQ ID NO: 26328 - DNA, 16 bp, Artificial Sequence
  synthetic [barcode part1]
ttgtgcagtcagtgtg

SEQ ID NO: 26329 - DNA, 16 bp, Artificial Sequence
  synthetic [barcode part1]
taccgttggacgcctt

SEQ ID NO: 26330 - DNA, 16 bp, Artificial Sequence
  synthetic [barcode part1]
cagtgtggaggcagtt

SEQ ID NO: 26331 - DNA, 16 bp, Artificial Sequence
  synthetic [barcode part1]
cctatagtctggacag

SEQ ID NO: 26332 - DNA, 16 bp, Artificial Sequence
  synthetic [barcode part1]
tccagtctacgtaatc

SEQ ID NO: 26333 - DNA, 16 bp, Artificial Sequence
  synthetic [barcode part1]
tacgacgaccttaggt

SEQ ID NO: 26334 - DNA, 16 bp, Artificial Sequence
  synthetic [barcode part1]
tacctacgacgaacgt

SEQ ID NO: 26335 - DNA, 16 bp, Artificial Sequence
  synthetic [barcode part1]
gtccgcagagaatcag

SEQ ID NO: 26336 - DNA, 16 bp, Artificial Sequence
  synthetic [barcode part1]
cggagattagactgcg

SEQ ID NO: 26337 - DNA, 16 bp, Artificial Sequence
  synthetic [barcode part1]
acgtcgacgtagactt

SEQ ID NO: 26338 - DNA, 16 bp, Artificial Sequence
  synthetic [barcode part1]
ccaactcgatatatcc

SEQ ID NO: 26339 - DNA, 16 bp, Artificial Sequence
  synthetic [barcode part1]
acttggatcgcagatc

SEQ ID NO: 26340 - DNA, 16 bp, Artificial Sequence
  synthetic [barcode part1]
tgttgttgcaaggtgc

SEQ ID NO: 26341 - DNA, 16 bp, Artificial Sequence
  synthetic [barcode part1]
aagttccgttacgacg

SEQ ID NO: 26342 - DNA, 16 bp, Artificial Sequence
  synthetic [barcode part1]
tcaagtgattcgcgac

SEQ ID NO: 26343 - DNA, 16 bp, Artificial Sequence
  synthetic [barcode part1]
gtgactacaatcgtgc

SEQ ID NO: 26344 - DNA, 16 bp, Artificial Sequence
  synthetic [barcode part1]
gtgttggtgacggagt

SEQ ID NO: 26345 - DNA, 16 bp, Artificial Sequence
  synthetic [barcode part1]
atctcgtcggaaggtt

SEQ ID NO: 26346 - DNA, 16 bp, Artificial Sequence
  synthetic [barcode part1]
agtgtcaaccaaccac

SEQ ID NO: 26347 - DNA, 16 bp, Artificial Sequence
  synthetic [barcode part1]
gtagtaactaccgtcg

SEQ ID NO: 26348 - DNA, 16 bp, Artificial Sequence
  synthetic [barcode part1]
tgacagtggcctaatc

SEQ ID NO: 26349 - DNA, 16 bp, Artificial Sequence
  synthetic [barcode part1]
gtatcttccggattac

SEQ ID NO: 26350 - DNA, 16 bp, Artificial Sequence
  synthetic [barcode part1]
cctctcttaacgtcgt

SEQ ID NO: 26351 - DNA, 16 bp, Artificial Sequence
  synthetic [barcode part1]
ttagacaagacgacgt

SEQ ID NO: 26352 - DNA, 16 bp, Artificial Sequence
  synthetic [barcode part1]
gccaagttcgtatctt

SEQ ID NO: 26353 - DNA, 16 bp, Artificial Sequence
  synthetic [barcode part1]
tctcgtggaagtacac

SEQ ID NO: 26354 - DNA, 16 bp, Artificial Sequence
  synthetic [barcode part1]
tctggcgtatctccag

SEQ ID NO: 26355 - DNA, 16 bp, Artificial Sequence
  synthetic [barcode part1]
cggacaataccgtgag

SEQ ID NO: 26356 - DNA, 16 bp, Artificial Sequence
  synthetic [barcode part1]
taagtgcgccacttcc

SEQ ID NO: 26357 - DNA, 16 bp, Artificial Sequence
  synthetic [barcode part1]
aatctgactccgtgtt

SEQ ID NO: 26358 - DNA, 16 bp, Artificial Sequence
  synthetic [barcode part1]
aagtgccacttgcagt

SEQ ID NO: 26359 - DNA, 16 bp, Artificial Sequence
  synthetic [barcode part1]
caactcctgcagttgc

SEQ ID NO: 26360 - DNA, 16 bp, Artificial Sequence
  synthetic [barcode part1]
ccgaagatcgacacag

SEQ ID NO: 26361 - DNA, 16 bp, Artificial Sequence
  synthetic [barcode part1]
ccgattcgtagttgcc

SEQ ID NO: 26362 - DNA, 16 bp, Artificial Sequence
  synthetic [barcode part1]
gatcaacagtcagtcc

SEQ ID NO: 26363 - DNA, 16 bp, Artificial Sequence
  synthetic [barcode part1]
gccgtggtaagtaggt

SEQ ID NO: 26364 - DNA, 16 bp, Artificial Sequence
  synthetic [barcode part1]
cgcgatagaattccgt

SEQ ID NO: 26365 - DNA, 16 bp, Artificial Sequence
  synthetic [barcode part1]
gtggagtataacggag

SEQ ID NO: 26366 - DNA, 16 bp, Artificial Sequence
  synthetic [barcode part1]
acaagaatcagactgc

SEQ ID NO: 26367 - DNA, 16 bp, Artificial Sequence
  synthetic [barcode part1]
tccgtcagtacttggc

SEQ ID NO: 26368 - DNA, 16 bp, Artificial Sequence
  synthetic [barcode part1]
tgtgttcaagttgcct

SEQ ID NO: 26369 - DNA, 16 bp, Artificial Sequence
  synthetic [barcode part1]
cgcgaggtaataaccg

SEQ ID NO: 26370 - DNA, 16 bp, Artificial Sequence
  synthetic [barcode part1]
acgtgacctgactcct

SEQ ID NO: 26371 - DNA, 16 bp, Artificial Sequence
  synthetic [barcode part1]
gaatccaacctctcgc

SEQ ID NO: 26372 - DNA, 16 bp, Artificial Sequence
  synthetic [barcode part1]
cggtattaagtagacg

SEQ ID NO: 26373 - DNA, 16 bp, Artificial Sequence
  synthetic [barcode part1]
actgaggttggttctg

SEQ ID NO: 26374 - DNA, 16 bp, Artificial Sequence
  synthetic [barcode part1]
tgagtctggtgttcag

SEQ ID NO: 26375 - DNA, 16 bp, Artificial Sequence
  synthetic [barcode part1]
agtcctcggttgtgtc

SEQ ID NO: 26376 - DNA, 16 bp, Artificial Sequence
  synthetic [barcode part1]
cagatatatcggaggt

SEQ ID NO: 26377 - DNA, 16 bp, Artificial Sequence
  synthetic [barcode part1]
gcacaactgcacagtt

SEQ ID NO: 26378 - DNA, 16 bp, Artificial Sequence
  synthetic [barcode part1]
gcaaccggattgagac

SEQ ID NO: 26379 - DNA, 16 bp, Artificial Sequence
  synthetic [barcode part1]
ttgcaagttcaactcc

SEQ ID NO: 26380 - DNA, 16 bp, Artificial Sequence
  synthetic [barcode part1]
tcctgacaattcgtac

SEQ ID NO: 26381 - DNA, 16 bp, Artificial Sequence
  synthetic [barcode part1]
attctctggtcttccg

SEQ ID NO: 26382 - DNA, 16 bp, Artificial Sequence
  synthetic [barcode part1]
taatcaacgtgtgcgc

SEQ ID NO: 26383 - DNA, 16 bp, Artificial Sequence
  synthetic [barcode part1]
tacactgcaaccacag

SEQ ID NO: 26384 - DNA, 16 bp, Artificial Sequence
  synthetic [barcode part1]
ttggaatcaggtaggt

SEQ ID NO: 26385 - DNA, 16 bp, Artificial Sequence
  synthetic [barcode part1]
aaggagtccgtacggt

SEQ ID NO: 26386 - DNA, 16 bp, Artificial Sequence
  synthetic [barcode part1]
tctaaggccgattgac

SEQ ID NO: 26387 - DNA, 16 bp, Artificial Sequence
  synthetic [barcode part1]
acgattggtcgatacc

SEQ ID NO: 26388 - DNA, 16 bp, Artificial Sequence
  synthetic [barcode part1]
actaagagtgtgtcag

SEQ ID NO: 26389 - DNA, 16 bp, Artificial Sequence
  synthetic [barcode part1]
acctcacctgttactc

SEQ ID NO: 26390 - DNA, 16 bp, Artificial Sequence
  synthetic [barcode part1]
cgttcaccgagatctc

SEQ ID NO: 26391 - DNA, 16 bp, Artificial Sequence
  synthetic [barcode part1]
caacgtggcacttagt

SEQ ID NO: 26392 - DNA, 16 bp, Artificial Sequence
  synthetic [barcode part1]
cactgtaaggaaggag

SEQ ID NO: 26393 - DNA, 16 bp, Artificial Sequence
  synthetic [barcode part1]
attatccacggcgaac

SEQ ID NO: 26394 - DNA, 16 bp, Artificial Sequence
  synthetic [barcode part1]
tctgtatcttcgcgtc

SEQ ID NO: 26395 - DNA, 16 bp, Artificial Sequence
  synthetic [barcode part1]
tggactaaggagtgcc

SEQ ID NO: 26396 - DNA, 16 bp, Artificial Sequence
  synthetic [barcode part1]
tggcctggaactattg

SEQ ID NO: 26397 - DNA, 16 bp, Artificial Sequence
  synthetic [barcode part1]
gttgactgtaccacag

SEQ ID NO: 26398 - DNA, 16 bp, Artificial Sequence
  synthetic [barcode part1]
cctgactcaactatac

SEQ ID NO: 26399 - DNA, 16 bp, Artificial Sequence
  synthetic [barcode part1]
tgttgcaaccagtcag

SEQ ID NO: 26400 - DNA, 16 bp, Artificial Sequence
  synthetic [barcode part1]
gcggttactaagaagt

SEQ ID NO: 26401 - DNA, 16 bp, Artificial Sequence
  synthetic [barcode part1]
ccgatctaacgcgttc

SEQ ID NO: 26402 - DNA, 16 bp, Artificial Sequence
  synthetic [barcode part1]
atcgatactaccgtct

SEQ ID NO: 26403 - DNA, 16 bp, Artificial Sequence
  synthetic [barcode part1]
tgagaccgagattcct

SEQ ID NO: 26404 - DNA, 16 bp, Artificial Sequence
  synthetic [barcode part1]
ttccacaggaggtact

SEQ ID NO: 26405 - DNA, 16 bp, Artificial Sequence
  synthetic [barcode part1]
cacacgatatcctact

SEQ ID NO: 26406 - DNA, 16 bp, Artificial Sequence
  synthetic [barcode part1]
gagttaaccaactccg

SEQ ID NO: 26407 - DNA, 16 bp, Artificial Sequence
  synthetic [barcode part1]
tcttacggtgtgaggt

SEQ ID NO: 26408 - DNA, 16 bp, Artificial Sequence
  synthetic [barcode part1]
aggcgaggcagtactt

SEQ ID NO: 26409 - DNA, 16 bp, Artificial Sequence
  synthetic [barcode part1]
gcaagtgcagagtctg

SEQ ID NO: 26410 - DNA, 16 bp, Artificial Sequence
  synthetic [barcode part1]
atcacaatctgtccgt

SEQ ID NO: 26411 - DNA, 16 bp, Artificial Sequence
  synthetic [barcode part1]
acgaccggagactaac

SEQ ID NO: 26412 - DNA, 16 bp, Artificial Sequence
  synthetic [barcode part1]
gactgacttctctcct

SEQ ID NO: 26413 - DNA, 16 bp, Artificial Sequence
  synthetic [barcode part1]
acacacgaaggtcctt

SEQ ID NO: 26414 - DNA, 16 bp, Artificial Sequence
  synthetic [barcode part1]
gacagagaatcgcgtc

SEQ ID NO: 26415 - DNA, 16 bp, Artificial Sequence
  synthetic [barcode part1]
gtgactaattgacgcc

SEQ ID NO: 26416 - DNA, 16 bp, Artificial Sequence
  synthetic [barcode part1]
cagacaccacagactt

SEQ ID NO: 26417 - DNA, 16 bp, Artificial Sequence
  synthetic [barcode part1]
gttatagtcacggcgt

SEQ ID NO: 26418 - DNA, 16 bp, Artificial Sequence
  synthetic [barcode part1]
gaactacgatataggc

SEQ ID NO: 26419 - DNA, 16 bp, Artificial Sequence
  synthetic [barcode part1]
ttgacaacggaccgtt

SEQ ID NO: 26420 - DNA, 16 bp, Artificial Sequence
  synthetic [barcode part1]
aattccgcctgaagtg

SEQ ID NO: 26421 - DNA, 16 bp, Artificial Sequence
  synthetic [barcode part1]
agtctgaggttcgatc

SEQ ID NO: 26422 - DNA, 16 bp, Artificial Sequence
  synthetic [barcode part1]
aagaggacttctcctg

SEQ ID NO: 26423 - DNA, 16 bp, Artificial Sequence
  synthetic [barcode part1]
ccaccttaacttacag

SEQ ID NO: 26424 - DNA, 16 bp, Artificial Sequence
  synthetic [barcode part1]
aacacctggacacttg

SEQ ID NO: 26425 - DNA, 16 bp, Artificial Sequence
  synthetic [barcode part1]
tcggcaggtaatctac

SEQ ID NO: 26426 - DNA, 16 bp, Artificial Sequence
  synthetic [barcode part1]
caacgacctctcacgt

SEQ ID NO: 26427 - DNA, 16 bp, Artificial Sequence
  synthetic [barcode part1]
tgcgaccgtattcaag

SEQ ID NO: 26428 - DNA, 16 bp, Artificial Sequence
  synthetic [barcode part1]
aggagactgttggcac

SEQ ID NO: 26429 - DNA, 16 bp, Artificial Sequence
  synthetic [barcode part1]
tcgcgaactcgatcct

SEQ ID NO: 26430 - DNA, 16 bp, Artificial Sequence
  synthetic [barcode part1]
gagtctggtctcctgt

SEQ ID NO: 26431 - DNA, 16 bp, Artificial Sequence
  synthetic [barcode part1]
aatagaccaccgcgag

SEQ ID NO: 26432 - DNA, 16 bp, Artificial Sequence
  synthetic [barcode part1]
tggtgatatcaggtcc

SEQ ID NO: 26433 - DNA, 16 bp, Artificial Sequence
  synthetic [barcode part1]
tgagtcgtccttgcgt

SEQ ID NO: 26434 - DNA, 16 bp, Artificial Sequence
  synthetic [barcode part1]
aaggcgaagtaagacc

SEQ ID NO: 26435 - DNA, 16 bp, Artificial Sequence
  synthetic [barcode part1]
gtgcctcaagaacact

SEQ ID NO: 26436 - DNA, 16 bp, Artificial Sequence
  synthetic [barcode part1]
tcggtctcgagtctac

SEQ ID NO: 26437 - DNA, 16 bp, Artificial Sequence
  synthetic [barcode part1]
cgaggccaattaacct

SEQ ID NO: 26438 - DNA, 16 bp, Artificial Sequence
  synthetic [barcode part1]
tcctcacacaagaacg

SEQ ID NO: 26439 - DNA, 16 bp, Artificial Sequence
  synthetic [barcode part1]
cgtcttgcactcagac

SEQ ID NO: 26440 - DNA, 16 bp, Artificial Sequence
  synthetic [barcode part1]
agaactaccagtacag

SEQ ID NO: 26441 - DNA, 16 bp, Artificial Sequence
  synthetic [barcode part1]
tctggcctcttagtct

SEQ ID NO: 26442 - DNA, 16 bp, Artificial Sequence
  synthetic [barcode part1]
attaggtgaacacggt

SEQ ID NO: 26443 - DNA, 16 bp, Artificial Sequence
  synthetic [barcode part1]
ccagagtacaggtggt

SEQ ID NO: 26444 - DNA, 16 bp, Artificial Sequence
  synthetic [barcode part1]
cgtcaccgaacgtctt

SEQ ID NO: 26445 - DNA, 16 bp, Artificial Sequence
  synthetic [barcode part1]
tataggcctcaccgtc

SEQ ID NO: 26446 - DNA, 16 bp, Artificial Sequence
  synthetic [barcode part1]
gtggtgttggtcaact

SEQ ID NO: 26447 - DNA, 16 bp, Artificial Sequence
  synthetic [barcode part1]
gtgcaacactgacgtt

SEQ ID NO: 26448 - DNA, 16 bp, Artificial Sequence
  synthetic [barcode part1]
aatcggcctccttctt

SEQ ID NO: 26449 - DNA, 16 bp, Artificial Sequence
  synthetic [barcode part1]
ccttgatcgactcctt

SEQ ID NO: 26450 - DNA, 16 bp, Artificial Sequence
  synthetic [barcode part1]
gtctctcctaatcctg

SEQ ID NO: 26451 - DNA, 16 bp, Artificial Sequence
  synthetic [barcode part1]
taccgagactcttgtt

SEQ ID NO: 26452 - DNA, 16 bp, Artificial Sequence
  synthetic [barcode part1]
gaggtctaacaccact

SEQ ID NO: 26453 - DNA, 16 bp, Artificial Sequence
  synthetic [barcode part1]
cgagtagtgttgcgag

SEQ ID NO: 26454 - DNA, 16 bp, Artificial Sequence
  synthetic [barcode part1]
tcgtacttctacgcct

SEQ ID NO: 26455 - DNA, 16 bp, Artificial Sequence
  synthetic [barcode part1]
tagaattaccacggcc

SEQ ID NO: 26456 - DNA, 16 bp, Artificial Sequence
  synthetic [barcode part1]
attccacgaacactct

SEQ ID NO: 26457 - DNA, 16 bp, Artificial Sequence
  synthetic [barcode part1]
aactacagaccaaggt

SEQ ID NO: 26458 - DNA, 16 bp, Artificial Sequence
  synthetic [barcode part1]
tgtaagtgttctgcct

SEQ ID NO: 26459 - DNA, 16 bp, Artificial Sequence
  synthetic [barcode part1]
aggcaaggccttagac

SEQ ID NO: 26460 - DNA, 16 bp, Artificial Sequence
  synthetic [barcode part1]
aggataagaacgacgc

SEQ ID NO: 26461 - DNA, 16 bp, Artificial Sequence
  synthetic [barcode part1]
atacttagagtggcag

SEQ ID NO: 26462 - DNA, 16 bp, Artificial Sequence
  synthetic [barcode part1]
tagactacttccacgt

SEQ ID NO: 26463 - DNA, 16 bp, Artificial Sequence
  synthetic [barcode part1]
ttggtacgtcagtacg

SEQ ID NO: 26464 - DNA, 16 bp, Artificial Sequence
  synthetic [barcode part1]
caaccggattagttgc

SEQ ID NO: 26465 - DNA, 16 bp, Artificial Sequence
  synthetic [barcode part1]
tggtacggatctgtgt

SEQ ID NO: 26466 - DNA, 16 bp, Artificial Sequence
  synthetic [barcode part1]
taccacctactaacac

SEQ ID NO: 26467 - DNA, 16 bp, Artificial Sequence
  synthetic [barcode part1]
gaggacttgacgtgtg

SEQ ID NO: 26468 - DNA, 16 bp, Artificial Sequence
  synthetic [barcode part1]
atcctagtcgaccaag

SEQ ID NO: 26469 - DNA, 16 bp, Artificial Sequence
  synthetic [barcode part1]
tcgcaataactccgag

SEQ ID NO: 26470 - DNA, 16 bp, Artificial Sequence
  synthetic [barcode part1]
agattgcgcgattcac

SEQ ID NO: 26471 - DNA, 16 bp, Artificial Sequence
  synthetic [barcode part1]
tgtgtgaacgagacgc

SEQ ID NO: 26472 - DNA, 16 bp, Artificial Sequence
  synthetic [barcode part1]
agatcctccttcttcg

SEQ ID NO: 26473 - DNA, 16 bp, Artificial Sequence
  synthetic [barcode part1]
agatctgtgaacctgc

SEQ ID NO: 26474 - DNA, 16 bp, Artificial Sequence
  synthetic [barcode part1]
gcgagtaacaacaccg

SEQ ID NO: 26475 - DNA, 16 bp, Artificial Sequence
  synthetic [barcode part1]
tctgccgtcgatacgt

SEQ ID NO: 26476 - DNA, 16 bp, Artificial Sequence
  synthetic [barcode part1]
tcgactaccgatcaag

SEQ ID NO: 26477 - DNA, 16 bp, Artificial Sequence
  synthetic [barcode part1]
gaactactcacacttc

SEQ ID NO: 26478 - DNA, 16 bp, Artificial Sequence
  synthetic [barcode part1]
gtacttcaatccggtt

SEQ ID NO: 26479 - DNA, 16 bp, Artificial Sequence
  synthetic [barcode part1]
cgagttgtgtgcctct

SEQ ID NO: 26480 - DNA, 16 bp, Artificial Sequence
  synthetic [barcode part1]
tacttggcgtaccaag

SEQ ID NO: 26481 - DNA, 16 bp, Artificial Sequence
  synthetic [barcode part1]
ttgtgttgcctggcac

SEQ ID NO: 26482 - DNA, 16 bp, Artificial Sequence
  synthetic [barcode part1]
tggaccactccacact

SEQ ID NO: 26483 - DNA, 16 bp, Artificial Sequence
  synthetic [barcode part1]
atcgttgttaacggcg

SEQ ID NO: 26484 - DNA, 16 bp, Artificial Sequence
  synthetic [barcode part1]
cgatcgaatcgtggtt

SEQ ID NO: 26485 - DNA, 16 bp, Artificial Sequence
  synthetic [barcode part1]
aactcttccaagtgtc

SEQ ID NO: 26486 - DNA, 16 bp, Artificial Sequence
  synthetic [barcode part1]
tggtaacctggactac

SEQ ID NO: 26487 - DNA, 16 bp, Artificial Sequence
  synthetic [barcode part1]
tcttgacgtcaggagt

SEQ ID NO: 26488 - DNA, 16 bp, Artificial Sequence
  synthetic [barcode part1]
acagatcggaggtcac

SEQ ID NO: 26489 - DNA, 16 bp, Artificial Sequence
  synthetic [barcode part1]
agagtcttccaaggtc

SEQ ID NO: 26490 - DNA, 16 bp, Artificial Sequence
  synthetic [barcode part1]
agtgattccagaccgt

SEQ ID NO: 26491 - DNA, 16 bp, Artificial Sequence
  synthetic [barcode part1]
tgttccgattcgtaac

SEQ ID NO: 26492 - DNA, 16 bp, Artificial Sequence
  synthetic [barcode part1]
tcgacgactgcactct

SEQ ID NO: 26493 - DNA, 16 bp, Artificial Sequence
  synthetic [barcode part1]
tatactccttggcggc

SEQ ID NO: 26494 - DNA, 16 bp, Artificial Sequence
  synthetic [barcode part1]
attctcacgagaacgc

SEQ ID NO: 26495 - DNA, 16 bp, Artificial Sequence
  synthetic [barcode part1]
gatctaaccaggtcgt

SEQ ID NO: 26496 - DNA, 16 bp, Artificial Sequence
  synthetic [barcode part1]
cctcaataaggcgact

SEQ ID NO: 26497 - DNA, 16 bp, Artificial Sequence
  synthetic [barcode part1]
atatatctgccttgcg

SEQ ID NO: 26498 - DNA, 16 bp, Artificial Sequence
  synthetic [barcode part1]
ttgttacggatccgcc

SEQ ID NO: 26499 - DNA, 16 bp, Artificial Sequence
  synthetic [barcode part1]
gtatctccggttcggt

SEQ ID NO: 26500 - DNA, 16 bp, Artificial Sequence
  synthetic [barcode part1]
gactacggtgtcgatt

SEQ ID NO: 26501 - DNA, 16 bp, Artificial Sequence
  synthetic [barcode part1]
gacttggatcgagtct

SEQ ID NO: 26502 - DNA, 16 bp, Artificial Sequence
  synthetic [barcode part1]
cctagatctaccgtcg

SEQ ID NO: 26503 - DNA, 16 bp, Artificial Sequence
  synthetic [barcode part1]
ttgtaaggacgtgcct

SEQ ID NO: 26504 - DNA, 16 bp, Artificial Sequence
  synthetic [barcode part1]
ttgtatcgtccggcac

SEQ ID NO: 26505 - DNA, 16 bp, Artificial Sequence
  synthetic [barcode part1]
accgacaagtgcactt

SEQ ID NO: 26506 - DNA, 16 bp, Artificial Sequence
  synthetic [barcode part1]
aaccggtatcacgact

SEQ ID NO: 26507 - DNA, 16 bp, Artificial Sequence
  synthetic [barcode part1]
gtctgttgtgagtggt

SEQ ID NO: 26508 - DNA, 16 bp, Artificial Sequence
  synthetic [barcode part1]
ccagagtgcctatcct

SEQ ID NO: 26509 - DNA, 16 bp, Artificial Sequence
  synthetic [barcode part1]
aggacaatacctgagt

SEQ ID NO: 26510 - DNA, 16 bp, Artificial Sequence
  synthetic [barcode part1]
aggtcgagttgacgtg

SEQ ID NO: 26511 - DNA, 16 bp, Artificial Sequence
  synthetic [barcode part1]
acggagttactgttcg

SEQ ID NO: 26512 - DNA, 16 bp, Artificial Sequence
  synthetic [barcode part1]
gacgtacacgtcaact

SEQ ID NO: 26513 - DNA, 16 bp, Artificial Sequence
  synthetic [barcode part1]
ttacactctactaggc

SEQ ID NO: 26514 - DNA, 16 bp, Artificial Sequence
  synthetic [barcode part1]
acgtacgagtcctagt

SEQ ID NO: 26515 - DNA, 16 bp, Artificial Sequence
  synthetic [barcode part1]
cgtctctgtattcctg

SEQ ID NO: 26516 - DNA, 16 bp, Artificial Sequence
  synthetic [barcode part1]
ttatctcgcactcaag

SEQ ID NO: 26517 - DNA, 16 bp, Artificial Sequence
  synthetic [barcode part1]
caagtcttgaacgtcg

SEQ ID NO: 26518 - DNA, 16 bp, Artificial Sequence
  synthetic [barcode part1]
caacggtgaagatact

SEQ ID NO: 26519 - DNA, 16 bp, Artificial Sequence
  synthetic [barcode part1]
actccgcgtggttgtt

SEQ ID NO: 26520 - DNA, 16 bp, Artificial Sequence
  synthetic [barcode part1]
ttgtccacctactcgt

SEQ ID NO: 26521 - DNA, 16 bp, Artificial Sequence
  synthetic [barcode part1]
tccgatcgtgttggtc

SEQ ID NO: 26522 - DNA, 16 bp, Artificial Sequence
  synthetic [barcode part1]
tcaggtaccgtgaatc

SEQ ID NO: 26523 - DNA, 16 bp, Artificial Sequence
  synthetic [barcode part1]
tagtcactgtcttgtg

SEQ ID NO: 26524 - DNA, 16 bp, Artificial Sequence
  synthetic [barcode part1]
cggatcctagatatcg

SEQ ID NO: 26525 - DNA, 16 bp, Artificial Sequence
  synthetic [barcode part1]
tcggagtcctgttcgt

SEQ ID NO: 26526 - DNA, 16 bp, Artificial Sequence
  synthetic [barcode part1]
ttctaacctaagtgcc

SEQ ID NO: 26527 - DNA, 16 bp, Artificial Sequence
  synthetic [barcode part1]
cacctcacaggtgttc

SEQ ID NO: 26528 - DNA, 16 bp, Artificial Sequence
  synthetic [barcode part1]
tcgttccgattgcgtg

SEQ ID NO: 26529 - DNA, 16 bp, Artificial Sequence
  synthetic [barcode part1]
actcactcctaaggtt

SEQ ID NO: 26530 - DNA, 16 bp, Artificial Sequence
  synthetic [barcode part1]
tcgcacggaagaactg

SEQ ID NO: 26531 - DNA, 16 bp, Artificial Sequence
  synthetic [barcode part1]
cacttactactgcagt

SEQ ID NO: 26532 - DNA, 16 bp, Artificial Sequence
  synthetic [barcode part1]
gagtaaggtggtatct

SEQ ID NO: 26533 - DNA, 16 bp, Artificial Sequence
  synthetic [barcode part1]
actctcagacgattct

SEQ ID NO: 26534 - DNA, 16 bp, Artificial Sequence
  synthetic [barcode part1]
ccgcagttatagtgtg

SEQ ID NO: 26535 - DNA, 16 bp, Artificial Sequence
  synthetic [barcode part1]
tcagtgaacttgacgc

SEQ ID NO: 26536 - DNA, 16 bp, Artificial Sequence
  synthetic [barcode part1]
agttcttgtgtgactc

SEQ ID NO: 26537 - DNA, 16 bp, Artificial Sequence
  synthetic [barcode part1]
tacaattactgcctcg

SEQ ID NO: 26538 - DNA, 16 bp, Artificial Sequence
  synthetic [barcode part1]
atatcctcggtctaac

SEQ ID NO: 26539 - DNA, 16 bp, Artificial Sequence
  synthetic [barcode part1]
tgaagaaggagagtcc

SEQ ID NO: 26540 - DNA, 16 bp, Artificial Sequence
  synthetic [barcode part1]
atcgagtcagatcgtc

SEQ ID NO: 26541 - DNA, 16 bp, Artificial Sequence
  synthetic [barcode part1]
tgtagactggaacaac

SEQ ID NO: 26542 - DNA, 16 bp, Artificial Sequence
  synthetic [barcode part1]
ttccggtatacttgac

SEQ ID NO: 26543 - DNA, 16 bp, Artificial Sequence
  synthetic [barcode part1]
atacgcaattggtcgc

SEQ ID NO: 26544 - DNA, 16 bp, Artificial Sequence
  synthetic [barcode part1]
attattctaggcgcct

SEQ ID NO: 26545 - DNA, 16 bp, Artificial Sequence
  synthetic [barcode part1]
tcggtgatcgcgtctt

SEQ ID NO: 26546 - DNA, 16 bp, Artificial Sequence
  synthetic [barcode part1]
acgaccgagagaactc

SEQ ID NO: 26547 - DNA, 16 bp, Artificial Sequence
  synthetic [barcode part1]
ttctactccacaggcg

SEQ ID NO: 26548 - DNA, 16 bp, Artificial Sequence
  synthetic [barcode part1]
attgcgtaggagttag

SEQ ID NO: 26549 - DNA, 16 bp, Artificial Sequence
  synthetic [barcode part1]
ttgcactacaatccgt

SEQ ID NO: 26550 - DNA, 16 bp, Artificial Sequence
  synthetic [barcode part1]
tgtacagattcggacc

SEQ ID NO: 26551 - DNA, 16 bp, Artificial Sequence
  synthetic [barcode part1]
tcctacacggtaactt

SEQ ID NO: 26552 - DNA, 16 bp, Artificial Sequence
  synthetic [barcode part1]
atcttggagtcagtcg

SEQ ID NO: 26553 - DNA, 16 bp, Artificial Sequence
  synthetic [barcode part1]
tagtgtggatcgtgtc

SEQ ID NO: 26554 - DNA, 16 bp, Artificial Sequence
  synthetic [barcode part1]
cgactggttagtcaac

SEQ ID NO: 26555 - DNA, 16 bp, Artificial Sequence
  synthetic [barcode part1]
ccttaaggcagataag

SEQ ID NO: 26556 - DNA, 16 bp, Artificial Sequence
  synthetic [barcode part1]
cgtagagaatctagtg

SEQ ID NO: 26557 - DNA, 16 bp, Artificial Sequence
  synthetic [barcode part1]
gtcagtgcacctcgtt

SEQ ID NO: 26558 - DNA, 16 bp, Artificial Sequence
  synthetic [barcode part1]
tgcctacacggtatcc

SEQ ID NO: 26559 - DNA, 16 bp, Artificial Sequence
  synthetic [barcode part1]
tccgattcgcacaatt

SEQ ID NO: 26560 - DNA, 16 bp, Artificial Sequence
  synthetic [barcode part1]
cgcaattcgtagatcg

SEQ ID NO: 26561 - DNA, 16 bp, Artificial Sequence
  synthetic [barcode part1]
caacaacctaggttgc

SEQ ID NO: 26562 - DNA, 16 bp, Artificial Sequence
  synthetic [barcode part1]
agagagtaacggcagt

SEQ ID NO: 26563 - DNA, 16 bp, Artificial Sequence
  synthetic [barcode part1]
gacgtcaagtctcagt

SEQ ID NO: 26564 - DNA, 16 bp, Artificial Sequence
  synthetic [barcode part1]
accgtaactacagtgc

SEQ ID NO: 26565 - DNA, 16 bp, Artificial Sequence
  synthetic [barcode part1]
tgcgacactgcctact

SEQ ID NO: 26566 - DNA, 16 bp, Artificial Sequence
  synthetic [barcode part1]
actgtcctactcggac

SEQ ID NO: 26567 - DNA, 16 bp, Artificial Sequence
  synthetic [barcode part1]
tcgtcacacggatctc

SEQ ID NO: 26568 - DNA, 16 bp, Artificial Sequence
  synthetic [barcode part1]
gcaattcaggttaccg

SEQ ID NO: 26569 - DNA, 16 bp, Artificial Sequence
  synthetic [barcode part1]
gagaggtcgaacttgc

SEQ ID NO: 26570 - DNA, 16 bp, Artificial Sequence
  synthetic [barcode part1]
ccgagaaggcctatag

SEQ ID NO: 26571 - DNA, 16 bp, Artificial Sequence
  synthetic [barcode part1]
tcgtgtaccgatcctg

SEQ ID NO: 26572 - DNA, 16 bp, Artificial Sequence
  synthetic [barcode part1]
ttcgagattgactggc

SEQ ID NO: 26573 - DNA, 16 bp, Artificial Sequence
  synthetic [barcode part1]
agatacacggtggtcg

SEQ ID NO: 26574 - DNA, 16 bp, Artificial Sequence
  synthetic [barcode part1]
tcaataaggcggtctc

SEQ ID NO: 26575 - DNA, 16 bp, Artificial Sequence
  synthetic [barcode part1]
ttcgtaggccttattg

SEQ ID NO: 26576 - DNA, 16 bp, Artificial Sequence
  synthetic [barcode part1]
gaatccggccttctgt

SEQ ID NO: 26577 - DNA, 16 bp, Artificial Sequence
  synthetic [barcode part1]
taggtcggttatcggt

SEQ ID NO: 26578 - DNA, 16 bp, Artificial Sequence
  synthetic [barcode part1]
gatagaagaggcagtc

SEQ ID NO: 26579 - DNA, 16 bp, Artificial Sequence
  synthetic [barcode part1]
aacacgtcctcggttc

SEQ ID NO: 26580 - DNA, 16 bp, Artificial Sequence
  synthetic [barcode part1]
ttcgtcgaactatacc

SEQ ID NO: 26581 - DNA, 16 bp, Artificial Sequence
  synthetic [barcode part1]
gccgacttacgtatag

SEQ ID NO: 26582 - DNA, 16 bp, Artificial Sequence
  synthetic [barcode part1]
tgacgacaaggatact

SEQ ID NO: 26583 - DNA, 16 bp, Artificial Sequence
  synthetic [barcode part1]
cgaccttcgtggttac

SEQ ID NO: 26584 - DNA, 16 bp, Artificial Sequence
  synthetic [barcode part1]
cagacgtcacagatct

SEQ ID NO: 26585 - DNA, 16 bp, Artificial Sequence
  synthetic [barcode part1]
gatcactctgtcgaag

SEQ ID NO: 26586 - DNA, 16 bp, Artificial Sequence
  synthetic [barcode part1]
actctgaccggaattg

SEQ ID NO: 26587 - DNA, 16 bp, Artificial Sequence
  synthetic [barcode part1]
taaggccgtcaactgt

SEQ ID NO: 26588 - DNA, 16 bp, Artificial Sequence
  synthetic [barcode part1]
acaatacctggccagt

SEQ ID NO: 26589 - DNA, 16 bp, Artificial Sequence
  synthetic [barcode part1]
ttcgccgcacagatct

SEQ ID NO: 26590 - DNA, 16 bp, Artificial Sequence
  synthetic [barcode part1]
tagtaccgtctattcg

SEQ ID NO: 26591 - DNA, 16 bp, Artificial Sequence
  synthetic [barcode part1]
gatcgttggcaacttg

SEQ ID NO: 26592 - DNA, 16 bp, Artificial Sequence
  synthetic [barcode part1]
ttcgttggaggatcgt

SEQ ID NO: 26593 - DNA, 16 bp, Artificial Sequence
  synthetic [barcode part1]
tgacgtacgtaccaac

SEQ ID NO: 26594 - DNA, 16 bp, Artificial Sequence
  synthetic [barcode part1]
gcaacgttcttcctct

SEQ ID NO: 26595 - DNA, 16 bp, Artificial Sequence
  synthetic [barcode part1]
tggatcttgagtaccg

SEQ ID NO: 26596 - DNA, 16 bp, Artificial Sequence
  synthetic [barcode part1]
tatccgattcctaacg

SEQ ID NO: 26597 - DNA, 16 bp, Artificial Sequence
  synthetic [barcode part1]
gtctccttccttcaag

SEQ ID NO: 26598 - DNA, 16 bp, Artificial Sequence
  synthetic [barcode part1]
cgtaggacgacctaag

SEQ ID NO: 26599 - DNA, 16 bp, Artificial Sequence
  synthetic [barcode part1]
ttactctgcactcaag

SEQ ID NO: 26600 - DNA, 16 bp, Artificial Sequence
  synthetic [barcode part1]
gacttgtagactcgtg

SEQ ID NO: 26601 - DNA, 16 bp, Artificial Sequence
  synthetic [barcode part1]
ttcctccgactctagt

SEQ ID NO: 26602 - DNA, 16 bp, Artificial Sequence
  synthetic [barcode part1]
acaagagttgagtcgt

SEQ ID NO: 26603 - DNA, 16 bp, Artificial Sequence
  synthetic [barcode part1]
cgcacaaggtgtatct

SEQ ID NO: 26604 - DNA, 16 bp, Artificial Sequence
  synthetic [barcode part1]
cagttggcagttggtt

SEQ ID NO: 26605 - DNA, 16 bp, Artificial Sequence
  synthetic [barcode part1]
gatccaggtcgaactt

SEQ ID NO: 26606 - DNA, 16 bp, Artificial Sequence
  synthetic [barcode part1]
gcaagacttgttccag

SEQ ID NO: 26607 - DNA, 16 bp, Artificial Sequence
  synthetic [barcode part1]
aacgttgtgtgacacc

SEQ ID NO: 26608 - DNA, 16 bp, Artificial Sequence
  synthetic [barcode part1]
tcgaatcgtgcaggag

SEQ ID NO: 26609 - DNA, 16 bp, Artificial Sequence
  synthetic [barcode part1]
tctccgaacgccaatc

SEQ ID NO: 26610 - DNA, 16 bp, Artificial Sequence
  synthetic [barcode part1]
tgactacgataacgag

SEQ ID NO: 26611 - DNA, 16 bp, Artificial Sequence
  synthetic [barcode part1]
caagatccacacgtac

SEQ ID NO: 26612 - DNA, 16 bp, Artificial Sequence
  synthetic [barcode part1]
ccaacaagatataggc

SEQ ID NO: 26613 - DNA, 16 bp, Artificial Sequence
  synthetic [barcode part1]
gtgttctctagtggtt

SEQ ID NO: 26614 - DNA, 16 bp, Artificial Sequence
  synthetic [barcode part1]
tcaccacggtaagatc

SEQ ID NO: 26615 - DNA, 16 bp, Artificial Sequence
  synthetic [barcode part1]
caacaactatagaggc

SEQ ID NO: 26616 - DNA, 16 bp, Artificial Sequence
  synthetic [barcode part1]
gtgtactgtcctccag

SEQ ID NO: 26617 - DNA, 16 bp, Artificial Sequence
  synthetic [barcode part1]
atctgagtgagtgtcc

SEQ ID NO: 26618 - DNA, 16 bp, Artificial Sequence
  synthetic [barcode part1]
tagttgagtgccgtgt

SEQ ID NO: 26619 - DNA, 16 bp, Artificial Sequence
  synthetic [barcode part1]
tactcactccaaggtt

SEQ ID NO: 26620 - DNA, 16 bp, Artificial Sequence
  synthetic [barcode part1]
tcctggcagttatact

SEQ ID NO: 26621 - DNA, 16 bp, Artificial Sequence
  synthetic [barcode part1]
cgcacaagttcgaact

SEQ ID NO: 26622 - DNA, 16 bp, Artificial Sequence
  synthetic [barcode part1]
atcgcagtctggaact

SEQ ID NO: 26623 - DNA, 16 bp, Artificial Sequence
  synthetic [barcode part1]
gcctcgaaccaattag

SEQ ID NO: 26624 - DNA, 16 bp, Artificial Sequence
  synthetic [barcode part1]
aactgtctctgtgttg

SEQ ID NO: 26625 - DNA, 16 bp, Artificial Sequence
  synthetic [barcode part1]
acgccaagatcgtact

SEQ ID NO: 26626 - DNA, 16 bp, Artificial Sequence
  synthetic [barcode part1]
cacgcaacacctcgtt

SEQ ID NO: 26627 - DNA, 16 bp, Artificial Sequence
  synthetic [barcode part1]
attctggtctcaggag

SEQ ID NO: 26628 - DNA, 16 bp, Artificial Sequence
  synthetic [barcode part1]
caccgcctcgtataac

SEQ ID NO: 26629 - DNA, 16 bp, Artificial Sequence
  synthetic [barcode part1]
ccaagttactaccgag

SEQ ID NO: 26630 - DNA, 16 bp, Artificial Sequence
  synthetic [barcode part1]
tctaatctgcggccac

SEQ ID NO: 26631 - DNA, 16 bp, Artificial Sequence
  synthetic [barcode part1]
aataggacgcaagttc

SEQ ID NO: 26632 - DNA, 16 bp, Artificial Sequence
  synthetic [barcode part1]
tggtctccaatcgcac

SEQ ID NO: 26633 - DNA, 16 bp, Artificial Sequence
  synthetic [barcode part1]
ttactctgcgtctaag

SEQ ID NO: 26634 - DNA, 16 bp, Artificial Sequence
  synthetic [barcode part1]
gccttacacgattgcc

SEQ ID NO: 26635 - DNA, 16 bp, Artificial Sequence
  synthetic [barcode part1]
cctaagtctactgttg

SEQ ID NO: 26636 - DNA, 16 bp, Artificial Sequence
  synthetic [barcode part1]
gttggtaagtgcgttc

SEQ ID NO: 26637 - DNA, 16 bp, Artificial Sequence
  synthetic [barcode part1]
ttgatcgccggttaag

SEQ ID NO: 26638 - DNA, 16 bp, Artificial Sequence
  synthetic [barcode part1]
ttgaagaacgtagtcg

SEQ ID NO: 26639 - DNA, 16 bp, Artificial Sequence
  synthetic [barcode part1]
tggattaccggcaact

SEQ ID NO: 26640 - DNA, 16 bp, Artificial Sequence
  synthetic [barcode part1]
attaacgagaccgagt

SEQ ID NO: 26641 - DNA, 16 bp, Artificial Sequence
  synthetic [barcode part1]
aatccgaacgcaaggc

SEQ ID NO: 26642 - DNA, 16 bp, Artificial Sequence
  synthetic [barcode part1]
gcacgtagactgatct

SEQ ID NO: 26643 - DNA, 16 bp, Artificial Sequence
  synthetic [barcode part1]
gcgtacctcactgttg

SEQ ID NO: 26644 - DNA, 16 bp, Artificial Sequence
  synthetic [barcode part1]
cacttgcgttctaggc

SEQ ID NO: 26645 - DNA, 16 bp, Artificial Sequence
  synthetic [barcode part1]
gtctgttccgtctact

SEQ ID NO: 26646 - DNA, 16 bp, Artificial Sequence
  synthetic [barcode part1]
cacgtcgttgaaggag

SEQ ID NO: 26647 - DNA, 16 bp, Artificial Sequence
  synthetic [barcode part1]
cgcggtgtattacagt

SEQ ID NO: 26648 - DNA, 16 bp, Artificial Sequence
  synthetic [barcode part1]
atcgcgagttccaagt

SEQ ID NO: 26649 - DNA, 16 bp, Artificial Sequence
  synthetic [barcode part1]
acaatccggcaatctg

SEQ ID NO: 26650 - DNA, 16 bp, Artificial Sequence
  synthetic [barcode part1]
tccagttctggaaggt

SEQ ID NO: 26651 - DNA, 16 bp, Artificial Sequence
  synthetic [barcode part1]
gcaactatcaacttcc

SEQ ID NO: 26652 - DNA, 16 bp, Artificial Sequence
  synthetic [barcode part1]
cggattgcaatctggt

SEQ ID NO: 26653 - DNA, 16 bp, Artificial Sequence
  synthetic [barcode part1]
taggtacgtacagtcc

SEQ ID NO: 26654 - DNA, 16 bp, Artificial Sequence
  synthetic [barcode part1]
cacgtcctgttagatt

SEQ ID NO: 26655 - DNA, 16 bp, Artificial Sequence
  synthetic [barcode part1]
agacctacaggtctac

SEQ ID NO: 26656 - DNA, 16 bp, Artificial Sequence
  synthetic [barcode part1]
ccgttctcgcgaattg

SEQ ID NO: 26657 - DNA, 16 bp, Artificial Sequence
  synthetic [barcode part1]
cgacctcgtgttgact

SEQ ID NO: 26658 - DNA, 16 bp, Artificial Sequence
  synthetic [barcode part1]
cgtatccgttcgacac

SEQ ID NO: 26659 - DNA, 16 bp, Artificial Sequence
  synthetic [barcode part1]
tgtggatcctgagtac

SEQ ID NO: 26660 - DNA, 16 bp, Artificial Sequence
  synthetic [barcode part1]
gacgagaccaggtatc

SEQ ID NO: 26661 - DNA, 16 bp, Artificial Sequence
  synthetic [barcode part1]
tcagaactgagacctc

SEQ ID NO: 26662 - DNA, 16 bp, Artificial Sequence
  synthetic [barcode part1]
ccgaacctggtaattg

SEQ ID NO: 26663 - DNA, 16 bp, Artificial Sequence
  synthetic [barcode part1]
ttaggaaggtcgcgtg

SEQ ID NO: 26664 - DNA, 16 bp, Artificial Sequence
  synthetic [barcode part1]
tcggtctaagttaggc

SEQ ID NO: 26665 - DNA, 16 bp, Artificial Sequence
  synthetic [barcode part1]
gtcgaaccgtcttcgt

SEQ ID NO: 26666 - DNA, 16 bp, Artificial Sequence
  synthetic [barcode part1]
tacgacaacgacactc

SEQ ID NO: 26667 - DNA, 16 bp, Artificial Sequence
  synthetic [barcode part1]
cctcttccgactgatt

SEQ ID NO: 26668 - DNA, 16 bp, Artificial Sequence
  synthetic [barcode part1]
gaccagtcagtcagtt

SEQ ID NO: 26669 - DNA, 16 bp, Artificial Sequence
  synthetic [barcode part1]
ttactaatcctcgcag

SEQ ID NO: 26670 - DNA, 16 bp, Artificial Sequence
  synthetic [barcode part1]
ttctacgttggcaact

SEQ ID NO: 26671 - DNA, 16 bp, Artificial Sequence
  synthetic [barcode part1]
gtcgtggcctattcac

SEQ ID NO: 26672 - DNA, 16 bp, Artificial Sequence
  synthetic [barcode part1]
taggatccagtcagtc

SEQ ID NO: 26673 - DNA, 16 bp, Artificial Sequence
  synthetic [barcode part1]
gtcacaataagtggac

SEQ ID NO: 26674 - DNA, 16 bp, Artificial Sequence
  synthetic [barcode part1]
cgaattcttacctcag

SEQ ID NO: 26675 - DNA, 16 bp, Artificial Sequence
  synthetic [barcode part1]
aattgtacgtgcgacc

SEQ ID NO: 26676 - DNA, 16 bp, Artificial Sequence
  synthetic [barcode part1]
aataggtgaacaggcg

SEQ ID NO: 26677 - DNA, 16 bp, Artificial Sequence
  synthetic [barcode part1]
acgtgttcacctcgtg

SEQ ID NO: 26678 - DNA, 16 bp, Artificial Sequence
  synthetic [barcode part1]
ttctcgcagacgtaag

SEQ ID NO: 26679 - DNA, 16 bp, Artificial Sequence
  synthetic [barcode part1]
gaagttccggacagac

SEQ ID NO: 26680 - DNA, 16 bp, Artificial Sequence
  synthetic [barcode part1]
acgtactaggtgtctg

SEQ ID NO: 26681 - DNA, 16 bp, Artificial Sequence
  synthetic [barcode part1]
tcgttagtgtatcctg

SEQ ID NO: 26682 - DNA, 16 bp, Artificial Sequence
  synthetic [barcode part1]
taacaagtgccacctg

SEQ ID NO: 26683 - DNA, 16 bp, Artificial Sequence
  synthetic [barcode part1]
tgtgagtccaccttgc

SEQ ID NO: 26684 - DNA, 16 bp, Artificial Sequence
  synthetic [barcode part1]
gccttcagtgagaatc

SEQ ID NO: 26685 - DNA, 16 bp, Artificial Sequence
  synthetic [barcode part1]
gacagtctcgacaact

SEQ ID NO: 26686 - DNA, 16 bp, Artificial Sequence
  synthetic [barcode part1]
tgtgcggagactagac

SEQ ID NO: 26687 - DNA, 16 bp, Artificial Sequence
  synthetic [barcode part1]
aacagtatccactgcg

SEQ ID NO: 26688 - DNA, 16 bp, Artificial Sequence
  synthetic [barcode part1]
gcgttaggttatcctt

SEQ ID NO: 26689 - DNA, 16 bp, Artificial Sequence
  synthetic [barcode part1]
acacgatccaagaggc

SEQ ID NO: 26690 - DNA, 16 bp, Artificial Sequence
  synthetic [barcode part1]
aagaccgacgcaatcg

SEQ ID NO: 26691 - DNA, 16 bp, Artificial Sequence
  synthetic [barcode part1]
caagactccaagactc

SEQ ID NO: 26692 - DNA, 16 bp, Artificial Sequence
  synthetic [barcode part1]
tgcgacaggataagtt

SEQ ID NO: 26693 - DNA, 16 bp, Artificial Sequence
  synthetic [barcode part1]
tattcggtccttagtg

SEQ ID NO: 26694 - DNA, 16 bp, Artificial Sequence
  synthetic [barcode part1]
actgcggcaagtagac

SEQ ID NO: 26695 - DNA, 16 bp, Artificial Sequence
  synthetic [barcode part1]
tgtgactctgagtacg

SEQ ID NO: 26696 - DNA, 16 bp, Artificial Sequence
  synthetic [barcode part1]
gaagaaggcgtatacg

SEQ ID NO: 26697 - DNA, 16 bp, Artificial Sequence
  synthetic [barcode part1]
cgattgaggaatctcc

SEQ ID NO: 26698 - DNA, 16 bp, Artificial Sequence
  synthetic [barcode part1]
gttatatcgcgccaag

SEQ ID NO: 26699 - DNA, 16 bp, Artificial Sequence
  synthetic [barcode part1]
gcacttactgcctcag

SEQ ID NO: 26700 - DNA, 16 bp, Artificial Sequence
  synthetic [barcode part1]
agtcgttcaggttgtg

SEQ ID NO: 26701 - DNA, 16 bp, Artificial Sequence
  synthetic [barcode part1]
cacgattacgcagttg

SEQ ID NO: 26702 - DNA, 16 bp, Artificial Sequence
  synthetic [barcode part1]
gagttgccttgacagt

SEQ ID NO: 26703 - DNA, 16 bp, Artificial Sequence
  synthetic [barcode part1]
aaggttctgtcgtgac

SEQ ID NO: 26704 - DNA, 16 bp, Artificial Sequence
  synthetic [barcode part1]
tcttaaccttcgtcgc

SEQ ID NO: 26705 - DNA, 16 bp, Artificial Sequence
  synthetic [barcode part1]
actggattatcctcac

SEQ ID NO: 26706 - DNA, 16 bp, Artificial Sequence
  synthetic [barcode part1]
tctgttatcctcgacc

SEQ ID NO: 26707 - DNA, 16 bp, Artificial Sequence
  synthetic [barcode part1]
taatagtaaggtgcgc

SEQ ID NO: 26708 - DNA, 16 bp, Artificial Sequence
  synthetic [barcode part1]
gtagttcaacacgaag

SEQ ID NO: 26709 - DNA, 16 bp, Artificial Sequence
  synthetic [barcode part1]
aggtaatcgtatcgag

SEQ ID NO: 26710 - DNA, 16 bp, Artificial Sequence
  synthetic [barcode part1]
tggttaccacctcacg

SEQ ID NO: 26711 - DNA, 16 bp, Artificial Sequence
  synthetic [barcode part1]
tagaacaactcaggtg

SEQ ID NO: 26712 - DNA, 16 bp, Artificial Sequence
  synthetic [barcode part1]
agaggattaggttcgt

SEQ ID NO: 26713 - DNA, 16 bp, Artificial Sequence
  synthetic [barcode part1]
atcagaacggcacacg

SEQ ID NO: 26714 - DNA, 16 bp, Artificial Sequence
  synthetic [barcode part1]
gaacagatactcgcct

SEQ ID NO: 26715 - DNA, 16 bp, Artificial Sequence
  synthetic [barcode part1]
ccgttcgtccaagact

SEQ ID NO: 26716 - DNA, 16 bp, Artificial Sequence
  synthetic [barcode part1]
actcctccgattgcag

SEQ ID NO: 26717 - DNA, 16 bp, Artificial Sequence
  synthetic [barcode part1]
gtgaccagtgtgttgt

SEQ ID NO: 26718 - DNA, 16 bp, Artificial Sequence
  synthetic [barcode part1]
gtactgaggttgtgtc

SEQ ID NO: 26719 - DNA, 16 bp, Artificial Sequence
  synthetic [barcode part1]
taagtgtcagtctcct

SEQ ID NO: 26720 - DNA, 16 bp, Artificial Sequence
  synthetic [barcode part1]
ccttcacactcaatag

SEQ ID NO: 26721 - DNA, 16 bp, Artificial Sequence
  synthetic [barcode part1]
tacctacctcaaggtt

SEQ ID NO: 26722 - DNA, 16 bp, Artificial Sequence
  synthetic [barcode part1]
ttaggtcgagaacgcg

SEQ ID NO: 26723 - DNA, 16 bp, Artificial Sequence
  synthetic [barcode part1]
gttgtgaataagtggc

SEQ ID NO: 26724 - DNA, 16 bp, Artificial Sequence
  synthetic [barcode part1]
taccttgatccgcggt

SEQ ID NO: 26725 - DNA, 16 bp, Artificial Sequence
  synthetic [barcode part1]
aattcggaccgttgac

SEQ ID NO: 26726 - DNA, 16 bp, Artificial Sequence
  synthetic [barcode part1]
gtgtggaagacgtaag

SEQ ID NO: 26727 - DNA, 16 bp, Artificial Sequence
  synthetic [barcode part1]
tccgtctgtctacttg

SEQ ID NO: 26728 - DNA, 16 bp, Artificial Sequence
  synthetic [barcode part1]
tcgcgtcaacgtaagt

SEQ ID NO: 26729 - DNA, 16 bp, Artificial Sequence
  synthetic [barcode part1]
gagttcagtgagacgc

SEQ ID NO: 26730 - DNA, 16 bp, Artificial Sequence
  synthetic [barcode part1]
cctgatctgcaatcgc

SEQ ID NO: 26731 - DNA, 16 bp, Artificial Sequence
  synthetic [barcode part1]
tagtcgtgttcagacg

SEQ ID NO: 26732 - DNA, 16 bp, Artificial Sequence
  synthetic [barcode part1]
aggatctggtatcacc

SEQ ID NO: 26733 - DNA, 16 bp, Artificial Sequence
  synthetic [barcode part1]
tgcgttactctgattg

SEQ ID NO: 26734 - DNA, 16 bp, Artificial Sequence
  synthetic [barcode part1]
gataggagtcgtcctt

SEQ ID NO: 26735 - DNA, 16 bp, Artificial Sequence
  synthetic [barcode part1]
cctctgttaaggacag

SEQ ID NO: 26736 - DNA, 16 bp, Artificial Sequence
  synthetic [barcode part1]
gattcgttgtcgcctg

SEQ ID NO: 26737 - DNA, 16 bp, Artificial Sequence
  synthetic [barcode part1]
acgatcgtgtggttgt

SEQ ID NO: 26738 - DNA, 16 bp, Artificial Sequence
  synthetic [barcode part1]
tgagtctcaggacgag

SEQ ID NO: 26739 - DNA, 16 bp, Artificial Sequence
  synthetic [barcode part1]
acggttggactgaggt

SEQ ID NO: 26740 - DNA, 16 bp, Artificial Sequence
  synthetic [barcode part1]
aggaagtcactggcgt

SEQ ID NO: 26741 - DNA, 16 bp, Artificial Sequence
  synthetic [barcode part1]
gcgtaaggttcggtag

SEQ ID NO: 26742 - DNA, 16 bp, Artificial Sequence
  synthetic [barcode part1]
tcgtggactcgacctt

SEQ ID NO: 26743 - DNA, 16 bp, Artificial Sequence
  synthetic [barcode part1]
cgttccttgatctaag

SEQ ID NO: 26744 - DNA, 16 bp, Artificial Sequence
  synthetic [barcode part1]
attataggttcgcctc

SEQ ID NO: 26745 - DNA, 16 bp, Artificial Sequence
  synthetic [barcode part1]
acaactctcacacttg

SEQ ID NO: 26746 - DNA, 16 bp, Artificial Sequence
  synthetic [barcode part1]
acgatacggaatcctc

SEQ ID NO: 26747 - DNA, 16 bp, Artificial Sequence
  synthetic [barcode part1]
tagtcggttagtcggt

SEQ ID NO: 26748 - DNA, 16 bp, Artificial Sequence
  synthetic [barcode part1]
aggaaccaccacacag

SEQ ID NO: 26749 - DNA, 16 bp, Artificial Sequence
  synthetic [barcode part1]
caggacaaggtgttcg

SEQ ID NO: 26750 - DNA, 16 bp, Artificial Sequence
  synthetic [barcode part1]
tgtctcactacagact

SEQ ID NO: 26751 - DNA, 16 bp, Artificial Sequence
  synthetic [barcode part1]
gtcgacactattgtct

SEQ ID NO: 26752 - DNA, 16 bp, Artificial Sequence
  synthetic [barcode part1]
acgagtcgacttgtgt

SEQ ID NO: 26753 - DNA, 16 bp, Artificial Sequence
  synthetic [barcode part1]
gagttaaggaggatcg

SEQ ID NO: 26754 - DNA, 16 bp, Artificial Sequence
  synthetic [barcode part1]
acgagtctgtgagtct

SEQ ID NO: 26755 - DNA, 16 bp, Artificial Sequence
  synthetic [barcode part1]
accttccaaggtcaag

SEQ ID NO: 26756 - DNA, 16 bp, Artificial Sequence
  synthetic [barcode part1]
acaggcacttgaggtg

SEQ ID NO: 26757 - DNA, 16 bp, Artificial Sequence
  synthetic [barcode part1]
ccaacctgatacgtcc

SEQ ID NO: 26758 - DNA, 16 bp, Artificial Sequence
  synthetic [barcode part1]
cagtcaacgactaacc

SEQ ID NO: 26759 - DNA, 16 bp, Artificial Sequence
  synthetic [barcode part1]
ttaaccgtctcttccg

SEQ ID NO: 26760 - DNA, 16 bp, Artificial Sequence
  synthetic [barcode part1]
agtaactccgacggtt

SEQ ID NO: 26761 - DNA, 16 bp, Artificial Sequence
  synthetic [barcode part1]
gcagtcagtcaacgtt

SEQ ID NO: 26762 - DNA, 16 bp, Artificial Sequence
  synthetic [barcode part1]
gtcaccttaccacttc

SEQ ID NO: 26763 - DNA, 16 bp, Artificial Sequence
  synthetic [barcode part1]
cctcgttgcagattcg

SEQ ID NO: 26764 - DNA, 16 bp, Artificial Sequence
  synthetic [barcode part1]
aacaacaacctgtgag

SEQ ID NO: 26765 - DNA, 16 bp, Artificial Sequence
  synthetic [barcode part1]
agtggtgatccgcaag

SEQ ID NO: 26766 - DNA, 16 bp, Artificial Sequence
  synthetic [barcode part1]
tgttccaagtatccgt

SEQ ID NO: 26767 - DNA, 16 bp, Artificial Sequence
  synthetic [barcode part1]
ataggcgcaaggtctg

SEQ ID NO: 26768 - DNA, 16 bp, Artificial Sequence
  synthetic [barcode part1]
tgtccgtggtattgcc

SEQ ID NO: 26769 - DNA, 16 bp, Artificial Sequence
  synthetic [barcode part1]
cgttacctccaatctc

SEQ ID NO: 26770 - DNA, 16 bp, Artificial Sequence
  synthetic [barcode part1]
gattcgaggagacacc

SEQ ID NO: 26771 - DNA, 16 bp, Artificial Sequence
  synthetic [barcode part1]
tcttcctcggtactac

SEQ ID NO: 26772 - DNA, 16 bp, Artificial Sequence
  synthetic [barcode part1]
tatcggtattggtgcg

SEQ ID NO: 26773 - DNA, 16 bp, Artificial Sequence
  synthetic [barcode part1]
tgtcgaacacctctgc

SEQ ID NO: 26774 - DNA, 16 bp, Artificial Sequence
  synthetic [barcode part1]
cgcctgtgtcttaggt

SEQ ID NO: 26775 - DNA, 16 bp, Artificial Sequence
  synthetic [barcode part1]
tcgtgattgtagtgcg

SEQ ID NO: 26776 - DNA, 16 bp, Artificial Sequence
  synthetic [barcode part1]
acgcaactgactacgt

SEQ ID NO: 26777 - DNA, 16 bp, Artificial Sequence
  synthetic [barcode part1]
acggtatcacggtatc

SEQ ID NO: 26778 - DNA, 16 bp, Artificial Sequence
  synthetic [barcode part1]
ttgtaagaggccaagt

SEQ ID NO: 26779 - DNA, 16 bp, Artificial Sequence
  synthetic [barcode part1]
aacacctctactgccg

SEQ ID NO: 26780 - DNA, 16 bp, Artificial Sequence
  synthetic [barcode part1]
ttgagataggcagact

SEQ ID NO: 26781 - DNA, 16 bp, Artificial Sequence
  synthetic [barcode part1]
gccgtagtatctgtcc

SEQ ID NO: 26782 - DNA, 16 bp, Artificial Sequence
  synthetic [barcode part1]
cgcggacgataagact

SEQ ID NO: 26783 - DNA, 16 bp, Artificial Sequence
  synthetic [barcode part1]
tcttatcgagtccgcg

SEQ ID NO: 26784 - DNA, 16 bp, Artificial Sequence
  synthetic [barcode part1]
caacagtcgtaagaac

SEQ ID NO: 26785 - DNA, 16 bp, Artificial Sequence
  synthetic [barcode part1]
acggtattggcactac

SEQ ID NO: 26786 - DNA, 16 bp, Artificial Sequence
  synthetic [barcode part1]
tctagacgaaccggag

SEQ ID NO: 26787 - DNA, 16 bp, Artificial Sequence
  synthetic [barcode part1]
tcgtgagttcaatcct

SEQ ID NO: 26788 - DNA, 16 bp, Artificial Sequence
  synthetic [barcode part1]
ccggaactgagtagac

SEQ ID NO: 26789 - DNA, 16 bp, Artificial Sequence
  synthetic [barcode part1]
tagtcttatcgtgcac

SEQ ID NO: 26790 - DNA, 16 bp, Artificial Sequence
  synthetic [barcode part1]
acgtagttgtacggtc

SEQ ID NO: 26791 - DNA, 16 bp, Artificial Sequence
  synthetic [barcode part1]
acttcaccggaaggtt

SEQ ID NO: 26792 - DNA, 16 bp, Artificial Sequence
  synthetic [barcode part1]
caaggttaaccttggc

SEQ ID NO: 26793 - DNA, 16 bp, Artificial Sequence
  synthetic [barcode part1]
agttccaacaagtgag

SEQ ID NO: 26794 - DNA, 16 bp, Artificial Sequence
  synthetic [barcode part1]
gaacggtgtgcaatcg

SEQ ID NO: 26795 - DNA, 16 bp, Artificial Sequence
  synthetic [barcode part1]
ttgcgaacaccaacac

SEQ ID NO: 26796 - DNA, 16 bp, Artificial Sequence
  synthetic [barcode part1]
tacgttggactctccg

SEQ ID NO: 26797 - DNA, 16 bp, Artificial Sequence
  synthetic [barcode part1]
aacgttctctggtccg

SEQ ID NO: 26798 - DNA, 16 bp, Artificial Sequence
  synthetic [barcode part1]
cgccaagagtgtagac

SEQ ID NO: 26799 - DNA, 16 bp, Artificial Sequence
  synthetic [barcode part1]
atagagttgaggcgag

SEQ ID NO: 26800 - DNA, 16 bp, Artificial Sequence
  synthetic [barcode part1]
gagaggcagatattct

SEQ ID NO: 26801 - DNA, 16 bp, Artificial Sequence
  synthetic [barcode part1]
gtccagacagagtggt

SEQ ID NO: 26802 - DNA, 16 bp, Artificial Sequence
  synthetic [barcode part1]
agtggttcagtgatcc

SEQ ID NO: 26803 - DNA, 16 bp, Artificial Sequence
  synthetic [barcode part1]
tgttgcctggacctac

SEQ ID NO: 26804 - DNA, 16 bp, Artificial Sequence
  synthetic [barcode part1]
caatctctgcgattgt

SEQ ID NO: 26805 - DNA, 16 bp, Artificial Sequence
  synthetic [barcode part1]
ttggtcagtgttgcag

SEQ ID NO: 26806 - DNA, 16 bp, Artificial Sequence
  synthetic [barcode part1]
gccttactatcctacc

SEQ ID NO: 26807 - DNA, 16 bp, Artificial Sequence
  synthetic [barcode part1]
gacgagtgtgacactg

SEQ ID NO: 26808 - DNA, 16 bp, Artificial Sequence
  synthetic [barcode part1]
ttaccgaccgatagtg

SEQ ID NO: 26809 - DNA, 16 bp, Artificial Sequence
  synthetic [barcode part1]
ttgacgagacagtctc

SEQ ID NO: 26810 - DNA, 16 bp, Artificial Sequence
  synthetic [barcode part1]
atctcgttctgtgagt

SEQ ID NO: 26811 - DNA, 16 bp, Artificial Sequence
  synthetic [barcode part1]
cacaagttctgttacc

SEQ ID NO: 26812 - DNA, 16 bp, Artificial Sequence
  synthetic [barcode part1]
gtacctcttggtgacc

SEQ ID NO: 26813 - DNA, 16 bp, Artificial Sequence
  synthetic [barcode part1]
gtgaactgagataacc

SEQ ID NO: 26814 - DNA, 16 bp, Artificial Sequence
  synthetic [barcode part1]
caacgattcgacgatc

SEQ ID NO: 26815 - DNA, 16 bp, Artificial Sequence
  synthetic [barcode part1]
gactatcggtaactcg

SEQ ID NO: 26816 - DNA, 16 bp, Artificial Sequence
  synthetic [barcode part1]
agtcgagacaaccgtg

SEQ ID NO: 26817 - DNA, 16 bp, Artificial Sequence
  synthetic [barcode part1]
ccgatattgtgcagtg

SEQ ID NO: 26818 - DNA, 16 bp, Artificial Sequence
  synthetic [barcode part1]
ttggtacgtcacacag

SEQ ID NO: 26819 - DNA, 16 bp, Artificial Sequence
  synthetic [barcode part1]
tgtcgttgcagaacgt

SEQ ID NO: 26820 - DNA, 16 bp, Artificial Sequence
  synthetic [barcode part1]
ataacttctcgcactg

SEQ ID NO: 26821 - DNA, 16 bp, Artificial Sequence
  synthetic [barcode part1]
gttctgacgtagtgtg

SEQ ID NO: 26822 - DNA, 16 bp, Artificial Sequence
  synthetic [barcode part1]
cacaataacaggcagt

SEQ ID NO: 26823 - DNA, 16 bp, Artificial Sequence
  synthetic [barcode part1]
gtacctcttctgtgtc

SEQ ID NO: 26824 - DNA, 16 bp, Artificial Sequence
  synthetic [barcode part1]
gcctgagataacaggc

SEQ ID NO: 26825 - DNA, 16 bp, Artificial Sequence
  synthetic [barcode part1]
cgcaccaagtcagaag

SEQ ID NO: 26826 - DNA, 16 bp, Artificial Sequence
  synthetic [barcode part1]
aggtccggtagagtac

SEQ ID NO: 26827 - DNA, 16 bp, Artificial Sequence
  synthetic [barcode part1]
tacgtggatccgagtt

SEQ ID NO: 26828 - DNA, 16 bp, Artificial Sequence
  synthetic [barcode part1]
tgtgtcaacactggtg

SEQ ID NO: 26829 - DNA, 16 bp, Artificial Sequence
  synthetic [barcode part1]
gtctatcctgcggtgt

SEQ ID NO: 26830 - DNA, 16 bp, Artificial Sequence
  synthetic [barcode part1]
taacaccgtaggtaag

SEQ ID NO: 26831 - DNA, 16 bp, Artificial Sequence
  synthetic [barcode part1]
gcactagaagacgatt

SEQ ID NO: 26832 - DNA, 16 bp, Artificial Sequence
  synthetic [barcode part1]
attgtcttccaccacc

SEQ ID NO: 26833 - DNA, 16 bp, Artificial Sequence
  synthetic [barcode part1]
cacacttcgaaggtgt

SEQ ID NO: 26834 - DNA, 16 bp, Artificial Sequence
  synthetic [barcode part1]
caggttgagtccaact

SEQ ID NO: 26835 - DNA, 16 bp, Artificial Sequence
  synthetic [barcode part1]
ataaggagaaggcgtc

SEQ ID NO: 26836 - DNA, 16 bp, Artificial Sequence
  synthetic [barcode part1]
acgtagtcttcaactc

SEQ ID NO: 26837 - DNA, 16 bp, Artificial Sequence
  synthetic [barcode part1]
cgtggcagtaagtgac

SEQ ID NO: 26838 - DNA, 16 bp, Artificial Sequence
  synthetic [barcode part1]
tacgatccagtctccg

SEQ ID NO: 26839 - DNA, 16 bp, Artificial Sequence
  synthetic [barcode part1]
ttgcagtctaggactg

SEQ ID NO: 26840 - DNA, 16 bp, Artificial Sequence
  synthetic [barcode part1]
gcaattcggatacaag

SEQ ID NO: 26841 - DNA, 16 bp, Artificial Sequence
  synthetic [barcode part1]
tatccttcgcaccttg

SEQ ID NO: 26842 - DNA, 16 bp, Artificial Sequence
  synthetic [barcode part1]
actatagacggcacct

SEQ ID NO: 26843 - DNA, 16 bp, Artificial Sequence
  synthetic [barcode part1]
tagtcttactgcgcgc

SEQ ID NO: 26844 - DNA, 16 bp, Artificial Sequence
  synthetic [barcode part1]
ccacactcctatactc

SEQ ID NO: 26845 - DNA, 16 bp, Artificial Sequence
  synthetic [barcode part1]
caggttagtatcttcc

SEQ ID NO: 26846 - DNA, 16 bp, Artificial Sequence
  synthetic [barcode part1]
tgaccgaggtcaatct

SEQ ID NO: 26847 - DNA, 16 bp, Artificial Sequence
  synthetic [barcode part1]
cgtataccggtatcag

SEQ ID NO: 26848 - DNA, 16 bp, Artificial Sequence
  synthetic [barcode part1]
ttgtacgcgatcacag

SEQ ID NO: 26849 - DNA, 16 bp, Artificial Sequence
  synthetic [barcode part1]
gcagtaggtaggatag

SEQ ID NO: 26850 - DNA, 16 bp, Artificial Sequence
  synthetic [barcode part1]
cacaatctaacttccg

SEQ ID NO: 26851 - DNA, 16 bp, Artificial Sequence
  synthetic [barcode part1]
ccagaattgtctatcc

SEQ ID NO: 26852 - DNA, 16 bp, Artificial Sequence
  synthetic [barcode part1]
acgtcgattctgccgt

SEQ ID NO: 26853 - DNA, 16 bp, Artificial Sequence
  synthetic [barcode part1]
ttaatctggcgcgcct

SEQ ID NO: 26854 - DNA, 16 bp, Artificial Sequence
  synthetic [barcode part1]
gcagtatcgacactac

SEQ ID NO: 26855 - DNA, 16 bp, Artificial Sequence
  synthetic [barcode part1]
gtctctgcaggaatac

SEQ ID NO: 26856 - DNA, 16 bp, Artificial Sequence
  synthetic [barcode part1]
ttgtgtgagtcaagag

SEQ ID NO: 26857 - DNA, 16 bp, Artificial Sequence
  synthetic [barcode part1]
atcaagtacctggcgt

SEQ ID NO: 26858 - DNA, 16 bp, Artificial Sequence
  synthetic [barcode part1]
aaccggtgattggtct

SEQ ID NO: 26859 - DNA, 16 bp, Artificial Sequence
  synthetic [barcode part1]
attagtacgagagacc

SEQ ID NO: 26860 - DNA, 16 bp, Artificial Sequence
  synthetic [barcode part1]
gactaggcgaacctag

SEQ ID NO: 26861 - DNA, 16 bp, Artificial Sequence
  synthetic [barcode part1]
aaccgtacctcgactc

SEQ ID NO: 26862 - DNA, 16 bp, Artificial Sequence
  synthetic [barcode part1]
gcagaaggaagtgtac

SEQ ID NO: 26863 - DNA, 16 bp, Artificial Sequence
  synthetic [barcode part1]
acactgtcctatctag

SEQ ID NO: 26864 - DNA, 16 bp, Artificial Sequence
  synthetic [barcode part1]
agtcggcgtcaattac

SEQ ID NO: 26865 - DNA, 16 bp, Artificial Sequence
  synthetic [barcode part1]
cggattagactcagtc

SEQ ID NO: 26866 - DNA, 16 bp, Artificial Sequence
  synthetic [barcode part1]
agtcagttgtgacacc

SEQ ID NO: 26867 - DNA, 16 bp, Artificial Sequence
  synthetic [barcode part1]
acgttgattgacgtgc

SEQ ID NO: 26868 - DNA, 16 bp, Artificial Sequence
  synthetic [barcode part1]
attgtgcctctgttag

SEQ ID NO: 26869 - DNA, 16 bp, Artificial Sequence
  synthetic [barcode part1]
ttattatccgcggatc

SEQ ID NO: 26870 - DNA, 16 bp, Artificial Sequence
  synthetic [barcode part1]
tggactgtacgcctct

SEQ ID NO: 26871 - DNA, 16 bp, Artificial Sequence
  synthetic [barcode part1]
ccaagttcttccgcag

SEQ ID NO: 26872 - DNA, 16 bp, Artificial Sequence
  synthetic [barcode part1]
tcacagattgttgtcc

SEQ ID NO: 26873 - DNA, 16 bp, Artificial Sequence
  synthetic [barcode part1]
atacctccaacttggt

SEQ ID NO: 26874 - DNA, 16 bp, Artificial Sequence
  synthetic [barcode part1]
tacgacgtccaggatt

SEQ ID NO: 26875 - DNA, 16 bp, Artificial Sequence
  synthetic [barcode part1]
tgaagtacggagaacg

SEQ ID NO: 26876 - DNA, 16 bp, Artificial Sequence
  synthetic [barcode part1]
ccaagacacgacactt

SEQ ID NO: 26877 - DNA, 16 bp, Artificial Sequence
  synthetic [barcode part1]
tattcggtctcgccag

SEQ ID NO: 26878 - DNA, 16 bp, Artificial Sequence
  synthetic [barcode part1]
atcctgcggtacgttc

SEQ ID NO: 26879 - DNA, 16 bp, Artificial Sequence
  synthetic [barcode part1]
gtagtcttctggcaag

SEQ ID NO: 26880 - DNA, 16 bp, Artificial Sequence
  synthetic [barcode part1]
tagaccagtcagactc

SEQ ID NO: 26881 - DNA, 16 bp, Artificial Sequence
  synthetic [barcode part1]
gtagtgtactgcgatc

SEQ ID NO: 26882 - DNA, 16 bp, Artificial Sequence
  synthetic [barcode part1]
acacactcggattcag

SEQ ID NO: 26883 - DNA, 16 bp, Artificial Sequence
  synthetic [barcode part1]
tctaacgccacactcg

SEQ ID NO: 26884 - DNA, 16 bp, Artificial Sequence
  synthetic [barcode part1]
tctgtactgacggcct

SEQ ID NO: 26885 - DNA, 16 bp, Artificial Sequence
  synthetic [barcode part1]
ttgccgcactctactt

SEQ ID NO: 26886 - DNA, 16 bp, Artificial Sequence
  synthetic [barcode part1]
gagactgaacctatag

SEQ ID NO: 26887 - DNA, 16 bp, Artificial Sequence
  synthetic [barcode part1]
gccttgtgtccgaatc

SEQ ID NO: 26888 - DNA, 16 bp, Artificial Sequence
  synthetic [barcode part1]
tcttggcgcacaatcc

SEQ ID NO: 26889 - DNA, 16 bp, Artificial Sequence
  synthetic [barcode part1]
gcagtgcctaactaac

SEQ ID NO: 26890 - DNA, 16 bp, Artificial Sequence
  synthetic [barcode part1]
cggaagtaagttgccg

SEQ ID NO: 26891 - DNA, 16 bp, Artificial Sequence
  synthetic [barcode part1]
gtccttcttagttccg

SEQ ID NO: 26892 - DNA, 16 bp, Artificial Sequence
  synthetic [barcode part1]
tgaattgcggttcggt

SEQ ID NO: 26893 - DNA, 16 bp, Artificial Sequence
  synthetic [barcode part1]
tgttggttggtacgtg

SEQ ID NO: 26894 - DNA, 16 bp, Artificial Sequence
  synthetic [barcode part1]
agtctcaccgcaatag

SEQ ID NO: 26895 - DNA, 16 bp, Artificial Sequence
  synthetic [barcode part1]
gtcgttctcgttctac

SEQ ID NO: 26896 - DNA, 16 bp, Artificial Sequence
  synthetic [barcode part1]
agacggttaactctcg

SEQ ID NO: 26897 - DNA, 16 bp, Artificial Sequence
  synthetic [barcode part1]
aggccacctatactcc

SEQ ID NO: 26898 - DNA, 16 bp, Artificial Sequence
  synthetic [barcode part1]
taagagtctcgacaag

SEQ ID NO: 26899 - DNA, 16 bp, Artificial Sequence
  synthetic [barcode part1]
acggccactaactctc

SEQ ID NO: 26900 - DNA, 16 bp, Artificial Sequence
  synthetic [barcode part1]
agacactctacgaacc

SEQ ID NO: 26901 - DNA, 16 bp, Artificial Sequence
  synthetic [barcode part1]
tccaccggagataact

SEQ ID NO: 26902 - DNA, 16 bp, Artificial Sequence
  synthetic [barcode part1]
atcactcttgcaggtt

SEQ ID NO: 26903 - DNA, 16 bp, Artificial Sequence
  synthetic [barcode part1]
gccagacacttagtac

SEQ ID NO: 26904 - DNA, 16 bp, Artificial Sequence
  synthetic [barcode part1]
caggcacttaggtatc

SEQ ID NO: 26905 - DNA, 16 bp, Artificial Sequence
  synthetic [barcode part1]
actctcgagtggttcc

SEQ ID NO: 26906 - DNA, 16 bp, Artificial Sequence
  synthetic [barcode part1]
atcgagtccgttagac

SEQ ID NO: 26907 - DNA, 16 bp, Artificial Sequence
  synthetic [barcode part1]
gactgtgacgttggtt

SEQ ID NO: 26908 - DNA, 16 bp, Artificial Sequence
  synthetic [barcode part1]
caacctactcacgtcg

SEQ ID NO: 26909 - DNA, 16 bp, Artificial Sequence
  synthetic [barcode part1]
ccaacagatctctgtt

SEQ ID NO: 26910 - DNA, 16 bp, Artificial Sequence
  synthetic [barcode part1]
ttctgttcaccactcg

SEQ ID NO: 26911 - DNA, 16 bp, Artificial Sequence
  synthetic [barcode part1]
cacctattactgtggt

SEQ ID NO: 26912 - DNA, 16 bp, Artificial Sequence
  synthetic [barcode part1]
aacgcacagttcttct

SEQ ID NO: 26913 - DNA, 16 bp, Artificial Sequence
  synthetic [barcode part1]
gacgccaattgatcac

SEQ ID NO: 26914 - DNA, 16 bp, Artificial Sequence
  synthetic [barcode part1]
cacaccttaccaggtc

SEQ ID NO: 26915 - DNA, 16 bp, Artificial Sequence
  synthetic [barcode part1]
actggttctgagatcg

SEQ ID NO: 26916 - DNA, 16 bp, Artificial Sequence
  synthetic [barcode part1]
gtaagattcacagacg

SEQ ID NO: 26917 - DNA, 16 bp, Artificial Sequence
  synthetic [barcode part1]
tccaacctggttacgc

SEQ ID NO: 26918 - DNA, 16 bp, Artificial Sequence
  synthetic [barcode part1]
acgttactccgaagtg

SEQ ID NO: 26919 - DNA, 16 bp, Artificial Sequence
  synthetic [barcode part1]
aacgccacggttaact

SEQ ID NO: 26920 - DNA, 16 bp, Artificial Sequence
  synthetic [barcode part1]
gttgtgtgtgtgactg

SEQ ID NO: 26921 - DNA, 16 bp, Artificial Sequence
  synthetic [barcode part1]
aaccactggacacgag

SEQ ID NO: 26922 - DNA, 16 bp, Artificial Sequence
  synthetic [barcode part1]
acacaacaaccagaac

SEQ ID NO: 26923 - DNA, 16 bp, Artificial Sequence
  synthetic [barcode part1]
gtgatacgtcgcaatc

SEQ ID NO: 26924 - DNA, 16 bp, Artificial Sequence
  synthetic [barcode part1]
acttaggtaggacaac

SEQ ID NO: 26925 - DNA, 16 bp, Artificial Sequence
  synthetic [barcode part1]
cgtactcgataatctc

SEQ ID NO: 26926 - DNA, 16 bp, Artificial Sequence
  synthetic [barcode part1]
aaccttgtaccgcaag

SEQ ID NO: 26927 - DNA, 16 bp, Artificial Sequence
  synthetic [barcode part1]
attggactacctctac

SEQ ID NO: 26928 - DNA, 16 bp, Artificial Sequence
  synthetic [barcode part1]
cgaatcggttgaacct

SEQ ID NO: 26929 - DNA, 16 bp, Artificial Sequence
  synthetic [barcode part1]
gttcaaggcctacaac

SEQ ID NO: 26930 - DNA, 16 bp, Artificial Sequence
  synthetic [barcode part1]
cactcaagattcgcag

SEQ ID NO: 26931 - DNA, 16 bp, Artificial Sequence
  synthetic [barcode part1]
tcaacctgtcttccgt

SEQ ID NO: 26932 - DNA, 16 bp, Artificial Sequence
  synthetic [barcode part1]
attcggttcggtaacg

SEQ ID NO: 26933 - DNA, 16 bp, Artificial Sequence
  synthetic [barcode part1]
cgaagacttacgttcg

SEQ ID NO: 26934 - DNA, 16 bp, Artificial Sequence
  synthetic [barcode part1]
attgttcgcgaattcc

SEQ ID NO: 26935 - DNA, 16 bp, Artificial Sequence
  synthetic [barcode part1]
gacctgatcgacgatt

SEQ ID NO: 26936 - DNA, 16 bp, Artificial Sequence
  synthetic [barcode part1]
acggttaattggcacc

SEQ ID NO: 26937 - DNA, 16 bp, Artificial Sequence
  synthetic [barcode part1]
tcgtacaaccgtacag

SEQ ID NO: 26938 - DNA, 16 bp, Artificial Sequence
  synthetic [barcode part1]
acctaccttatagtgc

SEQ ID NO: 26939 - DNA, 16 bp, Artificial Sequence
  synthetic [barcode part1]
gatcgcctaagttgtg

SEQ ID NO: 26940 - DNA, 16 bp, Artificial Sequence
  synthetic [barcode part1]
gatctacgacggaacg

SEQ ID NO: 26941 - DNA, 16 bp, Artificial Sequence
  synthetic [barcode part1]
gtgtatctgagaagtg

SEQ ID NO: 26942 - DNA, 16 bp, Artificial Sequence
  synthetic [barcode part1]
gatcttcgcacctggt

SEQ ID NO: 26943 - DNA, 16 bp, Artificial Sequence
  synthetic [barcode part1]
aacctaggactactgc

SEQ ID NO: 26944 - DNA, 16 bp, Artificial Sequence
  synthetic [barcode part1]
tactatcgtagtcacc

SEQ ID NO: 26945 - DNA, 16 bp, Artificial Sequence
  synthetic [barcode part1]
ttccttcgtcgatcac

SEQ ID NO: 26946 - DNA, 16 bp, Artificial Sequence
  synthetic [barcode part1]
tctataccggtagttc

SEQ ID NO: 26947 - DNA, 16 bp, Artificial Sequence
  synthetic [barcode part1]
tacaagtggcaagact

SEQ ID NO: 26948 - DNA, 16 bp, Artificial Sequence
  synthetic [barcode part1]
cgccttatccggatac

SEQ ID NO: 26949 - DNA, 16 bp, Artificial Sequence
  synthetic [barcode part1]
ttgcagaacttaggcc

SEQ ID NO: 26950 - DNA, 16 bp, Artificial Sequence
  synthetic [barcode part1]
tcgagttccagtagtg

SEQ ID NO: 26951 - DNA, 16 bp, Artificial Sequence
  synthetic [barcode part1]
gtcgatagtggttacc

SEQ ID NO: 26952 - DNA, 16 bp, Artificial Sequence
  synthetic [barcode part1]
actcggatctgttact

SEQ ID NO: 26953 - DNA, 16 bp, Artificial Sequence
  synthetic [barcode part1]
accacttctgcaagtt

SEQ ID NO: 26954 - DNA, 16 bp, Artificial Sequence
  synthetic [barcode part1]
cgtaacaacctcagac

SEQ ID NO: 26955 - DNA, 16 bp, Artificial Sequence
  synthetic [barcode part1]
ataccaccttactcag

SEQ ID NO: 26956 - DNA, 16 bp, Artificial Sequence
  synthetic [barcode part1]
cctctacctgttggag

SEQ ID NO: 26957 - DNA, 16 bp, Artificial Sequence
  synthetic [barcode part1]
ataaccggtataccgc

SEQ ID NO: 26958 - DNA, 16 bp, Artificial Sequence
  synthetic [barcode part1]
gtgaagaatcgtcagt

SEQ ID NO: 26959 - DNA, 16 bp, Artificial Sequence
  synthetic [barcode part1]
cgacctgattcaacag

SEQ ID NO: 26960 - DNA, 16 bp, Artificial Sequence
  synthetic [barcode part1]
agacaagtggaatcct

SEQ ID NO: 26961 - DNA, 16 bp, Artificial Sequence
  synthetic [barcode part1]
gtgcagaagtggttcg

SEQ ID NO: 26962 - DNA, 16 bp, Artificial Sequence
  synthetic [barcode part1]
tgtagacctatcctac

SEQ ID NO: 26963 - DNA, 16 bp, Artificial Sequence
  synthetic [barcode part1]
cgtctacgcgaataac

SEQ ID NO: 26964 - DNA, 16 bp, Artificial Sequence
  synthetic [barcode part1]
agaccagtccttcaag

SEQ ID NO: 26965 - DNA, 16 bp, Artificial Sequence
  synthetic [barcode part1]
attacggttgcggtac

SEQ ID NO: 26966 - DNA, 16 bp, Artificial Sequence
  synthetic [barcode part1]
cctagtaagatcaccg

SEQ ID NO: 26967 - DNA, 16 bp, Artificial Sequence
  synthetic [barcode part1]
tatcgaatctacgcct

SEQ ID NO: 26968 - DNA, 16 bp, Artificial Sequence
  synthetic [barcode part1]
tccacaacactgtccg

SEQ ID NO: 26969 - DNA, 16 bp, Artificial Sequence
  synthetic [barcode part1]
gaatccgtggattcgt

SEQ ID NO: 26970 - DNA, 16 bp, Artificial Sequence
  synthetic [barcode part1]
tgagagaatcacacgt

SEQ ID NO: 26971 - DNA, 16 bp, Artificial Sequence
  synthetic [barcode part1]
gaactcgccaccactt

SEQ ID NO: 26972 - DNA, 16 bp, Artificial Sequence
  synthetic [barcode part1]
tggttgagaagtctcc

SEQ ID NO: 26973 - DNA, 16 bp, Artificial Sequence
  synthetic [barcode part1]
cgattgaccgagattc

SEQ ID NO: 26974 - DNA, 16 bp, Artificial Sequence
  synthetic [barcode part1]
ttgtcgcagtgagatc

SEQ ID NO: 26975 - DNA, 16 bp, Artificial Sequence
  synthetic [barcode part1]
taacttctgtacgacc

SEQ ID NO: 26976 - DNA, 16 bp, Artificial Sequence
  synthetic [barcode part1]
tgagtctaccttgccg

SEQ ID NO: 26977 - DNA, 16 bp, Artificial Sequence
  synthetic [barcode part1]
gatcgtgaacttcctt

SEQ ID NO: 26978 - DNA, 16 bp, Artificial Sequence
  synthetic [barcode part1]
tctctccacacacgtt

SEQ ID NO: 26979 - DNA, 16 bp, Artificial Sequence
  synthetic [barcode part1]
cgagttgtcgacgatt

SEQ ID NO: 26980 - DNA, 16 bp, Artificial Sequence
  synthetic [barcode part1]
gaatctggcagttacc

SEQ ID NO: 26981 - DNA, 16 bp, Artificial Sequence
  synthetic [barcode part1]
gataccacgatcaacc

SEQ ID NO: 26982 - DNA, 16 bp, Artificial Sequence
  synthetic [barcode part1]
tcctagtgacctgcgt

SEQ ID NO: 26983 - DNA, 16 bp, Artificial Sequence
  synthetic [barcode part1]
tccttatcgccagacg

SEQ ID NO: 26984 - DNA, 16 bp, Artificial Sequence
  synthetic [barcode part1]
tatcggagttcctgcc

SEQ ID NO: 26985 - DNA, 16 bp, Artificial Sequence
  synthetic [barcode part1]
gcgtacctagaagacg

SEQ ID NO: 26986 - DNA, 16 bp, Artificial Sequence
  synthetic [barcode part1]
tcaaccactaggactg

SEQ ID NO: 26987 - DNA, 16 bp, Artificial Sequence
  synthetic [barcode part1]
gcgaccaactgtatac

SEQ ID NO: 26988 - DNA, 16 bp, Artificial Sequence
  synthetic [barcode part1]
tcacagtgttgcaacg

SEQ ID NO: 26989 - DNA, 16 bp, Artificial Sequence
  synthetic [barcode part1]
caagaagaaggccagt

SEQ ID NO: 26990 - DNA, 16 bp, Artificial Sequence
  synthetic [barcode part1]
ttcgccagagaatcac

SEQ ID NO: 26991 - DNA, 16 bp, Artificial Sequence
  synthetic [barcode part1]
gtaccgaactacttct

SEQ ID NO: 26992 - DNA, 16 bp, Artificial Sequence
  synthetic [barcode part1]
atcgacactcgtgaac

SEQ ID NO: 26993 - DNA, 16 bp, Artificial Sequence
  synthetic [barcode part1]
cagtgcctactgtaag

SEQ ID NO: 26994 - DNA, 16 bp, Artificial Sequence
  synthetic [barcode part1]
cagatcaagttgtcgc

SEQ ID NO: 26995 - DNA, 16 bp, Artificial Sequence
  synthetic [barcode part1]
gaagtaatacctggac

SEQ ID NO: 26996 - DNA, 16 bp, Artificial Sequence
  synthetic [barcode part1]
gttaggtcctggtaac

SEQ ID NO: 26997 - DNA, 16 bp, Artificial Sequence
  synthetic [barcode part1]
actgaacacgatctgc

SEQ ID NO: 26998 - DNA, 16 bp, Artificial Sequence
  synthetic [barcode part1]
aggaacactgttgagt

SEQ ID NO: 26999 - DNA, 16 bp, Artificial Sequence
  synthetic [barcode part1]
actaatacgtcggcac

SEQ ID NO: 27000 - DNA, 16 bp, Artificial Sequence
  synthetic [barcode part1]
aacgtctggtgtgttg

SEQ ID NO: 27001 - DNA, 16 bp, Artificial Sequence
  synthetic [barcode part1]
ccacacttgaaggtac

SEQ ID NO: 27002 - DNA, 16 bp, Artificial Sequence
  synthetic [barcode part1]
ttctactcgtctgaag

SEQ ID NO: 27003 - DNA, 16 bp, Artificial Sequence
  synthetic [barcode part1]
gaacttggcagttgtc

SEQ ID NO: 27004 - DNA, 16 bp, Artificial Sequence
  synthetic [barcode part1]
actacactgcaggttg

SEQ ID NO: 27005 - DNA, 16 bp, Artificial Sequence
  synthetic [barcode part1]
agttgcacgtacgatc

SEQ ID NO: 27006 - DNA, 16 bp, Artificial Sequence
  synthetic [barcode part1]
atctcgcgacaacaac

SEQ ID NO: 27007 - DNA, 16 bp, Artificial Sequence
  synthetic [barcode part1]
gcgttaaccaagtacc

SEQ ID NO: 27008 - DNA, 16 bp, Artificial Sequence
  synthetic [barcode part1]
gtggaactgaggtaag

SEQ ID NO: 27009 - DNA, 16 bp, Artificial Sequence
  synthetic [barcode part1]
gtagagatcggcaatt

SEQ ID NO: 27010 - DNA, 16 bp, Artificial Sequence
  synthetic [barcode part1]
gatcacgaccggtatt

SEQ ID NO: 27011 - DNA, 16 bp, Artificial Sequence
  synthetic [barcode part1]
agtaaccgactcaacc

SEQ ID NO: 27012 - DNA, 16 bp, Artificial Sequence
  synthetic [barcode part1]
actagactcgcgttcc

SEQ ID NO: 27013 - DNA, 16 bp, Artificial Sequence
  synthetic [barcode part1]
gcaggtcaaggtgatc

SEQ ID NO: 27014 - DNA, 16 bp, Artificial Sequence
  synthetic [barcode part1]
caagatcacgtcgtac

SEQ ID NO: 27015 - DNA, 16 bp, Artificial Sequence
  synthetic [barcode part1]
ccggatcacacttctg

SEQ ID NO: 27016 - DNA, 16 bp, Artificial Sequence
  synthetic [barcode part1]
gagagtccagttgcag

SEQ ID NO: 27017 - DNA, 16 bp, Artificial Sequence
  synthetic [barcode part1]
gactgtactcttcaac

SEQ ID NO: 27018 - DNA, 16 bp, Artificial Sequence
  synthetic [barcode part1]
gactaaccttcgagac

SEQ ID NO: 27019 - DNA, 16 bp, Artificial Sequence
  synthetic [barcode part1]
aggagtgacagaagtc

SEQ ID NO: 27020 - DNA, 16 bp, Artificial Sequence
  synthetic [barcode part1]
ccgacacagaagatcg

SEQ ID NO: 27021 - DNA, 16 bp, Artificial Sequence
  synthetic [barcode part1]
acacgaggatacagag

SEQ ID NO: 27022 - DNA, 16 bp, Artificial Sequence
  synthetic [barcode part1]
cagatctcctgtcgtg

SEQ ID NO: 27023 - DNA, 16 bp, Artificial Sequence
  synthetic [barcode part1]
ttcggtctgtacgacc

SEQ ID NO: 27024 - DNA, 16 bp, Artificial Sequence
  synthetic [barcode part1]
acaacactcttgaggc

SEQ ID NO: 27025 - DNA, 16 bp, Artificial Sequence
  synthetic [barcode part1]
caggaagtacacaatc

SEQ ID NO: 27026 - DNA, 16 bp, Artificial Sequence
  synthetic [barcode part1]
tcgtactgccttcgtt

SEQ ID NO: 27027 - DNA, 16 bp, Artificial Sequence
  synthetic [barcode part1]
tagtgtccttggagtg

SEQ ID NO: 27028 - DNA, 16 bp, Artificial Sequence
  synthetic [barcode part1]
tccaccgtagtgaagt

SEQ ID NO: 27029 - DNA, 16 bp, Artificial Sequence
  synthetic [barcode part1]
tggtgcgattgtctcc

SEQ ID NO: 27030 - DNA, 16 bp, Artificial Sequence
  synthetic [barcode part1]
ataccactgcctattg

SEQ ID NO: 27031 - DNA, 16 bp, Artificial Sequence
  synthetic [barcode part1]
aaccgcgagaattggc

SEQ ID NO: 27032 - DNA, 16 bp, Artificial Sequence
  synthetic [barcode part1]
ttgagtagacggagtt

SEQ ID NO: 27033 - DNA, 16 bp, Artificial Sequence
  synthetic [barcode part1]
actggcacggaaggtt

SEQ ID NO: 27034 - DNA, 16 bp, Artificial Sequence
  synthetic [barcode part1]
acctcacctcaatctc

SEQ ID NO: 27035 - DNA, 16 bp, Artificial Sequence
  synthetic [barcode part1]
gtcggtagaacgtctt

SEQ ID NO: 27036 - DNA, 16 bp, Artificial Sequence
  synthetic [barcode part1]
aaggagtaatacgcct

SEQ ID NO: 27037 - DNA, 16 bp, Artificial Sequence
  synthetic [barcode part1]
gtagacttggtcctcc

SEQ ID NO: 27038 - DNA, 16 bp, Artificial Sequence
  synthetic [barcode part1]
agagagactggaactg

SEQ ID NO: 27039 - DNA, 16 bp, Artificial Sequence
  synthetic [barcode part1]
tatacaaggcacgtcc

SEQ ID NO: 27040 - DNA, 16 bp, Artificial Sequence
  synthetic [barcode part1]
gtcgtctcctattgtc

SEQ ID NO: 27041 - DNA, 16 bp, Artificial Sequence
  synthetic [barcode part1]
aggacacgttgaattg

SEQ ID NO: 27042 - DNA, 16 bp, Artificial Sequence
  synthetic [barcode part1]
cgttagagtctccacc

SEQ ID NO: 27043 - DNA, 16 bp, Artificial Sequence
  synthetic [barcode part1]
atctctagagtcactc

SEQ ID NO: 27044 - DNA, 16 bp, Artificial Sequence
  synthetic [barcode part1]
gtcgataacctgaacc

SEQ ID NO: 27045 - DNA, 16 bp, Artificial Sequence
  synthetic [barcode part1]
tgaccgagagaagagt

SEQ ID NO: 27046 - DNA, 16 bp, Artificial Sequence
  synthetic [barcode part1]
tgactgtctaccgtcg

SEQ ID NO: 27047 - DNA, 16 bp, Artificial Sequence
  synthetic [barcode part1]
tatacggacctcctgc

SEQ ID NO: 27048 - DNA, 16 bp, Artificial Sequence
  synthetic [barcode part1]
gacacgtagaatcagt

SEQ ID NO: 27049 - DNA, 16 bp, Artificial Sequence
  synthetic [barcode part1]
taaggcgttcaactcg

SEQ ID NO: 27050 - DNA, 16 bp, Artificial Sequence
  synthetic [barcode part1]
cgtagtaagtaagtgc

SEQ ID NO: 27051 - DNA, 16 bp, Artificial Sequence
  synthetic [barcode part1]
gtgttctgtgtggagt

SEQ ID NO: 27052 - DNA, 16 bp, Artificial Sequence
  synthetic [barcode part1]
accagagttgattccg

SEQ ID NO: 27053 - DNA, 16 bp, Artificial Sequence
  synthetic [barcode part1]
tgcaccggaagaactg

SEQ ID NO: 27054 - DNA, 16 bp, Artificial Sequence
  synthetic [barcode part1]
aggaagtctcagtcct

SEQ ID NO: 27055 - DNA, 16 bp, Artificial Sequence
  synthetic [barcode part1]
tagaacctacgtgtgc

SEQ ID NO: 27056 - DNA, 16 bp, Artificial Sequence
  synthetic [barcode part1]
atcggcacactaacgt

SEQ ID NO: 27057 - DNA, 16 bp, Artificial Sequence
  synthetic [barcode part1]
ttactgcgccttacct

SEQ ID NO: 27058 - DNA, 16 bp, Artificial Sequence
  synthetic [barcode part1]
ttaccgttaggcactt

SEQ ID NO: 27059 - DNA, 16 bp, Artificial Sequence
  synthetic [barcode part1]
aagagtgcgtctctgt

SEQ ID NO: 27060 - DNA, 16 bp, Artificial Sequence
  synthetic [barcode part1]
gacagtggtccacaag

SEQ ID NO: 27061 - DNA, 16 bp, Artificial Sequence
  synthetic [barcode part1]
tcttcgccagattgcg

SEQ ID NO: 27062 - DNA, 16 bp, Artificial Sequence
  synthetic [barcode part1]
aggaaccgtgtcagtg

SEQ ID NO: 27063 - DNA, 16 bp, Artificial Sequence
  synthetic [barcode part1]
tggaggaggaagattc

SEQ ID NO: 27064 - DNA, 16 bp, Artificial Sequence
  synthetic [barcode part1]
ttaggaacacgagttg

SEQ ID NO: 27065 - DNA, 16 bp, Artificial Sequence
  synthetic [barcode part1]
tcgaagttgtctatcc

SEQ ID NO: 27066 - DNA, 16 bp, Artificial Sequence
  synthetic [barcode part1]
ttagtggacaagagtc

SEQ ID NO: 27067 - DNA, 16 bp, Artificial Sequence
  synthetic [barcode part1]
aggactccttgtccgt

SEQ ID NO: 27068 - DNA, 16 bp, Artificial Sequence
  synthetic [barcode part1]
gcaatcttggaggcag

SEQ ID NO: 27069 - DNA, 16 bp, Artificial Sequence
  synthetic [barcode part1]
taccaacacactggtg

SEQ ID NO: 27070 - DNA, 16 bp, Artificial Sequence
  synthetic [barcode part1]
tacttcttgacggccg

SEQ ID NO: 27071 - DNA, 16 bp, Artificial Sequence
  synthetic [barcode part1]
cacaacaagtactgcc

SEQ ID NO: 27072 - DNA, 16 bp, Artificial Sequence
  synthetic [barcode part1]
aacacgttgaccacac

SEQ ID NO: 27073 - DNA, 16 bp, Artificial Sequence
  synthetic [barcode part1]
actaagagtcaacacg

SEQ ID NO: 27074 - DNA, 16 bp, Artificial Sequence
  synthetic [barcode part1]
ccttgacttaacgtac

SEQ ID NO: 27075 - DNA, 16 bp, Artificial Sequence
  synthetic [barcode part1]
gcgccgagaagtaact

SEQ ID NO: 27076 - DNA, 16 bp, Artificial Sequence
  synthetic [barcode part1]
gaatctgagatcgaac

SEQ ID NO: 27077 - DNA, 16 bp, Artificial Sequence
  synthetic [barcode part1]
aattggcctggagttc

SEQ ID NO: 27078 - DNA, 16 bp, Artificial Sequence
  synthetic [barcode part1]
atcttctcgtagtcag

SEQ ID NO: 27079 - DNA, 16 bp, Artificial Sequence
  synthetic [barcode part1]
gtgtgtacaatcgacc

SEQ ID NO: 27080 - DNA, 16 bp, Artificial Sequence
  synthetic [barcode part1]
tccttggcgatatatc

SEQ ID NO: 27081 - DNA, 16 bp, Artificial Sequence
  synthetic [barcode part1]
ttagtcgtcctgagag

SEQ ID NO: 27082 - DNA, 16 bp, Artificial Sequence
  synthetic [barcode part1]
tactgttgagtacctc

SEQ ID NO: 27083 - DNA, 16 bp, Artificial Sequence
  synthetic [barcode part1]
aggtattctcaccgtt

SEQ ID NO: 27084 - DNA, 16 bp, Artificial Sequence
  synthetic [barcode part1]
gaagaataggcacttc

SEQ ID NO: 27085 - DNA, 16 bp, Artificial Sequence
  synthetic [barcode part1]
atagaggtcgaatcgt

SEQ ID NO: 27086 - DNA, 16 bp, Artificial Sequence
  synthetic [barcode part1]
gccggtaacagaacac

SEQ ID NO: 27087 - DNA, 16 bp, Artificial Sequence
  synthetic [barcode part1]
acctgccacttcgagt

SEQ ID NO: 27088 - DNA, 16 bp, Artificial Sequence
  synthetic [barcode part1]
tctaactcgactgcgc

SEQ ID NO: 27089 - DNA, 16 bp, Artificial Sequence
  synthetic [barcode part1]
gagtctagtccaagtc

SEQ ID NO: 27090 - DNA, 16 bp, Artificial Sequence
  synthetic [barcode part1]
actgttgtcagaccag

SEQ ID NO: 27091 - DNA, 16 bp, Artificial Sequence
  synthetic [barcode part1]
gattggttgtgtacgc

SEQ ID NO: 27092 - DNA, 16 bp, Artificial Sequence
  synthetic [barcode part1]
tgtgatccacaggttg

SEQ ID NO: 27093 - DNA, 16 bp, Artificial Sequence
  synthetic [barcode part1]
aggaagatcgagatcg

SEQ ID NO: 27094 - DNA, 16 bp, Artificial Sequence
  synthetic [barcode part1]
ccgaacacgaggtagt

SEQ ID NO: 27095 - DNA, 16 bp, Artificial Sequence
  synthetic [barcode part1]
tatactcgacgtggac

SEQ ID NO: 27096 - DNA, 16 bp, Artificial Sequence
  synthetic [barcode part1]
atacgactcaacttcc

SEQ ID NO: 27097 - DNA, 16 bp, Artificial Sequence
  synthetic [barcode part1]
cagaaggtaaccgcac

SEQ ID NO: 27098 - DNA, 16 bp, Artificial Sequence
  synthetic [barcode part1]
ccttgaactacggtag

SEQ ID NO: 27099 - DNA, 16 bp, Artificial Sequence
  synthetic [barcode part1]
cgtctgcctattcact

SEQ ID NO: 27100 - DNA, 16 bp, Artificial Sequence
  synthetic [barcode part1]
agaagatctgtacgac

SEQ ID NO: 27101 - DNA, 16 bp, Artificial Sequence
  synthetic [barcode part1]
gtcctgttgaactcgc

SEQ ID NO: 27102 - DNA, 16 bp, Artificial Sequence
  synthetic [barcode part1]
gaccaattccttctcc

SEQ ID NO: 27103 - DNA, 16 bp, Artificial Sequence
  synthetic [barcode part1]
agtagaggcgtaatct

SEQ ID NO: 27104 - DNA, 16 bp, Artificial Sequence
  synthetic [barcode part1]
tacacggtaccttact

SEQ ID NO: 27105 - DNA, 16 bp, Artificial Sequence
  synthetic [barcode part1]
gtcgtattccttagtg

SEQ ID NO: 27106 - DNA, 16 bp, Artificial Sequence
  synthetic [barcode part1]
cgtattcggattgtct

SEQ ID NO: 27107 - DNA, 16 bp, Artificial Sequence
  synthetic [barcode part1]
cgtcaagtgaggacgt

SEQ ID NO: 27108 - DNA, 16 bp, Artificial Sequence
  synthetic [barcode part1]
ccaataagaaccgcct

SEQ ID NO: 27109 - DNA, 16 bp, Artificial Sequence
  synthetic [barcode part1]
tcgtatcctcgtacct

SEQ ID NO: 27110 - DNA, 16 bp, Artificial Sequence
  synthetic [barcode part1]
gtagatagtggcaccg

SEQ ID NO: 27111 - DNA, 16 bp, Artificial Sequence
  synthetic [barcode part1]
aatcggtattgaccgc

SEQ ID NO: 27112 - DNA, 16 bp, Artificial Sequence
  synthetic [barcode part1]
gaatctcgaagaggag

SEQ ID NO: 27113 - DNA, 16 bp, Artificial Sequence
  synthetic [barcode part1]
cacctaacttctggcg

SEQ ID NO: 27114 - DNA, 16 bp, Artificial Sequence
  synthetic [barcode part1]
cgatctctgtacaatc

SEQ ID NO: 27115 - DNA, 16 bp, Artificial Sequence
  synthetic [barcode part1]
gtcacctaacactcgc

SEQ ID NO: 27116 - DNA, 16 bp, Artificial Sequence
  synthetic [barcode part1]
tgtgtcaacgttgacg

SEQ ID NO: 27117 - DNA, 16 bp, Artificial Sequence
  synthetic [barcode part1]
ttcaaggataccacgc

SEQ ID NO: 27118 - DNA, 16 bp, Artificial Sequence
  synthetic [barcode part1]
tggtaacgttaggtcc

SEQ ID NO: 27119 - DNA, 16 bp, Artificial Sequence
  synthetic [barcode part1]
aacgactcgtacctcc

SEQ ID NO: 27120 - DNA, 16 bp, Artificial Sequence
  synthetic [barcode part1]
acactacacaagtgag

SEQ ID NO: 27121 - DNA, 16 bp, Artificial Sequence
  synthetic [barcode part1]
gcacaattcctaactc

SEQ ID NO: 27122 - DNA, 16 bp, Artificial Sequence
  synthetic [barcode part1]
ataattgcacggccac

SEQ ID NO: 27123 - DNA, 16 bp, Artificial Sequence
  synthetic [barcode part1]
tctgccagttactctc

SEQ ID NO: 27124 - DNA, 16 bp, Artificial Sequence
  synthetic [barcode part1]
aaggcaccgacaatcg

SEQ ID NO: 27125 - DNA, 16 bp, Artificial Sequence
  synthetic [barcode part1]
gagttctcaaccaacg

SEQ ID NO: 27126 - DNA, 16 bp, Artificial Sequence
  synthetic [barcode part1]
aacctggtaacgacct

SEQ ID NO: 27127 - DNA, 16 bp, Artificial Sequence
  synthetic [barcode part1]
aacacgcctctaactt

SEQ ID NO: 27128 - DNA, 16 bp, Artificial Sequence
  synthetic [barcode part1]
gtcgcctgtgataagt

SEQ ID NO: 27129 - DNA, 16 bp, Artificial Sequence
  synthetic [barcode part1]
agtctgttcacgaacg

SEQ ID NO: 27130 - DNA, 16 bp, Artificial Sequence
  synthetic [barcode part1]
gaggatacactctcgt

SEQ ID NO: 27131 - DNA, 16 bp, Artificial Sequence
  synthetic [barcode part1]
aggcacacgatccaag

SEQ ID NO: 27132 - DNA, 16 bp, Artificial Sequence
  synthetic [barcode part1]
agaccagaggattgag

SEQ ID NO: 27133 - DNA, 16 bp, Artificial Sequence
  synthetic [barcode part1]
gtgtaattcgaggagt

SEQ ID NO: 27134 - DNA, 16 bp, Artificial Sequence
  synthetic [barcode part1]
cactccgcaagatagt

SEQ ID NO: 27135 - DNA, 16 bp, Artificial Sequence
  synthetic [barcode part1]
atagttgtgtggccgt

SEQ ID NO: 27136 - DNA, 16 bp, Artificial Sequence
  synthetic [barcode part1]
tactgttaacggcgac

SEQ ID NO: 27137 - DNA, 16 bp, Artificial Sequence
  synthetic [barcode part1]
gaataggacgacgcct

SEQ ID NO: 27138 - DNA, 16 bp, Artificial Sequence
  synthetic [barcode part1]
gatcgtactccttggc

SEQ ID NO: 27139 - DNA, 16 bp, Artificial Sequence
  synthetic [barcode part1]
tgtcctgagacaacac

SEQ ID NO: 27140 - DNA, 16 bp, Artificial Sequence
  synthetic [barcode part1]
tccttggcaactgcac

SEQ ID NO: 27141 - DNA, 16 bp, Artificial Sequence
  synthetic [barcode part1]
gtattcctggcaactt

SEQ ID NO: 27142 - DNA, 16 bp, Artificial Sequence
  synthetic [barcode part1]
cgaggtagaactagag

SEQ ID NO: 27143 - DNA, 16 bp, Artificial Sequence
  synthetic [barcode part1]
aggtggttatagatcg

SEQ ID NO: 27144 - DNA, 16 bp, Artificial Sequence
  synthetic [barcode part1]
cagatcgactgaacct

SEQ ID NO: 27145 - DNA, 16 bp, Artificial Sequence
  synthetic [barcode part1]
agtgtcgtctctctct

SEQ ID NO: 27146 - DNA, 16 bp, Artificial Sequence
  synthetic [barcode part1]
agaggtcagttcttcg

SEQ ID NO: 27147 - DNA, 16 bp, Artificial Sequence
  synthetic [barcode part1]
tagatcacgcactctt

SEQ ID NO: 27148 - DNA, 16 bp, Artificial Sequence
  synthetic [barcode part1]
aggtaggataagtggc

SEQ ID NO: 27149 - DNA, 16 bp, Artificial Sequence
  synthetic [barcode part1]
tgtgccgcacaattag

SEQ ID NO: 27150 - DNA, 16 bp, Artificial Sequence
  synthetic [barcode part1]
tgatcctgtgcgtcgt

SEQ ID NO: 27151 - DNA, 16 bp, Artificial Sequence
  synthetic [barcode part1]
tcttggaccgtctacg

SEQ ID NO: 27152 - DNA, 16 bp, Artificial Sequence
  synthetic [barcode part1]
acaattgcgaccgtgt

SEQ ID NO: 27153 - DNA, 16 bp, Artificial Sequence
  synthetic [barcode part1]
tgcactccgttggatc

SEQ ID NO: 27154 - DNA, 16 bp, Artificial Sequence
  synthetic [barcode part1]
acacgcagttaaccgt

SEQ ID NO: 27155 - DNA, 16 bp, Artificial Sequence
  synthetic [barcode part1]
acgaagattctcgcgt

SEQ ID NO: 27156 - DNA, 16 bp, Artificial Sequence
  synthetic [barcode part1]
agttacaacgcaccgt

SEQ ID NO: 27157 - DNA, 16 bp, Artificial Sequence
  synthetic [barcode part1]
ccaagaccgtctacct

SEQ ID NO: 27158 - DNA, 16 bp, Artificial Sequence
  synthetic [barcode part1]
tcaagtgcagagtggc

SEQ ID NO: 27159 - DNA, 16 bp, Artificial Sequence
  synthetic [barcode part1]
cgagtactaatctcct

SEQ ID NO: 27160 - DNA, 16 bp, Artificial Sequence
  synthetic [barcode part1]
cacgtccacaggaatt

SEQ ID NO: 27161 - DNA, 16 bp, Artificial Sequence
  synthetic [barcode part1]
cgtgtaataccagtgc

SEQ ID NO: 27162 - DNA, 16 bp, Artificial Sequence
  synthetic [barcode part1]
tgttgcctctacggac

SEQ ID NO: 27163 - DNA, 16 bp, Artificial Sequence
  synthetic [barcode part1]
gcggaggatataagac

SEQ ID NO: 27164 - DNA, 16 bp, Artificial Sequence
  synthetic [barcode part1]
ccactcagaatctcgc

SEQ ID NO: 27165 - DNA, 16 bp, Artificial Sequence
  synthetic [barcode part1]
agacgaagtccactct

SEQ ID NO: 27166 - DNA, 16 bp, Artificial Sequence
  synthetic [barcode part1]
cgagtgtacacgactt

SEQ ID NO: 27167 - DNA, 16 bp, Artificial Sequence
  synthetic [barcode part1]
agtagtctatagaggc

SEQ ID NO: 27168 - DNA, 16 bp, Artificial Sequence
  synthetic [barcode part1]
tcaacgaggtacggac

SEQ ID NO: 27169 - DNA, 16 bp, Artificial Sequence
  synthetic [barcode part1]
agtagaacgcgttaac

SEQ ID NO: 27170 - DNA, 16 bp, Artificial Sequence
  synthetic [barcode part1]
ttccgcgactgttggt

SEQ ID NO: 27171 - DNA, 16 bp, Artificial Sequence
  synthetic [barcode part1]
aggccggtatacagtg

SEQ ID NO: 27172 - DNA, 16 bp, Artificial Sequence
  synthetic [barcode part1]
taagtcgtcggattgc

SEQ ID NO: 27173 - DNA, 16 bp, Artificial Sequence
  synthetic [barcode part1]
cgactctagttcttcc

SEQ ID NO: 27174 - DNA, 16 bp, Artificial Sequence
  synthetic [barcode part1]
ttgacagacgagaatc

SEQ ID NO: 27175 - DNA, 16 bp, Artificial Sequence
  synthetic [barcode part1]
attcgtggcacaactg

SEQ ID NO: 27176 - DNA, 16 bp, Artificial Sequence
  synthetic [barcode part1]
tcctgcggtattctct

SEQ ID NO: 27177 - DNA, 16 bp, Artificial Sequence
  synthetic [barcode part1]
aaccaactgactgacc

SEQ ID NO: 27178 - DNA, 16 bp, Artificial Sequence
  synthetic [barcode part1]
gaacaagtccgagatt

SEQ ID NO: 27179 - DNA, 16 bp, Artificial Sequence
  synthetic [barcode part1]
tgacctacacttctag

SEQ ID NO: 27180 - DNA, 16 bp, Artificial Sequence
  synthetic [barcode part1]
aagtccaagtagtgac

SEQ ID NO: 27181 - DNA, 16 bp, Artificial Sequence
  synthetic [barcode part1]
gagattcgtccgttcc

SEQ ID NO: 27182 - DNA, 16 bp, Artificial Sequence
  synthetic [barcode part1]
cggcgccttataatag

SEQ ID NO: 27183 - DNA, 16 bp, Artificial Sequence
  synthetic [barcode part1]
atcgtgacaagtgaac

SEQ ID NO: 27184 - DNA, 16 bp, Artificial Sequence
  synthetic [barcode part1]
ccggacaacttcgttc

SEQ ID NO: 27185 - DNA, 16 bp, Artificial Sequence
  synthetic [barcode part1]
gatcgaccttccttct

SEQ ID NO: 27186 - DNA, 16 bp, Artificial Sequence
  synthetic [barcode part1]
cgacggtgtatccttc

SEQ ID NO: 27187 - DNA, 16 bp, Artificial Sequence
  synthetic [barcode part1]
cggcgattcgataatc

SEQ ID NO: 27188 - DNA, 16 bp, Artificial Sequence
  synthetic [barcode part1]
ttctaacagttgcacc

SEQ ID NO: 27189 - DNA, 16 bp, Artificial Sequence
  synthetic [barcode part1]
gtgttcaccacctcag

SEQ ID NO: 27190 - DNA, 16 bp, Artificial Sequence
  synthetic [barcode part1]
cactattacggagtgc

SEQ ID NO: 27191 - DNA, 16 bp, Artificial Sequence
  synthetic [barcode part1]
tattctgtgtcgcctc

SEQ ID NO: 27192 - DNA, 16 bp, Artificial Sequence
  synthetic [barcode part1]
cgaatcaccgacaatc

SEQ ID NO: 27193 - DNA, 16 bp, Artificial Sequence
  synthetic [barcode part1]
cgtgaatctacggatc

SEQ ID NO: 27194 - DNA, 16 bp, Artificial Sequence
  synthetic [barcode part1]
ttcgcggtctatcgtg

SEQ ID NO: 27195 - DNA, 16 bp, Artificial Sequence
  synthetic [barcode part1]
ccgtggtgtactatag

SEQ ID NO: 27196 - DNA, 16 bp, Artificial Sequence
  synthetic [barcode part1]
ccactgttcgtaggtc

SEQ ID NO: 27197 - DNA, 16 bp, Artificial Sequence
  synthetic [barcode part1]
gagtgtctctgttgtt

SEQ ID NO: 27198 - DNA, 16 bp, Artificial Sequence
  synthetic [barcode part1]
gtataagtaccgagtg

SEQ ID NO: 27199 - DNA, 16 bp, Artificial Sequence
  synthetic [barcode part1]
ccaatcctattggcgc

SEQ ID NO: 27200 - DNA, 16 bp, Artificial Sequence
  synthetic [barcode part1]
tgtgtcctaggtcgtc

SEQ ID NO: 27201 - DNA, 16 bp, Artificial Sequence
  synthetic [barcode part1]
tattgccggcgcactt

SEQ ID NO: 27202 - DNA, 16 bp, Artificial Sequence
  synthetic [barcode part1]
cgtacctaagtacgac

SEQ ID NO: 27203 - DNA, 16 bp, Artificial Sequence
  synthetic [barcode part1]
gtaggccaattcacac

SEQ ID NO: 27204 - DNA, 16 bp, Artificial Sequence
  synthetic [barcode part1]
aagactaaggacgacg

SEQ ID NO: 27205 - DNA, 16 bp, Artificial Sequence
  synthetic [barcode part1]
ttacgtggagaagttg

SEQ ID NO: 27206 - DNA, 16 bp, Artificial Sequence
  synthetic [barcode part1]
agtgccacgactaact

SEQ ID NO: 27207 - DNA, 16 bp, Artificial Sequence
  synthetic [barcode part1]
agactaagtattggcg

SEQ ID NO: 27208 - DNA, 16 bp, Artificial Sequence
  synthetic [barcode part1]
gacgcctctatcactg

SEQ ID NO: 27209 - DNA, 16 bp, Artificial Sequence
  synthetic [barcode part1]
tgtaacgaggtaggcc

SEQ ID NO: 27210 - DNA, 16 bp, Artificial Sequence
  synthetic [barcode part1]
gagaatacgaagacgc

SEQ ID NO: 27211 - DNA, 16 bp, Artificial Sequence
  synthetic [barcode part1]
ccacacctatccttgt

SEQ ID NO: 27212 - DNA, 16 bp, Artificial Sequence
  synthetic [barcode part1]
atcgacgactcgagtt

SEQ ID NO: 27213 - DNA, 16 bp, Artificial Sequence
  synthetic [barcode part1]
aggtaggccacagtac

SEQ ID NO: 27214 - DNA, 16 bp, Artificial Sequence
  synthetic [barcode part1]
ttcggattgccgatag

SEQ ID NO: 27215 - DNA, 16 bp, Artificial Sequence
  synthetic [barcode part1]
aattaaccacggcacc

SEQ ID NO: 27216 - DNA, 16 bp, Artificial Sequence
  synthetic [barcode part1]
tgtaattgaggcaacg

SEQ ID NO: 27217 - DNA, 16 bp, Artificial Sequence
  synthetic [barcode part1]
cgagtaggccttgaag

SEQ ID NO: 27218 - DNA, 16 bp, Artificial Sequence
  synthetic [barcode part1]
tcttgtagtcgttgac

SEQ ID NO: 27219 - DNA, 16 bp, Artificial Sequence
  synthetic [barcode part1]
ccaaggtataacgcct

SEQ ID NO: 27220 - DNA, 16 bp, Artificial Sequence
  synthetic [barcode part1]
tataccggacctctcg

SEQ ID NO: 27221 - DNA, 16 bp, Artificial Sequence
  synthetic [barcode part1]
attgacgcggaaggtc

SEQ ID NO: 27222 - DNA, 16 bp, Artificial Sequence
  synthetic [barcode part1]
tgttgtggttgaccag

SEQ ID NO: 27223 - DNA, 16 bp, Artificial Sequence
  synthetic [barcode part1]
cgtattccacctctgt

SEQ ID NO: 27224 - DNA, 16 bp, Artificial Sequence
  synthetic [barcode part1]
aatccacgcctcactg

SEQ ID NO: 27225 - DNA, 16 bp, Artificial Sequence
  synthetic [barcode part1]
tgagactaattccggc

SEQ ID NO: 27226 - DNA, 16 bp, Artificial Sequence
  synthetic [barcode part1]
taagaggcgatacact

SEQ ID NO: 27227 - DNA, 16 bp, Artificial Sequence
  synthetic [barcode part1]
acttccgtggattgcc

SEQ ID NO: 27228 - DNA, 16 bp, Artificial Sequence
  synthetic [barcode part1]
gactgtgtgtgcaact

SEQ ID NO: 27229 - DNA, 16 bp, Artificial Sequence
  synthetic [barcode part1]
caccttcttgacgacg

SEQ ID NO: 27230 - DNA, 16 bp, Artificial Sequence
  synthetic [barcode part1]
ccacttactcgtctgt

SEQ ID NO: 27231 - DNA, 16 bp, Artificial Sequence
  synthetic [barcode part1]
gacctcttgattctcc

SEQ ID NO: 27232 - DNA, 16 bp, Artificial Sequence
  synthetic [barcode part1]
actgaggagaagatcg

SEQ ID NO: 27233 - DNA, 16 bp, Artificial Sequence
  synthetic [barcode part1]
gtgacactcgagatct

SEQ ID NO: 27234 - DNA, 16 bp, Artificial Sequence
  synthetic [barcode part1]
ccgtattcggaagtgt

SEQ ID NO: 27235 - DNA, 16 bp, Artificial Sequence
  synthetic [barcode part1]
cctaagtggcagtgag

SEQ ID NO: 27236 - DNA, 16 bp, Artificial Sequence
  synthetic [barcode part1]
cgatcgaggttaacct

SEQ ID NO: 27237 - DNA, 16 bp, Artificial Sequence
  synthetic [barcode part1]
cctaacttctctcggt

SEQ ID NO: 27238 - DNA, 16 bp, Artificial Sequence
  synthetic [barcode part1]
ttaggcaactctatcc

SEQ ID NO: 27239 - DNA, 16 bp, Artificial Sequence
  synthetic [barcode part1]
actgtccaatacctac

SEQ ID NO: 27240 - DNA, 16 bp, Artificial Sequence
  synthetic [barcode part1]
tacttctctccgtgtg

SEQ ID NO: 27241 - DNA, 16 bp, Artificial Sequence
  synthetic [barcode part1]
ttacgcaaccgtacag

SEQ ID NO: 27242 - DNA, 16 bp, Artificial Sequence
  synthetic [barcode part1]
tcaatcgtcgactgag

SEQ ID NO: 27243 - DNA, 16 bp, Artificial Sequence
  synthetic [barcode part1]
gactgtaatcagtgcc

SEQ ID NO: 27244 - DNA, 16 bp, Artificial Sequence
  synthetic [barcode part1]
cgttgtctaccagtgc

SEQ ID NO: 27245 - DNA, 16 bp, Artificial Sequence
  synthetic [barcode part1]
cggtcacactctctag

SEQ ID NO: 27246 - DNA, 16 bp, Artificial Sequence
  synthetic [barcode part1]
aggtcactaccagact

SEQ ID NO: 27247 - DNA, 16 bp, Artificial Sequence
  synthetic [barcode part1]
cctgatctgcacgatc

SEQ ID NO: 27248 - DNA, 16 bp, Artificial Sequence
  synthetic [barcode part1]
cgtctgtctcaagacc

SEQ ID NO: 27249 - DNA, 16 bp, Artificial Sequence
  synthetic [barcode part1]
gcaagttctggatacc

SEQ ID NO: 27250 - DNA, 16 bp, Artificial Sequence
  synthetic [barcode part1]
aactctgtcacttgtg

SEQ ID NO: 27251 - DNA, 16 bp, Artificial Sequence
  synthetic [barcode part1]
gtactaagaaggtcgt

SEQ ID NO: 27252 - DNA, 16 bp, Artificial Sequence
  synthetic [barcode part1]
ttatctctctccggtg

SEQ ID NO: 27253 - DNA, 16 bp, Artificial Sequence
  synthetic [barcode part1]
cgaccactacttcacg

SEQ ID NO: 27254 - DNA, 16 bp, Artificial Sequence
  synthetic [barcode part1]
tccggtggatacagag

SEQ ID NO: 27255 - DNA, 16 bp, Artificial Sequence
  synthetic [barcode part1]
aacgaaggtcgagagt

SEQ ID NO: 27256 - DNA, 16 bp, Artificial Sequence
  synthetic [barcode part1]
gagttgtaggtacaac

SEQ ID NO: 27257 - DNA, 16 bp, Artificial Sequence
  synthetic [barcode part1]
acacacttcgttgttg

SEQ ID NO: 27258 - DNA, 16 bp, Artificial Sequence
  synthetic [barcode part1]
tctgacctacaattgc

SEQ ID NO: 27259 - DNA, 16 bp, Artificial Sequence
  synthetic [barcode part1]
gtctcacagattaggc

SEQ ID NO: 27260 - DNA, 16 bp, Artificial Sequence
  synthetic [barcode part1]
gacgtgttgcacaact

SEQ ID NO: 27261 - DNA, 16 bp, Artificial Sequence
  synthetic [barcode part1]
ccgtatcgtgaagatc

SEQ ID NO: 27262 - DNA, 16 bp, Artificial Sequence
  synthetic [barcode part1]
agagtcttctggagtc

SEQ ID NO: 27263 - DNA, 16 bp, Artificial Sequence
  synthetic [barcode part1]
atagacttgacgaggt

SEQ ID NO: 27264 - DNA, 16 bp, Artificial Sequence
  synthetic [barcode part1]
gtcgtcgttaggttag

SEQ ID NO: 27265 - DNA, 16 bp, Artificial Sequence
  synthetic [barcode part1]
ttaccttccgaatacg

SEQ ID NO: 27266 - DNA, 16 bp, Artificial Sequence
  synthetic [barcode part1]
tgtcggcaattaagag

SEQ ID NO: 27267 - DNA, 16 bp, Artificial Sequence
  synthetic [barcode part1]
gattacactggaaggt

SEQ ID NO: 27268 - DNA, 16 bp, Artificial Sequence
  synthetic [barcode part1]
tactgcaacacacgtg

SEQ ID NO: 27269 - DNA, 16 bp, Artificial Sequence
  synthetic [barcode part1]
acaaggacgactcggt

SEQ ID NO: 27270 - DNA, 16 bp, Artificial Sequence
  synthetic [barcode part1]
acgagtgagtgagtag

SEQ ID NO: 27271 - DNA, 16 bp, Artificial Sequence
  synthetic [barcode part1]
gtactgatcagtgtgc

SEQ ID NO: 27272 - DNA, 16 bp, Artificial Sequence
  synthetic [barcode part1]
tgagtctgttctgccg

SEQ ID NO: 27273 - DNA, 16 bp, Artificial Sequence
  synthetic [barcode part1]
ttgtcttggcctatag

SEQ ID NO: 27274 - DNA, 16 bp, Artificial Sequence
  synthetic [barcode part1]
gcagtcactagttctt

SEQ ID NO: 27275 - DNA, 16 bp, Artificial Sequence
  synthetic [barcode part1]
gtgaactaaggtggcc

SEQ ID NO: 27276 - DNA, 16 bp, Artificial Sequence
  synthetic [barcode part1]
cactaaccacggttag

SEQ ID NO: 27277 - DNA, 16 bp, Artificial Sequence
  synthetic [barcode part1]
tgcgcaacagagaatt

SEQ ID NO: 27278 - DNA, 16 bp, Artificial Sequence
  synthetic [barcode part1]
tggcacaacacctagt

SEQ ID NO: 27279 - DNA, 16 bp, Artificial Sequence
  synthetic [barcode part1]
tgtgtgaagacgttcc

SEQ ID NO: 27280 - DNA, 16 bp, Artificial Sequence
  synthetic [barcode part1]
attctgcggtacactt

SEQ ID NO: 27281 - DNA, 16 bp, Artificial Sequence
  synthetic [barcode part1]
cagtatctctaaggcg

SEQ ID NO: 27282 - DNA, 16 bp, Artificial Sequence
  synthetic [barcode part1]
tggcctcagaagactt

SEQ ID NO: 27283 - DNA, 16 bp, Artificial Sequence
  synthetic [barcode part1]
acttcgacagttggtg

SEQ ID NO: 27284 - DNA, 16 bp, Artificial Sequence
  synthetic [barcode part1]
gagtgcagatcaccag

SEQ ID NO: 27285 - DNA, 16 bp, Artificial Sequence
  synthetic [barcode part1]
gccacacggagattag

SEQ ID NO: 27286 - DNA, 16 bp, Artificial Sequence
  synthetic [barcode part1]
ccacttagtgatacct

SEQ ID NO: 27287 - DNA, 16 bp, Artificial Sequence
  synthetic [barcode part1]
cagtataggagtggtt

SEQ ID NO: 27288 - DNA, 16 bp, Artificial Sequence
  synthetic [barcode part1]
cgttcctccgatagtg

SEQ ID NO: 27289 - DNA, 16 bp, Artificial Sequence
  synthetic [barcode part1]
acaggttacgtagtcc

SEQ ID NO: 27290 - DNA, 16 bp, Artificial Sequence
  synthetic [barcode part1]
gcctgaatctgttact

SEQ ID NO: 27291 - DNA, 16 bp, Artificial Sequence
  synthetic [barcode part1]
cgaacttgcctgtaag

SEQ ID NO: 27292 - DNA, 16 bp, Artificial Sequence
  synthetic [barcode part1]
agttggtgtgttgcac

SEQ ID NO: 27293 - DNA, 16 bp, Artificial Sequence
  synthetic [barcode part1]
atcaccagtgtaagag

SEQ ID NO: 27294 - DNA, 16 bp, Artificial Sequence
  synthetic [barcode part1]
taacctggaactaccg

SEQ ID NO: 27295 - DNA, 16 bp, Artificial Sequence
  synthetic [barcode part1]
taacagtctccgtgtt

SEQ ID NO: 27296 - DNA, 16 bp, Artificial Sequence
  synthetic [barcode part1]
gacctatcctgttgcg

SEQ ID NO: 27297 - DNA, 16 bp, Artificial Sequence
  synthetic [barcode part1]
aataccgactagtcgc

SEQ ID NO: 27298 - DNA, 16 bp, Artificial Sequence
  synthetic [barcode part1]
cgatatcgagtctcag

SEQ ID NO: 27299 - DNA, 16 bp, Artificial Sequence
  synthetic [barcode part1]
ttgcacagtgtaccag

SEQ ID NO: 27300 - DNA, 16 bp, Artificial Sequence
  synthetic [barcode part1]
aactgtaggaaggtct

SEQ ID NO: 27301 - DNA, 16 bp, Artificial Sequence
  synthetic [barcode part1]
tggccacaggttagag

SEQ ID NO: 27302 - DNA, 16 bp, Artificial Sequence
  synthetic [barcode part1]
accgacacttaatcct

SEQ ID NO: 27303 - DNA, 16 bp, Artificial Sequence
  synthetic [barcode part1]
tctccgtgagttattg

SEQ ID NO: 27304 - DNA, 16 bp, Artificial Sequence
  synthetic [barcode part1]
ttgttgtgtaggttcc

SEQ ID NO: 27305 - DNA, 16 bp, Artificial Sequence
  synthetic [barcode part1]
tcaaggtaacggacgc

SEQ ID NO: 27306 - DNA, 16 bp, Artificial Sequence
  synthetic [barcode part1]
acgaccgatactagtc

SEQ ID NO: 27307 - DNA, 16 bp, Artificial Sequence
  synthetic [barcode part1]
taacggtacgcggaac

SEQ ID NO: 27308 - DNA, 16 bp, Artificial Sequence
  synthetic [barcode part1]
gtacgatctgacctcc

SEQ ID NO: 27309 - DNA, 16 bp, Artificial Sequence
  synthetic [barcode part1]
tggtctcctaatctcc

SEQ ID NO: 27310 - DNA, 16 bp, Artificial Sequence
  synthetic [barcode part1]
gtactaacggtaaggt

SEQ ID NO: 27311 - DNA, 16 bp, Artificial Sequence
  synthetic [barcode part1]
gtcaggtggatcactt

SEQ ID NO: 27312 - DNA, 16 bp, Artificial Sequence
  synthetic [barcode part1]
aactcttgactacgtc

SEQ ID NO: 27313 - DNA, 16 bp, Artificial Sequence
  synthetic [barcode part1]
tgtgactgatccgtag

SEQ ID NO: 27314 - DNA, 16 bp, Artificial Sequence
  synthetic [barcode part1]
acgcacgaactagttc

SEQ ID NO: 27315 - DNA, 16 bp, Artificial Sequence
  synthetic [barcode part1]
ccaggtaagtgagatt

SEQ ID NO: 27316 - DNA, 16 bp, Artificial Sequence
  synthetic [barcode part1]
gttgtgataggcaggc

SEQ ID NO: 27317 - DNA, 16 bp, Artificial Sequence
  synthetic [barcode part1]
agtgcgactgtatctg

SEQ ID NO: 27318 - DNA, 16 bp, Artificial Sequence
  synthetic [barcode part1]
gacacgcaaggaatcc

SEQ ID NO: 27319 - DNA, 16 bp, Artificial Sequence
  synthetic [barcode part1]
ccgacctctactatct

SEQ ID NO: 27320 - DNA, 16 bp, Artificial Sequence
  synthetic [barcode part1]
taagtattggcgagac

SEQ ID NO: 27321 - DNA, 16 bp, Artificial Sequence
  synthetic [barcode part1]
tagttccacgccggtt

SEQ ID NO: 27322 - DNA, 16 bp, Artificial Sequence
  synthetic [barcode part1]
cgtcctagtctgcaac

SEQ ID NO: 27323 - DNA, 16 bp, Artificial Sequence
  synthetic [barcode part1]
cagactggaggtgtgt

SEQ ID NO: 27324 - DNA, 16 bp, Artificial Sequence
  synthetic [barcode part1]
aagttcaccgtcactt

SEQ ID NO: 27325 - DNA, 16 bp, Artificial Sequence
  synthetic [barcode part1]
agtgactgccgttaac

SEQ ID NO: 27326 - DNA, 16 bp, Artificial Sequence
  synthetic [barcode part1]
atatcggaatccgtgc

SEQ ID NO: 27327 - DNA, 16 bp, Artificial Sequence
  synthetic [barcode part1]
gtgccaggttaaggac

SEQ ID NO: 27328 - DNA, 16 bp, Artificial Sequence
  synthetic [barcode part1]
ttcagactccggtctg

SEQ ID NO: 27329 - DNA, 16 bp, Artificial Sequence
  synthetic [barcode part1]
gttgtgagtgacgttc

SEQ ID NO: 27330 - DNA, 16 bp, Artificial Sequence
  synthetic [barcode part1]
tgcagatcactcagac

SEQ ID NO: 27331 - DNA, 16 bp, Artificial Sequence
  synthetic [barcode part1]
gaggttgacacgatcg

SEQ ID NO: 27332 - DNA, 16 bp, Artificial Sequence
  synthetic [barcode part1]
ccaattctccggttct

SEQ ID NO: 27333 - DNA, 16 bp, Artificial Sequence
  synthetic [barcode part1]
atccgatcgtactccg

SEQ ID NO: 27334 - DNA, 16 bp, Artificial Sequence
  synthetic [barcode part1]
gcctgttctgcaacac

SEQ ID NO: 27335 - DNA, 16 bp, Artificial Sequence
  synthetic [barcode part1]
ttgattccacctcacc

SEQ ID NO: 27336 - DNA, 16 bp, Artificial Sequence
  synthetic [barcode part1]
tgcagatatcctactc

SEQ ID NO: 27337 - DNA, 16 bp, Artificial Sequence
  synthetic [barcode part1]
tgatacgcgatagaac

SEQ ID NO: 27338 - DNA, 16 bp, Artificial Sequence
  synthetic [barcode part1]
agtattgcacgcacgt

SEQ ID NO: 27339 - DNA, 16 bp, Artificial Sequence
  synthetic [barcode part1]
acctatcgtgacactt

SEQ ID NO: 27340 - DNA, 16 bp, Artificial Sequence
  synthetic [barcode part1]
gatacacactgtacgc

SEQ ID NO: 27341 - DNA, 16 bp, Artificial Sequence
  synthetic [barcode part1]
tacgtactgtgcacag

SEQ ID NO: 27342 - DNA, 16 bp, Artificial Sequence
  synthetic [barcode part1]
gtatcagttggtacgc

SEQ ID NO: 27343 - DNA, 16 bp, Artificial Sequence
  synthetic [barcode part1]
tcaagatcgccgtagt

SEQ ID NO: 27344 - DNA, 16 bp, Artificial Sequence
  synthetic [barcode part1]
tggcacactccactgt

SEQ ID NO: 27345 - DNA, 16 bp, Artificial Sequence
  synthetic [barcode part1]
cctataccgacgacct

SEQ ID NO: 27346 - DNA, 16 bp, Artificial Sequence
  synthetic [barcode part1]
tgcgagacgacagttg

SEQ ID NO: 27347 - DNA, 16 bp, Artificial Sequence
  synthetic [barcode part1]
tgtacgttgcacacag

SEQ ID NO: 27348 - DNA, 16 bp, Artificial Sequence
  synthetic [barcode part1]
gtaacgcaggatctct

SEQ ID NO: 27349 - DNA, 16 bp, Artificial Sequence
  synthetic [barcode part1]
gacttggtcttacgtt

SEQ ID NO: 27350 - DNA, 16 bp, Artificial Sequence
  synthetic [barcode part1]
cgtcactgttctctac

SEQ ID NO: 27351 - DNA, 16 bp, Artificial Sequence
  synthetic [barcode part1]
gcgaacaagatagacg

SEQ ID NO: 27352 - DNA, 16 bp, Artificial Sequence
  synthetic [barcode part1]
acctcaatcaaccgag

SEQ ID NO: 27353 - DNA, 16 bp, Artificial Sequence
  synthetic [barcode part1]
agatcgttattctcgc

SEQ ID NO: 27354 - DNA, 16 bp, Artificial Sequence
  synthetic [barcode part1]
tagactgactgccaac

SEQ ID NO: 27355 - DNA, 16 bp, Artificial Sequence
  synthetic [barcode part1]
gactggaaggtgtctg

SEQ ID NO: 27356 - DNA, 16 bp, Artificial Sequence
  synthetic [barcode part1]
ataacgacacctcacg

SEQ ID NO: 27357 - DNA, 16 bp, Artificial Sequence
  synthetic [barcode part1]
tcgtcctgttattccg

SEQ ID NO: 27358 - DNA, 16 bp, Artificial Sequence
  synthetic [barcode part1]
cgtgccaatcaatacg

SEQ ID NO: 27359 - DNA, 16 bp, Artificial Sequence
  synthetic [barcode part1]
cctgtaccgtattctc

SEQ ID NO: 27360 - DNA, 16 bp, Artificial Sequence
  synthetic [barcode part1]
tcgcacgttccaatcg

SEQ ID NO: 27361 - DNA, 16 bp, Artificial Sequence
  synthetic [barcode part1]
cgtgaacgtgaacctt

SEQ ID NO: 27362 - DNA, 16 bp, Artificial Sequence
  synthetic [barcode part1]
aacgacctcggtagtt

SEQ ID NO: 27363 - DNA, 16 bp, Artificial Sequence
  synthetic [barcode part1]
gcgtggtaccaatatc

SEQ ID NO: 27364 - DNA, 16 bp, Artificial Sequence
  synthetic [barcode part1]
ccagagataacggaag

SEQ ID NO: 27365 - DNA, 16 bp, Artificial Sequence
  synthetic [barcode part1]
ccgcagtgtcaattag

SEQ ID NO: 27366 - DNA, 16 bp, Artificial Sequence
  synthetic [barcode part1]
ttgcgcctgtcaggtt

SEQ ID NO: 27367 - DNA, 16 bp, Artificial Sequence
  synthetic [barcode part1]
ttacgcaagagttgag

SEQ ID NO: 27368 - DNA, 16 bp, Artificial Sequence
  synthetic [barcode part1]
aagtattcggaacgac

SEQ ID NO: 27369 - DNA, 16 bp, Artificial Sequence
  synthetic [barcode part1]
gtcaggtaacgcaggt

SEQ ID NO: 27370 - DNA, 16 bp, Artificial Sequence
  synthetic [barcode part1]
tggagagtgcgcaatc

SEQ ID NO: 27371 - DNA, 16 bp, Artificial Sequence
  synthetic [barcode part1]
cgagttaccgatagtc

SEQ ID NO: 27372 - DNA, 16 bp, Artificial Sequence
  synthetic [barcode part1]
tctgccaactatcctc

SEQ ID NO: 27373 - DNA, 16 bp, Artificial Sequence
  synthetic [barcode part1]
agaccaggtcgatacg

SEQ ID NO: 27374 - DNA, 16 bp, Artificial Sequence
  synthetic [barcode part1]
cagtgacagtcactgt

SEQ ID NO: 27375 - DNA, 16 bp, Artificial Sequence
  synthetic [barcode part1]
atccgatcgtatcttg

SEQ ID NO: 27376 - DNA, 16 bp, Artificial Sequence
  synthetic [barcode part1]
gcaacaccaacactgt

SEQ ID NO: 27377 - DNA, 16 bp, Artificial Sequence
  synthetic [barcode part1]
atactccgttgtcagt

SEQ ID NO: 27378 - DNA, 16 bp, Artificial Sequence
  synthetic [barcode part1]
gtgcaatcaatcgcac

SEQ ID NO: 27379 - DNA, 16 bp, Artificial Sequence
  synthetic [barcode part1]
atcttactcgcgtggc

SEQ ID NO: 27380 - DNA, 16 bp, Artificial Sequence
  synthetic [barcode part1]
caggtcgcaataatcc

SEQ ID NO: 27381 - DNA, 16 bp, Artificial Sequence
  synthetic [barcode part1]
cgaagttgcgttgtac

SEQ ID NO: 27382 - DNA, 16 bp, Artificial Sequence
  synthetic [barcode part1]
tgagactcacaacacc

SEQ ID NO: 27383 - DNA, 16 bp, Artificial Sequence
  synthetic [barcode part1]
gtattctgtcaccaac

SEQ ID NO: 27384 - DNA, 16 bp, Artificial Sequence
  synthetic [barcode part1]
gattaagatccaggtg

SEQ ID NO: 27385 - DNA, 16 bp, Artificial Sequence
  synthetic [barcode part1]
gcctctactatcaggc

SEQ ID NO: 27386 - DNA, 16 bp, Artificial Sequence
  synthetic [barcode part1]
gaccgcgttaattctt

SEQ ID NO: 27387 - DNA, 16 bp, Artificial Sequence
  synthetic [barcode part1]
aattctagtccacctg

SEQ ID NO: 27388 - DNA, 16 bp, Artificial Sequence
  synthetic [barcode part1]
tctgattgtgcgttac

SEQ ID NO: 27389 - DNA, 16 bp, Artificial Sequence
  synthetic [barcode part1]
gaacgtggtattcctg

SEQ ID NO: 27390 - DNA, 16 bp, Artificial Sequence
  synthetic [barcode part1]
tctcaacaccactcct

SEQ ID NO: 27391 - DNA, 16 bp, Artificial Sequence
  synthetic [barcode part1]
ttaggtcgcactcctg

SEQ ID NO: 27392 - DNA, 16 bp, Artificial Sequence
  synthetic [barcode part1]
tcgcaattcggagttg

SEQ ID NO: 27393 - DNA, 16 bp, Artificial Sequence
  synthetic [barcode part1]
gacgtccacgagatag

SEQ ID NO: 27394 - DNA, 16 bp, Artificial Sequence
  synthetic [barcode part1]
tcaagtgttgtctcac

SEQ ID NO: 27395 - DNA, 16 bp, Artificial Sequence
  synthetic [barcode part1]
acttcgagttgcagtg

SEQ ID NO: 27396 - DNA, 16 bp, Artificial Sequence
  synthetic [barcode part1]
gcgccaggagaattgt

SEQ ID NO: 27397 - DNA, 16 bp, Artificial Sequence
  synthetic [barcode part1]
tacgttcacctggcgt

SEQ ID NO: 27398 - DNA, 16 bp, Artificial Sequence
  synthetic [barcode part1]
tctactatctccgacc

SEQ ID NO: 27399 - DNA, 16 bp, Artificial Sequence
  synthetic [barcode part1]
gtgattcggattgtcg

SEQ ID NO: 27400 - DNA, 16 bp, Artificial Sequence
  synthetic [barcode part1]
tcgcgagtattccgtc

SEQ ID NO: 27401 - DNA, 16 bp, Artificial Sequence
  synthetic [barcode part1]
caccaggacaacttac

SEQ ID NO: 27402 - DNA, 16 bp, Artificial Sequence
  synthetic [barcode part1]
tcaagatctcactcgt

SEQ ID NO: 27403 - DNA, 16 bp, Artificial Sequence
  synthetic [barcode part1]
tctaccaagtctacgt

SEQ ID NO: 27404 - DNA, 16 bp, Artificial Sequence
  synthetic [barcode part1]
aagatcaccgaacgcg

SEQ ID NO: 27405 - DNA, 16 bp, Artificial Sequence
  synthetic [barcode part1]
tgcgatacttgttcac

SEQ ID NO: 27406 - DNA, 16 bp, Artificial Sequence
  synthetic [barcode part1]
tcagtgttgaccacag

SEQ ID NO: 27407 - DNA, 16 bp, Artificial Sequence
  synthetic [barcode part1]
tccgtaaggacttgtg

SEQ ID NO: 27408 - DNA, 16 bp, Artificial Sequence
  synthetic [barcode part1]
tgtagtcggagtgacg

SEQ ID NO: 27409 - DNA, 16 bp, Artificial Sequence
  synthetic [barcode part1]
gttaattcgcgcacag

SEQ ID NO: 27410 - DNA, 16 bp, Artificial Sequence
  synthetic [barcode part1]
ccacctaacctcgaac

SEQ ID NO: 27411 - DNA, 16 bp, Artificial Sequence
  synthetic [barcode part1]
cgtccactgttgtggt

SEQ ID NO: 27412 - DNA, 16 bp, Artificial Sequence
  synthetic [barcode part1]
ttacacttctggcggc

SEQ ID NO: 27413 - DNA, 16 bp, Artificial Sequence
  synthetic [barcode part1]
aactcgatcttgcgcc

SEQ ID NO: 27414 - DNA, 16 bp, Artificial Sequence
  synthetic [barcode part1]
tgttcactccagagtt

SEQ ID NO: 27415 - DNA, 16 bp, Artificial Sequence
  synthetic [barcode part1]
tcgtaaccgacgttag

SEQ ID NO: 27416 - DNA, 16 bp, Artificial Sequence
  synthetic [barcode part1]
atcttgccactagtgt

SEQ ID NO: 27417 - DNA, 16 bp, Artificial Sequence
  synthetic [barcode part1]
cggatcagtgcaaggt

SEQ ID NO: 27418 - DNA, 16 bp, Artificial Sequence
  synthetic [barcode part1]
tcaacagttcaacggc

SEQ ID NO: 27419 - DNA, 16 bp, Artificial Sequence
  synthetic [barcode part1]
agaggtcttcctcaag

SEQ ID NO: 27420 - DNA, 16 bp, Artificial Sequence
  synthetic [barcode part1]
actagaatcttggccg

SEQ ID NO: 27421 - DNA, 16 bp, Artificial Sequence
  synthetic [barcode part1]
cggcactacctatctg

SEQ ID NO: 27422 - DNA, 16 bp, Artificial Sequence
  synthetic [barcode part1]
tgtagtgccacaacac

SEQ ID NO: 27423 - DNA, 16 bp, Artificial Sequence
  synthetic [barcode part1]
gttaataacgaggcac

SEQ ID NO: 27424 - DNA, 16 bp, Artificial Sequence
  synthetic [barcode part1]
gaactaagtatcggtg

SEQ ID NO: 27425 - DNA, 16 bp, Artificial Sequence
  synthetic [barcode part1]
agtaccttaccttacg

SEQ ID NO: 27426 - DNA, 16 bp, Artificial Sequence
  synthetic [barcode part1]
gcggcagagtatactg

SEQ ID NO: 27427 - DNA, 16 bp, Artificial Sequence
  synthetic [barcode part1]
tcgagatctacttgtc

SEQ ID NO: 27428 - DNA, 16 bp, Artificial Sequence
  synthetic [barcode part1]
cctatcgttcttggtc

SEQ ID NO: 27429 - DNA, 16 bp, Artificial Sequence
  synthetic [barcode part1]
atcgccgtaataaccg

SEQ ID NO: 27430 - DNA, 16 bp, Artificial Sequence
  synthetic [barcode part1]
gacgttggactctagt

SEQ ID NO: 27431 - DNA, 16 bp, Artificial Sequence
  synthetic [barcode part1]
tccgatcgtaccagtc

SEQ ID NO: 27432 - DNA, 16 bp, Artificial Sequence
  synthetic [barcode part1]
taggaggtgtggttgc

SEQ ID NO: 27433 - DNA, 16 bp, Artificial Sequence
  synthetic [barcode part1]
ttgtccagtcttgagt

SEQ ID NO: 27434 - DNA, 16 bp, Artificial Sequence
  synthetic [barcode part1]
ttccgtgttgaattgc

SEQ ID NO: 27435 - DNA, 16 bp, Artificial Sequence
  synthetic [barcode part1]
tggaaccgccgtaatt

SEQ ID NO: 27436 - DNA, 16 bp, Artificial Sequence
  synthetic [barcode part1]
tggttgtgtgaggcag

SEQ ID NO: 27437 - DNA, 16 bp, Artificial Sequence
  synthetic [barcode part1]
tgtgtcaacgtgtcag

SEQ ID NO: 27438 - DNA, 16 bp, Artificial Sequence
  synthetic [barcode part1]
cggagagtaacgcgtt

SEQ ID NO: 27439 - DNA, 16 bp, Artificial Sequence
  synthetic [barcode part1]
gttaggtgaacgtggc

SEQ ID NO: 27440 - DNA, 16 bp, Artificial Sequence
  synthetic [barcode part1]
accagtggtaggacgt

SEQ ID NO: 27441 - DNA, 16 bp, Artificial Sequence
  synthetic [barcode part1]
ttggcagacctccgtt

SEQ ID NO: 27442 - DNA, 16 bp, Artificial Sequence
  synthetic [barcode part1]
atcctagtggttggtg

SEQ ID NO: 27443 - DNA, 16 bp, Artificial Sequence
  synthetic [barcode part1]
gacgtactgtgtggtt

SEQ ID NO: 27444 - DNA, 16 bp, Artificial Sequence
  synthetic [barcode part1]
aggtggatcgcagtac

SEQ ID NO: 27445 - DNA, 16 bp, Artificial Sequence
  synthetic [barcode part1]
cgtggtaggtactact

SEQ ID NO: 27446 - DNA, 16 bp, Artificial Sequence
  synthetic [barcode part1]
tggtcttcgtaatcgt

SEQ ID NO: 27447 - DNA, 16 bp, Artificial Sequence
  synthetic [barcode part1]
acgccttattgccgac

SEQ ID NO: 27448 - DNA, 16 bp, Artificial Sequence
  synthetic [barcode part1]
tggaatcgcgttgtac

SEQ ID NO: 27449 - DNA, 16 bp, Artificial Sequence
  synthetic [barcode part1]
tgtcagttgcacaacg

SEQ ID NO: 27450 - DNA, 16 bp, Artificial Sequence
  synthetic [barcode part1]
actgacggtctaggtt

SEQ ID NO: 27451 - DNA, 16 bp, Artificial Sequence
  synthetic [barcode part1]
tcacagtacacacgtg

SEQ ID NO: 27452 - DNA, 16 bp, Artificial Sequence
  synthetic [barcode part1]
ttgtgtgcacacagtg

SEQ ID NO: 27453 - DNA, 16 bp, Artificial Sequence
  synthetic [barcode part1]
acaacgccttcaaggt

SEQ ID NO: 27454 - DNA, 16 bp, Artificial Sequence
  synthetic [barcode part1]
tctactggtgtaacct

SEQ ID NO: 27455 - DNA, 16 bp, Artificial Sequence
  synthetic [barcode part1]
cggagattctgtatcg

SEQ ID NO: 27456 - DNA, 16 bp, Artificial Sequence
  synthetic [barcode part1]
acaacggataggacag

SEQ ID NO: 27457 - DNA, 16 bp, Artificial Sequence
  synthetic [barcode part1]
attcacgtaacaggag

SEQ ID NO: 27458 - DNA, 16 bp, Artificial Sequence
  synthetic [barcode part1]
cgaagttaggaccttc

SEQ ID NO: 27459 - DNA, 16 bp, Artificial Sequence
  synthetic [barcode part1]
actaattcgcgcgtag

SEQ ID NO: 27460 - DNA, 16 bp, Artificial Sequence
  synthetic [barcode part1]
ttagttcggtgtatcc

SEQ ID NO: 27461 - DNA, 16 bp, Artificial Sequence
  synthetic [barcode part1]
tacgtcagatcctccg

SEQ ID NO: 27462 - DNA, 16 bp, Artificial Sequence
  synthetic [barcode part1]
agtcttcctaacacgt

SEQ ID NO: 27463 - DNA, 16 bp, Artificial Sequence
  synthetic [barcode part1]
tatctctgttaccgag

SEQ ID NO: 27464 - DNA, 16 bp, Artificial Sequence
  synthetic [barcode part1]
tgcggatcgaatacct

SEQ ID NO: 27465 - DNA, 16 bp, Artificial Sequence
  synthetic [barcode part1]
gataattgccgccaac

SEQ ID NO: 27466 - DNA, 16 bp, Artificial Sequence
  synthetic [barcode part1]
gaacacttaagacgac

SEQ ID NO: 27467 - DNA, 16 bp, Artificial Sequence
  synthetic [barcode part1]
gtcagaccagatcact

SEQ ID NO: 27468 - DNA, 16 bp, Artificial Sequence
  synthetic [barcode part1]
tcgagatcggaattcc

SEQ ID NO: 27469 - DNA, 16 bp, Artificial Sequence
  synthetic [barcode part1]
tcgcactgtggttcac

SEQ ID NO: 27470 - DNA, 16 bp, Artificial Sequence
  synthetic [barcode part1]
cactcgcacagtacct

SEQ ID NO: 27471 - DNA, 16 bp, Artificial Sequence
  synthetic [barcode part1]
tacgaacgcaacggac

SEQ ID NO: 27472 - DNA, 16 bp, Artificial Sequence
  synthetic [barcode part1]
tggcgtgtctcactac

SEQ ID NO: 27473 - DNA, 16 bp, Artificial Sequence
  synthetic [barcode part1]
acactgtctgtccgtg

SEQ ID NO: 27474 - DNA, 16 bp, Artificial Sequence
  synthetic [barcode part1]
accaggagattaggag

SEQ ID NO: 27475 - DNA, 16 bp, Artificial Sequence
  synthetic [barcode part1]
ttcttccgtcggttac

SEQ ID NO: 27476 - DNA, 16 bp, Artificial Sequence
  synthetic [barcode part1]
cctctggcacgattgt

SEQ ID NO: 27477 - DNA, 16 bp, Artificial Sequence
  synthetic [barcode part1]
aattcctaactgcacc

SEQ ID NO: 27478 - DNA, 16 bp, Artificial Sequence
  synthetic [barcode part1]
tcgtaaccttcggaag

SEQ ID NO: 27479 - DNA, 16 bp, Artificial Sequence
  synthetic [barcode part1]
agaccgtggtataagt

SEQ ID NO: 27480 - DNA, 16 bp, Artificial Sequence
  synthetic [barcode part1]
gcaaccgataccaatc

SEQ ID NO: 27481 - DNA, 16 bp, Artificial Sequence
  synthetic [barcode part1]
attgcgtgattacgcg

SEQ ID NO: 27482 - DNA, 16 bp, Artificial Sequence
  synthetic [barcode part1]
aactcagagtccaacc

SEQ ID NO: 27483 - DNA, 16 bp, Artificial Sequence
  synthetic [barcode part1]
gcgcgactgatatact

SEQ ID NO: 27484 - DNA, 16 bp, Artificial Sequence
  synthetic [barcode part1]
tcctatactagtgacc

SEQ ID NO: 27485 - DNA, 16 bp, Artificial Sequence
  synthetic [barcode part1]
aataactccagaccgc

SEQ ID NO: 27486 - DNA, 16 bp, Artificial Sequence
  synthetic [barcode part1]
gacgtatatactggcc

SEQ ID NO: 27487 - DNA, 16 bp, Artificial Sequence
  synthetic [barcode part1]
ccgtagacgagaggtt

SEQ ID NO: 27488 - DNA, 16 bp, Artificial Sequence
  synthetic [barcode part1]
attatacgtcgccttg

SEQ ID NO: 27489 - DNA, 16 bp, Artificial Sequence
  synthetic [barcode part1]
tggtgttgtcctgaag

SEQ ID NO: 27490 - DNA, 16 bp, Artificial Sequence
  synthetic [barcode part1]
gtaatcctctgtgccg

SEQ ID NO: 27491 - DNA, 16 bp, Artificial Sequence
  synthetic [barcode part1]
ttgcagtcacacacag

SEQ ID NO: 27492 - DNA, 16 bp, Artificial Sequence
  synthetic [barcode part1]
tggtatccaagatccg

SEQ ID NO: 27493 - DNA, 16 bp, Artificial Sequence
  synthetic [barcode part1]
tactcttccggcaacg

SEQ ID NO: 27494 - DNA, 16 bp, Artificial Sequence
  synthetic [barcode part1]
acaagtcgtgtctgac

SEQ ID NO: 27495 - DNA, 16 bp, Artificial Sequence
  synthetic [barcode part1]
aaggtggtctgttgtc

SEQ ID NO: 27496 - DNA, 16 bp, Artificial Sequence
  synthetic [barcode part1]
tcagttgcgcgtatag

SEQ ID NO: 27497 - DNA, 16 bp, Artificial Sequence
  synthetic [barcode part1]
gcacgatagtcttctt

SEQ ID NO: 27498 - DNA, 16 bp, Artificial Sequence
  synthetic [barcode part1]
aacggacgcgatactg

SEQ ID NO: 27499 - DNA, 16 bp, Artificial Sequence
  synthetic [barcode part1]
agaggtcttgatctcg

SEQ ID NO: 27500 - DNA, 16 bp, Artificial Sequence
  synthetic [barcode part1]
aggtgtcttcgccact

SEQ ID NO: 27501 - DNA, 16 bp, Artificial Sequence
  synthetic [barcode part1]
caccttgaggcctatc

SEQ ID NO: 27502 - DNA, 16 bp, Artificial Sequence
  synthetic [barcode part1]
tctcgacgtattcaac

SEQ ID NO: 27503 - DNA, 16 bp, Artificial Sequence
  synthetic [barcode part1]
agtgtggtcgtcagag

SEQ ID NO: 27504 - DNA, 16 bp, Artificial Sequence
  synthetic [barcode part1]
aggttgtggtagtctc

SEQ ID NO: 27505 - DNA, 16 bp, Artificial Sequence
  synthetic [barcode part1]
acagtaacgagaggtg

SEQ ID NO: 27506 - DNA, 16 bp, Artificial Sequence
  synthetic [barcode part1]
ttcaggtccaccgttg

SEQ ID NO: 27507 - DNA, 16 bp, Artificial Sequence
  synthetic [barcode part1]
accgtaacgcctatcc

SEQ ID NO: 27508 - DNA, 16 bp, Artificial Sequence
  synthetic [barcode part1]
atccaccttacctgtc

SEQ ID NO: 27509 - DNA, 16 bp, Artificial Sequence
  synthetic [barcode part1]
cgcctacttatccgtt

SEQ ID NO: 27510 - DNA, 16 bp, Artificial Sequence
  synthetic [barcode part1]
aggattccagacggac

SEQ ID NO: 27511 - DNA, 16 bp, Artificial Sequence
  synthetic [barcode part1]
ccgttctctgatatag

SEQ ID NO: 27512 - DNA, 16 bp, Artificial Sequence
  synthetic [barcode part1]
tgtagacgacaggacc

SEQ ID NO: 27513 - DNA, 16 bp, Artificial Sequence
  synthetic [barcode part1]
agtgatataccgtccg

SEQ ID NO: 27514 - DNA, 16 bp, Artificial Sequence
  synthetic [barcode part1]
gacacactgcagttgt

SEQ ID NO: 27515 - DNA, 16 bp, Artificial Sequence
  synthetic [barcode part1]
tgcagttagagatcag

SEQ ID NO: 27516 - DNA, 16 bp, Artificial Sequence
  synthetic [barcode part1]
agaagtagacgattcc

SEQ ID NO: 27517 - DNA, 16 bp, Artificial Sequence
  synthetic [barcode part1]
aagtccgtccgacctt

SEQ ID NO: 27518 - DNA, 16 bp, Artificial Sequence
  synthetic [barcode part1]
acgccaacctccagtt

SEQ ID NO: 27519 - DNA, 16 bp, Artificial Sequence
  synthetic [barcode part1]
taaggcctggtgttgt

SEQ ID NO: 27520 - DNA, 16 bp, Artificial Sequence
  synthetic [barcode part1]
cgcgttccaggttact

SEQ ID NO: 27521 - DNA, 16 bp, Artificial Sequence
  synthetic [barcode part1]
gtgttagaaggattgc

SEQ ID NO: 27522 - DNA, 16 bp, Artificial Sequence
  synthetic [barcode part1]
ttacgcctaagttacc

SEQ ID NO: 27523 - DNA, 16 bp, Artificial Sequence
  synthetic [barcode part1]
caccagagtagagatt

SEQ ID NO: 27524 - DNA, 16 bp, Artificial Sequence
  synthetic [barcode part1]
attgtggagattccgc

SEQ ID NO: 27525 - DNA, 16 bp, Artificial Sequence
  synthetic [barcode part1]
tgttggtaagaccaag

SEQ ID NO: 27526 - DNA, 16 bp, Artificial Sequence
  synthetic [barcode part1]
cctgtggtattgtccg

SEQ ID NO: 27527 - DNA, 16 bp, Artificial Sequence
  synthetic [barcode part1]
caggtataaggactac

SEQ ID NO: 27528 - DNA, 16 bp, Artificial Sequence
  synthetic [barcode part1]
tcagtagtgccttcgc

SEQ ID NO: 27529 - DNA, 16 bp, Artificial Sequence
  synthetic [barcode part1]
tgtgcctaatagtctc

SEQ ID NO: 27530 - DNA, 16 bp, Artificial Sequence
  synthetic [barcode part1]
gtacggaggtgacttg

SEQ ID NO: 27531 - DNA, 16 bp, Artificial Sequence
  synthetic [barcode part1]
agaccgtgaactgtct

SEQ ID NO: 27532 - DNA, 16 bp, Artificial Sequence
  synthetic [barcode part1]
gttcgcctagagtcct

SEQ ID NO: 27533 - DNA, 16 bp, Artificial Sequence
  synthetic [barcode part1]
aatcagtgccgtgact

SEQ ID NO: 27534 - DNA, 16 bp, Artificial Sequence
  synthetic [barcode part1]
gttcttagtcctcgtc

SEQ ID NO: 27535 - DNA, 16 bp, Artificial Sequence
  synthetic [barcode part1]
aaccacgtcaacttct

SEQ ID NO: 27536 - DNA, 16 bp, Artificial Sequence
  synthetic [barcode part1]
tagagaggcgtaccgt

SEQ ID NO: 27537 - DNA, 16 bp, Artificial Sequence
  synthetic [barcode part1]
ataggcctaatcctct

SEQ ID NO: 27538 - DNA, 16 bp, Artificial Sequence
  synthetic [barcode part1]
aggagtgtgttcttgc

SEQ ID NO: 27539 - DNA, 16 bp, Artificial Sequence
  synthetic [barcode part1]
attcctgccacgttct

SEQ ID NO: 27540 - DNA, 16 bp, Artificial Sequence
  synthetic [barcode part1]
tactggatactggacc

SEQ ID NO: 27541 - DNA, 16 bp, Artificial Sequence
  synthetic [barcode part1]
agatagacaggatctc

SEQ ID NO: 27542 - DNA, 16 bp, Artificial Sequence
  synthetic [barcode part1]
tctagtcctgactcct

SEQ ID NO: 27543 - DNA, 16 bp, Artificial Sequence
  synthetic [barcode part1]
cggtaacacgcaaggt

SEQ ID NO: 27544 - DNA, 16 bp, Artificial Sequence
  synthetic [barcode part1]
caacagtgcgcagaac

SEQ ID NO: 27545 - DNA, 16 bp, Artificial Sequence
  synthetic [barcode part1]
ttgaacgtcgcctcac

SEQ ID NO: 27546 - DNA, 16 bp, Artificial Sequence
  synthetic [barcode part1]
taaggccttctctcct

SEQ ID NO: 27547 - DNA, 16 bp, Artificial Sequence
  synthetic [barcode part1]
atcggtggtaaggcgt

SEQ ID NO: 27548 - DNA, 16 bp, Artificial Sequence
  synthetic [barcode part1]
ttcctctgagaaggac

SEQ ID NO: 27549 - DNA, 16 bp, Artificial Sequence
  synthetic [barcode part1]
gttacaccacagatcg

SEQ ID NO: 27550 - DNA, 16 bp, Artificial Sequence
  synthetic [barcode part1]
atctctacgtctctgc

SEQ ID NO: 27551 - DNA, 16 bp, Artificial Sequence
  synthetic [barcode part1]
tggccttagttaaggc

SEQ ID NO: 27552 - DNA, 16 bp, Artificial Sequence
  synthetic [barcode part1]
tggacgcaggagttac

SEQ ID NO: 27553 - DNA, 16 bp, Artificial Sequence
  synthetic [barcode part1]
aatcgaaccgtgtaag

SEQ ID NO: 27554 - DNA, 16 bp, Artificial Sequence
  synthetic [barcode part1]
tgttcgcgtcctagac

SEQ ID NO: 27555 - DNA, 16 bp, Artificial Sequence
  synthetic [barcode part1]
ataccttgattcggtc

SEQ ID NO: 27556 - DNA, 16 bp, Artificial Sequence
  synthetic [barcode part1]
agatacactggatcag

SEQ ID NO: 27557 - DNA, 16 bp, Artificial Sequence
  synthetic [barcode part1]
atcacgactgcagtac

SEQ ID NO: 27558 - DNA, 16 bp, Artificial Sequence
  synthetic [barcode part1]
gcacagattacgtctg

SEQ ID NO: 27559 - DNA, 16 bp, Artificial Sequence
  synthetic [barcode part1]
cctgtaatctgtcgcg

SEQ ID NO: 27560 - DNA, 16 bp, Artificial Sequence
  synthetic [barcode part1]
gtcttcctgcgactag

SEQ ID NO: 27561 - DNA, 16 bp, Artificial Sequence
  synthetic [barcode part1]
atatctcgagaacgcc

SEQ ID NO: 27562 - DNA, 16 bp, Artificial Sequence
  synthetic [barcode part1]
atccaggagtagagtt

SEQ ID NO: 27563 - DNA, 16 bp, Artificial Sequence
  synthetic [barcode part1]
ataatctgcctctgtg

SEQ ID NO: 27564 - DNA, 16 bp, Artificial Sequence
  synthetic [barcode part1]
cagagtcgtgtacgtt

SEQ ID NO: 27565 - DNA, 16 bp, Artificial Sequence
  synthetic [barcode part1]
gcgaacttggcgaagt

SEQ ID NO: 27566 - DNA, 16 bp, Artificial Sequence
  synthetic [barcode part1]
caacctattcgcaccg

SEQ ID NO: 27567 - DNA, 16 bp, Artificial Sequence
  synthetic [barcode part1]
acagagacgacaatct

SEQ ID NO: 27568 - DNA, 16 bp, Artificial Sequence
  synthetic [barcode part1]
aatccactctaggcag

SEQ ID NO: 27569 - DNA, 16 bp, Artificial Sequence
  synthetic [barcode part1]
gcactaagaagattgc

SEQ ID NO: 27570 - DNA, 16 bp, Artificial Sequence
  synthetic [barcode part1]
gtgcaacaaccgaggt

SEQ ID NO: 27571 - DNA, 16 bp, Artificial Sequence
  synthetic [barcode part1]
gagtcagactgcgtag

SEQ ID NO: 27572 - DNA, 16 bp, Artificial Sequence
  synthetic [barcode part1]
gtatccttagttcggt

SEQ ID NO: 27573 - DNA, 16 bp, Artificial Sequence
  synthetic [barcode part1]
acaatccactcttgtg

SEQ ID NO: 27574 - DNA, 16 bp, Artificial Sequence
  synthetic [barcode part1]
attggtggtctagacc

SEQ ID NO: 27575 - DNA, 16 bp, Artificial Sequence
  synthetic [barcode part1]
gtagtctggcacgaag

SEQ ID NO: 27576 - DNA, 16 bp, Artificial Sequence
  synthetic [barcode part1]
gtaggccagaacgatc

SEQ ID NO: 27577 - DNA, 16 bp, Artificial Sequence
  synthetic [barcode part1]
gatctaacttccgtgt

SEQ ID NO: 27578 - DNA, 16 bp, Artificial Sequence
  synthetic [barcode part1]
gtcaacggtccgaatt

SEQ ID NO: 27579 - DNA, 16 bp, Artificial Sequence
  synthetic [barcode part1]
gcgtagtctaactctt

SEQ ID NO: 27580 - DNA, 16 bp, Artificial Sequence
  synthetic [barcode part1]
tacagacacaggtctc

SEQ ID NO: 27581 - DNA, 16 bp, Artificial Sequence
  synthetic [barcode part1]
gaactgcaggtgtggt

SEQ ID NO: 27582 - DNA, 16 bp, Artificial Sequence
  synthetic [barcode part1]
taacgactggcaactc

SEQ ID NO: 27583 - DNA, 16 bp, Artificial Sequence
  synthetic [barcode part1]
tgcaccgttcctcaag

SEQ ID NO: 27584 - DNA, 16 bp, Artificial Sequence
  synthetic [barcode part1]
aacgatcgaggtatac

SEQ ID NO: 27585 - DNA, 16 bp, Artificial Sequence
  synthetic [barcode part1]
gttacctgatatccgt

SEQ ID NO: 27586 - DNA, 16 bp, Artificial Sequence
  synthetic [barcode part1]
gtcgcacgagaatcag

SEQ ID NO: 27587 - DNA, 16 bp, Artificial Sequence
  synthetic [barcode part1]
actaatactgccgttc

SEQ ID NO: 27588 - DNA, 16 bp, Artificial Sequence
  synthetic [barcode part1]
tgcgtaagttcgaacc

SEQ ID NO: 27589 - DNA, 16 bp, Artificial Sequence
  synthetic [barcode part1]
caagtcaggaggtacc

SEQ ID NO: 27590 - DNA, 16 bp, Artificial Sequence
  synthetic [barcode part1]
gcaatcttggactgtg

SEQ ID NO: 27591 - DNA, 16 bp, Artificial Sequence
  synthetic [barcode part1]
gcgcgagtattgaacg

SEQ ID NO: 27592 - DNA, 16 bp, Artificial Sequence
  synthetic [barcode part1]
gaccttagagtaggcg

SEQ ID NO: 27593 - DNA, 16 bp, Artificial Sequence
  synthetic [barcode part1]
gttgtaacggataggt

SEQ ID NO: 27594 - DNA, 16 bp, Artificial Sequence
  synthetic [barcode part1]
ttggagttgagacctc

SEQ ID NO: 27595 - DNA, 16 bp, Artificial Sequence
  synthetic [barcode part1]
tacgcaataggcctac

SEQ ID NO: 27596 - DNA, 16 bp, Artificial Sequence
  synthetic [barcode part1]
cgcgcagtaaggaact

SEQ ID NO: 27597 - DNA, 16 bp, Artificial Sequence
  synthetic [barcode part1]
actctcgattctcgtc

SEQ ID NO: 27598 - DNA, 16 bp, Artificial Sequence
  synthetic [barcode part1]
ccacacttagattacc

SEQ ID NO: 27599 - DNA, 16 bp, Artificial Sequence
  synthetic [barcode part1]
ttctcctctcttctcc

SEQ ID NO: 27600 - DNA, 16 bp, Artificial Sequence
  synthetic [barcode part1]
ttcgcgtgtataaggc

SEQ ID NO: 27601 - DNA, 16 bp, Artificial Sequence
  synthetic [barcode part1]
tactattgtggccgtt

SEQ ID NO: 27602 - DNA, 16 bp, Artificial Sequence
  synthetic [barcode part1]
gtgtcaacgcaagttc

SEQ ID NO: 27603 - DNA, 16 bp, Artificial Sequence
  synthetic [barcode part1]
tgttgcctactctacc

SEQ ID NO: 27604 - DNA, 16 bp, Artificial Sequence
  synthetic [barcode part1]
gacaatattcaccgcg

SEQ ID NO: 27605 - DNA, 16 bp, Artificial Sequence
  synthetic [barcode part1]
tggcgtagatctgtgt

SEQ ID NO: 27606 - DNA, 16 bp, Artificial Sequence
  synthetic [barcode part1]
gttgatatctggtcct

SEQ ID NO: 27607 - DNA, 16 bp, Artificial Sequence
  synthetic [barcode part1]
tccaattgtgtgccgc

SEQ ID NO: 27608 - DNA, 16 bp, Artificial Sequence
  synthetic [barcode part1]
gacagacaacggatag

SEQ ID NO: 27609 - DNA, 16 bp, Artificial Sequence
  synthetic [barcode part1]
ccacagattcagttct

SEQ ID NO: 27610 - DNA, 16 bp, Artificial Sequence
  synthetic [barcode part1]
tgaagttgcaccacgt

SEQ ID NO: 27611 - DNA, 16 bp, Artificial Sequence
  synthetic [barcode part1]
gaaggtggacgattcc

SEQ ID NO: 27612 - DNA, 16 bp, Artificial Sequence
  synthetic [barcode part1]
acagactagaacggcc

SEQ ID NO: 27613 - DNA, 16 bp, Artificial Sequence
  synthetic [barcode part1]
gcggatacttgttcag

SEQ ID NO: 27614 - DNA, 16 bp, Artificial Sequence
  synthetic [barcode part1]
tgagtggactctggag

SEQ ID NO: 27615 - DNA, 16 bp, Artificial Sequence
  synthetic [barcode part1]
acaacctcgttagacg

SEQ ID NO: 27616 - DNA, 16 bp, Artificial Sequence
  synthetic [barcode part1]
gtggcacaatcagttc

SEQ ID NO: 27617 - DNA, 16 bp, Artificial Sequence
  synthetic [barcode part1]
tgcgagtcagatacct

SEQ ID NO: 27618 - DNA, 16 bp, Artificial Sequence
  synthetic [barcode part1]
gtattggacgtgatcc

SEQ ID NO: 27619 - DNA, 16 bp, Artificial Sequence
  synthetic [barcode part1]
agactgtcaggagtgc

SEQ ID NO: 27620 - DNA, 16 bp, Artificial Sequence
  synthetic [barcode part1]
gattccttcctcgact

SEQ ID NO: 27621 - DNA, 16 bp, Artificial Sequence
  synthetic [barcode part1]
ttcctaacgtgtgatc

SEQ ID NO: 27622 - DNA, 16 bp, Artificial Sequence
  synthetic [barcode part1]
aggtattcgccgcctt

SEQ ID NO: 27623 - DNA, 16 bp, Artificial Sequence
  synthetic [barcode part1]
ccaagagttgagtgcg

SEQ ID NO: 27624 - DNA, 16 bp, Artificial Sequence
  synthetic [barcode part1]
ttctgtagaccactac

SEQ ID NO: 27625 - DNA, 16 bp, Artificial Sequence
  synthetic [barcode part1]
ttaccactgaggcagt

SEQ ID NO: 27626 - DNA, 16 bp, Artificial Sequence
  synthetic [barcode part1]
attaaggtcggttccg

SEQ ID NO: 27627 - DNA, 16 bp, Artificial Sequence
  synthetic [barcode part1]
tgacagttacgaagac

SEQ ID NO: 27628 - DNA, 16 bp, Artificial Sequence
  synthetic [barcode part1]
aacggagtgcagatcc

SEQ ID NO: 27629 - DNA, 16 bp, Artificial Sequence
  synthetic [barcode part1]
gagatctacttcaggc

SEQ ID NO: 27630 - DNA, 16 bp, Artificial Sequence
  synthetic [barcode part1]
acacgaggaattgttg

SEQ ID NO: 27631 - DNA, 16 bp, Artificial Sequence
  synthetic [barcode part1]
gattagaggacgtccg

SEQ ID NO: 27632 - DNA, 16 bp, Artificial Sequence
  synthetic [barcode part1]
cagttcaccgtactcg

SEQ ID NO: 27633 - DNA, 16 bp, Artificial Sequence
  synthetic [barcode part1]
aagatcctcgtggtac

SEQ ID NO: 27634 - DNA, 16 bp, Artificial Sequence
  synthetic [barcode part1]
tatctaaggtcgcgtg

SEQ ID NO: 27635 - DNA, 16 bp, Artificial Sequence
  synthetic [barcode part1]
ttctgccgtgagtctg

SEQ ID NO: 27636 - DNA, 16 bp, Artificial Sequence
  synthetic [barcode part1]
agacaggttgcggtac

SEQ ID NO: 27637 - DNA, 16 bp, Artificial Sequence
  synthetic [barcode part1]
acaatccgcgacttag

SEQ ID NO: 27638 - DNA, 16 bp, Artificial Sequence
  synthetic [barcode part1]
tagagtcgtcagttgc

SEQ ID NO: 27639 - DNA, 16 bp, Artificial Sequence
  synthetic [barcode part1]
ccttggtggttgtgtc

SEQ ID NO: 27640 - DNA, 16 bp, Artificial Sequence
  synthetic [barcode part1]
cgccgaatatctctgc

SEQ ID NO: 27641 - DNA, 16 bp, Artificial Sequence
  synthetic [barcode part1]
caccgaaggattgtct

SEQ ID NO: 27642 - DNA, 16 bp, Artificial Sequence
  synthetic [barcode part1]
caggagtcgtcaagtg

SEQ ID NO: 27643 - DNA, 16 bp, Artificial Sequence
  synthetic [barcode part1]
aatacagtggatcgtg

SEQ ID NO: 27644 - DNA, 16 bp, Artificial Sequence
  synthetic [barcode part1]
tcacagtgtgtgtacg

SEQ ID NO: 27645 - DNA, 16 bp, Artificial Sequence
  synthetic [barcode part1]
ttgcctagacgagtgt

SEQ ID NO: 27646 - DNA, 16 bp, Artificial Sequence
  synthetic [barcode part1]
cgacgtctgttgtaag

SEQ ID NO: 27647 - DNA, 16 bp, Artificial Sequence
  synthetic [barcode part1]
atcgtctacggatctt

SEQ ID NO: 27648 - DNA, 16 bp, Artificial Sequence
  synthetic [barcode part1]
acgcaaccgatacgtt

SEQ ID NO: 27649 - DNA, 16 bp, Artificial Sequence
  synthetic [barcode part1]
gtggtgaagacgtctg

SEQ ID NO: 27650 - DNA, 16 bp, Artificial Sequence
  synthetic [barcode part1]
aggcgttacctcacct

SEQ ID NO: 27651 - DNA, 16 bp, Artificial Sequence
  synthetic [barcode part1]
gcgtagttagtcacgt

SEQ ID NO: 27652 - DNA, 16 bp, Artificial Sequence
  synthetic [barcode part1]
taggaccaatcctggt

SEQ ID NO: 27653 - DNA, 16 bp, Artificial Sequence
  synthetic [barcode part1]
tcaccaccgtctagac

SEQ ID NO: 27654 - DNA, 16 bp, Artificial Sequence
  synthetic [barcode part1]
gttctgtcgttggcgt

SEQ ID NO: 27655 - DNA, 16 bp, Artificial Sequence
  synthetic [barcode part1]
gcgaacttcaacgtgt

SEQ ID NO: 27656 - DNA, 16 bp, Artificial Sequence
  synthetic [barcode part1]
atactctagagacgcc

SEQ ID NO: 27657 - DNA, 16 bp, Artificial Sequence
  synthetic [barcode part1]
tatcttggtctgcggc

SEQ ID NO: 27658 - DNA, 16 bp, Artificial Sequence
  synthetic [barcode part1]
gcggtacgtgtatatc

SEQ ID NO: 27659 - DNA, 16 bp, Artificial Sequence
  synthetic [barcode part1]
gactcttagtcacact

SEQ ID NO: 27660 - DNA, 16 bp, Artificial Sequence
  synthetic [barcode part1]
ttgttcgaccttaggt

SEQ ID NO: 27661 - DNA, 16 bp, Artificial Sequence
  synthetic [barcode part1]
gcctataagtccgtag

SEQ ID NO: 27662 - DNA, 16 bp, Artificial Sequence
  synthetic [barcode part1]
ttcgaggtacgacgtt

SEQ ID NO: 27663 - DNA, 16 bp, Artificial Sequence
  synthetic [barcode part1]
caacacgcgacaaggt

SEQ ID NO: 27664 - DNA, 16 bp, Artificial Sequence
  synthetic [barcode part1]
ttggccttgttctgtc

SEQ ID NO: 27665 - DNA, 16 bp, Artificial Sequence
  synthetic [barcode part1]
gtgtcggaactgtatc

SEQ ID NO: 27666 - DNA, 16 bp, Artificial Sequence
  synthetic [barcode part1]
caggagttggattgcg

SEQ ID NO: 27667 - DNA, 16 bp, Artificial Sequence
  synthetic [barcode part1]
cggaactgaccttagt

SEQ ID NO: 27668 - DNA, 16 bp, Artificial Sequence
  synthetic [barcode part1]
aggtgccgagtaacac

SEQ ID NO: 27669 - DNA, 16 bp, Artificial Sequence
  synthetic [barcode part1]
gttgtggtctgagact

SEQ ID NO: 27670 - DNA, 16 bp, Artificial Sequence
  synthetic [barcode part1]
aagtaggcaagactct

SEQ ID NO: 27671 - DNA, 16 bp, Artificial Sequence
  synthetic [barcode part1]
ttgttcggcagtgcct

SEQ ID NO: 27672 - DNA, 16 bp, Artificial Sequence
  synthetic [barcode part1]
ttggaacaataccgcc

SEQ ID NO: 27673 - DNA, 16 bp, Artificial Sequence
  synthetic [barcode part1]
cgaacttgacaaggcg

SEQ ID NO: 27674 - DNA, 16 bp, Artificial Sequence
  synthetic [barcode part1]
cacaacggtgatacct

SEQ ID NO: 27675 - DNA, 16 bp, Artificial Sequence
  synthetic [barcode part1]
agacggacactataac

SEQ ID NO: 27676 - DNA, 16 bp, Artificial Sequence
  synthetic [barcode part1]
cggacaatagagtccg

SEQ ID NO: 27677 - DNA, 16 bp, Artificial Sequence
  synthetic [barcode part1]
acaggaatcctcacgt

SEQ ID NO: 27678 - DNA, 16 bp, Artificial Sequence
  synthetic [barcode part1]
gaccgatacactacgt

SEQ ID NO: 27679 - DNA, 16 bp, Artificial Sequence
  synthetic [barcode part1]
gacttactgcctgaag

SEQ ID NO: 27680 - DNA, 16 bp, Artificial Sequence
  synthetic [barcode part1]
agtgtaccacaaccac

SEQ ID NO: 27681 - DNA, 16 bp, Artificial Sequence
  synthetic [barcode part1]
gactcgacaacagtct

SEQ ID NO: 27682 - DNA, 16 bp, Artificial Sequence
  synthetic [barcode part1]
tggagacggattgtcg

SEQ ID NO: 27683 - DNA, 16 bp, Artificial Sequence
  synthetic [barcode part1]
tgaagtctgaccagtc

SEQ ID NO: 27684 - DNA, 16 bp, Artificial Sequence
  synthetic [barcode part1]
ttctggaataacgccg

SEQ ID NO: 27685 - DNA, 16 bp, Artificial Sequence
  synthetic [barcode part1]
aacctcacttgttcag

SEQ ID NO: 27686 - DNA, 16 bp, Artificial Sequence
  synthetic [barcode part1]
atagtgtactggccgt

SEQ ID NO: 27687 - DNA, 16 bp, Artificial Sequence
  synthetic [barcode part1]
gtaacgtcacacgtac

SEQ ID NO: 27688 - DNA, 16 bp, Artificial Sequence
  synthetic [barcode part1]
tgtcactctcagtcct

SEQ ID NO: 27689 - DNA, 16 bp, Artificial Sequence
  synthetic [barcode part1]
aggttcggtctgagtt

SEQ ID NO: 27690 - DNA, 16 bp, Artificial Sequence
  synthetic [barcode part1]
cagacgcaatcgtatc

SEQ ID NO: 27691 - DNA, 16 bp, Artificial Sequence
  synthetic [barcode part1]
aagtgtagacctagtg

SEQ ID NO: 27692 - DNA, 16 bp, Artificial Sequence
  synthetic [barcode part1]
ttgcgttggtgtaggt

SEQ ID NO: 27693 - DNA, 16 bp, Artificial Sequence
  synthetic [barcode part1]
ccgcagacgaagaatc

SEQ ID NO: 27694 - DNA, 16 bp, Artificial Sequence
  synthetic [barcode part1]
tgcctcgacgaactct

SEQ ID NO: 27695 - DNA, 16 bp, Artificial Sequence
  synthetic [barcode part1]
accacttatctgtggt

SEQ ID NO: 27696 - DNA, 16 bp, Artificial Sequence
  synthetic [barcode part1]
tctccacaatagttcg

SEQ ID NO: 27697 - DNA, 16 bp, Artificial Sequence
  synthetic [barcode part1]
gacgtccgacaacaag

SEQ ID NO: 27698 - DNA, 16 bp, Artificial Sequence
  synthetic [barcode part1]
taacaacgccggatct

SEQ ID NO: 27699 - DNA, 16 bp, Artificial Sequence
  synthetic [barcode part1]
gacgttagtcgtaacc

SEQ ID NO: 27700 - DNA, 16 bp, Artificial Sequence
  synthetic [barcode part1]
tacgacagtgaacaac

SEQ ID NO: 27701 - DNA, 16 bp, Artificial Sequence
  synthetic [barcode part1]
cgtcggtcttcgattg

SEQ ID NO: 27702 - DNA, 16 bp, Artificial Sequence
  synthetic [barcode part1]
ttctatccaaggcgag

SEQ ID NO: 27703 - DNA, 16 bp, Artificial Sequence
  synthetic [barcode part1]
agaaggtagtgtgtct

SEQ ID NO: 27704 - DNA, 16 bp, Artificial Sequence
  synthetic [barcode part1]
cctgatattcggtgag

SEQ ID NO: 27705 - DNA, 16 bp, Artificial Sequence
  synthetic [barcode part1]
agtcgtaggagaattc

SEQ ID NO: 27706 - DNA, 16 bp, Artificial Sequence
  synthetic [barcode part1]
cctatacagaggcgtt

SEQ ID NO: 27707 - DNA, 16 bp, Artificial Sequence
  synthetic [barcode part1]
gtgagactggagtaag

SEQ ID NO: 27708 - DNA, 16 bp, Artificial Sequence
  synthetic [barcode part1]
actcagaacagtgaac

SEQ ID NO: 27709 - DNA, 16 bp, Artificial Sequence
  synthetic [barcode part1]
tgcaagttcgtctcgc

SEQ ID NO: 27710 - DNA, 16 bp, Artificial Sequence
  synthetic [barcode part1]
aagtagaggtgtcgcc

SEQ ID NO: 27711 - DNA, 16 bp, Artificial Sequence
  synthetic [barcode part1]
ttacgacgaagttccg

SEQ ID NO: 27712 - DNA, 16 bp, Artificial Sequence
  synthetic [barcode part1]
atccacacgtagatcg

SEQ ID NO: 27713 - DNA, 16 bp, Artificial Sequence
  synthetic [barcode part1]
gaactggatcaacgcg

SEQ ID NO: 27714 - DNA, 16 bp, Artificial Sequence
  synthetic [barcode part1]
gttgactcacaacgtg

SEQ ID NO: 27715 - DNA, 16 bp, Artificial Sequence
  synthetic [barcode part1]
gtcgtatcgaccttcg

SEQ ID NO: 27716 - DNA, 16 bp, Artificial Sequence
  synthetic [barcode part1]
taggtaccaacttctc

SEQ ID NO: 27717 - DNA, 16 bp, Artificial Sequence
  synthetic [barcode part1]
tacttatcggagtcct

SEQ ID NO: 27718 - DNA, 16 bp, Artificial Sequence
  synthetic [barcode part1]
tcacggcaattctgag

SEQ ID NO: 27719 - DNA, 16 bp, Artificial Sequence
  synthetic [barcode part1]
cggaagagtactggtc

SEQ ID NO: 27720 - DNA, 16 bp, Artificial Sequence
  synthetic [barcode part1]
ttctacgattaggcct

SEQ ID NO: 27721 - DNA, 16 bp, Artificial Sequence
  synthetic [barcode part1]
attggaatctcgaccg

SEQ ID NO: 27722 - DNA, 16 bp, Artificial Sequence
  synthetic [barcode part1]
gagttcgagattaggt

SEQ ID NO: 27723 - DNA, 16 bp, Artificial Sequence
  synthetic [barcode part1]
cctacacctgacagtc

SEQ ID NO: 27724 - DNA, 16 bp, Artificial Sequence
  synthetic [barcode part1]
ttaccgcagatctatc

SEQ ID NO: 27725 - DNA, 16 bp, Artificial Sequence
  synthetic [barcode part1]
ccagtcggtattacag

SEQ ID NO: 27726 - DNA, 16 bp, Artificial Sequence
  synthetic [barcode part1]
aagtggcactatctcg

SEQ ID NO: 27727 - DNA, 16 bp, Artificial Sequence
  synthetic [barcode part1]
atatcggcacgttgac

SEQ ID NO: 27728 - DNA, 16 bp, Artificial Sequence
  synthetic [barcode part1]
aatctggttccgtgcc

SEQ ID NO: 27729 - DNA, 16 bp, Artificial Sequence
  synthetic [barcode part1]
gtgaaggaatcgtcgc

SEQ ID NO: 27730 - DNA, 16 bp, Artificial Sequence
  synthetic [barcode part1]
caggtcagacttgact

SEQ ID NO: 27731 - DNA, 16 bp, Artificial Sequence
  synthetic [barcode part1]
gttatcttccggacgc

SEQ ID NO: 27732 - DNA, 16 bp, Artificial Sequence
  synthetic [barcode part1]
acttgagttaccttgc

SEQ ID NO: 27733 - DNA, 16 bp, Artificial Sequence
  synthetic [barcode part1]
taggcgtaccgttcct

SEQ ID NO: 27734 - DNA, 16 bp, Artificial Sequence
  synthetic [barcode part1]
gtagattcgacagagt

SEQ ID NO: 27735 - DNA, 16 bp, Artificial Sequence
  synthetic [barcode part1]
cctcacttcgttctag

SEQ ID NO: 27736 - DNA, 16 bp, Artificial Sequence
  synthetic [barcode part1]
tcgtctactcgttcgt

SEQ ID NO: 27737 - DNA, 16 bp, Artificial Sequence
  synthetic [barcode part1]
aatacgacctgtaccg

SEQ ID NO: 27738 - DNA, 16 bp, Artificial Sequence
  synthetic [barcode part1]
tccagaatcgattggc

SEQ ID NO: 27739 - DNA, 16 bp, Artificial Sequence
  synthetic [barcode part1]
cctactgtcagtgcac

SEQ ID NO: 27740 - DNA, 16 bp, Artificial Sequence
  synthetic [barcode part1]
taacgacgaagtacac

SEQ ID NO: 27741 - DNA, 16 bp, Artificial Sequence
  synthetic [barcode part1]
ttggtacctagagaag

SEQ ID NO: 27742 - DNA, 16 bp, Artificial Sequence
  synthetic [barcode part1]
ttcagtccgatacgtt

SEQ ID NO: 27743 - DNA, 16 bp, Artificial Sequence
  synthetic [barcode part1]
tgaacggactccagag

SEQ ID NO: 27744 - DNA, 16 bp, Artificial Sequence
  synthetic [barcode part1]
gacagaccttaaggcg

SEQ ID NO: 27745 - DNA, 16 bp, Artificial Sequence
  synthetic [barcode part1]
taggtcgtaacgacct

SEQ ID NO: 27746 - DNA, 16 bp, Artificial Sequence
  synthetic [barcode part1]
gagacggacaagtcct

SEQ ID NO: 27747 - DNA, 16 bp, Artificial Sequence
  synthetic [barcode part1]
actctcgttcaacaac

SEQ ID NO: 27748 - DNA, 16 bp, Artificial Sequence
  synthetic [barcode part1]
gagagactgccttatc

SEQ ID NO: 27749 - DNA, 16 bp, Artificial Sequence
  synthetic [barcode part1]
gatctggtctcgcgtt

SEQ ID NO: 27750 - DNA, 16 bp, Artificial Sequence
  synthetic [barcode part1]
acttgcactccgtcag

SEQ ID NO: 27751 - DNA, 16 bp, Artificial Sequence
  synthetic [barcode part1]
tggttaaccaaccggt

SEQ ID NO: 27752 - DNA, 16 bp, Artificial Sequence
  synthetic [barcode part1]
cctcctaacaattgtg

SEQ ID NO: 27753 - DNA, 16 bp, Artificial Sequence
  synthetic [barcode part1]
gaactaagtcgcgcag

SEQ ID NO: 27754 - DNA, 16 bp, Artificial Sequence
  synthetic [barcode part1]
aatcaacgccgtggtt

SEQ ID NO: 27755 - DNA, 16 bp, Artificial Sequence
  synthetic [barcode part1]
accgatacgttccacc

SEQ ID NO: 27756 - DNA, 16 bp, Artificial Sequence
  synthetic [barcode part1]
tgaaccggtgcctctt

SEQ ID NO: 27757 - DNA, 16 bp, Artificial Sequence
  synthetic [barcode part1]
tcacctactcaggatt

SEQ ID NO: 27758 - DNA, 16 bp, Artificial Sequence
  synthetic [barcode part1]
tcgtctgttatccacc

SEQ ID NO: 27759 - DNA, 16 bp, Artificial Sequence
  synthetic [barcode part1]
gtgaatacagaatccg

SEQ ID NO: 27760 - DNA, 16 bp, Artificial Sequence
  synthetic [barcode part1]
tgagagaccgaagagt

SEQ ID NO: 27761 - DNA, 16 bp, Artificial Sequence
  synthetic [barcode part1]
ataggatcctgtcgtg

SEQ ID NO: 27762 - DNA, 16 bp, Artificial Sequence
  synthetic [barcode part1]
actgcggtggatagac

SEQ ID NO: 27763 - DNA, 16 bp, Artificial Sequence
  synthetic [barcode part1]
gtgactgaattcctct

SEQ ID NO: 27764 - DNA, 16 bp, Artificial Sequence
  synthetic [barcode part1]
tacaccacgcgattag

SEQ ID NO: 27765 - DNA, 16 bp, Artificial Sequence
  synthetic [barcode part1]
gatattgcggtgtcgt

SEQ ID NO: 27766 - DNA, 16 bp, Artificial Sequence
  synthetic [barcode part1]
ttaggtgcctaagtgc

SEQ ID NO: 27767 - DNA, 16 bp, Artificial Sequence
  synthetic [barcode part1]
gtccgttgaatctcgc

SEQ ID NO: 27768 - DNA, 16 bp, Artificial Sequence
  synthetic [barcode part1]
tggttccgagactaac

SEQ ID NO: 27769 - DNA, 16 bp, Artificial Sequence
  synthetic [barcode part1]
ttgcaccgacagtctc

SEQ ID NO: 27770 - DNA, 16 bp, Artificial Sequence
  synthetic [barcode part1]
cacaagtggtggagtc

SEQ ID NO: 27771 - DNA, 16 bp, Artificial Sequence
  synthetic [barcode part1]
atatctcggtccgacc

SEQ ID NO: 27772 - DNA, 16 bp, Artificial Sequence
  synthetic [barcode part1]
cacacgatccgtaagt

SEQ ID NO: 27773 - DNA, 16 bp, Artificial Sequence
  synthetic [barcode part1]
gcagtcaagtcggagt

SEQ ID NO: 27774 - DNA, 16 bp, Artificial Sequence
  synthetic [barcode part1]
cctgtaagacgttcag

SEQ ID NO: 27775 - DNA, 16 bp, Artificial Sequence
  synthetic [barcode part1]
cctacgttcttgtacc

SEQ ID NO: 27776 - DNA, 16 bp, Artificial Sequence
  synthetic [barcode part1]
cagttgaggaatcctc

SEQ ID NO: 27777 - DNA, 16 bp, Artificial Sequence
  synthetic [barcode part1]
cgcggagagaatatag

SEQ ID NO: 27778 - DNA, 16 bp, Artificial Sequence
  synthetic [barcode part1]
tcgtccgttgtctgtt

SEQ ID NO: 27779 - DNA, 16 bp, Artificial Sequence
  synthetic [barcode part1]
tccagttgaccgaagt

SEQ ID NO: 27780 - DNA, 16 bp, Artificial Sequence
  synthetic [barcode part1]
aacaagaagtccacac

SEQ ID NO: 27781 - DNA, 16 bp, Artificial Sequence
  synthetic [barcode part1]
ttactcttggcgagag

SEQ ID NO: 27782 - DNA, 16 bp, Artificial Sequence
  synthetic [barcode part1]
gtgaagagtgtgaggt

SEQ ID NO: 27783 - DNA, 16 bp, Artificial Sequence
  synthetic [barcode part1]
gattgtcggcaatctg

SEQ ID NO: 27784 - DNA, 16 bp, Artificial Sequence
  synthetic [barcode part1]
gcaatctcctgcgttg

SEQ ID NO: 27785 - DNA, 16 bp, Artificial Sequence
  synthetic [barcode part1]
atctggattcactgtc

SEQ ID NO: 27786 - DNA, 16 bp, Artificial Sequence
  synthetic [barcode part1]
tacgtgtgtgtacgtg

SEQ ID NO: 27787 - DNA, 16 bp, Artificial Sequence
  synthetic [barcode part1]
aagtcaccgttcttac

SEQ ID NO: 27788 - DNA, 16 bp, Artificial Sequence
  synthetic [barcode part1]
tgagatcactggttgc

SEQ ID NO: 27789 - DNA, 16 bp, Artificial Sequence
  synthetic [barcode part1]
acaacgccacgatact

SEQ ID NO: 27790 - DNA, 16 bp, Artificial Sequence
  synthetic [barcode part1]
ttccgattgtggactt

SEQ ID NO: 27791 - DNA, 16 bp, Artificial Sequence
  synthetic [barcode part1]
agatcggtcaaccttg

SEQ ID NO: 27792 - DNA, 16 bp, Artificial Sequence
  synthetic [barcode part1]
cgaataattgtggcag

SEQ ID NO: 27793 - DNA, 16 bp, Artificial Sequence
  synthetic [barcode part1]
gtcgtcgtcaatagtg

SEQ ID NO: 27794 - DNA, 16 bp, Artificial Sequence
  synthetic [barcode part1]
tgtgtacctccttctg

SEQ ID NO: 27795 - DNA, 16 bp, Artificial Sequence
  synthetic [barcode part1]
agtatatcgcgcagtc

SEQ ID NO: 27796 - DNA, 16 bp, Artificial Sequence
  synthetic [barcode part1]
aaccggttgcggtatt

SEQ ID NO: 27797 - DNA, 16 bp, Artificial Sequence
  synthetic [barcode part1]
ttgtgcctggaagtac

SEQ ID NO: 27798 - DNA, 16 bp, Artificial Sequence
  synthetic [barcode part1]
atagattgccaccttc

SEQ ID NO: 27799 - DNA, 16 bp, Artificial Sequence
  synthetic [barcode part1]
cactgataactctctg

SEQ ID NO: 27800 - DNA, 16 bp, Artificial Sequence
  synthetic [barcode part1]
tggaggattgaggaac

SEQ ID NO: 27801 - DNA, 16 bp, Artificial Sequence
  synthetic [barcode part1]
attgttaccttgcacg

SEQ ID NO: 27802 - DNA, 16 bp, Artificial Sequence
  synthetic [barcode part1]
gttattccagacactc

SEQ ID NO: 27803 - DNA, 16 bp, Artificial Sequence
  synthetic [barcode part1]
gcagagaggaatacac

SEQ ID NO: 27804 - DNA, 16 bp, Artificial Sequence
  synthetic [barcode part1]
ataggccgtgttcagt

SEQ ID NO: 27805 - DNA, 16 bp, Artificial Sequence
  synthetic [barcode part1]
tgcggtgtaagtggac

SEQ ID NO: 27806 - DNA, 16 bp, Artificial Sequence
  synthetic [barcode part1]
gtgacaggtagttgcg

SEQ ID NO: 27807 - DNA, 16 bp, Artificial Sequence
  synthetic [barcode part1]
taggccggtactcttc

SEQ ID NO: 27808 - DNA, 16 bp, Artificial Sequence
  synthetic [barcode part1]
gtggactacactcagt

SEQ ID NO: 27809 - DNA, 16 bp, Artificial Sequence
  synthetic [barcode part1]
gtattgccggaattcg

SEQ ID NO: 27810 - DNA, 16 bp, Artificial Sequence
  synthetic [barcode part1]
acctagagtggtaggc

SEQ ID NO: 27811 - DNA, 16 bp, Artificial Sequence
  synthetic [barcode part1]
gtgaactgtattcggc

SEQ ID NO: 27812 - DNA, 16 bp, Artificial Sequence
  synthetic [barcode part1]
gttacggagattccgt

SEQ ID NO: 27813 - DNA, 16 bp, Artificial Sequence
  synthetic [barcode part1]
tgtacactgaccaacg

SEQ ID NO: 27814 - DNA, 16 bp, Artificial Sequence
  synthetic [barcode part1]
aacgtcgtcctaaggt

SEQ ID NO: 27815 - DNA, 16 bp, Artificial Sequence
  synthetic [barcode part1]
atcactcgacggagtt

SEQ ID NO: 27816 - DNA, 16 bp, Artificial Sequence
  synthetic [barcode part1]
tgtcgtccttagttcc

SEQ ID NO: 27817 - DNA, 16 bp, Artificial Sequence
  synthetic [barcode part1]
gagttggaaccagaag

SEQ ID NO: 27818 - DNA, 16 bp, Artificial Sequence
  synthetic [barcode part1]
gactgaggagtactcg

SEQ ID NO: 27819 - DNA, 16 bp, Artificial Sequence
  synthetic [barcode part1]
gccgacagagttgaac

SEQ ID NO: 27820 - DNA, 16 bp, Artificial Sequence
  synthetic [barcode part1]
taaccagatacgcacc

SEQ ID NO: 27821 - DNA, 16 bp, Artificial Sequence
  synthetic [barcode part1]
attgtggttgcctgcc

SEQ ID NO: 27822 - DNA, 16 bp, Artificial Sequence
  synthetic [barcode part1]
gcacttactattccag

SEQ ID NO: 27823 - DNA, 16 bp, Artificial Sequence
  synthetic [barcode part1]
tccgttcaagtgaacg

SEQ ID NO: 27824 - DNA, 16 bp, Artificial Sequence
  synthetic [barcode part1]
aacacgtacacgttgc

SEQ ID NO: 27825 - DNA, 16 bp, Artificial Sequence
  synthetic [barcode part1]
acctctcgagatcaag

SEQ ID NO: 27826 - DNA, 16 bp, Artificial Sequence
  synthetic [barcode part1]
gatcactggtgattcg

SEQ ID NO: 27827 - DNA, 16 bp, Artificial Sequence
  synthetic [barcode part1]
atccgatatatctccg

SEQ ID NO: 27828 - DNA, 16 bp, Artificial Sequence
  synthetic [barcode part1]
ttaggcgacagactct

SEQ ID NO: 27829 - DNA, 16 bp, Artificial Sequence
  synthetic [barcode part1]
tgcgtagacgactgtt

SEQ ID NO: 27830 - DNA, 16 bp, Artificial Sequence
  synthetic [barcode part1]
tggtcttcctcctagt

SEQ ID NO: 27831 - DNA, 16 bp, Artificial Sequence
  synthetic [barcode part1]
cagaggtgtgacctag

SEQ ID NO: 27832 - DNA, 16 bp, Artificial Sequence
  synthetic [barcode part1]
gtctaacttgacggtg

SEQ ID NO: 27833 - DNA, 16 bp, Artificial Sequence
  synthetic [barcode part1]
ccgaacacctattact

SEQ ID NO: 27834 - DNA, 16 bp, Artificial Sequence
  synthetic [barcode part1]
tcgtagaatccagacc

SEQ ID NO: 27835 - DNA, 16 bp, Artificial Sequence
  synthetic [barcode part1]
tctgtcggattgtatc

SEQ ID NO: 27836 - DNA, 16 bp, Artificial Sequence
  synthetic [barcode part1]
aacacacgtgttgacc

SEQ ID NO: 27837 - DNA, 16 bp, Artificial Sequence
  synthetic [barcode part1]
ccagtgatatcggact

SEQ ID NO: 27838 - DNA, 16 bp, Artificial Sequence
  synthetic [barcode part1]
tcgactctagatctac

SEQ ID NO: 27839 - DNA, 16 bp, Artificial Sequence
  synthetic [barcode part1]
atctgtgtcgagtgtg

SEQ ID NO: 27840 - DNA, 16 bp, Artificial Sequence
  synthetic [barcode part1]
tctctctgaccttgac

SEQ ID NO: 27841 - DNA, 16 bp, Artificial Sequence
  synthetic [barcode part1]
gcagttgttctggcct

SEQ ID NO: 27842 - DNA, 16 bp, Artificial Sequence
  synthetic [barcode part1]
atctactccgtgatac

SEQ ID NO: 27843 - DNA, 16 bp, Artificial Sequence
  synthetic [barcode part1]
gtgttgaagagtgatc

SEQ ID NO: 27844 - DNA, 16 bp, Artificial Sequence
  synthetic [barcode part1]
gcaggtcaatctgtac

SEQ ID NO: 27845 - DNA, 16 bp, Artificial Sequence
  synthetic [barcode part1]
acgtagtccttgattc

SEQ ID NO: 27846 - DNA, 16 bp, Artificial Sequence
  synthetic [barcode part1]
cggtgtgtcttcaacc

SEQ ID NO: 27847 - DNA, 16 bp, Artificial Sequence
  synthetic [barcode part1]
atcagtctacgacacg

SEQ ID NO: 27848 - DNA, 16 bp, Artificial Sequence
  synthetic [barcode part1]
tcgaggtggtatcgtt

SEQ ID NO: 27849 - DNA, 16 bp, Artificial Sequence
  synthetic [barcode part1]
ttgacagttacacctc

SEQ ID NO: 27850 - DNA, 16 bp, Artificial Sequence
  synthetic [barcode part1]
aagtagaccgcgacac

SEQ ID NO: 27851 - DNA, 16 bp, Artificial Sequence
  synthetic [barcode part1]
accgtaacaggtggac

SEQ ID NO: 27852 - DNA, 16 bp, Artificial Sequence
  synthetic [barcode part1]
atagagatctcacgcc

SEQ ID NO: 27853 - DNA, 16 bp, Artificial Sequence
  synthetic [barcode part1]
agaatactctcgcacg

SEQ ID NO: 27854 - DNA, 16 bp, Artificial Sequence
  synthetic [barcode part1]
actcaacacgtaagag

SEQ ID NO: 27855 - DNA, 16 bp, Artificial Sequence
  synthetic [barcode part1]
gaggagtgcaactacc

SEQ ID NO: 27856 - DNA, 16 bp, Artificial Sequence
  synthetic [barcode part1]
tacgtggtcgtacagt

SEQ ID NO: 27857 - DNA, 16 bp, Artificial Sequence
  synthetic [barcode part1]
ccaggtcgagatacag

SEQ ID NO: 27858 - DNA, 16 bp, Artificial Sequence
  synthetic [barcode part1]
accgacgtattccacc

SEQ ID NO: 27859 - DNA, 16 bp, Artificial Sequence
  synthetic [barcode part1]
gccgacaacagttatc

SEQ ID NO: 27860 - DNA, 16 bp, Artificial Sequence
  synthetic [barcode part1]
atcttgtcacctcgtc

SEQ ID NO: 27861 - DNA, 16 bp, Artificial Sequence
  synthetic [barcode part1]
attctcgcacctctgt

SEQ ID NO: 27862 - DNA, 16 bp, Artificial Sequence
  synthetic [barcode part1]
cacctaccgttgcaac

SEQ ID NO: 27863 - DNA, 16 bp, Artificial Sequence
  synthetic [barcode part1]
cggtaattacgtcttc

SEQ ID NO: 27864 - DNA, 16 bp, Artificial Sequence
  synthetic [barcode part1]
cactcctgaagtacag

SEQ ID NO: 27865 - DNA, 16 bp, Artificial Sequence
  synthetic [barcode part1]
tcagtagagtgacctc

SEQ ID NO: 27866 - DNA, 16 bp, Artificial Sequence
  synthetic [barcode part1]
aagtagttctccggtg

SEQ ID NO: 27867 - DNA, 16 bp, Artificial Sequence
  synthetic [barcode part1]
acttggtaagacacag

SEQ ID NO: 27868 - DNA, 16 bp, Artificial Sequence
  synthetic [barcode part1]
tcttgagtgagtgaag

SEQ ID NO: 27869 - DNA, 16 bp, Artificial Sequence
  synthetic [barcode part1]
tgtctccactgagtcg

SEQ ID NO: 27870 - DNA, 16 bp, Artificial Sequence
  synthetic [barcode part1]
gactgcggaagttgac

SEQ ID NO: 27871 - DNA, 16 bp, Artificial Sequence
  synthetic [barcode part1]
ttgtggacgaatctgc

SEQ ID NO: 27872 - DNA, 16 bp, Artificial Sequence
  synthetic [barcode part1]
tcgtccaagtaagtgc

SEQ ID NO: 27873 - DNA, 16 bp, Artificial Sequence
  synthetic [barcode part1]
tcagtgttggttgcag

SEQ ID NO: 27874 - DNA, 16 bp, Artificial Sequence
  synthetic [barcode part1]
cgtcgaacagactgtt

SEQ ID NO: 27875 - DNA, 16 bp, Artificial Sequence
  synthetic [barcode part1]
aatcgtgtctctcggc

SEQ ID NO: 27876 - DNA, 16 bp, Artificial Sequence
  synthetic [barcode part1]
tacgactaccactccg

SEQ ID NO: 27877 - DNA, 16 bp, Artificial Sequence
  synthetic [barcode part1]
acaggaataacgacct

SEQ ID NO: 27878 - DNA, 16 bp, Artificial Sequence
  synthetic [barcode part1]
cactaggtggatcact

SEQ ID NO: 27879 - DNA, 16 bp, Artificial Sequence
  synthetic [barcode part1]
ttcgaggacgttacgt

SEQ ID NO: 27880 - DNA, 16 bp, Artificial Sequence
  synthetic [barcode part1]
gtaattgtgcgcggtt

SEQ ID NO: 27881 - DNA, 16 bp, Artificial Sequence
  synthetic [barcode part1]
gtagtcaccaattctc

SEQ ID NO: 27882 - DNA, 16 bp, Artificial Sequence
  synthetic [barcode part1]
atctcgtcggagaact

SEQ ID NO: 27883 - DNA, 16 bp, Artificial Sequence
  synthetic [barcode part1]
tcgtcaaggtctagtg

SEQ ID NO: 27884 - DNA, 16 bp, Artificial Sequence
  synthetic [barcode part1]
caccggactgtatctc

SEQ ID NO: 27885 - DNA, 16 bp, Artificial Sequence
  synthetic [barcode part1]
caccaattaacacgcg

SEQ ID NO: 27886 - DNA, 16 bp, Artificial Sequence
  synthetic [barcode part1]
gtgatacctaaccgac

SEQ ID NO: 27887 - DNA, 16 bp, Artificial Sequence
  synthetic [barcode part1]
acttgccgcggtattc

SEQ ID NO: 27888 - DNA, 16 bp, Artificial Sequence
  synthetic [barcode part1]
aactcaggttggactc

SEQ ID NO: 27889 - DNA, 16 bp, Artificial Sequence
  synthetic [barcode part1]
tggccaggttaactac

SEQ ID NO: 27890 - DNA, 16 bp, Artificial Sequence
  synthetic [barcode part1]
ttgacgaccgtactcc

SEQ ID NO: 27891 - DNA, 16 bp, Artificial Sequence
  synthetic [barcode part1]
tactggtacgttgacg

SEQ ID NO: 27892 - DNA, 16 bp, Artificial Sequence
  synthetic [barcode part1]
atcaacgtatctcgtc

SEQ ID NO: 27893 - DNA, 16 bp, Artificial Sequence
  synthetic [barcode part1]
ttgactgcaaccagtg

SEQ ID NO: 27894 - DNA, 16 bp, Artificial Sequence
  synthetic [barcode part1]
aatccacgacaaggcg

SEQ ID NO: 27895 - DNA, 16 bp, Artificial Sequence
  synthetic [barcode part1]
tggtgtattagtgcgc

SEQ ID NO: 27896 - DNA, 16 bp, Artificial Sequence
  synthetic [barcode part1]
cagtcttgactcctct

SEQ ID NO: 27897 - DNA, 16 bp, Artificial Sequence
  synthetic [barcode part1]
tagttgccgagagacg

SEQ ID NO: 27898 - DNA, 16 bp, Artificial Sequence
  synthetic [barcode part1]
ccgagaattctcaacg

SEQ ID NO: 27899 - DNA, 16 bp, Artificial Sequence
  synthetic [barcode part1]
tgcaggatccttgtag

SEQ ID NO: 27900 - DNA, 16 bp, Artificial Sequence
  synthetic [barcode part1]
ttcgcggaggtgatag

SEQ ID NO: 27901 - DNA, 16 bp, Artificial Sequence
  synthetic [barcode part1]
cacggatccgtagatt

SEQ ID NO: 27902 - DNA, 16 bp, Artificial Sequence
  synthetic [barcode part1]
gcgattggattagagt

SEQ ID NO: 27903 - DNA, 16 bp, Artificial Sequence
  synthetic [barcode part1]
caccgcaactagttag

SEQ ID NO: 27904 - DNA, 16 bp, Artificial Sequence
  synthetic [barcode part1]
tgagagagaccttcct

SEQ ID NO: 27905 - DNA, 16 bp, Artificial Sequence
  synthetic [barcode part1]
tcgtggattgtcgcct

SEQ ID NO: 27906 - DNA, 16 bp, Artificial Sequence
  synthetic [barcode part1]
tgagtgcaggatagtt

SEQ ID NO: 27907 - DNA, 16 bp, Artificial Sequence
  synthetic [barcode part1]
ttgttgtccacctcac

SEQ ID NO: 27908 - DNA, 16 bp, Artificial Sequence
  synthetic [barcode part1]
actcagaggtaaggcc

SEQ ID NO: 27909 - DNA, 16 bp, Artificial Sequence
  synthetic [barcode part1]
cggaacttcctctctt

SEQ ID NO: 27910 - DNA, 16 bp, Artificial Sequence
  synthetic [barcode part1]
agtccaagtactcttc

SEQ ID NO: 27911 - DNA, 16 bp, Artificial Sequence
  synthetic [barcode part1]
ttctaggagacaggcg

SEQ ID NO: 27912 - DNA, 16 bp, Artificial Sequence
  synthetic [barcode part1]
tagtgtcggtggacag

SEQ ID NO: 27913 - DNA, 16 bp, Artificial Sequence
  synthetic [barcode part1]
acctctcttgactctg

SEQ ID NO: 27914 - DNA, 16 bp, Artificial Sequence
  synthetic [barcode part1]
tgaggactctgataag

SEQ ID NO: 27915 - DNA, 16 bp, Artificial Sequence
  synthetic [barcode part1]
tgccggtctcttcaag

SEQ ID NO: 27916 - DNA, 16 bp, Artificial Sequence
  synthetic [barcode part1]
atagagacttcgtgcc

SEQ ID NO: 27917 - DNA, 16 bp, Artificial Sequence
  synthetic [barcode part1]
tatcgacaccgtacag

SEQ ID NO: 27918 - DNA, 16 bp, Artificial Sequence
  synthetic [barcode part1]
tcttgcgtacaggaac

SEQ ID NO: 27919 - DNA, 16 bp, Artificial Sequence
  synthetic [barcode part1]
atcgtgtctaggtacg

SEQ ID NO: 27920 - DNA, 16 bp, Artificial Sequence
  synthetic [barcode part1]
agttggcctcttcctt

SEQ ID NO: 27921 - DNA, 16 bp, Artificial Sequence
  synthetic [barcode part1]
atcttactgccggtgc

SEQ ID NO: 27922 - DNA, 16 bp, Artificial Sequence
  synthetic [barcode part1]
tacttcggacgaggtt

SEQ ID NO: 27923 - DNA, 16 bp, Artificial Sequence
  synthetic [barcode part1]
tcttcggattgcacgc

SEQ ID NO: 27924 - DNA, 16 bp, Artificial Sequence
  synthetic [barcode part1]
gtgtggttggtgtgtt

SEQ ID NO: 27925 - DNA, 16 bp, Artificial Sequence
  synthetic [barcode part1]
atcctagactggtcag

SEQ ID NO: 27926 - DNA, 16 bp, Artificial Sequence
  synthetic [barcode part1]
cggttagtaaccgact

SEQ ID NO: 27927 - DNA, 16 bp, Artificial Sequence
  synthetic [barcode part1]
aggcgtcttgtcctac

SEQ ID NO: 27928 - DNA, 16 bp, Artificial Sequence
  synthetic [barcode part1]
tacacagacgattgcc

SEQ ID NO: 27929 - DNA, 16 bp, Artificial Sequence
  synthetic [barcode part1]
gttacgtgtgtgatcg

SEQ ID NO: 27930 - DNA, 16 bp, Artificial Sequence
  synthetic [barcode part1]
atcggacggtgtgagt

SEQ ID NO: 27931 - DNA, 16 bp, Artificial Sequence
  synthetic [barcode part1]
taacgaagtgaatccg

SEQ ID NO: 27932 - DNA, 16 bp, Artificial Sequence
  synthetic [barcode part1]
cgttcggtaacgagag

SEQ ID NO: 27933 - DNA, 16 bp, Artificial Sequence
  synthetic [barcode part1]
aatagtggcggtgaag

SEQ ID NO: 27934 - DNA, 16 bp, Artificial Sequence
  synthetic [barcode part1]
gtcgtataatccgcag

SEQ ID NO: 27935 - DNA, 16 bp, Artificial Sequence
  synthetic [barcode part1]
tacttgtgtgacactc

SEQ ID NO: 27936 - DNA, 16 bp, Artificial Sequence
  synthetic [barcode part1]
tctggagtggtgttgt

SEQ ID NO: 27937 - DNA, 16 bp, Artificial Sequence
  synthetic [barcode part1]
cctgactactgtacgc

SEQ ID NO: 27938 - DNA, 16 bp, Artificial Sequence
  synthetic [barcode part1]
ataggtcgattacgcc

SEQ ID NO: 27939 - DNA, 16 bp, Artificial Sequence
  synthetic [barcode part1]
gcaagttggaacgacc

SEQ ID NO: 27940 - DNA, 16 bp, Artificial Sequence
  synthetic [barcode part1]
tgccgagtgaaggtac

SEQ ID NO: 27941 - DNA, 16 bp, Artificial Sequence
  synthetic [barcode part1]
cgcctcagatacctgt

SEQ ID NO: 27942 - DNA, 16 bp, Artificial Sequence
  synthetic [barcode part1]
caacactatccacttg

SEQ ID NO: 27943 - DNA, 16 bp, Artificial Sequence
  synthetic [barcode part1]
tgagtacgtcagaggc

SEQ ID NO: 27944 - DNA, 16 bp, Artificial Sequence
  synthetic [barcode part1]
acagataaggcgaacg

SEQ ID NO: 27945 - DNA, 16 bp, Artificial Sequence
  synthetic [barcode part1]
tcaagtgcaccgttcc

SEQ ID NO: 27946 - DNA, 16 bp, Artificial Sequence
  synthetic [barcode part1]
cgcagacttgtcctac

SEQ ID NO: 27947 - DNA, 16 bp, Artificial Sequence
  synthetic [barcode part1]
caattaacaacgccgc

SEQ ID NO: 27948 - DNA, 16 bp, Artificial Sequence
  synthetic [barcode part1]
cggtaacgaaggcact

SEQ ID NO: 27949 - DNA, 16 bp, Artificial Sequence
  synthetic [barcode part1]
aacagtcttctgcgcc

SEQ ID NO: 27950 - DNA, 16 bp, Artificial Sequence
  synthetic [barcode part1]
cctcttctctcctctt

SEQ ID NO: 27951 - DNA, 16 bp, Artificial Sequence
  synthetic [barcode part1]
gcgtcttacgttcttc

SEQ ID NO: 27952 - DNA, 16 bp, Artificial Sequence
  synthetic [barcode part1]
accgaagaaggaactg

SEQ ID NO: 27953 - DNA, 16 bp, Artificial Sequence
  synthetic [barcode part1]
aatccgttctatcgtg

SEQ ID NO: 27954 - DNA, 16 bp, Artificial Sequence
  synthetic [barcode part1]
cgtcactgtaatcgcc

SEQ ID NO: 27955 - DNA, 16 bp, Artificial Sequence
  synthetic [barcode part1]
aattcggcacggagac

SEQ ID NO: 27956 - DNA, 16 bp, Artificial Sequence
  synthetic [barcode part1]
ccagagatagtcttcg

SEQ ID NO: 27957 - DNA, 16 bp, Artificial Sequence
  synthetic [barcode part1]
aattgcacagtcgcgt

SEQ ID NO: 27958 - DNA, 16 bp, Artificial Sequence
  synthetic [barcode part1]
ttgcacctgttcctac

SEQ ID NO: 27959 - DNA, 16 bp, Artificial Sequence
  synthetic [barcode part1]
gcactggactatcctc

SEQ ID NO: 27960 - DNA, 16 bp, Artificial Sequence
  synthetic [barcode part1]
atctgacacgttcttg

SEQ ID NO: 27961 - DNA, 16 bp, Artificial Sequence
  synthetic [barcode part1]
acaaccgaactaaggt

SEQ ID NO: 27962 - DNA, 16 bp, Artificial Sequence
  synthetic [barcode part1]
ttactggttagtggcg

SEQ ID NO: 27963 - DNA, 16 bp, Artificial Sequence
  synthetic [barcode part1]
taactgcgaacgttcg

SEQ ID NO: 27964 - DNA, 16 bp, Artificial Sequence
  synthetic [barcode part1]
tgatcaccactgacag

SEQ ID NO: 27965 - DNA, 16 bp, Artificial Sequence
  synthetic [barcode part1]
aactgaccacacacac

SEQ ID NO: 27966 - DNA, 16 bp, Artificial Sequence
  synthetic [barcode part1]
ttaacgcacgcactag

SEQ ID NO: 27967 - DNA, 16 bp, Artificial Sequence
  synthetic [barcode part1]
tcagtagtaggtcacc

SEQ ID NO: 27968 - DNA, 16 bp, Artificial Sequence
  synthetic [barcode part1]
aaccgcgtatacagtc

SEQ ID NO: 27969 - DNA, 16 bp, Artificial Sequence
  synthetic [barcode part1]
tattgaggagtgcagt

SEQ ID NO: 27970 - DNA, 16 bp, Artificial Sequence
  synthetic [barcode part1]
tgcagtatcacttacc

SEQ ID NO: 27971 - DNA, 16 bp, Artificial Sequence
  synthetic [barcode part1]
atacggttcctctaac

SEQ ID NO: 27972 - DNA, 16 bp, Artificial Sequence
  synthetic [barcode part1]
atctcgcagtgacaac

SEQ ID NO: 27973 - DNA, 16 bp, Artificial Sequence
  synthetic [barcode part1]
accaccttattgcctc

SEQ ID NO: 27974 - DNA, 16 bp, Artificial Sequence
  synthetic [barcode part1]
tcttgtaaccgccgac

SEQ ID NO: 27975 - DNA, 16 bp, Artificial Sequence
  synthetic [barcode part1]
acggaacaatatccag

SEQ ID NO: 27976 - DNA, 16 bp, Artificial Sequence
  synthetic [barcode part1]
tggatctatcttgtcg

SEQ ID NO: 27977 - DNA, 16 bp, Artificial Sequence
  synthetic [barcode part1]
tgccttctcaatagtg

SEQ ID NO: 27978 - DNA, 16 bp, Artificial Sequence
  synthetic [barcode part1]
cgcggtgagtaagtgt

SEQ ID NO: 27979 - DNA, 16 bp, Artificial Sequence
  synthetic [barcode part1]
taacgtggtattcggc

SEQ ID NO: 27980 - DNA, 16 bp, Artificial Sequence
  synthetic [barcode part1]
cctctacctaccagag

SEQ ID NO: 27981 - DNA, 16 bp, Artificial Sequence
  synthetic [barcode part1]
cactagtgaagtcaag

SEQ ID NO: 27982 - DNA, 16 bp, Artificial Sequence
  synthetic [barcode part1]
actgtcagtgttcttg

SEQ ID NO: 27983 - DNA, 16 bp, Artificial Sequence
  synthetic [barcode part1]
taagtcgcgcaggaac

SEQ ID NO: 27984 - DNA, 16 bp, Artificial Sequence
  synthetic [barcode part1]
cagacgagacagatag

SEQ ID NO: 27985 - DNA, 16 bp, Artificial Sequence
  synthetic [barcode part1]
gtccttggacgatctc

SEQ ID NO: 27986 - DNA, 16 bp, Artificial Sequence
  synthetic [barcode part1]
accagatcgccttcac

SEQ ID NO: 27987 - DNA, 16 bp, Artificial Sequence
  synthetic [barcode part1]
tccacaacgttatctg

SEQ ID NO: 27988 - DNA, 16 bp, Artificial Sequence
  synthetic [barcode part1]
actagacctgcactcc

SEQ ID NO: 27989 - DNA, 16 bp, Artificial Sequence
  synthetic [barcode part1]
agttaccacaagagtg

SEQ ID NO: 27990 - DNA, 16 bp, Artificial Sequence
  synthetic [barcode part1]
tgtgttgacgttggtg

SEQ ID NO: 27991 - DNA, 16 bp, Artificial Sequence
  synthetic [barcode part1]
tgccgacgattaggag

SEQ ID NO: 27992 - DNA, 16 bp, Artificial Sequence
  synthetic [barcode part1]
tccgttcacggtgttg

SEQ ID NO: 27993 - DNA, 16 bp, Artificial Sequence
  synthetic [barcode part1]
cagtaggagacctacg

SEQ ID NO: 27994 - DNA, 16 bp, Artificial Sequence
  synthetic [barcode part1]
acctgtccgttataac

SEQ ID NO: 27995 - DNA, 16 bp, Artificial Sequence
  synthetic [barcode part1]
tctgttgacacggcct

SEQ ID NO: 27996 - DNA, 16 bp, Artificial Sequence
  synthetic [barcode part1]
actcaactcttacgtg

SEQ ID NO: 27997 - DNA, 16 bp, Artificial Sequence
  synthetic [barcode part1]
tgtactgacactggtg

SEQ ID NO: 27998 - DNA, 16 bp, Artificial Sequence
  synthetic [barcode part1]
taagaccgtcgcaatc

SEQ ID NO: 27999 - DNA, 16 bp, Artificial Sequence
  synthetic [barcode part1]
ttcgtccttgttcacg

SEQ ID NO: 28000 - DNA, 16 bp, Artificial Sequence
  synthetic [barcode part1]
gtctcaatcggaatcg

SEQ ID NO: 28001 - DNA, 16 bp, Artificial Sequence
  synthetic [barcode part1]
gaatcgtcggagacac

SEQ ID NO: 28002 - DNA, 16 bp, Artificial Sequence
  synthetic [barcode part1]
cctgtaacgttgtccg

SEQ ID NO: 28003 - DNA, 16 bp, Artificial Sequence
  synthetic [barcode part1]
taggactagtctcgac

SEQ ID NO: 28004 - DNA, 16 bp, Artificial Sequence
  synthetic [barcode part1]
taccgttctaccgtct

SEQ ID NO: 28005 - DNA, 16 bp, Artificial Sequence
  synthetic [barcode part1]
acacggcctagaagac

SEQ ID NO: 28006 - DNA, 16 bp, Artificial Sequence
  synthetic [barcode part1]
actgtcctggacactc

SEQ ID NO: 28007 - DNA, 16 bp, Artificial Sequence
  synthetic [barcode part1]
gaacgtgtccttgtag

SEQ ID NO: 28008 - DNA, 16 bp, Artificial Sequence
  synthetic [barcode part1]
cggttccttgatctct

SEQ ID NO: 28009 - DNA, 16 bp, Artificial Sequence
  synthetic [barcode part1]
ttgaggttctacctac

SEQ ID NO: 28010 - DNA, 16 bp, Artificial Sequence
  synthetic [barcode part1]
caggaagtagttgcgc

SEQ ID NO: 28011 - DNA, 16 bp, Artificial Sequence
  synthetic [barcode part1]
tcaggatcgtcacaac

SEQ ID NO: 28012 - DNA, 16 bp, Artificial Sequence
  synthetic [barcode part1]
cctccgacaattgcgt

SEQ ID NO: 28013 - DNA, 16 bp, Artificial Sequence
  synthetic [barcode part1]
cagagagtgatcgtgc

SEQ ID NO: 28014 - DNA, 16 bp, Artificial Sequence
  synthetic [barcode part1]
gatcaaccgatcaacc

SEQ ID NO: 28015 - DNA, 16 bp, Artificial Sequence
  synthetic [barcode part1]
actgtaggacactacc

SEQ ID NO: 28016 - DNA, 16 bp, Artificial Sequence
  synthetic [barcode part1]
gtgcgacttgactctc

SEQ ID NO: 28017 - DNA, 16 bp, Artificial Sequence
  synthetic [barcode part1]
gccaacagtctagact

SEQ ID NO: 28018 - DNA, 16 bp, Artificial Sequence
  synthetic [barcode part1]
ttaagaggtcgtcctg

SEQ ID NO: 28019 - DNA, 16 bp, Artificial Sequence
  synthetic [barcode part1]
atccggaacctgtagt

SEQ ID NO: 28020 - DNA, 16 bp, Artificial Sequence
  synthetic [barcode part1]
cgagtgcactatctcc

SEQ ID NO: 28021 - DNA, 16 bp, Artificial Sequence
  synthetic [barcode part1]
gatagaaggcctacgc

SEQ ID NO: 28022 - DNA, 16 bp, Artificial Sequence
  synthetic [barcode part1]
attgtggataggcggc

SEQ ID NO: 28023 - DNA, 16 bp, Artificial Sequence
  synthetic [barcode part1]
tctcaattcctcgacc

SEQ ID NO: 28024 - DNA, 16 bp, Artificial Sequence
  synthetic [barcode part1]
gtcgccagagaatacg

SEQ ID NO: 28025 - DNA, 16 bp, Artificial Sequence
  synthetic [barcode part1]
aattcttccaacgcgt

SEQ ID NO: 28026 - DNA, 16 bp, Artificial Sequence
  synthetic [barcode part1]
gactctagagtcctag

SEQ ID NO: 28027 - DNA, 16 bp, Artificial Sequence
  synthetic [barcode part1]
tcacggagacggtagt

SEQ ID NO: 28028 - DNA, 16 bp, Artificial Sequence
  synthetic [barcode part1]
cgtaaggtaacagttg

SEQ ID NO: 28029 - DNA, 16 bp, Artificial Sequence
  synthetic [barcode part1]
gacgtcacagtcagtt

SEQ ID NO: 28030 - DNA, 16 bp, Artificial Sequence
  synthetic [barcode part1]
cagttcttgtgactgt

SEQ ID NO: 28031 - DNA, 16 bp, Artificial Sequence
  synthetic [barcode part1]
gtatattgcgaccacg

SEQ ID NO: 28032 - DNA, 16 bp, Artificial Sequence
  synthetic [barcode part1]
gtcttcgttgccagac

SEQ ID NO: 28033 - DNA, 16 bp, Artificial Sequence
  synthetic [barcode part1]
acttaccgacgaacgt

SEQ ID NO: 28034 - DNA, 16 bp, Artificial Sequence
  synthetic [barcode part1]
acttccaacaatccgt

SEQ ID NO: 28035 - DNA, 16 bp, Artificial Sequence
  synthetic [barcode part1]
cgcgcggaatatattc

SEQ ID NO: 28036 - DNA, 16 bp, Artificial Sequence
  synthetic [barcode part1]
aacgccgaagatcttc

SEQ ID NO: 28037 - DNA, 16 bp, Artificial Sequence
  synthetic [barcode part1]
ccaggtctgtaggaag

SEQ ID NO: 28038 - DNA, 16 bp, Artificial Sequence
  synthetic [barcode part1]
gcctatactagacgtg

SEQ ID NO: 28039 - DNA, 16 bp, Artificial Sequence
  synthetic [barcode part1]
tactctaccgtaggcc

SEQ ID NO: 28040 - DNA, 16 bp, Artificial Sequence
  synthetic [barcode part1]
ataactgtcgactcct

SEQ ID NO: 28041 - DNA, 16 bp, Artificial Sequence
  synthetic [barcode part1]
gaggtccgacagatac

SEQ ID NO: 28042 - DNA, 16 bp, Artificial Sequence
  synthetic [barcode part1]
tacggataacgtccac

SEQ ID NO: 28043 - DNA, 16 bp, Artificial Sequence
  synthetic [barcode part1]
tgccgaatactggact

SEQ ID NO: 28044 - DNA, 16 bp, Artificial Sequence
  synthetic [barcode part1]
agagtccaataggtgt

SEQ ID NO: 28045 - DNA, 16 bp, Artificial Sequence
  synthetic [barcode part1]
tgttgacaaccttctg

SEQ ID NO: 28046 - DNA, 16 bp, Artificial Sequence
  synthetic [barcode part1]
cctaactggaaggtct

SEQ ID NO: 28047 - DNA, 16 bp, Artificial Sequence
  synthetic [barcode part1]
gcactaggaggtgact

SEQ ID NO: 28048 - DNA, 16 bp, Artificial Sequence
  synthetic [barcode part1]
gtggagaactagattc

SEQ ID NO: 28049 - DNA, 16 bp, Artificial Sequence
  synthetic [barcode part1]
tctcctctgaccgatt

SEQ ID NO: 28050 - DNA, 16 bp, Artificial Sequence
  synthetic [barcode part1]
tgtccacagtgaacac

SEQ ID NO: 28051 - DNA, 16 bp, Artificial Sequence
  synthetic [barcode part1]
ttaactccggactcgc

SEQ ID NO: 28052 - DNA, 16 bp, Artificial Sequence
  synthetic [barcode part1]
aattctcgccaggaac

SEQ ID NO: 28053 - DNA, 16 bp, Artificial Sequence
  synthetic [barcode part1]
tgtccgcgtcttaggt

SEQ ID NO: 28054 - DNA, 16 bp, Artificial Sequence
  synthetic [barcode part1]
gcaccgattccactac

SEQ ID NO: 28055 - DNA, 16 bp, Artificial Sequence
  synthetic [barcode part1]
tgcgaccgagaatcag

SEQ ID NO: 28056 - DNA, 16 bp, Artificial Sequence
  synthetic [barcode part1]
tggatcgttctgtact

SEQ ID NO: 28057 - DNA, 16 bp, Artificial Sequence
  synthetic [barcode part1]
ccaacaacgttgaacc

SEQ ID NO: 28058 - DNA, 16 bp, Artificial Sequence
  synthetic [barcode part1]
cgaataccgtgaactc

SEQ ID NO: 28059 - DNA, 16 bp, Artificial Sequence
  synthetic [barcode part1]
cctgtgttcgaaccac

SEQ ID NO: 28060 - DNA, 16 bp, Artificial Sequence
  synthetic [barcode part1]
cgtgtcgtcaatctcg

SEQ ID NO: 28061 - DNA, 16 bp, Artificial Sequence
  synthetic [barcode part1]
gtgacacacacacgtt

SEQ ID NO: 28062 - DNA, 16 bp, Artificial Sequence
  synthetic [barcode part1]
attgtcgcgtgccttg

SEQ ID NO: 28063 - DNA, 16 bp, Artificial Sequence
  synthetic [barcode part1]
caggtattagtccttc

SEQ ID NO: 28064 - DNA, 16 bp, Artificial Sequence
  synthetic [barcode part1]
taagtcctgagacaag

SEQ ID NO: 28065 - DNA, 16 bp, Artificial Sequence
  synthetic [barcode part1]
tgtagtcaaccgtgtg

SEQ ID NO: 28066 - DNA, 16 bp, Artificial Sequence
  synthetic [barcode part1]
tagttctgccgatatc

SEQ ID NO: 28067 - DNA, 16 bp, Artificial Sequence
  synthetic [barcode part1]
accgatattcgcgaac

SEQ ID NO: 28068 - DNA, 16 bp, Artificial Sequence
  synthetic [barcode part1]
gatcgacttgagacct

SEQ ID NO: 28069 - DNA, 16 bp, Artificial Sequence
  synthetic [barcode part1]
aacctaaccgacgact

SEQ ID NO: 28070 - DNA, 16 bp, Artificial Sequence
  synthetic [barcode part1]
ccggtctactcaggtt

SEQ ID NO: 28071 - DNA, 16 bp, Artificial Sequence
  synthetic [barcode part1]
attccacgcaactgtt

SEQ ID NO: 28072 - DNA, 16 bp, Artificial Sequence
  synthetic [barcode part1]
actacgaagactccac

SEQ ID NO: 28073 - DNA, 16 bp, Artificial Sequence
  synthetic [barcode part1]
tgacgcctgtctactg

SEQ ID NO: 28074 - DNA, 16 bp, Artificial Sequence
  synthetic [barcode part1]
attgtcgcgcaaggag

SEQ ID NO: 28075 - DNA, 16 bp, Artificial Sequence
  synthetic [barcode part1]
tccagaaggagagaac

SEQ ID NO: 28076 - DNA, 16 bp, Artificial Sequence
  synthetic [barcode part1]
accttgtagacgtctt

SEQ ID NO: 28077 - DNA, 16 bp, Artificial Sequence
  synthetic [barcode part1]
tagaccgtctcgtatt

SEQ ID NO: 28078 - DNA, 16 bp, Artificial Sequence
  synthetic [barcode part1]
gactctccaatcttcc

SEQ ID NO: 28079 - DNA, 16 bp, Artificial Sequence
  synthetic [barcode part1]
actacggcgttgtagt

SEQ ID NO: 28080 - DNA, 16 bp, Artificial Sequence
  synthetic [barcode part1]
gtcagtaagtaacgac

SEQ ID NO: 28081 - DNA, 16 bp, Artificial Sequence
  synthetic [barcode part1]
attactacgtgttccg

SEQ ID NO: 28082 - DNA, 16 bp, Artificial Sequence
  synthetic [barcode part1]
gataagttaccgtgag

SEQ ID NO: 28083 - DNA, 16 bp, Artificial Sequence
  synthetic [barcode part1]
ttccgtctactgtctg

SEQ ID NO: 28084 - DNA, 16 bp, Artificial Sequence
  synthetic [barcode part1]
aggacgaaggttcgtc

SEQ ID NO: 28085 - DNA, 16 bp, Artificial Sequence
  synthetic [barcode part1]
tccaatcactacacgt

SEQ ID NO: 28086 - DNA, 16 bp, Artificial Sequence
  synthetic [barcode part1]
tatcgaaggatcgcct

SEQ ID NO: 28087 - DNA, 16 bp, Artificial Sequence
  synthetic [barcode part1]
aagtaccttgcaggtc

SEQ ID NO: 28088 - DNA, 16 bp, Artificial Sequence
  synthetic [barcode part1]
ttcaactgcgtactac

SEQ ID NO: 28089 - DNA, 16 bp, Artificial Sequence
  synthetic [barcode part1]
tcgtcctcttctagtg

SEQ ID NO: 28090 - DNA, 16 bp, Artificial Sequence
  synthetic [barcode part1]
acgtgttggcgacaag

SEQ ID NO: 28091 - DNA, 16 bp, Artificial Sequence
  synthetic [barcode part1]
gcaatctagtgatccg

SEQ ID NO: 28092 - DNA, 16 bp, Artificial Sequence
  synthetic [barcode part1]
atatcaaccgacacgc

SEQ ID NO: 28093 - DNA, 16 bp, Artificial Sequence
  synthetic [barcode part1]
tctcaataactcgtgc

SEQ ID NO: 28094 - DNA, 16 bp, Artificial Sequence
  synthetic [barcode part1]
gcaattgttgaggaac

SEQ ID NO: 28095 - DNA, 16 bp, Artificial Sequence
  synthetic [barcode part1]
tctcgaatatctgtcg

SEQ ID NO: 28096 - DNA, 16 bp, Artificial Sequence
  synthetic [barcode part1]
gttcggactacggatt

SEQ ID NO: 28097 - DNA, 16 bp, Artificial Sequence
  synthetic [barcode part1]
ttaggcgtcgcgaatt

SEQ ID NO: 28098 - DNA, 16 bp, Artificial Sequence
  synthetic [barcode part1]
cgcgcgaatagttact

SEQ ID NO: 28099 - DNA, 16 bp, Artificial Sequence
  synthetic [barcode part1]
tcaacggtaccgaact

SEQ ID NO: 28100 - DNA, 16 bp, Artificial Sequence
  synthetic [barcode part1]
acaaggacgtgtctct

SEQ ID NO: 28101 - DNA, 16 bp, Artificial Sequence
  synthetic [barcode part1]
cggaacttgtacgtgt

SEQ ID NO: 28102 - DNA, 16 bp, Artificial Sequence
  synthetic [barcode part1]
ttgtactgagtcgttc

SEQ ID NO: 28103 - DNA, 16 bp, Artificial Sequence
  synthetic [barcode part1]
tcggcaacctgtgtct

SEQ ID NO: 28104 - DNA, 16 bp, Artificial Sequence
  synthetic [barcode part1]
agatcgtgttcagtgc

SEQ ID NO: 28105 - DNA, 16 bp, Artificial Sequence
  synthetic [barcode part1]
tgagactcaactggtc

SEQ ID NO: 28106 - DNA, 16 bp, Artificial Sequence
  synthetic [barcode part1]
taccaaccagtgtacg

SEQ ID NO: 28107 - DNA, 16 bp, Artificial Sequence
  synthetic [barcode part1]
ttatctgccgcgacac

SEQ ID NO: 28108 - DNA, 16 bp, Artificial Sequence
  synthetic [barcode part1]
tgcactataacgcacg

SEQ ID NO: 28109 - DNA, 16 bp, Artificial Sequence
  synthetic [barcode part1]
gactgactgtgacact

SEQ ID NO: 28110 - DNA, 16 bp, Artificial Sequence
  synthetic [barcode part1]
tctactacgcaggtcc

SEQ ID NO: 28111 - DNA, 16 bp, Artificial Sequence
  synthetic [barcode part1]
tgagaggcgatatatc

SEQ ID NO: 28112 - DNA, 16 bp, Artificial Sequence
  synthetic [barcode part1]
acacctcaacctggtc

SEQ ID NO: 28113 - DNA, 16 bp, Artificial Sequence
  synthetic [barcode part1]
agtggcaactctgttg

SEQ ID NO: 28114 - DNA, 16 bp, Artificial Sequence
  synthetic [barcode part1]
aactcgaagtccagtc

SEQ ID NO: 28115 - DNA, 16 bp, Artificial Sequence
  synthetic [barcode part1]
atcgaacctcgacaac

SEQ ID NO: 28116 - DNA, 16 bp, Artificial Sequence
  synthetic [barcode part1]
gtcgtagttacggtgt

SEQ ID NO: 28117 - DNA, 16 bp, Artificial Sequence
  synthetic [barcode part1]
ccttcaagttacgtgt

SEQ ID NO: 28118 - DNA, 16 bp, Artificial Sequence
  synthetic [barcode part1]
aagtgaacgttgcggc

SEQ ID NO: 28119 - DNA, 16 bp, Artificial Sequence
  synthetic [barcode part1]
gacgtagaataatccg

SEQ ID NO: 28120 - DNA, 16 bp, Artificial Sequence
  synthetic [barcode part1]
gaggtgtaattcggcg

SEQ ID NO: 28121 - DNA, 16 bp, Artificial Sequence
  synthetic [barcode part1]
ttctataccggcaact

SEQ ID NO: 28122 - DNA, 16 bp, Artificial Sequence
  synthetic [barcode part1]
taccgcctagactcgt

SEQ ID NO: 28123 - DNA, 16 bp, Artificial Sequence
  synthetic [barcode part1]
gcctactcgaatagac

SEQ ID NO: 28124 - DNA, 16 bp, Artificial Sequence
  synthetic [barcode part1]
tgtattcacgatccac

SEQ ID NO: 28125 - DNA, 16 bp, Artificial Sequence
  synthetic [barcode part1]
acgtggacttaacaag

SEQ ID NO: 28126 - DNA, 16 bp, Artificial Sequence
  synthetic [barcode part1]
ttggcagtcgtgcctt

SEQ ID NO: 28127 - DNA, 16 bp, Artificial Sequence
  synthetic [barcode part1]
ttgcgcgtaatacgtg

SEQ ID NO: 28128 - DNA, 16 bp, Artificial Sequence
  synthetic [barcode part1]
agactcgcacctcact

SEQ ID NO: 28129 - DNA, 16 bp, Artificial Sequence
  synthetic [barcode part1]
atccgaggcgataggt

SEQ ID NO: 28130 - DNA, 16 bp, Artificial Sequence
  synthetic [barcode part1]
tccgtaccaacagtcc

SEQ ID NO: 28131 - DNA, 16 bp, Artificial Sequence
  synthetic [barcode part1]
cagtaacgcactctcc

SEQ ID NO: 28132 - DNA, 16 bp, Artificial Sequence
  synthetic [barcode part1]
agactggatcaatacg

SEQ ID NO: 28133 - DNA, 16 bp, Artificial Sequence
  synthetic [barcode part1]
tgcagattctgagtgc

SEQ ID NO: 28134 - DNA, 16 bp, Artificial Sequence
  synthetic [barcode part1]
gagtatacgatagtcg

SEQ ID NO: 28135 - DNA, 16 bp, Artificial Sequence
  synthetic [barcode part1]
caatagtgaaggcact

SEQ ID NO: 28136 - DNA, 16 bp, Artificial Sequence
  synthetic [barcode part1]
tcaagacttgtctacc

SEQ ID NO: 28137 - DNA, 16 bp, Artificial Sequence
  synthetic [barcode part1]
gcctaatcagtctgag

SEQ ID NO: 28138 - DNA, 16 bp, Artificial Sequence
  synthetic [barcode part1]
ttagagacgtggaccg

SEQ ID NO: 28139 - DNA, 16 bp, Artificial Sequence
  synthetic [barcode part1]
gttccacacagttatc

SEQ ID NO: 28140 - DNA, 16 bp, Artificial Sequence
  synthetic [barcode part1]
atcctactgtcggcgt

SEQ ID NO: 28141 - DNA, 16 bp, Artificial Sequence
  synthetic [barcode part1]
tgacggtcttcgcgtt

SEQ ID NO: 28142 - DNA, 16 bp, Artificial Sequence
  synthetic [barcode part1]
cgtgacctaacctctg

SEQ ID NO: 28143 - DNA, 16 bp, Artificial Sequence
  synthetic [barcode part1]
cgcaccacaactatag

SEQ ID NO: 28144 - DNA, 16 bp, Artificial Sequence
  synthetic [barcode part1]
cggtacgttctaccac

SEQ ID NO: 28145 - DNA, 16 bp, Artificial Sequence
  synthetic [barcode part1]
gtctccttgattacag

SEQ ID NO: 28146 - DNA, 16 bp, Artificial Sequence
  synthetic [barcode part1]
acgaattggagactgt

SEQ ID NO: 28147 - DNA, 16 bp, Artificial Sequence
  synthetic [barcode part1]
aactattggcacgaag

SEQ ID NO: 28148 - DNA, 16 bp, Artificial Sequence
  synthetic [barcode part1]
tcggaatcacttgttc

SEQ ID NO: 28149 - DNA, 16 bp, Artificial Sequence
  synthetic [barcode part1]
ccgtaggataatcgtc

SEQ ID NO: 28150 - DNA, 16 bp, Artificial Sequence
  synthetic [barcode part1]
gtcgtaggaacggact

SEQ ID NO: 28151 - DNA, 16 bp, Artificial Sequence
  synthetic [barcode part1]
cacctatcagaatcct

SEQ ID NO: 28152 - DNA, 16 bp, Artificial Sequence
  synthetic [barcode part1]
ccgtatctatcaagtc

SEQ ID NO: 28153 - DNA, 16 bp, Artificial Sequence
  synthetic [barcode part1]
gaagtgagtgagttct

SEQ ID NO: 28154 - DNA, 16 bp, Artificial Sequence
  synthetic [barcode part1]
tcgtacacgtggttag

SEQ ID NO: 28155 - DNA, 16 bp, Artificial Sequence
  synthetic [barcode part1]
tgatctgactcgacag

SEQ ID NO: 28156 - DNA, 16 bp, Artificial Sequence
  synthetic [barcode part1]
gtagattggtctgcgt

SEQ ID NO: 28157 - DNA, 16 bp, Artificial Sequence
  synthetic [barcode part1]
gaacgtgaatcactag

SEQ ID NO: 28158 - DNA, 16 bp, Artificial Sequence
  synthetic [barcode part1]
tgcggcaatagtgttc

SEQ ID NO: 28159 - DNA, 16 bp, Artificial Sequence
  synthetic [barcode part1]
atacaccgtgatcgtg

SEQ ID NO: 28160 - DNA, 16 bp, Artificial Sequence
  synthetic [barcode part1]
taccaccagacgttcc

SEQ ID NO: 28161 - DNA, 16 bp, Artificial Sequence
  synthetic [barcode part1]
ttcactgaccactcct

SEQ ID NO: 28162 - DNA, 16 bp, Artificial Sequence
  synthetic [barcode part1]
gccaacacaggagact

SEQ ID NO: 28163 - DNA, 16 bp, Artificial Sequence
  synthetic [barcode part1]
caggtataggaattgc

SEQ ID NO: 28164 - DNA, 16 bp, Artificial Sequence
  synthetic [barcode part1]
gattagactactgccg

SEQ ID NO: 28165 - DNA, 16 bp, Artificial Sequence
  synthetic [barcode part1]
tggcaagtactcggag

SEQ ID NO: 28166 - DNA, 16 bp, Artificial Sequence
  synthetic [barcode part1]
aactggtactggtcac

SEQ ID NO: 28167 - DNA, 16 bp, Artificial Sequence
  synthetic [barcode part1]
tatcgcacttccttcg

SEQ ID NO: 28168 - DNA, 16 bp, Artificial Sequence
  synthetic [barcode part1]
cgttacctgaagaacc

SEQ ID NO: 28169 - DNA, 16 bp, Artificial Sequence
  synthetic [barcode part1]
actacgaaggtaagtc

SEQ ID NO: 28170 - DNA, 16 bp, Artificial Sequence
  synthetic [barcode part1]
gatctacgtctgcaag

SEQ ID NO: 28171 - DNA, 16 bp, Artificial Sequence
  synthetic [barcode part1]
caggtcagttgttggt

SEQ ID NO: 28172 - DNA, 16 bp, Artificial Sequence
  synthetic [barcode part1]
attgcgtagttgtgcg

SEQ ID NO: 28173 - DNA, 16 bp, Artificial Sequence
  synthetic [barcode part1]
tgtgacaagacaagtc

SEQ ID NO: 28174 - DNA, 16 bp, Artificial Sequence
  synthetic [barcode part1]
atctggtaaccaccag

SEQ ID NO: 28175 - DNA, 16 bp, Artificial Sequence
  synthetic [barcode part1]
cctcttcctctctctt

SEQ ID NO: 28176 - DNA, 16 bp, Artificial Sequence
  synthetic [barcode part1]
acgtatcctcgatccg

SEQ ID NO: 28177 - DNA, 16 bp, Artificial Sequence
  synthetic [barcode part1]
agtcgcaatcacgtgt

SEQ ID NO: 28178 - DNA, 16 bp, Artificial Sequence
  synthetic [barcode part1]
ccgtgtgttaacctcg

SEQ ID NO: 28179 - DNA, 16 bp, Artificial Sequence
  synthetic [barcode part1]
caaccttcacggtcgt

SEQ ID NO: 28180 - DNA, 16 bp, Artificial Sequence
  synthetic [barcode part1]
gaggaacttaccactc

SEQ ID NO: 28181 - DNA, 16 bp, Artificial Sequence
  synthetic [barcode part1]
cctatagaagtccgtg

SEQ ID NO: 28182 - DNA, 16 bp, Artificial Sequence
  synthetic [barcode part1]
tctctctgtcgatcac

SEQ ID NO: 28183 - DNA, 16 bp, Artificial Sequence
  synthetic [barcode part1]
tctataccacgtcctc

SEQ ID NO: 28184 - DNA, 16 bp, Artificial Sequence
  synthetic [barcode part1]
tctggtcctaatcctc

SEQ ID NO: 28185 - DNA, 16 bp, Artificial Sequence
  synthetic [barcode part1]
aggacttgcaacgttc

SEQ ID NO: 28186 - DNA, 16 bp, Artificial Sequence
  synthetic [barcode part1]
cgaccaggttaattgc

SEQ ID NO: 28187 - DNA, 16 bp, Artificial Sequence
  synthetic [barcode part1]
gactgcagtgtgttgt

SEQ ID NO: 28188 - DNA, 16 bp, Artificial Sequence
  synthetic [barcode part1]
cctggttcgcgattac

SEQ ID NO: 28189 - DNA, 16 bp, Artificial Sequence
  synthetic [barcode part1]
taggataggacgtccg

SEQ ID NO: 28190 - DNA, 16 bp, Artificial Sequence
  synthetic [barcode part1]
tatcacgcgtgatacg

SEQ ID NO: 28191 - DNA, 16 bp, Artificial Sequence
  synthetic [barcode part1]
cctagtccacaatcgc

SEQ ID NO: 28192 - DNA, 16 bp, Artificial Sequence
  synthetic [barcode part1]
gtgcagatatcctcag

SEQ ID NO: 28193 - DNA, 16 bp, Artificial Sequence
  synthetic [barcode part1]
aacgatagaatccgtg

SEQ ID NO: 28194 - DNA, 16 bp, Artificial Sequence
  synthetic [barcode part1]
cctcgttcgagtactg

SEQ ID NO: 28195 - DNA, 16 bp, Artificial Sequence
  synthetic [barcode part1]
ttaccgtcgtccaggt

SEQ ID NO: 28196 - DNA, 16 bp, Artificial Sequence
  synthetic [barcode part1]
ttggcaacagactgtc

SEQ ID NO: 28197 - DNA, 16 bp, Artificial Sequence
  synthetic [barcode part1]
gagaacctatagtcag

SEQ ID NO: 28198 - DNA, 16 bp, Artificial Sequence
  synthetic [barcode part1]
tgtgaggtgtgtcttg

SEQ ID NO: 28199 - DNA, 16 bp, Artificial Sequence
  synthetic [barcode part1]
agataaccggtggaag

SEQ ID NO: 28200 - DNA, 16 bp, Artificial Sequence
  synthetic [barcode part1]
aacctggtcctcacgt

SEQ ID NO: 28201 - DNA, 16 bp, Artificial Sequence
  synthetic [barcode part1]
gcctcacaacacgtct

SEQ ID NO: 28202 - DNA, 16 bp, Artificial Sequence
  synthetic [barcode part1]
cctctggtcaatctct

SEQ ID NO: 28203 - DNA, 16 bp, Artificial Sequence
  synthetic [barcode part1]
ttccaattggcaggac

SEQ ID NO: 28204 - DNA, 16 bp, Artificial Sequence
  synthetic [barcode part1]
tacagaacggcgactg

SEQ ID NO: 28205 - DNA, 16 bp, Artificial Sequence
  synthetic [barcode part1]
tgtgcctctcgacaac

SEQ ID NO: 28206 - DNA, 16 bp, Artificial Sequence
  synthetic [barcode part1]
tagtcctcacgtgatt

SEQ ID NO: 28207 - DNA, 16 bp, Artificial Sequence
  synthetic [barcode part1]
tctgcacggaagtatc

SEQ ID NO: 28208 - DNA, 16 bp, Artificial Sequence
  synthetic [barcode part1]
gatcgatcgatcgatc

SEQ ID NO: 28209 - DNA, 16 bp, Artificial Sequence
  synthetic [barcode part1]
ttctcaacggttgtac

SEQ ID NO: 28210 - DNA, 16 bp, Artificial Sequence
  synthetic [barcode part1]
tgtaggtcaaggtaac

SEQ ID NO: 28211 - DNA, 16 bp, Artificial Sequence
  synthetic [barcode part1]
taggtacgccgtcttc

SEQ ID NO: 28212 - DNA, 16 bp, Artificial Sequence
  synthetic [barcode part1]
tatacctccgcacttc

SEQ ID NO: 28213 - DNA, 16 bp, Artificial Sequence
  synthetic [barcode part1]
taagattccgactggc

SEQ ID NO: 28214 - DNA, 16 bp, Artificial Sequence
  synthetic [barcode part1]
tagactcgtctgtgag

SEQ ID NO: 28215 - DNA, 16 bp, Artificial Sequence
  synthetic [barcode part1]
aaggtctggtggacac

SEQ ID NO: 28216 - DNA, 16 bp, Artificial Sequence
  synthetic [barcode part1]
ttatcgcctcggacgt

SEQ ID NO: 28217 - DNA, 16 bp, Artificial Sequence
  synthetic [barcode part1]
tatagttaccgtctcg

SEQ ID NO: 28218 - DNA, 16 bp, Artificial Sequence
  synthetic [barcode part1]
tgaccagaaggtcctt

SEQ ID NO: 28219 - DNA, 16 bp, Artificial Sequence
  synthetic [barcode part1]
accaggtgagtacggt

SEQ ID NO: 28220 - DNA, 16 bp, Artificial Sequence
  synthetic [barcode part1]
tgtagtggtgagtaac

SEQ ID NO: 28221 - DNA, 16 bp, Artificial Sequence
  synthetic [barcode part1]
cgagattgtatcgcac

SEQ ID NO: 28222 - DNA, 16 bp, Artificial Sequence
  synthetic [barcode part1]
caggactcaaccaact

SEQ ID NO: 28223 - DNA, 16 bp, Artificial Sequence
  synthetic [barcode part1]
gtgttcagtgaactcg

SEQ ID NO: 28224 - DNA, 16 bp, Artificial Sequence
  synthetic [barcode part1]
aggcagttacgccaag

SEQ ID NO: 28225 - DNA, 16 bp, Artificial Sequence
  synthetic [barcode part1]
gtcgtataccgccttg

SEQ ID NO: 28226 - DNA, 16 bp, Artificial Sequence
  synthetic [barcode part1]
ttcaggtggtaacaag

SEQ ID NO: 28227 - DNA, 16 bp, Artificial Sequence
  synthetic [barcode part1]
agatactcaagacggt

SEQ ID NO: 28228 - DNA, 16 bp, Artificial Sequence
  synthetic [barcode part1]
aatcacggaccaaggc

SEQ ID NO: 28229 - DNA, 16 bp, Artificial Sequence
  synthetic [barcode part1]
aacctactctgttacg

SEQ ID NO: 28230 - DNA, 16 bp, Artificial Sequence
  synthetic [barcode part1]
acggatcttcttgact

SEQ ID NO: 28231 - DNA, 16 bp, Artificial Sequence
  synthetic [barcode part1]
gtgagttactaaggac

SEQ ID NO: 28232 - DNA, 16 bp, Artificial Sequence
  synthetic [barcode part1]
taggagatcctggtct

SEQ ID NO: 28233 - DNA, 16 bp, Artificial Sequence
  synthetic [barcode part1]
aatctcctcgaacgtt

SEQ ID NO: 28234 - DNA, 16 bp, Artificial Sequence
  synthetic [barcode part1]
caacggcagaagtgtc

SEQ ID NO: 28235 - DNA, 16 bp, Artificial Sequence
  synthetic [barcode part1]
tagattgtctccgtgt

SEQ ID NO: 28236 - DNA, 16 bp, Artificial Sequence
  synthetic [barcode part1]
atattccaccgaatcc

SEQ ID NO: 28237 - DNA, 16 bp, Artificial Sequence
  synthetic [barcode part1]
acgttccttgaatcac

SEQ ID NO: 28238 - DNA, 16 bp, Artificial Sequence
  synthetic [barcode part1]
cgtagtgtggagtctt

SEQ ID NO: 28239 - DNA, 16 bp, Artificial Sequence
  synthetic [barcode part1]
aatcggcgtacgtgtt

SEQ ID NO: 28240 - DNA, 16 bp, Artificial Sequence
  synthetic [barcode part1]
tgagtgttcgatacgc

SEQ ID NO: 28241 - DNA, 16 bp, Artificial Sequence
  synthetic [barcode part1]
aacgttaccgaccagt

SEQ ID NO: 28242 - DNA, 16 bp, Artificial Sequence
  synthetic [barcode part1]
gagataaggtaaggcc

SEQ ID NO: 28243 - DNA, 16 bp, Artificial Sequence
  synthetic [barcode part1]
gtgagagataccttcc

SEQ ID NO: 28244 - DNA, 16 bp, Artificial Sequence
  synthetic [barcode part1]
agaaggccgttagtgc

SEQ ID NO: 28245 - DNA, 16 bp, Artificial Sequence
  synthetic [barcode part1]
tggtagtggaacacgc

SEQ ID NO: 28246 - DNA, 16 bp, Artificial Sequence
  synthetic [barcode part1]
cggtgtaaggagtcgt

SEQ ID NO: 28247 - DNA, 16 bp, Artificial Sequence
  synthetic [barcode part1]
atcggttgatcggttg

SEQ ID NO: 28248 - DNA, 16 bp, Artificial Sequence
  synthetic [barcode part1]
tgttatcaacgacggc

SEQ ID NO: 28249 - DNA, 16 bp, Artificial Sequence
  synthetic [barcode part1]
gacgtcgagttgattc

SEQ ID NO: 28250 - DNA, 16 bp, Artificial Sequence
  synthetic [barcode part1]
agtctctgtcgtctct

SEQ ID NO: 28251 - DNA, 16 bp, Artificial Sequence
  synthetic [barcode part1]
acttggttcagtggtg

SEQ ID NO: 28252 - DNA, 16 bp, Artificial Sequence
  synthetic [barcode part1]
cacggtcgttatcctg

SEQ ID NO: 28253 - DNA, 16 bp, Artificial Sequence
  synthetic [barcode part1]
gaccaatagagaggac

SEQ ID NO: 28254 - DNA, 16 bp, Artificial Sequence
  synthetic [barcode part1]
gaagttcctactcgcc

SEQ ID NO: 28255 - DNA, 16 bp, Artificial Sequence
  synthetic [barcode part1]
caagtgccaatagagt

SEQ ID NO: 28256 - DNA, 16 bp, Artificial Sequence
  synthetic [barcode part1]
atcaacgacagagtac

SEQ ID NO: 28257 - DNA, 16 bp, Artificial Sequence
  synthetic [barcode part1]
acagttccttggtgag

SEQ ID NO: 28258 - DNA, 16 bp, Artificial Sequence
  synthetic [barcode part1]
gtaccgcacaagtgag

SEQ ID NO: 28259 - DNA, 16 bp, Artificial Sequence
  synthetic [barcode part1]
tagtgaagtcttgccg

SEQ ID NO: 28260 - DNA, 16 bp, Artificial Sequence
  synthetic [barcode part1]
aagaatccgtgtaacg

SEQ ID NO: 28261 - DNA, 16 bp, Artificial Sequence
  synthetic [barcode part1]
gaagtggaacaggatc

SEQ ID NO: 28262 - DNA, 16 bp, Artificial Sequence
  synthetic [barcode part1]
gtaacgtatcgaccac

SEQ ID NO: 28263 - DNA, 16 bp, Artificial Sequence
  synthetic [barcode part1]
cacgccaattgtacag

SEQ ID NO: 28264 - DNA, 16 bp, Artificial Sequence
  synthetic [barcode part1]
aaccgttagtagtccg

SEQ ID NO: 28265 - DNA, 16 bp, Artificial Sequence
  synthetic [barcode part1]
tcgtaggtgagttcgt

SEQ ID NO: 28266 - DNA, 16 bp, Artificial Sequence
  synthetic [barcode part1]
aaggcacgaagtgtag

SEQ ID NO: 28267 - DNA, 16 bp, Artificial Sequence
  synthetic [barcode part1]
caaggcagatatatcg

SEQ ID NO: 28268 - DNA, 16 bp, Artificial Sequence
  synthetic [barcode part1]
actcgaacttaggtgc

SEQ ID NO: 28269 - DNA, 16 bp, Artificial Sequence
  synthetic [barcode part1]
gtagtgtgtgtcgtac

SEQ ID NO: 28270 - DNA, 16 bp, Artificial Sequence
  synthetic [barcode part1]
ttgttgttgaggtggc

SEQ ID NO: 28271 - DNA, 16 bp, Artificial Sequence
  synthetic [barcode part1]
cgcggttcaacaagag

SEQ ID NO: 28272 - DNA, 16 bp, Artificial Sequence
  synthetic [barcode part1]
taatacgtgtgccggt

SEQ ID NO: 28273 - DNA, 16 bp, Artificial Sequence
  synthetic [barcode part1]
tggtcagtcagttggt

SEQ ID NO: 28274 - DNA, 16 bp, Artificial Sequence
  synthetic [barcode part1]
ccagattgcacggaag

SEQ ID NO: 28275 - DNA, 16 bp, Artificial Sequence
  synthetic [barcode part1]
agattcgactcctcgc

SEQ ID NO: 28276 - DNA, 16 bp, Artificial Sequence
  synthetic [barcode part1]
gcgatccgtaatctag

SEQ ID NO: 28277 - DNA, 16 bp, Artificial Sequence
  synthetic [barcode part1]
gaccttcacgcctaac

SEQ ID NO: 28278 - DNA, 16 bp, Artificial Sequence
  synthetic [barcode part1]
tctacgttgcaggagt

SEQ ID NO: 28279 - DNA, 16 bp, Artificial Sequence
  synthetic [barcode part1]
tggcgactacagagac

SEQ ID NO: 28280 - DNA, 16 bp, Artificial Sequence
  synthetic [barcode part1]
gaatatccaaggcagt

SEQ ID NO: 28281 - DNA, 16 bp, Artificial Sequence
  synthetic [barcode part1]
cgtctatacgatacct

SEQ ID NO: 28282 - DNA, 16 bp, Artificial Sequence
  synthetic [barcode part1]
taacgatccggcaact

SEQ ID NO: 28283 - DNA, 16 bp, Artificial Sequence
  synthetic [barcode part1]
ccaaccgtgattagtg

SEQ ID NO: 28284 - DNA, 16 bp, Artificial Sequence
  synthetic [barcode part1]
tacacggtagagaact

SEQ ID NO: 28285 - DNA, 16 bp, Artificial Sequence
  synthetic [barcode part1]
tcacgcgttctagtcg

SEQ ID NO: 28286 - DNA, 16 bp, Artificial Sequence
  synthetic [barcode part1]
gtacgaggaatcgtcg

SEQ ID NO: 28287 - DNA, 16 bp, Artificial Sequence
  synthetic [barcode part1]
tattgtctcacgcaac

SEQ ID NO: 28288 - DNA, 16 bp, Artificial Sequence
  synthetic [barcode part1]
aatcctcgtacgactt

SEQ ID NO: 28289 - DNA, 16 bp, Artificial Sequence
  synthetic [barcode part1]
aatctgcaggtaacag

SEQ ID NO: 28290 - DNA, 16 bp, Artificial Sequence
  synthetic [barcode part1]
atcgacactcgactcc

SEQ ID NO: 28291 - DNA, 16 bp, Artificial Sequence
  synthetic [barcode part1]
tggcaaggagttcacg

SEQ ID NO: 28292 - DNA, 16 bp, Artificial Sequence
  synthetic [barcode part1]
atactagacgtggcct

SEQ ID NO: 28293 - DNA, 16 bp, Artificial Sequence
  synthetic [barcode part1]
taggataggtgtgccg

SEQ ID NO: 28294 - DNA, 16 bp, Artificial Sequence
  synthetic [barcode part1]
gccaagaatcgacgtg

SEQ ID NO: 28295 - DNA, 16 bp, Artificial Sequence
  synthetic [barcode part1]
cacactcgttcaatac

SEQ ID NO: 28296 - DNA, 16 bp, Artificial Sequence
  synthetic [barcode part1]
gcacaacctccttggt

SEQ ID NO: 28297 - DNA, 16 bp, Artificial Sequence
  synthetic [barcode part1]
aggcacaggttcaacg

SEQ ID NO: 28298 - DNA, 16 bp, Artificial Sequence
  synthetic [barcode part1]
gtgttacgtccgttcg

SEQ ID NO: 28299 - DNA, 16 bp, Artificial Sequence
  synthetic [barcode part1]
actacctccgcgagtt

SEQ ID NO: 28300 - DNA, 16 bp, Artificial Sequence
  synthetic [barcode part1]
ccagttactcttctcg

SEQ ID NO: 28301 - DNA, 16 bp, Artificial Sequence
  synthetic [barcode part1]
gactgtaaccgatacc

SEQ ID NO: 28302 - DNA, 16 bp, Artificial Sequence
  synthetic [barcode part1]
cgtgaattaaggtgac

SEQ ID NO: 28303 - DNA, 16 bp, Artificial Sequence
  synthetic [barcode part1]
ccacaaggcctcttgt

SEQ ID NO: 28304 - DNA, 16 bp, Artificial Sequence
  synthetic [barcode part1]
actatctacgacggac

SEQ ID NO: 28305 - DNA, 16 bp, Artificial Sequence
  synthetic [barcode part1]
tgccggtctaacttcg

SEQ ID NO: 28306 - DNA, 16 bp, Artificial Sequence
  synthetic [barcode part1]
gagtggttaatctccg

SEQ ID NO: 28307 - DNA, 16 bp, Artificial Sequence
  synthetic [barcode part1]
gttacggaagtgaact

SEQ ID NO: 28308 - DNA, 16 bp, Artificial Sequence
  synthetic [barcode part1]
gaccagaataaggcag

SEQ ID NO: 28309 - DNA, 16 bp, Artificial Sequence
  synthetic [barcode part1]
tcaagacttacctgtc

SEQ ID NO: 28310 - DNA, 16 bp, Artificial Sequence
  synthetic [barcode part1]
actacaacaggtaggt

SEQ ID NO: 28311 - DNA, 16 bp, Artificial Sequence
  synthetic [barcode part1]
aactgacctagagtcc

SEQ ID NO: 28312 - DNA, 16 bp, Artificial Sequence
  synthetic [barcode part1]
gcgcgacagagttagt

SEQ ID NO: 28313 - DNA, 16 bp, Artificial Sequence
  synthetic [barcode part1]
tgacactcggaattcg

SEQ ID NO: 28314 - DNA, 16 bp, Artificial Sequence
  synthetic [barcode part1]
cgatcctcgtgatcac

SEQ ID NO: 28315 - DNA, 16 bp, Artificial Sequence
  synthetic [barcode part1]
caataataagacgcgc

SEQ ID NO: 28316 - DNA, 16 bp, Artificial Sequence
  synthetic [barcode part1]
tgtgaaccttaccgcc

SEQ ID NO: 28317 - DNA, 16 bp, Artificial Sequence
  synthetic [barcode part1]
taccagtctgaagaag

SEQ ID NO: 28318 - DNA, 16 bp, Artificial Sequence
  synthetic [barcode part1]
gatatcgcgatcgatc

SEQ ID NO: 28319 - DNA, 16 bp, Artificial Sequence
  synthetic [barcode part1]
tagaccaactggactc

SEQ ID NO: 28320 - DNA, 16 bp, Artificial Sequence
  synthetic [barcode part1]
aagtcgcgacacgagt

SEQ ID NO: 28321 - DNA, 16 bp, Artificial Sequence
  synthetic [barcode part1]
tgcctcaatccacgac

SEQ ID NO: 28322 - DNA, 16 bp, Artificial Sequence
  synthetic [barcode part1]
gttcggcagaacgtag

SEQ ID NO: 28323 - DNA, 16 bp, Artificial Sequence
  synthetic [barcode part1]
tggttagtgcgtgtac

SEQ ID NO: 28324 - DNA, 16 bp, Artificial Sequence
  synthetic [barcode part1]
tggacagttacaacag

SEQ ID NO: 28325 - DNA, 16 bp, Artificial Sequence
  synthetic [barcode part1]
tcaggacactctgagt

SEQ ID NO: 28326 - DNA, 16 bp, Artificial Sequence
  synthetic [barcode part1]
tctagttcgtgtaacc

SEQ ID NO: 28327 - DNA, 16 bp, Artificial Sequence
  synthetic [barcode part1]
agataacaatcgcacg

SEQ ID NO: 28328 - DNA, 16 bp, Artificial Sequence
  synthetic [barcode part1]
gcacaataacttcctc

SEQ ID NO: 28329 - DNA, 16 bp, Artificial Sequence
  synthetic [barcode part1]
tcgtcgtgaatagtgc

SEQ ID NO: 28330 - DNA, 16 bp, Artificial Sequence
  synthetic [barcode part1]
agaagtaggtgtggac

SEQ ID NO: 28331 - DNA, 16 bp, Artificial Sequence
  synthetic [barcode part1]
gcgtgacaaccaagac

SEQ ID NO: 28332 - DNA, 16 bp, Artificial Sequence
  synthetic [barcode part1]
tactactgagtcggac

SEQ ID NO: 28333 - DNA, 16 bp, Artificial Sequence
  synthetic [barcode part1]
agacaggaagtagacc

SEQ ID NO: 28334 - DNA, 16 bp, Artificial Sequence
  synthetic [barcode part1]
tcaatctgtccggacc

SEQ ID NO: 28335 - DNA, 16 bp, Artificial Sequence
  synthetic [barcode part1]
atattggcggcggagt

SEQ ID NO: 28336 - DNA, 16 bp, Artificial Sequence
  synthetic [barcode part1]
aggatctcacctattc

SEQ ID NO: 28337 - DNA, 16 bp, Artificial Sequence
  synthetic [barcode part1]
taaggccttctggagt

SEQ ID NO: 28338 - DNA, 16 bp, Artificial Sequence
  synthetic [barcode part1]
agtgaggtcttactgc

SEQ ID NO: 28339 - DNA, 16 bp, Artificial Sequence
  synthetic [barcode part1]
tgataactgcgagagt

SEQ ID NO: 28340 - DNA, 16 bp, Artificial Sequence
  synthetic [barcode part1]
cctgttcgtctatctg

SEQ ID NO: 28341 - DNA, 16 bp, Artificial Sequence
  synthetic [barcode part1]
agttaccttgcgtccg

SEQ ID NO: 28342 - DNA, 16 bp, Artificial Sequence
  synthetic [barcode part1]
agtacacaaccttctc

SEQ ID NO: 28343 - DNA, 16 bp, Artificial Sequence
  synthetic [barcode part1]
ttcagtgacagtccag

SEQ ID NO: 28344 - DNA, 16 bp, Artificial Sequence
  synthetic [barcode part1]
gactatcaacgactcg

SEQ ID NO: 28345 - DNA, 16 bp, Artificial Sequence
  synthetic [barcode part1]
gcagacttcttcagtt

SEQ ID NO: 28346 - DNA, 16 bp, Artificial Sequence
  synthetic [barcode part1]
tataggactggtggcg

SEQ ID NO: 28347 - DNA, 16 bp, Artificial Sequence
  synthetic [barcode part1]
gtaccagtagtagagt

SEQ ID NO: 28348 - DNA, 16 bp, Artificial Sequence
  synthetic [barcode part1]
cctaactggtcctctt

SEQ ID NO: 28349 - DNA, 16 bp, Artificial Sequence
  synthetic [barcode part1]
gttgtgaccgtgatac

SEQ ID NO: 28350 - DNA, 16 bp, Artificial Sequence
  synthetic [barcode part1]
agtaagacctctgacc

SEQ ID NO: 28351 - DNA, 16 bp, Artificial Sequence
  synthetic [barcode part1]
gtgtgaggacagttcg

SEQ ID NO: 28352 - DNA, 16 bp, Artificial Sequence
  synthetic [barcode part1]
ttagtggcggactatc

SEQ ID NO: 28353 - DNA, 16 bp, Artificial Sequence
  synthetic [barcode part1]
agtcggtgattctggt

SEQ ID NO: 28354 - DNA, 16 bp, Artificial Sequence
  synthetic [barcode part1]
ccaataatcgcgtctt

SEQ ID NO: 28355 - DNA, 16 bp, Artificial Sequence
  synthetic [barcode part1]
gtgattggagactaac

SEQ ID NO: 28356 - DNA, 16 bp, Artificial Sequence
  synthetic [barcode part1]
caccttcaccgaactg

SEQ ID NO: 28357 - DNA, 16 bp, Artificial Sequence
  synthetic [barcode part1]
gtggttatcaacttcc

SEQ ID NO: 28358 - DNA, 16 bp, Artificial Sequence
  synthetic [barcode part1]
tgaatcgacgttcttc

SEQ ID NO: 28359 - DNA, 16 bp, Artificial Sequence
  synthetic [barcode part1]
tgcagactatcgttct

SEQ ID NO: 28360 - DNA, 16 bp, Artificial Sequence
  synthetic [barcode part1]
cgcagtaggtgagtgt

SEQ ID NO: 28361 - DNA, 16 bp, Artificial Sequence
  synthetic [barcode part1]
aggtataccggtgacg

SEQ ID NO: 28362 - DNA, 16 bp, Artificial Sequence
  synthetic [barcode part1]
gtaggtgatagacgag

SEQ ID NO: 28363 - DNA, 16 bp, Artificial Sequence
  synthetic [barcode part1]
aaggttccgagatctc

SEQ ID NO: 28364 - DNA, 16 bp, Artificial Sequence
  synthetic [barcode part1]
aacgactctaggtcac

SEQ ID NO: 28365 - DNA, 16 bp, Artificial Sequence
  synthetic [barcode part1]
gatcgatcagttgacc

SEQ ID NO: 28366 - DNA, 16 bp, Artificial Sequence
  synthetic [barcode part1]
cgagttaacgcctctc

SEQ ID NO: 28367 - DNA, 16 bp, Artificial Sequence
  synthetic [barcode part1]
cgatcgcctatcactg

SEQ ID NO: 28368 - DNA, 16 bp, Artificial Sequence
  synthetic [barcode part1]
cacaggatagtaatcg

SEQ ID NO: 28369 - DNA, 16 bp, Artificial Sequence
  synthetic [barcode part1]
cgagagtcttataccg

SEQ ID NO: 28370 - DNA, 16 bp, Artificial Sequence
  synthetic [barcode part1]
aatccgttgaggcgag

SEQ ID NO: 28371 - DNA, 16 bp, Artificial Sequence
  synthetic [barcode part1]
agtccgatcctatact

SEQ ID NO: 28372 - DNA, 16 bp, Artificial Sequence
  synthetic [barcode part1]
actaaccaccagtcag

SEQ ID NO: 28373 - DNA, 16 bp, Artificial Sequence
  synthetic [barcode part1]
ttacgttgtggtccgc

SEQ ID NO: 28374 - DNA, 16 bp, Artificial Sequence
  synthetic [barcode part1]
gattcctgtcggaagt

SEQ ID NO: 28375 - DNA, 16 bp, Artificial Sequence
  synthetic [barcode part1]
cgacttcgaagaatcc

SEQ ID NO: 28376 - DNA, 16 bp, Artificial Sequence
  synthetic [barcode part1]
atctacttgccgcgac

SEQ ID NO: 28377 - DNA, 16 bp, Artificial Sequence
  synthetic [barcode part1]
caggcgtatcactctc

SEQ ID NO: 28378 - DNA, 16 bp, Artificial Sequence
  synthetic [barcode part1]
gacttgattccacgcc

SEQ ID NO: 28379 - DNA, 16 bp, Artificial Sequence
  synthetic [barcode part1]
tccagttccttccagt

SEQ ID NO: 28380 - DNA, 16 bp, Artificial Sequence
  synthetic [barcode part1]
ttaggtgtgtccgaac

SEQ ID NO: 28381 - DNA, 16 bp, Artificial Sequence
  synthetic [barcode part1]
gtcagaccagactgtt

SEQ ID NO: 28382 - DNA, 16 bp, Artificial Sequence
  synthetic [barcode part1]
cggaggatcaagaagt

SEQ ID NO: 28383 - DNA, 16 bp, Artificial Sequence
  synthetic [barcode part1]
ttgacagtactcttgc

SEQ ID NO: 28384 - DNA, 16 bp, Artificial Sequence
  synthetic [barcode part1]
tctgtcctggaacctg

SEQ ID NO: 28385 - DNA, 16 bp, Artificial Sequence
  synthetic [barcode part1]
ttgcgaatactccgcc

SEQ ID NO: 28386 - DNA, 16 bp, Artificial Sequence
  synthetic [barcode part1]
tggtgtaccagtgtac

SEQ ID NO: 28387 - DNA, 16 bp, Artificial Sequence
  synthetic [barcode part1]
ccagtatccgagagag

SEQ ID NO: 28388 - DNA, 16 bp, Artificial Sequence
  synthetic [barcode part1]
gccggtaccgttattc

SEQ ID NO: 28389 - DNA, 16 bp, Artificial Sequence
  synthetic [barcode part1]
gtatctgaggcgacag

SEQ ID NO: 28390 - DNA, 16 bp, Artificial Sequence
  synthetic [barcode part1]
ttggttctccacaagt

SEQ ID NO: 28391 - DNA, 16 bp, Artificial Sequence
  synthetic [barcode part1]
gtctgattgcgccttg

SEQ ID NO: 28392 - DNA, 16 bp, Artificial Sequence
  synthetic [barcode part1]
tagaccacacacctcc

SEQ ID NO: 28393 - DNA, 16 bp, Artificial Sequence
  synthetic [barcode part1]
atagtgagtagtcgtg

SEQ ID NO: 28394 - DNA, 16 bp, Artificial Sequence
  synthetic [barcode part1]
aaccgccgataacttg

SEQ ID NO: 28395 - DNA, 16 bp, Artificial Sequence
  synthetic [barcode part1]
cgttcactattcgtcc

SEQ ID NO: 28396 - DNA, 16 bp, Artificial Sequence
  synthetic [barcode part1]
gagtaccgaatccgtt

SEQ ID NO: 28397 - DNA, 16 bp, Artificial Sequence
  synthetic [barcode part1]
tcacgcgcaactatag

SEQ ID NO: 28398 - DNA, 16 bp, Artificial Sequence
  synthetic [barcode part1]
tagatcgatcggatcc

SEQ ID NO: 28399 - DNA, 16 bp, Artificial Sequence
  synthetic [barcode part1]
gtcggtccaatatcag

SEQ ID NO: 28400 - DNA, 16 bp, Artificial Sequence
  synthetic [barcode part1]
taccaccaggtgtctc

SEQ ID NO: 28401 - DNA, 16 bp, Artificial Sequence
  synthetic [barcode part1]
cgccgaatactcttgc

SEQ ID NO: 28402 - DNA, 16 bp, Artificial Sequence
  synthetic [barcode part1]
gcaaccagtcagtgtt

SEQ ID NO: 28403 - DNA, 16 bp, Artificial Sequence
  synthetic [barcode part1]
gacacgacgaatcacg

SEQ ID NO: 28404 - DNA, 16 bp, Artificial Sequence
  synthetic [barcode part1]
tcgcgtctactcttgt

SEQ ID NO: 28405 - DNA, 16 bp, Artificial Sequence
  synthetic [barcode part1]
agacggtggaataacg

SEQ ID NO: 28406 - DNA, 16 bp, Artificial Sequence
  synthetic [barcode part1]
ccgaatattcactgtc

SEQ ID NO: 28407 - DNA, 16 bp, Artificial Sequence
  synthetic [barcode part1]
tctgatcagaaccggt

SEQ ID NO: 28408 - DNA, 16 bp, Artificial Sequence
  synthetic [barcode part1]
tctcaagtactgcgag

SEQ ID NO: 28409 - DNA, 16 bp, Artificial Sequence
  synthetic [barcode part1]
tcgtgccacttctact

SEQ ID NO: 28410 - DNA, 16 bp, Artificial Sequence
  synthetic [barcode part1]
ccacggatattaacgc

SEQ ID NO: 28411 - DNA, 16 bp, Artificial Sequence
  synthetic [barcode part1]
tagattgtctcgcgtt

SEQ ID NO: 28412 - DNA, 16 bp, Artificial Sequence
  synthetic [barcode part1]
taggcgtgaagtgatt

SEQ ID NO: 28413 - DNA, 16 bp, Artificial Sequence
  synthetic [barcode part1]
tggttgttgttctacg

SEQ ID NO: 28414 - DNA, 16 bp, Artificial Sequence
  synthetic [barcode part1]
cacgcgttaactaacg

SEQ ID NO: 28415 - DNA, 16 bp, Artificial Sequence
  synthetic [barcode part1]
actgcgatctgaggtt

SEQ ID NO: 28416 - DNA, 16 bp, Artificial Sequence
  synthetic [barcode part1]
tgccttgtccaggtac

SEQ ID NO: 28417 - DNA, 16 bp, Artificial Sequence
  synthetic [barcode part1]
ttgcgtcacttggtgc

SEQ ID NO: 28418 - DNA, 16 bp, Artificial Sequence
  synthetic [barcode part1]
tcttgccagtgaagtg

SEQ ID NO: 28419 - DNA, 16 bp, Artificial Sequence
  synthetic [barcode part1]
gagaacgtaggttgcc

SEQ ID NO: 28420 - DNA, 16 bp, Artificial Sequence
  synthetic [barcode part1]
tctgttatctccggtc

SEQ ID NO: 28421 - DNA, 16 bp, Artificial Sequence
  synthetic [barcode part1]
aggaccttagacaagt

SEQ ID NO: 28422 - DNA, 16 bp, Artificial Sequence
  synthetic [barcode part1]
gtgaggtgtgagttcg

SEQ ID NO: 28423 - DNA, 16 bp, Artificial Sequence
  synthetic [barcode part1]
cgtgaacacttcactt

SEQ ID NO: 28424 - DNA, 16 bp, Artificial Sequence
  synthetic [barcode part1]
ataatacgtcgcgacc

SEQ ID NO: 28425 - DNA, 16 bp, Artificial Sequence
  synthetic [barcode part1]
cggacacaattacgtc

SEQ ID NO: 28426 - DNA, 16 bp, Artificial Sequence
  synthetic [barcode part1]
cgaagttgccaactac

SEQ ID NO: 28427 - DNA, 16 bp, Artificial Sequence
  synthetic [barcode part1]
gttactcggcagagtt

SEQ ID NO: 28428 - DNA, 16 bp, Artificial Sequence
  synthetic [barcode part1]
aagagtacgccaggtc

SEQ ID NO: 28429 - DNA, 16 bp, Artificial Sequence
  synthetic [barcode part1]
cagtgaggaacttgcg

SEQ ID NO: 28430 - DNA, 16 bp, Artificial Sequence
  synthetic [barcode part1]
ttgagaatcgaacgtg

SEQ ID NO: 28431 - DNA, 16 bp, Artificial Sequence
  synthetic [barcode part1]
ttaggacagtagacac

SEQ ID NO: 28432 - DNA, 16 bp, Artificial Sequence
  synthetic [barcode part1]
gattctgtcgtctgcg

SEQ ID NO: 28433 - DNA, 16 bp, Artificial Sequence
  synthetic [barcode part1]
gtgttgtgacactgtg

SEQ ID NO: 28434 - DNA, 16 bp, Artificial Sequence
  synthetic [barcode part1]
cggtaatagaagtacc

SEQ ID NO: 28435 - DNA, 16 bp, Artificial Sequence
  synthetic [barcode part1]
gtgtcctccgatagtc

SEQ ID NO: 28436 - DNA, 16 bp, Artificial Sequence
  synthetic [barcode part1]
gttagtgatcttccac

SEQ ID NO: 28437 - DNA, 16 bp, Artificial Sequence
  synthetic [barcode part1]
taggactagtcggttc

SEQ ID NO: 28438 - DNA, 16 bp, Artificial Sequence
  synthetic [barcode part1]
aattcggtacaggaac

SEQ ID NO: 28439 - DNA, 16 bp, Artificial Sequence
  synthetic [barcode part1]
gaagtggaagtctatc

SEQ ID NO: 28440 - DNA, 16 bp, Artificial Sequence
  synthetic [barcode part1]
tccgtctactccagag

SEQ ID NO: 28441 - DNA, 16 bp, Artificial Sequence
  synthetic [barcode part1]
ttgcgatcgatcaacg

SEQ ID NO: 28442 - DNA, 16 bp, Artificial Sequence
  synthetic [barcode part1]
accgtaacgttcgtcc

SEQ ID NO: 28443 - DNA, 16 bp, Artificial Sequence
  synthetic [barcode part1]
actccgcagtagtagt

SEQ ID NO: 28444 - DNA, 16 bp, Artificial Sequence
  synthetic [barcode part1]
caggattaccgtagtc

SEQ ID NO: 28445 - DNA, 16 bp, Artificial Sequence
  synthetic [barcode part1]
taggtggtcacgacag

SEQ ID NO: 28446 - DNA, 16 bp, Artificial Sequence
  synthetic [barcode part1]
gcgttataagtagacg

SEQ ID NO: 28447 - DNA, 16 bp, Artificial Sequence
  synthetic [barcode part1]
agacgacaaggatcag

SEQ ID NO: 28448 - DNA, 16 bp, Artificial Sequence
  synthetic [barcode part1]
tacggagtaataaccg

SEQ ID NO: 28449 - DNA, 16 bp, Artificial Sequence
  synthetic [barcode part1]
gtacaataggactggt

SEQ ID NO: 28450 - DNA, 16 bp, Artificial Sequence
  synthetic [barcode part1]
gtaggccagtctatac

SEQ ID NO: 28451 - DNA, 16 bp, Artificial Sequence
  synthetic [barcode part1]
ttataggcctgacctt

SEQ ID NO: 28452 - DNA, 16 bp, Artificial Sequence
  synthetic [barcode part1]
gcagaggaagagtact

SEQ ID NO: 28453 - DNA, 16 bp, Artificial Sequence
  synthetic [barcode part1]
aggacttacgaacaac

SEQ ID NO: 28454 - DNA, 16 bp, Artificial Sequence
  synthetic [barcode part1]
aggactcgtggtactt

SEQ ID NO: 28455 - DNA, 16 bp, Artificial Sequence
  synthetic [barcode part1]
tggtctatactggacg

SEQ ID NO: 28456 - DNA, 16 bp, Artificial Sequence
  synthetic [barcode part1]
tatcactaacacgtcc

SEQ ID NO: 28457 - DNA, 16 bp, Artificial Sequence
  synthetic [barcode part1]
caacgtaatcgaagac

SEQ ID NO: 28458 - DNA, 16 bp, Artificial Sequence
  synthetic [barcode part1]
gaaggtaccaccaggt

SEQ ID NO: 28459 - DNA, 16 bp, Artificial Sequence
  synthetic [barcode part1]
acggtccagactattg

SEQ ID NO: 28460 - DNA, 16 bp, Artificial Sequence
  synthetic [barcode part1]
actaacctcgaagtcg

SEQ ID NO: 28461 - DNA, 16 bp, Artificial Sequence
  synthetic [barcode part1]
aggcgcgtaataattg

SEQ ID NO: 28462 - DNA, 16 bp, Artificial Sequence
  synthetic [barcode part1]
caacgacggaagtatt

SEQ ID NO: 28463 - DNA, 16 bp, Artificial Sequence
  synthetic [barcode part1]
tgttgttgtccagatc

SEQ ID NO: 28464 - DNA, 16 bp, Artificial Sequence
  synthetic [barcode part1]
cgaccacaacgtattg

SEQ ID NO: 28465 - DNA, 16 bp, Artificial Sequence
  synthetic [barcode part1]
cggttggccaattaac

SEQ ID NO: 28466 - DNA, 16 bp, Artificial Sequence
  synthetic [barcode part1]
ccttgtaccttcacgt

SEQ ID NO: 28467 - DNA, 16 bp, Artificial Sequence
  synthetic [barcode part1]
gcctcacctactactt

SEQ ID NO: 28468 - DNA, 16 bp, Artificial Sequence
  synthetic [barcode part1]
gagactcagtaggcgt

SEQ ID NO: 28469 - DNA, 16 bp, Artificial Sequence
  synthetic [barcode part1]
acaactccgttgaacg

SEQ ID NO: 28470 - DNA, 16 bp, Artificial Sequence
  synthetic [barcode part1]
tacgtgaatctggacc

SEQ ID NO: 28471 - DNA, 16 bp, Artificial Sequence
  synthetic [barcode part1]
gaagaagaccgactag

SEQ ID NO: 28472 - DNA, 16 bp, Artificial Sequence
  synthetic [barcode part1]
tctcctcagaagaggt

SEQ ID NO: 28473 - DNA, 16 bp, Artificial Sequence
  synthetic [barcode part1]
tgacgttactccgaag

SEQ ID NO: 28474 - DNA, 16 bp, Artificial Sequence
  synthetic [barcode part1]
gcgtgaatacctctag

SEQ ID NO: 28475 - DNA, 16 bp, Artificial Sequence
  synthetic [barcode part1]
agatcacctgtgcctc

SEQ ID NO: 28476 - DNA, 16 bp, Artificial Sequence
  synthetic [barcode part1]
cgactataggttagag

SEQ ID NO: 28477 - DNA, 16 bp, Artificial Sequence
  synthetic [barcode part1]
attcgtccgtcgcagt

SEQ ID NO: 28478 - DNA, 16 bp, Artificial Sequence
  synthetic [barcode part1]
aggagacggtaacaac

SEQ ID NO: 28479 - DNA, 16 bp, Artificial Sequence
  synthetic [barcode part1]
acgattccaagttgcg

SEQ ID NO: 28480 - DNA, 16 bp, Artificial Sequence
  synthetic [barcode part1]
actacggaccttaggt

SEQ ID NO: 28481 - DNA, 16 bp, Artificial Sequence
  synthetic [barcode part1]
agagttcgacgaacgc

SEQ ID NO: 28482 - DNA, 16 bp, Artificial Sequence
  synthetic [barcode part1]
acagattcgactctct

SEQ ID NO: 28483 - DNA, 16 bp, Artificial Sequence
  synthetic [barcode part1]
acgcctcttaacaact

SEQ ID NO: 28484 - DNA, 16 bp, Artificial Sequence
  synthetic [barcode part1]
attctcgaggtcgcct

SEQ ID NO: 28485 - DNA, 16 bp, Artificial Sequence
  synthetic [barcode part1]
atctgcaattacctcg

SEQ ID NO: 28486 - DNA, 16 bp, Artificial Sequence
  synthetic [barcode part1]
cggaggacacgtgatt

SEQ ID NO: 28487 - DNA, 16 bp, Artificial Sequence
  synthetic [barcode part1]
atatactgccttccag

SEQ ID NO: 28488 - DNA, 16 bp, Artificial Sequence
  synthetic [barcode part1]
ttagttccaggcctgc

SEQ ID NO: 28489 - DNA, 16 bp, Artificial Sequence
  synthetic [barcode part1]
atcaggttccgcactc

SEQ ID NO: 28490 - DNA, 16 bp, Artificial Sequence
  synthetic [barcode part1]
acacgacaactgaagt

SEQ ID NO: 28491 - DNA, 16 bp, Artificial Sequence
  synthetic [barcode part1]
gaagacaagaccgcct

SEQ ID NO: 28492 - DNA, 16 bp, Artificial Sequence
  synthetic [barcode part1]
tggcaagttgtaagtg

SEQ ID NO: 28493 - DNA, 16 bp, Artificial Sequence
  synthetic [barcode part1]
gaggtgtactgttaag

SEQ ID NO: 28494 - DNA, 16 bp, Artificial Sequence
  synthetic [barcode part1]
tccgatcgtcagtacc

SEQ ID NO: 28495 - DNA, 16 bp, Artificial Sequence
  synthetic [barcode part1]
gaaccagattgcgcag

SEQ ID NO: 28496 - DNA, 16 bp, Artificial Sequence
  synthetic [barcode part1]
gcggttctctgtatcg

SEQ ID NO: 28497 - DNA, 16 bp, Artificial Sequence
  synthetic [barcode part1]
gtctgccttgttcgtt

SEQ ID NO: 28498 - DNA, 16 bp, Artificial Sequence
  synthetic [barcode part1]
acgttggactggaggt

SEQ ID NO: 28499 - DNA, 16 bp, Artificial Sequence
  synthetic [barcode part1]
acgtcggaggaactac

SEQ ID NO: 28500 - DNA, 16 bp, Artificial Sequence
  synthetic [barcode part1]
gcaattactgaggagt

SEQ ID NO: 28501 - DNA, 16 bp, Artificial Sequence
  synthetic [barcode part1]
gcgcactcgttaatag

SEQ ID NO: 28502 - DNA, 16 bp, Artificial Sequence
  synthetic [barcode part1]
ataaggactggtgatc

SEQ ID NO: 28503 - DNA, 16 bp, Artificial Sequence
  synthetic [barcode part1]
atagtagtgcctcgtg

SEQ ID NO: 28504 - DNA, 16 bp, Artificial Sequence
  synthetic [barcode part1]
aacgtcgtcctctctt

SEQ ID NO: 28505 - DNA, 16 bp, Artificial Sequence
  synthetic [barcode part1]
atcctattactggcac

SEQ ID NO: 28506 - DNA, 16 bp, Artificial Sequence
  synthetic [barcode part1]
tacctcggacagaatc

SEQ ID NO: 28507 - DNA, 16 bp, Artificial Sequence
  synthetic [barcode part1]
gaggcaattgtcttgc

SEQ ID NO: 28508 - DNA, 16 bp, Artificial Sequence
  synthetic [barcode part1]
gagttgtcgtcctcac

SEQ ID NO: 28509 - DNA, 16 bp, Artificial Sequence
  synthetic [barcode part1]
cgaccagttagttgac

SEQ ID NO: 28510 - DNA, 16 bp, Artificial Sequence
  synthetic [barcode part1]
aagttactcgccgagt

SEQ ID NO: 28511 - DNA, 16 bp, Artificial Sequence
  synthetic [barcode part1]
accacctaacaagacc

SEQ ID NO: 28512 - DNA, 16 bp, Artificial Sequence
  synthetic [barcode part1]
gagaatacaccggacc

SEQ ID NO: 28513 - DNA, 16 bp, Artificial Sequence
  synthetic [barcode part1]
caggtcagtacttctt

SEQ ID NO: 28514 - DNA, 16 bp, Artificial Sequence
  synthetic [barcode part1]
atcggtagagtcaggc

SEQ ID NO: 28515 - DNA, 16 bp, Artificial Sequence
  synthetic [barcode part1]
ttacggaactctctac

SEQ ID NO: 28516 - DNA, 16 bp, Artificial Sequence
  synthetic [barcode part1]
gtgactgagaaggcct

SEQ ID NO: 28517 - DNA, 16 bp, Artificial Sequence
  synthetic [barcode part1]
aagtcacgatacagac

SEQ ID NO: 28518 - DNA, 16 bp, Artificial Sequence
  synthetic [barcode part1]
tcgtcgtctaccttac

SEQ ID NO: 28519 - DNA, 16 bp, Artificial Sequence
  synthetic [barcode part1]
tactgcagaggaagag

SEQ ID NO: 28520 - DNA, 16 bp, Artificial Sequence
  synthetic [barcode part1]
agattcgtagacctgc

SEQ ID NO: 28521 - DNA, 16 bp, Artificial Sequence
  synthetic [barcode part1]
gtcacaattcgttcac

SEQ ID NO: 28522 - DNA, 16 bp, Artificial Sequence
  synthetic [barcode part1]
tcaaccaactgaccag

SEQ ID NO: 28523 - DNA, 16 bp, Artificial Sequence
  synthetic [barcode part1]
acgtgtacgtgatacc

SEQ ID NO: 28524 - DNA, 16 bp, Artificial Sequence
  synthetic [barcode part1]
gagatagatccacagt

SEQ ID NO: 28525 - DNA, 16 bp, Artificial Sequence
  synthetic [barcode part1]
ttcgtagttcactacg

SEQ ID NO: 28526 - DNA, 16 bp, Artificial Sequence
  synthetic [barcode part1]
tctattggcacttgac

SEQ ID NO: 28527 - DNA, 16 bp, Artificial Sequence
  synthetic [barcode part1]
caatcgtactctctag

SEQ ID NO: 28528 - DNA, 16 bp, Artificial Sequence
  synthetic [barcode part1]
tacgtagtggattcgc

SEQ ID NO: 28529 - DNA, 16 bp, Artificial Sequence
  synthetic [barcode part1]
gaacactaggcagtgc

SEQ ID NO: 28530 - DNA, 16 bp, Artificial Sequence
  synthetic [barcode part1]
gacttcaacgaacaag

SEQ ID NO: 28531 - DNA, 16 bp, Artificial Sequence
  synthetic [barcode part1]
attccgactggaactg

SEQ ID NO: 28532 - DNA, 16 bp, Artificial Sequence
  synthetic [barcode part1]
cacttatcgcctgttc

SEQ ID NO: 28533 - DNA, 16 bp, Artificial Sequence
  synthetic [barcode part1]
atacgactgcgtaacc

SEQ ID NO: 28534 - DNA, 16 bp, Artificial Sequence
  synthetic [barcode part1]
agagacgtagattgtc

SEQ ID NO: 28535 - DNA, 16 bp, Artificial Sequence
  synthetic [barcode part1]
agtcgcaccgatctct

SEQ ID NO: 28536 - DNA, 16 bp, Artificial Sequence
  synthetic [barcode part1]
tgtcagtccggaagag

SEQ ID NO: 28537 - DNA, 16 bp, Artificial Sequence
  synthetic [barcode part1]
tgccgaactatatcct

SEQ ID NO: 28538 - DNA, 16 bp, Artificial Sequence
  synthetic [barcode part1]
tgtacagacgagacgc

SEQ ID NO: 28539 - DNA, 16 bp, Artificial Sequence
  synthetic [barcode part1]
tgattcttgaccacac

SEQ ID NO: 28540 - DNA, 16 bp, Artificial Sequence
  synthetic [barcode part1]
agttcctggtccacgt

SEQ ID NO: 28541 - DNA, 16 bp, Artificial Sequence
  synthetic [barcode part1]
gcaagaacaactcagt

SEQ ID NO: 28542 - DNA, 16 bp, Artificial Sequence
  synthetic [barcode part1]
gattctgttcgagacg

SEQ ID NO: 28543 - DNA, 16 bp, Artificial Sequence
  synthetic [barcode part1]
taggtcgaatcgtcgt

SEQ ID NO: 28544 - DNA, 16 bp, Artificial Sequence
  synthetic [barcode part1]
gtaacacctgatcgac

SEQ ID NO: 28545 - DNA, 16 bp, Artificial Sequence
  synthetic [barcode part1]
cctatccgttcacttg

SEQ ID NO: 28546 - DNA, 16 bp, Artificial Sequence
  synthetic [barcode part1]
acggactacgtagtct

SEQ ID NO: 28547 - DNA, 16 bp, Artificial Sequence
  synthetic [barcode part1]
tgcgaaggccaagttg

SEQ ID NO: 28548 - DNA, 16 bp, Artificial Sequence
  synthetic [barcode part1]
agaggtgtagactgcc

SEQ ID NO: 28549 - DNA, 16 bp, Artificial Sequence
  synthetic [barcode part1]
aaccgcacttcttagt

SEQ ID NO: 28550 - DNA, 16 bp, Artificial Sequence
  synthetic [barcode part1]
cggacgttatagatcc

SEQ ID NO: 28551 - DNA, 16 bp, Artificial Sequence
  synthetic [barcode part1]
atacctgagtgcctag

SEQ ID NO: 28552 - DNA, 16 bp, Artificial Sequence
  synthetic [barcode part1]
tatcgtgaccgtagtg

SEQ ID NO: 28553 - DNA, 16 bp, Artificial Sequence
  synthetic [barcode part1]
gtccagagtgaactct

SEQ ID NO: 28554 - DNA, 16 bp, Artificial Sequence
  synthetic [barcode part1]
tctactaccttgtcgc

SEQ ID NO: 28555 - DNA, 16 bp, Artificial Sequence
  synthetic [barcode part1]
aagaaggcgtgtacag

SEQ ID NO: 28556 - DNA, 16 bp, Artificial Sequence
  synthetic [barcode part1]
agagttaggtctgtag

SEQ ID NO: 28557 - DNA, 16 bp, Artificial Sequence
  synthetic [barcode part1]
agaactcgaattccgc

SEQ ID NO: 28558 - DNA, 16 bp, Artificial Sequence
  synthetic [barcode part1]
atactggccttcaatc

SEQ ID NO: 28559 - DNA, 16 bp, Artificial Sequence
  synthetic [barcode part1]
gtggacttcgaacgtt

SEQ ID NO: 28560 - DNA, 16 bp, Artificial Sequence
  synthetic [barcode part1]
gtctagtcgcaccttg

SEQ ID NO: 28561 - DNA, 16 bp, Artificial Sequence
  synthetic [barcode part1]
tggcacgaaggtagtc

SEQ ID NO: 28562 - DNA, 16 bp, Artificial Sequence
  synthetic [barcode part1]
accgtgagtgaatagt

SEQ ID NO: 28563 - DNA, 16 bp, Artificial Sequence
  synthetic [barcode part1]
ttcagactcgcgtaag

SEQ ID NO: 28564 - DNA, 16 bp, Artificial Sequence
  synthetic [barcode part1]
cctagtctacgtgacc

SEQ ID NO: 28565 - DNA, 16 bp, Artificial Sequence
  synthetic [barcode part1]
tcggtattctcgattg

SEQ ID NO: 28566 - DNA, 16 bp, Artificial Sequence
  synthetic [barcode part1]
cagttcttgacgtact

SEQ ID NO: 28567 - DNA, 16 bp, Artificial Sequence
  synthetic [barcode part1]
tgcggacagtagagtc

SEQ ID NO: 28568 - DNA, 16 bp, Artificial Sequence
  synthetic [barcode part1]
cgaattcagactcgtg

SEQ ID NO: 28569 - DNA, 16 bp, Artificial Sequence
  synthetic [barcode part1]
cgagagaagagttgac

SEQ ID NO: 28570 - DNA, 16 bp, Artificial Sequence
  synthetic [barcode part1]
tcgaagtagtaccacc

SEQ ID NO: 28571 - DNA, 16 bp, Artificial Sequence
  synthetic [barcode part1]
tgtgtaacgagagact

SEQ ID NO: 28572 - DNA, 16 bp, Artificial Sequence
  synthetic [barcode part1]
agtgcgtcgtgtaact

SEQ ID NO: 28573 - DNA, 16 bp, Artificial Sequence
  synthetic [barcode part1]
acggacacttactcag

SEQ ID NO: 28574 - DNA, 16 bp, Artificial Sequence
  synthetic [barcode part1]
gtaagattgtctggag

SEQ ID NO: 28575 - DNA, 16 bp, Artificial Sequence
  synthetic [barcode part1]
acctaacgcaccttcg

SEQ ID NO: 28576 - DNA, 16 bp, Artificial Sequence
  synthetic [barcode part1]
atatcctaggacacgc

SEQ ID NO: 28577 - DNA, 16 bp, Artificial Sequence
  synthetic [barcode part1]
agtgttgtgaccaacc

SEQ ID NO: 28578 - DNA, 16 bp, Artificial Sequence
  synthetic [barcode part1]
tctgactgcgcgttgt

SEQ ID NO: 28579 - DNA, 16 bp, Artificial Sequence
  synthetic [barcode part1]
agagattgtcgatacg

SEQ ID NO: 28580 - DNA, 16 bp, Artificial Sequence
  synthetic [barcode part1]
tatctcttggcagttg

SEQ ID NO: 28581 - DNA, 16 bp, Artificial Sequence
  synthetic [barcode part1]
agaaccttccacctgc

SEQ ID NO: 28582 - DNA, 16 bp, Artificial Sequence
  synthetic [barcode part1]
tgcacttgtgacttgt

SEQ ID NO: 28583 - DNA, 16 bp, Artificial Sequence
  synthetic [barcode part1]
gtgagtggtagtgtcg

SEQ ID NO: 28584 - DNA, 16 bp, Artificial Sequence
  synthetic [barcode part1]
aggataactcgtcacc

SEQ ID NO: 28585 - DNA, 16 bp, Artificial Sequence
  synthetic [barcode part1]
ttgtcttagtcacgtg

SEQ ID NO: 28586 - DNA, 16 bp, Artificial Sequence
  synthetic [barcode part1]
taccttgcactgtcct

SEQ ID NO: 28587 - DNA, 16 bp, Artificial Sequence
  synthetic [barcode part1]
ttgacgtaaccttctg

SEQ ID NO: 28588 - DNA, 16 bp, Artificial Sequence
  synthetic [barcode part1]
tcaaccagactggttg

SEQ ID NO: 28589 - DNA, 16 bp, Artificial Sequence
  synthetic [barcode part1]
actcgaaccacagatc

SEQ ID NO: 28590 - DNA, 16 bp, Artificial Sequence
  synthetic [barcode part1]
aagatccggtgaacgc

SEQ ID NO: 28591 - DNA, 16 bp, Artificial Sequence
  synthetic [barcode part1]
acactcttcggcaatt

SEQ ID NO: 28592 - DNA, 16 bp, Artificial Sequence
  synthetic [barcode part1]
caatcggtagtgtcgt

SEQ ID NO: 28593 - DNA, 16 bp, Artificial Sequence
  synthetic [barcode part1]
ttcaactattgtgcgc

SEQ ID NO: 28594 - DNA, 16 bp, Artificial Sequence
  synthetic [barcode part1]
tcacagttgtgacacg

SEQ ID NO: 28595 - DNA, 16 bp, Artificial Sequence
  synthetic [barcode part1]
cacgtccgtccttatt

SEQ ID NO: 28596 - DNA, 16 bp, Artificial Sequence
  synthetic [barcode part1]
atactaacttcgccac

SEQ ID NO: 28597 - DNA, 16 bp, Artificial Sequence
  synthetic [barcode part1]
cacagatacggatctc

SEQ ID NO: 28598 - DNA, 16 bp, Artificial Sequence
  synthetic [barcode part1]
gatcagtcctcttctc

SEQ ID NO: 28599 - DNA, 16 bp, Artificial Sequence
  synthetic [barcode part1]
acgcgtagtcagttgt

SEQ ID NO: 28600 - DNA, 16 bp, Artificial Sequence
  synthetic [barcode part1]
aatcgcacggttgtac

SEQ ID NO: 28601 - DNA, 16 bp, Artificial Sequence
  synthetic [barcode part1]
gatcgtggccagtatt

SEQ ID NO: 28602 - DNA, 16 bp, Artificial Sequence
  synthetic [barcode part1]
aaccttgtcacttacg

SEQ ID NO: 28603 - DNA, 16 bp, Artificial Sequence
  synthetic [barcode part1]
tctctaacacgattgc

SEQ ID NO: 28604 - DNA, 16 bp, Artificial Sequence
  synthetic [barcode part1]
caactctgcgtgtcgt

SEQ ID NO: 28605 - DNA, 16 bp, Artificial Sequence
  synthetic [barcode part1]
aatcctcgatcgtgtt

SEQ ID NO: 28606 - DNA, 16 bp, Artificial Sequence
  synthetic [barcode part1]
accaagtgtggagacc

SEQ ID NO: 28607 - DNA, 16 bp, Artificial Sequence
  synthetic [barcode part1]
tccgtactgcaagaac

SEQ ID NO: 28608 - DNA, 16 bp, Artificial Sequence
  synthetic [barcode part1]
cgtagattacctggac

SEQ ID NO: 28609 - DNA, 16 bp, Artificial Sequence
  synthetic [barcode part1]
ttccggttagtgagac

SEQ ID NO: 28610 - DNA, 16 bp, Artificial Sequence
  synthetic [barcode part1]
gttataaccgtctacc

SEQ ID NO: 28611 - DNA, 16 bp, Artificial Sequence
  synthetic [barcode part1]
tccttcttgactgacc

SEQ ID NO: 28612 - DNA, 16 bp, Artificial Sequence
  synthetic [barcode part1]
tgagttggtgtgaggc

SEQ ID NO: 28613 - DNA, 16 bp, Artificial Sequence
  synthetic [barcode part1]
tcggcaactcgatagt

SEQ ID NO: 28614 - DNA, 16 bp, Artificial Sequence
  synthetic [barcode part1]
gacttcacaccacaag

SEQ ID NO: 28615 - DNA, 16 bp, Artificial Sequence
  synthetic [barcode part1]
atagactactggaggt

SEQ ID NO: 28616 - DNA, 16 bp, Artificial Sequence
  synthetic [barcode part1]
aacgacttcgacagtc

SEQ ID NO: 28617 - DNA, 16 bp, Artificial Sequence
  synthetic [barcode part1]
gcacgcgtatagtgtt

SEQ ID NO: 28618 - DNA, 16 bp, Artificial Sequence
  synthetic [barcode part1]
gattcgtgttctactg

SEQ ID NO: 28619 - DNA, 16 bp, Artificial Sequence
  synthetic [barcode part1]
ttgcgcgtcttctgag

SEQ ID NO: 28620 - DNA, 16 bp, Artificial Sequence
  synthetic [barcode part1]
tgtgaacaggtggtgc

SEQ ID NO: 28621 - DNA, 16 bp, Artificial Sequence
  synthetic [barcode part1]
tcgtcactcaccttac

SEQ ID NO: 28622 - DNA, 16 bp, Artificial Sequence
  synthetic [barcode part1]
ttgtcactccaagtgt

SEQ ID NO: 28623 - DNA, 16 bp, Artificial Sequence
  synthetic [barcode part1]
gcgaccactccaattc

SEQ ID NO: 28624 - DNA, 16 bp, Artificial Sequence
  synthetic [barcode part1]
acaactgcaacgtacc

SEQ ID NO: 28625 - DNA, 16 bp, Artificial Sequence
  synthetic [barcode part1]
tcagtagttgtactcc

SEQ ID NO: 28626 - DNA, 16 bp, Artificial Sequence
  synthetic [barcode part1]
tcactgtatccgcggt

SEQ ID NO: 28627 - DNA, 16 bp, Artificial Sequence
  synthetic [barcode part1]
tgtacgtcagttgacg

SEQ ID NO: 28628 - DNA, 16 bp, Artificial Sequence
  synthetic [barcode part1]
gtgtacacacggtatc

SEQ ID NO: 28629 - DNA, 16 bp, Artificial Sequence
  synthetic [barcode part1]
tgcggtgaagttctac

SEQ ID NO: 28630 - DNA, 16 bp, Artificial Sequence
  synthetic [barcode part1]
tccactcgatatcgcg

SEQ ID NO: 28631 - DNA, 16 bp, Artificial Sequence
  synthetic [barcode part1]
agtagaggccacttct

SEQ ID NO: 28632 - DNA, 16 bp, Artificial Sequence
  synthetic [barcode part1]
tgtcaggttcgcgtct

SEQ ID NO: 28633 - DNA, 16 bp, Artificial Sequence
  synthetic [barcode part1]
gagtcacttcgcacct

SEQ ID NO: 28634 - DNA, 16 bp, Artificial Sequence
  synthetic [barcode part1]
gtcttatactcaggtc

SEQ ID NO: 28635 - DNA, 16 bp, Artificial Sequence
  synthetic [barcode part1]
cggaaggaccgatact

SEQ ID NO: 28636 - DNA, 16 bp, Artificial Sequence
  synthetic [barcode part1]
atacggtatactggcc

SEQ ID NO: 28637 - DNA, 16 bp, Artificial Sequence
  synthetic [barcode part1]
tctccacgagttaccg

SEQ ID NO: 28638 - DNA, 16 bp, Artificial Sequence
  synthetic [barcode part1]
cgcaattaaccgtgtg

SEQ ID NO: 28639 - DNA, 16 bp, Artificial Sequence
  synthetic [barcode part1]
tacttacgagtcttgc

SEQ ID NO: 28640 - DNA, 16 bp, Artificial Sequence
  synthetic [barcode part1]
gagaagtacctaggtt

SEQ ID NO: 28641 - DNA, 16 bp, Artificial Sequence
  synthetic [barcode part1]
tataggcgtaacagac

SEQ ID NO: 28642 - DNA, 16 bp, Artificial Sequence
  synthetic [barcode part1]
atcagactggaggcac

SEQ ID NO: 28643 - DNA, 16 bp, Artificial Sequence
  synthetic [barcode part1]
agatatcgcctcgcct

SEQ ID NO: 28644 - DNA, 16 bp, Artificial Sequence
  synthetic [barcode part1]
tgactgacaaccgatc

SEQ ID NO: 28645 - DNA, 16 bp, Artificial Sequence
  synthetic [barcode part1]
gtcgtaagataccacc

SEQ ID NO: 28646 - DNA, 16 bp, Artificial Sequence
  synthetic [barcode part1]
gcgtggttcttaattc

SEQ ID NO: 28647 - DNA, 16 bp, Artificial Sequence
  synthetic [barcode part1]
aagacaaggacttgtc

SEQ ID NO: 28648 - DNA, 16 bp, Artificial Sequence
  synthetic [barcode part1]
acagtactgaccaacc

SEQ ID NO: 28649 - DNA, 16 bp, Artificial Sequence
  synthetic [barcode part1]
tcttgtatcctgcgtc

SEQ ID NO: 28650 - DNA, 16 bp, Artificial Sequence
  synthetic [barcode part1]
cctaagtatccaggtg

SEQ ID NO: 28651 - DNA, 16 bp, Artificial Sequence
  synthetic [barcode part1]
ttcttctgcgcacgtt

SEQ ID NO: 28652 - DNA, 16 bp, Artificial Sequence
  synthetic [barcode part1]
aggcgagttgcaacgt

SEQ ID NO: 28653 - DNA, 16 bp, Artificial Sequence
  synthetic [barcode part1]
atctaggcctgttatc

SEQ ID NO: 28654 - DNA, 16 bp, Artificial Sequence
  synthetic [barcode part1]
cctaagatacgcgtac

SEQ ID NO: 28655 - DNA, 16 bp, Artificial Sequence
  synthetic [barcode part1]
tcagtgaataaggacc

SEQ ID NO: 28656 - DNA, 16 bp, Artificial Sequence
  synthetic [barcode part1]
aactcgaaccagatcc

SEQ ID NO: 28657 - DNA, 16 bp, Artificial Sequence
  synthetic [barcode part1]
ttctagtcgtgccgac

SEQ ID NO: 28658 - DNA, 16 bp, Artificial Sequence
  synthetic [barcode part1]
gcagtgaagacacctg

SEQ ID NO: 28659 - DNA, 16 bp, Artificial Sequence
  synthetic [barcode part1]
actgaacaacgactcc

SEQ ID NO: 28660 - DNA, 16 bp, Artificial Sequence
  synthetic [barcode part1]
aaccgacctaagacct

SEQ ID NO: 28661 - DNA, 16 bp, Artificial Sequence
  synthetic [barcode part1]
cagtgcgttagtacac

SEQ ID NO: 28662 - DNA, 16 bp, Artificial Sequence
  synthetic [barcode part1]
ataagaggcacaggac

SEQ ID NO: 28663 - DNA, 16 bp, Artificial Sequence
  synthetic [barcode part1]
cgacgtacgtagactt

SEQ ID NO: 28664 - DNA, 16 bp, Artificial Sequence
  synthetic [barcode part1]
ttagacactcgtcgtt

SEQ ID NO: 28665 - DNA, 16 bp, Artificial Sequence
  synthetic [barcode part1]
cgccttatctaagtac

SEQ ID NO: 28666 - DNA, 16 bp, Artificial Sequence
  synthetic [barcode part1]
aacaccgtagtgtcgt

SEQ ID NO: 28667 - DNA, 16 bp, Artificial Sequence
  synthetic [barcode part1]
accagtataccttacc

SEQ ID NO: 28668 - DNA, 16 bp, Artificial Sequence
  synthetic [barcode part1]
gacggaatagtccttc

SEQ ID NO: 28669 - DNA, 16 bp, Artificial Sequence
  synthetic [barcode part1]
tatctctcgtgtcctg

SEQ ID NO: 28670 - DNA, 16 bp, Artificial Sequence
  synthetic [barcode part1]
tcgtgtcgtaagaacc

SEQ ID NO: 28671 - DNA, 16 bp, Artificial Sequence
  synthetic [barcode part1]
acacactaccttctag

SEQ ID NO: 28672 - DNA, 16 bp, Artificial Sequence
  synthetic [barcode part1]
ccgtgcctactgaatc

SEQ ID NO: 28673 - DNA, 16 bp, Artificial Sequence
  synthetic [barcode part1]
ttagttcactcagacc

SEQ ID NO: 28674 - DNA, 16 bp, Artificial Sequence
  synthetic [barcode part1]
tccggagttaagatcc

SEQ ID NO: 28675 - DNA, 16 bp, Artificial Sequence
  synthetic [barcode part1]
tacaaccagtcgtacg

SEQ ID NO: 28676 - DNA, 16 bp, Artificial Sequence
  synthetic [barcode part1]
tgatcttcggcacacc

SEQ ID NO: 28677 - DNA, 16 bp, Artificial Sequence
  synthetic [barcode part1]
accgaactacttctgt

SEQ ID NO: 28678 - DNA, 16 bp, Artificial Sequence
  synthetic [barcode part1]
tgtcttgtaccgcctt

SEQ ID NO: 28679 - DNA, 16 bp, Artificial Sequence
  synthetic [barcode part1]
ccgttaatcttgcgcg

SEQ ID NO: 28680 - DNA, 16 bp, Artificial Sequence
  synthetic [barcode part1]
tcctcgatcagaagac

SEQ ID NO: 28681 - DNA, 16 bp, Artificial Sequence
  synthetic [barcode part1]
gtccttcgaagttgag

SEQ ID NO: 28682 - DNA, 16 bp, Artificial Sequence
  synthetic [barcode part1]
gatatcggtcagtcac

SEQ ID NO: 28683 - DNA, 16 bp, Artificial Sequence
  synthetic [barcode part1]
taatcggataccacgc

SEQ ID NO: 28684 - DNA, 16 bp, Artificial Sequence
  synthetic [barcode part1]
tcgcggatattccacc

SEQ ID NO: 28685 - DNA, 16 bp, Artificial Sequence
  synthetic [barcode part1]
ttagaccgtatctctg

SEQ ID NO: 28686 - DNA, 16 bp, Artificial Sequence
  synthetic [barcode part1]
tcttggcgaagtgatc

SEQ ID NO: 28687 - DNA, 16 bp, Artificial Sequence
  synthetic [barcode part1]
tggacgtcctccgatt

SEQ ID NO: 28688 - DNA, 16 bp, Artificial Sequence
  synthetic [barcode part1]
aacactcgacgtactg

SEQ ID NO: 28689 - DNA, 16 bp, Artificial Sequence
  synthetic [barcode part1]
actacctgacggagtt

SEQ ID NO: 28690 - DNA, 16 bp, Artificial Sequence
  synthetic [barcode part1]
gattcgtactctatcg

SEQ ID NO: 28691 - DNA, 16 bp, Artificial Sequence
  synthetic [barcode part1]
attctgcgaaccgagt

SEQ ID NO: 28692 - DNA, 16 bp, Artificial Sequence
  synthetic [barcode part1]
agacgactagttctcg

SEQ ID NO: 28693 - DNA, 16 bp, Artificial Sequence
  synthetic [barcode part1]
atcgtgtggttacgtg

SEQ ID NO: 28694 - DNA, 16 bp, Artificial Sequence
  synthetic [barcode part1]
gataggaacgcggtct

SEQ ID NO: 28695 - DNA, 16 bp, Artificial Sequence
  synthetic [barcode part1]
cggacaacctagagtg

SEQ ID NO: 28696 - DNA, 16 bp, Artificial Sequence
  synthetic [barcode part1]
tagtagatccaggtag

SEQ ID NO: 28697 - DNA, 16 bp, Artificial Sequence
  synthetic [barcode part1]
gacgaggtacggatct

SEQ ID NO: 28698 - DNA, 16 bp, Artificial Sequence
  synthetic [barcode part1]
ttgaccagtcagtcag

SEQ ID NO: 28699 - DNA, 16 bp, Artificial Sequence
  synthetic [barcode part1]
accaggaaggagattg

SEQ ID NO: 28700 - DNA, 16 bp, Artificial Sequence
  synthetic [barcode part1]
gtcggatacgagaatt

SEQ ID NO: 28701 - DNA, 16 bp, Artificial Sequence
  synthetic [barcode part1]
aattagttgcggcacc

SEQ ID NO: 28702 - DNA, 16 bp, Artificial Sequence
  synthetic [barcode part1]
agaactacgcagaccg

SEQ ID NO: 28703 - DNA, 16 bp, Artificial Sequence
  synthetic [barcode part1]
agattccgagagagag

SEQ ID NO: 28704 - DNA, 16 bp, Artificial Sequence
  synthetic [barcode part1]
ttgcgagactcgaact

SEQ ID NO: 28705 - DNA, 16 bp, Artificial Sequence
  synthetic [barcode part1]
cggcctactgtatctg

SEQ ID NO: 28706 - DNA, 16 bp, Artificial Sequence
  synthetic [barcode part1]
gaatcctaggaccttg

SEQ ID NO: 28707 - DNA, 16 bp, Artificial Sequence
  synthetic [barcode part1]
aatcttccgactctcc

SEQ ID NO: 28708 - DNA, 16 bp, Artificial Sequence
  synthetic [barcode part1]
tcaaccttctgcaagt

SEQ ID NO: 28709 - DNA, 16 bp, Artificial Sequence
  synthetic [barcode part1]
tattcgtacggtactc

SEQ ID NO: 28710 - DNA, 16 bp, Artificial Sequence
  synthetic [barcode part1]
gcggcactgtaatact

SEQ ID NO: 28711 - DNA, 16 bp, Artificial Sequence
  synthetic [barcode part1]
acctaaggcgaacttc

SEQ ID NO: 28712 - DNA, 16 bp, Artificial Sequence
  synthetic [barcode part1]
ttgcctggaacctcac

SEQ ID NO: 28713 - DNA, 16 bp, Artificial Sequence
  synthetic [barcode part1]
gcgtacacggtcaatt

SEQ ID NO: 28714 - DNA, 16 bp, Artificial Sequence
  synthetic [barcode part1]
gtggattgcgtaatcc

SEQ ID NO: 28715 - DNA, 16 bp, Artificial Sequence
  synthetic [barcode part1]
cagagaatacgatcgt

SEQ ID NO: 28716 - DNA, 16 bp, Artificial Sequence
  synthetic [barcode part1]
ccacaagtgagttcgt

SEQ ID NO: 28717 - DNA, 16 bp, Artificial Sequence
  synthetic [barcode part1]
agaacctcaggtggac

SEQ ID NO: 28718 - DNA, 16 bp, Artificial Sequence
  synthetic [barcode part1]
acgaaggtaacctaac

SEQ ID NO: 28719 - DNA, 16 bp, Artificial Sequence
  synthetic [barcode part1]
cgtagaggttaccgag

SEQ ID NO: 28720 - DNA, 16 bp, Artificial Sequence
  synthetic [barcode part1]
taacggttgtatctcc

SEQ ID NO: 28721 - DNA, 16 bp, Artificial Sequence
  synthetic [barcode part1]
gcctctaacttaacac

SEQ ID NO: 28722 - DNA, 16 bp, Artificial Sequence
  synthetic [barcode part1]
gccaagttctgcgtct

SEQ ID NO: 28723 - DNA, 16 bp, Artificial Sequence
  synthetic [barcode part1]
cacttcgtgaacgtcc

SEQ ID NO: 28724 - DNA, 16 bp, Artificial Sequence
  synthetic [barcode part1]
aagacaaggtgaggtc

SEQ ID NO: 28725 - DNA, 16 bp, Artificial Sequence
  synthetic [barcode part1]
aacttatcgttgtccg

SEQ ID NO: 28726 - DNA, 16 bp, Artificial Sequence
  synthetic [barcode part1]
tcttctagtagttgcg

SEQ ID NO: 28727 - DNA, 16 bp, Artificial Sequence
  synthetic [barcode part1]
caggtgatactgtaag

SEQ ID NO: 28728 - DNA, 16 bp, Artificial Sequence
  synthetic [barcode part1]
cacctaaccttcgacg

SEQ ID NO: 28729 - DNA, 16 bp, Artificial Sequence
  synthetic [barcode part1]
atagtgaagaccggag

SEQ ID NO: 28730 - DNA, 16 bp, Artificial Sequence
  synthetic [barcode part1]
cctcgtgatcagacct

SEQ ID NO: 28731 - DNA, 16 bp, Artificial Sequence
  synthetic [barcode part1]
tggtcctaacttcctc

SEQ ID NO: 28732 - DNA, 16 bp, Artificial Sequence
  synthetic [barcode part1]
aataatcggtccggtc

SEQ ID NO: 28733 - DNA, 16 bp, Artificial Sequence
  synthetic [barcode part1]
tcggaaggacctacag

SEQ ID NO: 28734 - DNA, 16 bp, Artificial Sequence
  synthetic [barcode part1]
caacgttggcagacag

SEQ ID NO: 28735 - DNA, 16 bp, Artificial Sequence
  synthetic [barcode part1]
tggttaggacctcaac

SEQ ID NO: 28736 - DNA, 16 bp, Artificial Sequence
  synthetic [barcode part1]
attcgacggaatacag

SEQ ID NO: 28737 - DNA, 16 bp, Artificial Sequence
  synthetic [barcode part1]
ttcagaccagatccag

SEQ ID NO: 28738 - DNA, 16 bp, Artificial Sequence
  synthetic [barcode part1]
cgaacagagtggatag

SEQ ID NO: 28739 - DNA, 16 bp, Artificial Sequence
  synthetic [barcode part1]
aggtcaccgttcctgt

SEQ ID NO: 28740 - DNA, 16 bp, Artificial Sequence
  synthetic [barcode part1]
atcctgcgaacactcc

SEQ ID NO: 28741 - DNA, 16 bp, Artificial Sequence
  synthetic [barcode part1]
ttaccaggaagatacg

SEQ ID NO: 28742 - DNA, 16 bp, Artificial Sequence
  synthetic [barcode part1]
tgcgagattgacggtg

SEQ ID NO: 28743 - DNA, 16 bp, Artificial Sequence
  synthetic [barcode part1]
tctgattacgcgtcgc

SEQ ID NO: 28744 - DNA, 16 bp, Artificial Sequence
  synthetic [barcode part1]
agacgcacggttcaag

SEQ ID NO: 28745 - DNA, 16 bp, Artificial Sequence
  synthetic [barcode part1]
tgcctcgaggttcact

SEQ ID NO: 28746 - DNA, 16 bp, Artificial Sequence
  synthetic [barcode part1]
cggatacttaggcgtt

SEQ ID NO: 28747 - DNA, 16 bp, Artificial Sequence
  synthetic [barcode part1]
acaggcaactccagag

SEQ ID NO: 28748 - DNA, 16 bp, Artificial Sequence
  synthetic [barcode part1]
cacgaaggttagaccg

SEQ ID NO: 28749 - DNA, 16 bp, Artificial Sequence
  synthetic [barcode part1]
aggcagtgtgtaaccg

SEQ ID NO: 28750 - DNA, 16 bp, Artificial Sequence
  synthetic [barcode part1]
gcctgtcaacaccact

SEQ ID NO: 28751 - DNA, 16 bp, Artificial Sequence
  synthetic [barcode part1]
agacacttgaagtgac

SEQ ID NO: 28752 - DNA, 16 bp, Artificial Sequence
  synthetic [barcode part1]
attcactctcacctgc

SEQ ID NO: 28753 - DNA, 16 bp, Artificial Sequence
  synthetic [barcode part1]
ttggaacgcaacgttc

SEQ ID NO: 28754 - DNA, 16 bp, Artificial Sequence
  synthetic [barcode part1]
caacagtcctctacgc

SEQ ID NO: 28755 - DNA, 16 bp, Artificial Sequence
  synthetic [barcode part1]
tctagacggtaacaag

SEQ ID NO: 28756 - DNA, 16 bp, Artificial Sequence
  synthetic [barcode part1]
tggagaatcgaggagt

SEQ ID NO: 28757 - DNA, 16 bp, Artificial Sequence
  synthetic [barcode part1]
caggacaacttcctag

SEQ ID NO: 28758 - DNA, 16 bp, Artificial Sequence
  synthetic [barcode part1]
gttggttcgataccag

SEQ ID NO: 28759 - DNA, 16 bp, Artificial Sequence
  synthetic [barcode part1]
tcgagagactactctg

SEQ ID NO: 28760 - DNA, 16 bp, Artificial Sequence
  synthetic [barcode part1]
acgacttaacggttcg

SEQ ID NO: 28761 - DNA, 16 bp, Artificial Sequence
  synthetic [barcode part1]
ccttcggttagagagt

SEQ ID NO: 28762 - DNA, 16 bp, Artificial Sequence
  synthetic [barcode part1]
actcctcggagaattg

SEQ ID NO: 28763 - DNA, 16 bp, Artificial Sequence
  synthetic [barcode part1]
tccagagaactctggt

SEQ ID NO: 28764 - DNA, 16 bp, Artificial Sequence
  synthetic [barcode part1]
tggtctacgtcctcag

SEQ ID NO: 28765 - DNA, 16 bp, Artificial Sequence
  synthetic [barcode part1]
cggaactcgtggtatt

SEQ ID NO: 28766 - DNA, 16 bp, Artificial Sequence
  synthetic [barcode part1]
gatccttgtcgaaggt

SEQ ID NO: 28767 - DNA, 16 bp, Artificial Sequence
  synthetic [barcode part1]
cagagttgcacgtatc

SEQ ID NO: 28768 - DNA, 16 bp, Artificial Sequence
  synthetic [barcode part1]
aagaactattggcacg

SEQ ID NO: 28769 - DNA, 16 bp, Artificial Sequence
  synthetic [barcode part1]
taacctcgccgtgtgt

SEQ ID NO: 28770 - DNA, 16 bp, Artificial Sequence
  synthetic [barcode part1]
gtctgtccttgtctac

SEQ ID NO: 28771 - DNA, 16 bp, Artificial Sequence
  synthetic [barcode part1]
gttgtaggcaagtggc

SEQ ID NO: 28772 - DNA, 16 bp, Artificial Sequence
  synthetic [barcode part1]
tgagtctgaatctgcg

SEQ ID NO: 28773 - DNA, 16 bp, Artificial Sequence
  synthetic [barcode part1]
gcagtcaactgtgtgt

SEQ ID NO: 28774 - DNA, 16 bp, Artificial Sequence
  synthetic [barcode part1]
gtaaggcctacagacg

SEQ ID NO: 28775 - DNA, 16 bp, Artificial Sequence
  synthetic [barcode part1]
gttattccgaacgttc

SEQ ID NO: 28776 - DNA, 16 bp, Artificial Sequence
  synthetic [barcode part1]
tgacttcaccggtatt

SEQ ID NO: 28777 - DNA, 16 bp, Artificial Sequence
  synthetic [barcode part1]
gatatccgtaactgcg

SEQ ID NO: 28778 - DNA, 16 bp, Artificial Sequence
  synthetic [barcode part1]
actcgaaccacttcgc

SEQ ID NO: 28779 - DNA, 16 bp, Artificial Sequence
  synthetic [barcode part1]
gttaacaggtgcgtct

SEQ ID NO: 28780 - DNA, 16 bp, Artificial Sequence
  synthetic [barcode part1]
aagagtagtctaacgc

SEQ ID NO: 28781 - DNA, 16 bp, Artificial Sequence
  synthetic [barcode part1]
gactaggtcgcacaag

SEQ ID NO: 28782 - DNA, 16 bp, Artificial Sequence
  synthetic [barcode part1]
gtggactatatccggt

SEQ ID NO: 28783 - DNA, 16 bp, Artificial Sequence
  synthetic [barcode part1]
tgacttggaatcaccg

SEQ ID NO: 28784 - DNA, 16 bp, Artificial Sequence
  synthetic [barcode part1]
tgaagttgccaaccgt

SEQ ID NO: 28785 - DNA, 16 bp, Artificial Sequence
  synthetic [barcode part1]
cggccttcaatcacgt

SEQ ID NO: 28786 - DNA, 16 bp, Artificial Sequence
  synthetic [barcode part1]
ttaatctctgcgcagt

SEQ ID NO: 28787 - DNA, 16 bp, Artificial Sequence
  synthetic [barcode part1]
ttcggtcaatccttcc

SEQ ID NO: 28788 - DNA, 16 bp, Artificial Sequence
  synthetic [barcode part1]
aagacaacttgagtgc

SEQ ID NO: 28789 - DNA, 16 bp, Artificial Sequence
  synthetic [barcode part1]
gtctgtagtgcgattg

SEQ ID NO: 28790 - DNA, 16 bp, Artificial Sequence
  synthetic [barcode part1]
cgatactctgcgatag

SEQ ID NO: 28791 - DNA, 16 bp, Artificial Sequence
  synthetic [barcode part1]
gacactgtcaggactt

SEQ ID NO: 28792 - DNA, 16 bp, Artificial Sequence
  synthetic [barcode part1]
gcgtgcacagtattac

SEQ ID NO: 28793 - DNA, 16 bp, Artificial Sequence
  synthetic [barcode part1]
agaggtgcgagaatac

SEQ ID NO: 28794 - DNA, 16 bp, Artificial Sequence
  synthetic [barcode part1]
cacaggatagttcaag

SEQ ID NO: 28795 - DNA, 16 bp, Artificial Sequence
  synthetic [barcode part1]
cgatcgcggtagtaag

SEQ ID NO: 28796 - DNA, 16 bp, Artificial Sequence
  synthetic [barcode part1]
gttcctcctgaagaag

SEQ ID NO: 28797 - DNA, 16 bp, Artificial Sequence
  synthetic [barcode part1]
gcgttcgcactacttg

SEQ ID NO: 28798 - DNA, 16 bp, Artificial Sequence
  synthetic [barcode part1]
aatacgagtgatccag

SEQ ID NO: 28799 - DNA, 16 bp, Artificial Sequence
  synthetic [barcode part1]
tgtgcagatcctccgt

SEQ ID NO: 28800 - DNA, 16 bp, Artificial Sequence
  synthetic [barcode part1]
agtgttgacgtgtacc

SEQ ID NO: 28801 - DNA, 16 bp, Artificial Sequence
  synthetic [barcode part1]
agtcttgacggacgag

SEQ ID NO: 28802 - DNA, 16 bp, Artificial Sequence
  synthetic [barcode part1]
acacagttgtgaccac

SEQ ID NO: 28803 - DNA, 16 bp, Artificial Sequence
  synthetic [barcode part1]
gatagaacacagatcc

SEQ ID NO: 28804 - DNA, 16 bp, Artificial Sequence
  synthetic [barcode part1]
actacactcttgtcag

SEQ ID NO: 28805 - DNA, 16 bp, Artificial Sequence
  synthetic [barcode part1]
gcctacttgagtgaac

SEQ ID NO: 28806 - DNA, 16 bp, Artificial Sequence
  synthetic [barcode part1]
atcgcgaagatctcgt

SEQ ID NO: 28807 - DNA, 16 bp, Artificial Sequence
  synthetic [barcode part1]
tagttgaggtcctggt

SEQ ID NO: 28808 - DNA, 16 bp, Artificial Sequence
  synthetic [barcode part1]
tacgtccttcagtggc

SEQ ID NO: 28809 - DNA, 16 bp, Artificial Sequence
  synthetic [barcode part1]
gatcctctgcagactc

SEQ ID NO: 28810 - DNA, 16 bp, Artificial Sequence
  synthetic [barcode part1]
gtccgagttattccgc

SEQ ID NO: 28811 - DNA, 16 bp, Artificial Sequence
  synthetic [barcode part1]
cacactcctacacttc

SEQ ID NO: 28812 - DNA, 16 bp, Artificial Sequence
  synthetic [barcode part1]
cctgtgtcgatccaac

SEQ ID NO: 28813 - DNA, 16 bp, Artificial Sequence
  synthetic [barcode part1]
gcgtgatactacacgt

SEQ ID NO: 28814 - DNA, 16 bp, Artificial Sequence
  synthetic [barcode part1]
cgttcactaccgcaac

SEQ ID NO: 28815 - DNA, 16 bp, Artificial Sequence
  synthetic [barcode part1]
atagttgttggcctct

SEQ ID NO: 28816 - DNA, 16 bp, Artificial Sequence
  synthetic [barcode part1]
aggtggaattctagac

SEQ ID NO: 28817 - DNA, 16 bp, Artificial Sequence
  synthetic [barcode part1]
acggacctgattcctc

SEQ ID NO: 28818 - DNA, 16 bp, Artificial Sequence
  synthetic [barcode part1]
acagactatatccggc

SEQ ID NO: 28819 - DNA, 16 bp, Artificial Sequence
  synthetic [barcode part1]
aattgagtggaggacg

SEQ ID NO: 28820 - DNA, 16 bp, Artificial Sequence
  synthetic [barcode part1]
gttactcaggcctatt

SEQ ID NO: 28821 - DNA, 16 bp, Artificial Sequence
  synthetic [barcode part1]
accttacgcggtcgtt

SEQ ID NO: 28822 - DNA, 16 bp, Artificial Sequence
  synthetic [barcode part1]
tgtccaccaaggtctc

SEQ ID NO: 28823 - DNA, 16 bp, Artificial Sequence
  synthetic [barcode part1]
atagagttcgcctcag

SEQ ID NO: 28824 - DNA, 16 bp, Artificial Sequence
  synthetic [barcode part1]
gcctcgtacctgaact

SEQ ID NO: 28825 - DNA, 16 bp, Artificial Sequence
  synthetic [barcode part1]
tctctctccgattgac

SEQ ID NO: 28826 - DNA, 16 bp, Artificial Sequence
  synthetic [barcode part1]
cgaccgataactgatc

SEQ ID NO: 28827 - DNA, 16 bp, Artificial Sequence
  synthetic [barcode part1]
atcgacgaggccaagt

SEQ ID NO: 28828 - DNA, 16 bp, Artificial Sequence
  synthetic [barcode part1]
aatcgcacacgattgc

SEQ ID NO: 28829 - DNA, 16 bp, Artificial Sequence
  synthetic [barcode part1]
gaccaaccaaccagtt

SEQ ID NO: 28830 - DNA, 16 bp, Artificial Sequence
  synthetic [barcode part1]
acagttgcagtgtacc

SEQ ID NO: 28831 - DNA, 16 bp, Artificial Sequence
  synthetic [barcode part1]
gtcacggtcacaatac

SEQ ID NO: 28832 - DNA, 16 bp, Artificial Sequence
  synthetic [barcode part1]
agacgtgaactcggtg

SEQ ID NO: 28833 - DNA, 16 bp, Artificial Sequence
  synthetic [barcode part1]
gtaccagtgataaggt

SEQ ID NO: 28834 - DNA, 16 bp, Artificial Sequence
  synthetic [barcode part1]
gaccttaatctacctg

SEQ ID NO: 28835 - DNA, 16 bp, Artificial Sequence
  synthetic [barcode part1]
acagatcgtgtggttc

SEQ ID NO: 28836 - DNA, 16 bp, Artificial Sequence
  synthetic [barcode part1]
gtgtcgccttactcag

SEQ ID NO: 28837 - DNA, 16 bp, Artificial Sequence
  synthetic [barcode part1]
aacacggcacttctag

SEQ ID NO: 28838 - DNA, 16 bp, Artificial Sequence
  synthetic [barcode part1]
gtcacaagtggataac

SEQ ID NO: 28839 - DNA, 16 bp, Artificial Sequence
  synthetic [barcode part1]
gtgttagtctccggtc

SEQ ID NO: 28840 - DNA, 16 bp, Artificial Sequence
  synthetic [barcode part1]
cctaccaacgtaattc

SEQ ID NO: 28841 - DNA, 16 bp, Artificial Sequence
  synthetic [barcode part1]
gtgacacacgtgtgtt

SEQ ID NO: 28842 - DNA, 16 bp, Artificial Sequence
  synthetic [barcode part1]
attaagttctgcgtcc

SEQ ID NO: 28843 - DNA, 16 bp, Artificial Sequence
  synthetic [barcode part1]
gtactgtaggcaggtg

SEQ ID NO: 28844 - DNA, 16 bp, Artificial Sequence
  synthetic [barcode part1]
cgttcggagttatacg

SEQ ID NO: 28845 - DNA, 16 bp, Artificial Sequence
  synthetic [barcode part1]
gtggattccaggtatc

SEQ ID NO: 28846 - DNA, 16 bp, Artificial Sequence
  synthetic [barcode part1]
ttctgtaactaccgac

SEQ ID NO: 28847 - DNA, 16 bp, Artificial Sequence
  synthetic [barcode part1]
acactacgatactgcg

SEQ ID NO: 28848 - DNA, 16 bp, Artificial Sequence
  synthetic [barcode part1]
gcgcctcactgttaac

SEQ ID NO: 28849 - DNA, 16 bp, Artificial Sequence
  synthetic [barcode part1]
cacctacctacttgtc

SEQ ID NO: 28850 - DNA, 16 bp, Artificial Sequence
  synthetic [barcode part1]
tcgttaggcgtaggag

SEQ ID NO: 28851 - DNA, 16 bp, Artificial Sequence
  synthetic [barcode part1]
tacgacttcgacacag

SEQ ID NO: 28852 - DNA, 16 bp, Artificial Sequence
  synthetic [barcode part1]
tctgaactctagttcg

SEQ ID NO: 28853 - DNA, 16 bp, Artificial Sequence
  synthetic [barcode part1]
cgagaggcacagttgt

SEQ ID NO: 28854 - DNA, 16 bp, Artificial Sequence
  synthetic [barcode part1]
ataggagagtccgatt

SEQ ID NO: 28855 - DNA, 16 bp, Artificial Sequence
  synthetic [barcode part1]
atcactctcactccgt

SEQ ID NO: 28856 - DNA, 16 bp, Artificial Sequence
  synthetic [barcode part1]
cggcaacaattaccac

SEQ ID NO: 28857 - DNA, 16 bp, Artificial Sequence
  synthetic [barcode part1]
atctaccggtgccact

SEQ ID NO: 28858 - DNA, 16 bp, Artificial Sequence
  synthetic [barcode part1]
tggtgagtgaggtaag

SEQ ID NO: 28859 - DNA, 16 bp, Artificial Sequence
  synthetic [barcode part1]
gactgcgactaatacc

SEQ ID NO: 28860 - DNA, 16 bp, Artificial Sequence
  synthetic [barcode part1]
tagtgcgttgacgtgt

SEQ ID NO: 28861 - DNA, 16 bp, Artificial Sequence
  synthetic [barcode part1]
gattcttggccacgtc

SEQ ID NO: 28862 - DNA, 16 bp, Artificial Sequence
  synthetic [barcode part1]
gtgtatacggcgttgt

SEQ ID NO: 28863 - DNA, 16 bp, Artificial Sequence
  synthetic [barcode part1]
gtgttctgtcaggcct

SEQ ID NO: 28864 - DNA, 16 bp, Artificial Sequence
  synthetic [barcode part1]
tgtagacacgaactcc

SEQ ID NO: 28865 - DNA, 16 bp, Artificial Sequence
  synthetic [barcode part1]
ccaataaggtacaggt

SEQ ID NO: 28866 - DNA, 16 bp, Artificial Sequence
  synthetic [barcode part1]
atccgtacgatctccg

SEQ ID NO: 28867 - DNA, 16 bp, Artificial Sequence
  synthetic [barcode part1]
tggtactgaacaggcg

SEQ ID NO: 28868 - DNA, 16 bp, Artificial Sequence
  synthetic [barcode part1]
aggagtgcgaagatac

SEQ ID NO: 28869 - DNA, 16 bp, Artificial Sequence
  synthetic [barcode part1]
gactctaggtatcacg

SEQ ID NO: 28870 - DNA, 16 bp, Artificial Sequence
  synthetic [barcode part1]
cgtcttatactcaggt

SEQ ID NO: 28871 - DNA, 16 bp, Artificial Sequence
  synthetic [barcode part1]
ccaagttaatccggtg

SEQ ID NO: 28872 - DNA, 16 bp, Artificial Sequence
  synthetic [barcode part1]
acctattagtaccacc

SEQ ID NO: 28873 - DNA, 16 bp, Artificial Sequence
  synthetic [barcode part1]
cctgtctacctatctg

SEQ ID NO: 28874 - DNA, 16 bp, Artificial Sequence
  synthetic [barcode part1]
gcgataccttccttct

SEQ ID NO: 28875 - DNA, 16 bp, Artificial Sequence
  synthetic [barcode part1]
caataacagaggcact

SEQ ID NO: 28876 - DNA, 16 bp, Artificial Sequence
  synthetic [barcode part1]
gccacggatagtatct

SEQ ID NO: 28877 - DNA, 16 bp, Artificial Sequence
  synthetic [barcode part1]
acgaatcaaggatcac

SEQ ID NO: 28878 - DNA, 16 bp, Artificial Sequence
  synthetic [barcode part1]
tacacagacgagatac

SEQ ID NO: 28879 - DNA, 16 bp, Artificial Sequence
  synthetic [barcode part1]
tcaacgagaacacggc

SEQ ID NO: 28880 - DNA, 16 bp, Artificial Sequence
  synthetic [barcode part1]
gcgtaaggcagttcag

SEQ ID NO: 28881 - DNA, 16 bp, Artificial Sequence
  synthetic [barcode part1]
ttccgcgttggtgact

SEQ ID NO: 28882 - DNA, 16 bp, Artificial Sequence
  synthetic [barcode part1]
ttctctaaggtgtctg

SEQ ID NO: 28883 - DNA, 16 bp, Artificial Sequence
  synthetic [barcode part1]
gaagagtcgaattcgt

SEQ ID NO: 28884 - DNA, 16 bp, Artificial Sequence
  synthetic [barcode part1]
gagacggtctgttgtt

SEQ ID NO: 28885 - DNA, 16 bp, Artificial Sequence
  synthetic [barcode part1]
atccgtcaacgtcacc

SEQ ID NO: 28886 - DNA, 16 bp, Artificial Sequence
  synthetic [barcode part1]
ccgtaggtactaacac

SEQ ID NO: 28887 - DNA, 16 bp, Artificial Sequence
  synthetic [barcode part1]
caggccttatctagag

SEQ ID NO: 28888 - DNA, 16 bp, Artificial Sequence
  synthetic [barcode part1]
tacttattcacggcgt

SEQ ID NO: 28889 - DNA, 16 bp, Artificial Sequence
  synthetic [barcode part1]
gttaggtgcaatccac

SEQ ID NO: 28890 - DNA, 16 bp, Artificial Sequence
  synthetic [barcode part1]
gtacactctactactg

SEQ ID NO: 28891 - DNA, 16 bp, Artificial Sequence
  synthetic [barcode part1]
ttctgagtgagacctg

SEQ ID NO: 28892 - DNA, 16 bp, Artificial Sequence
  synthetic [barcode part1]
ccactattccgtcact

SEQ ID NO: 28893 - DNA, 16 bp, Artificial Sequence
  synthetic [barcode part1]
tcacaagacttaggcc

SEQ ID NO: 28894 - DNA, 16 bp, Artificial Sequence
  synthetic [barcode part1]
tcaacaggacaactcc

SEQ ID NO: 28895 - DNA, 16 bp, Artificial Sequence
  synthetic [barcode part1]
ccactgtagtatccgc

SEQ ID NO: 28896 - DNA, 16 bp, Artificial Sequence
  synthetic [barcode part1]
cgatagttcaacgacc

SEQ ID NO: 28897 - DNA, 16 bp, Artificial Sequence
  synthetic [barcode part1]
cagttcaggatcgttg

SEQ ID NO: 28898 - DNA, 16 bp, Artificial Sequence
  synthetic [barcode part1]
gcacaccttgttgtcg

SEQ ID NO: 28899 - DNA, 16 bp, Artificial Sequence
  synthetic [barcode part1]
accacttccacagatt

SEQ ID NO: 28900 - DNA, 16 bp, Artificial Sequence
  synthetic [barcode part1]
tgagttctcgtgaacg

SEQ ID NO: 28901 - DNA, 16 bp, Artificial Sequence
  synthetic [barcode part1]
aatcctgccgtagtag

SEQ ID NO: 28902 - DNA, 16 bp, Artificial Sequence
  synthetic [barcode part1]
gttacagagtgttgcc

SEQ ID NO: 28903 - DNA, 16 bp, Artificial Sequence
  synthetic [barcode part1]
tgatcacagtacaccg

SEQ ID NO: 28904 - DNA, 16 bp, Artificial Sequence
  synthetic [barcode part1]
tcgaaggatcactctg

SEQ ID NO: 28905 - DNA, 16 bp, Artificial Sequence
  synthetic [barcode part1]
tcgttagaggatacag

SEQ ID NO: 28906 - DNA, 16 bp, Artificial Sequence
  synthetic [barcode part1]
gataagactagacacc

SEQ ID NO: 28907 - DNA, 16 bp, Artificial Sequence
  synthetic [barcode part1]
tgtgtactgtgacacg

SEQ ID NO: 28908 - DNA, 16 bp, Artificial Sequence
  synthetic [barcode part1]
tctcgaccgtgttgac

SEQ ID NO: 28909 - DNA, 16 bp, Artificial Sequence
  synthetic [barcode part1]
tcactcaacaacacct

SEQ ID NO: 28910 - DNA, 16 bp, Artificial Sequence
  synthetic [barcode part1]
tatcggtctctctaag

SEQ ID NO: 28911 - DNA, 16 bp, Artificial Sequence
  synthetic [barcode part1]
agaagttgcacactag

SEQ ID NO: 28912 - DNA, 16 bp, Artificial Sequence
  synthetic [barcode part1]
agatccgacgaggtgt

SEQ ID NO: 28913 - DNA, 16 bp, Artificial Sequence
  synthetic [barcode part1]
tcctagaggtgaatag

SEQ ID NO: 28914 - DNA, 16 bp, Artificial Sequence
  synthetic [barcode part1]
gcgatagaagtcagag

SEQ ID NO: 28915 - DNA, 16 bp, Artificial Sequence
  synthetic [barcode part1]
gtacaacaagaggttc

SEQ ID NO: 28916 - DNA, 16 bp, Artificial Sequence
  synthetic [barcode part1]
caactgtgacgataag

SEQ ID NO: 28917 - DNA, 16 bp, Artificial Sequence
  synthetic [barcode part1]
agtaattctgacggcc

SEQ ID NO: 28918 - DNA, 16 bp, Artificial Sequence
  synthetic [barcode part1]
gcggaggttaacagtc

SEQ ID NO: 28919 - DNA, 16 bp, Artificial Sequence
  synthetic [barcode part1]
gttacgtaccaagaag

SEQ ID NO: 28920 - DNA, 16 bp, Artificial Sequence
  synthetic [barcode part1]
tcgtagacgagttcac

SEQ ID NO: 28921 - DNA, 16 bp, Artificial Sequence
  synthetic [barcode part1]
ttgcaccagacgtaac

SEQ ID NO: 28922 - DNA, 16 bp, Artificial Sequence
  synthetic [barcode part1]
ttgagactggacaggc

SEQ ID NO: 28923 - DNA, 16 bp, Artificial Sequence
  synthetic [barcode part1]
cgttaagatcctcgcc

SEQ ID NO: 28924 - DNA, 16 bp, Artificial Sequence
  synthetic [barcode part1]
gacaatccacgaaggc

SEQ ID NO: 28925 - DNA, 16 bp, Artificial Sequence
  synthetic [barcode part1]
tattcaccaggcgaac

SEQ ID NO: 28926 - DNA, 16 bp, Artificial Sequence
  synthetic [barcode part1]
gattgtggttgcgtac

SEQ ID NO: 28927 - DNA, 16 bp, Artificial Sequence
  synthetic [barcode part1]
cgccgagataggaact

SEQ ID NO: 28928 - DNA, 16 bp, Artificial Sequence
  synthetic [barcode part1]
cgaagacacttgatag

SEQ ID NO: 28929 - DNA, 16 bp, Artificial Sequence
  synthetic [barcode part1]
ttcaccagatctacgt

SEQ ID NO: 28930 - DNA, 16 bp, Artificial Sequence
  synthetic [barcode part1]
gcacagtatcgtacgt

SEQ ID NO: 28931 - DNA, 16 bp, Artificial Sequence
  synthetic [barcode part1]
ttaccagattgccgag

SEQ ID NO: 28932 - DNA, 16 bp, Artificial Sequence
  synthetic [barcode part1]
aagtaggcgtctacct

SEQ ID NO: 28933 - DNA, 16 bp, Artificial Sequence
  synthetic [barcode part1]
gtgcagattgttgaag

SEQ ID NO: 28934 - DNA, 16 bp, Artificial Sequence
  synthetic [barcode part1]
cggacaagtggataag

SEQ ID NO: 28935 - DNA, 16 bp, Artificial Sequence
  synthetic [barcode part1]
aattcggtgtaccttc

SEQ ID NO: 28936 - DNA, 16 bp, Artificial Sequence
  synthetic [barcode part1]
aataatcaggaacgcc

SEQ ID NO: 28937 - DNA, 16 bp, Artificial Sequence
  synthetic [barcode part1]
aaccggactcaatctg

SEQ ID NO: 28938 - DNA, 16 bp, Artificial Sequence
  synthetic [barcode part1]
gagtgtggttggactg

SEQ ID NO: 28939 - DNA, 16 bp, Artificial Sequence
  synthetic [barcode part1]
aactacagtcgcacgt

SEQ ID NO: 28940 - DNA, 16 bp, Artificial Sequence
  synthetic [barcode part1]
tgaagtacgagttcag

SEQ ID NO: 28941 - DNA, 16 bp, Artificial Sequence
  synthetic [barcode part1]
gcgagttgtatctggt

SEQ ID NO: 28942 - DNA, 16 bp, Artificial Sequence
  synthetic [barcode part1]
acaagataggcgacag

SEQ ID NO: 28943 - DNA, 16 bp, Artificial Sequence
  synthetic [barcode part1]
gaacagatactgcagt

SEQ ID NO: 28944 - DNA, 16 bp, Artificial Sequence
  synthetic [barcode part1]
ttctgtggtcactagt

SEQ ID NO: 28945 - DNA, 16 bp, Artificial Sequence
  synthetic [barcode part1]
tagttatccgccgtcg

SEQ ID NO: 28946 - DNA, 16 bp, Artificial Sequence
  synthetic [barcode part1]
gtactacgttccgaag

SEQ ID NO: 28947 - DNA, 16 bp, Artificial Sequence
  synthetic [barcode part1]
attctggaccgactag

SEQ ID NO: 28948 - DNA, 16 bp, Artificial Sequence
  synthetic [barcode part1]
actggatattcctacc

SEQ ID NO: 28949 - DNA, 16 bp, Artificial Sequence
  synthetic [barcode part1]
acttattacggtgcct

SEQ ID NO: 28950 - DNA, 16 bp, Artificial Sequence
  synthetic [barcode part1]
tgcaagtactccgtcc

SEQ ID NO: 28951 - DNA, 16 bp, Artificial Sequence
  synthetic [barcode part1]
cggaatcagagagagt

SEQ ID NO: 28952 - DNA, 16 bp, Artificial Sequence
  synthetic [barcode part1]
gacgtatctctctggc

SEQ ID NO: 28953 - DNA, 16 bp, Artificial Sequence
  synthetic [barcode part1]
acgttagtctctggcc

SEQ ID NO: 28954 - DNA, 16 bp, Artificial Sequence
  synthetic [barcode part1]
cacagagatcactaag

SEQ ID NO: 28955 - DNA, 16 bp, Artificial Sequence
  synthetic [barcode part1]
cgcagtggaacagatc

SEQ ID NO: 28956 - DNA, 16 bp, Artificial Sequence
  synthetic [barcode part1]
tgacacagtacgatcc

SEQ ID NO: 28957 - DNA, 16 bp, Artificial Sequence
  synthetic [barcode part1]
ttcaggacggttaacc

SEQ ID NO: 28958 - DNA, 16 bp, Artificial Sequence
  synthetic [barcode part1]
attattctccggacgt

SEQ ID NO: 28959 - DNA, 16 bp, Artificial Sequence
  synthetic [barcode part1]
gcaaccgttccttgac

SEQ ID NO: 28960 - DNA, 16 bp, Artificial Sequence
  synthetic [barcode part1]
cactatcttgtgcagt

SEQ ID NO: 28961 - DNA, 16 bp, Artificial Sequence
  synthetic [barcode part1]
cctaaccagtctcttc

SEQ ID NO: 28962 - DNA, 16 bp, Artificial Sequence
  synthetic [barcode part1]
acactaggactcacac

SEQ ID NO: 28963 - DNA, 16 bp, Artificial Sequence
  synthetic [barcode part1]
gtgtggtactgacgtt

SEQ ID NO: 28964 - DNA, 16 bp, Artificial Sequence
  synthetic [barcode part1]
aacacgtcacagtcac

SEQ ID NO: 28965 - DNA, 16 bp, Artificial Sequence
  synthetic [barcode part1]
ttcttccgagatcctc

SEQ ID NO: 28966 - DNA, 16 bp, Artificial Sequence
  synthetic [barcode part1]
aatctaagtgcaggac

SEQ ID NO: 28967 - DNA, 16 bp, Artificial Sequence
  synthetic [barcode part1]
ttgttctgtacggttg

SEQ ID NO: 28968 - DNA, 16 bp, Artificial Sequence
  synthetic [barcode part1]
ttaccgaccttatacg

SEQ ID NO: 28969 - DNA, 16 bp, Artificial Sequence
  synthetic [barcode part1]
gacagactaggatccg

SEQ ID NO: 28970 - DNA, 16 bp, Artificial Sequence
  synthetic [barcode part1]
gttagactaggtcacc

SEQ ID NO: 28971 - DNA, 16 bp, Artificial Sequence
  synthetic [barcode part1]
caatccttggccgtgt

SEQ ID NO: 28972 - DNA, 16 bp, Artificial Sequence
  synthetic [barcode part1]
gttctcctcttctgag

SEQ ID NO: 28973 - DNA, 16 bp, Artificial Sequence
  synthetic [barcode part1]
gcgatcgagtctcttc

SEQ ID NO: 28974 - DNA, 16 bp, Artificial Sequence
  synthetic [barcode part1]
tggttacggattgaag

SEQ ID NO: 28975 - DNA, 16 bp, Artificial Sequence
  synthetic [barcode part1]
agttggtgttgcagtc

SEQ ID NO: 28976 - DNA, 16 bp, Artificial Sequence
  synthetic [barcode part1]
aggacacaccactgag

SEQ ID NO: 28977 - DNA, 16 bp, Artificial Sequence
  synthetic [barcode part1]
gtccactcgttacgac

SEQ ID NO: 28978 - DNA, 16 bp, Artificial Sequence
  synthetic [barcode part1]
ccgagtacggatatct

SEQ ID NO: 28979 - DNA, 16 bp, Artificial Sequence
  synthetic [barcode part1]
tccttgaatcacacgt

SEQ ID NO: 28980 - DNA, 16 bp, Artificial Sequence
  synthetic [barcode part1]
tcgcagaggtagtggt

SEQ ID NO: 28981 - DNA, 16 bp, Artificial Sequence
  synthetic [barcode part1]
gatatccacaaggtag

SEQ ID NO: 28982 - DNA, 16 bp, Artificial Sequence
  synthetic [barcode part1]
aaggtctacctacttc

SEQ ID NO: 28983 - DNA, 16 bp, Artificial Sequence
  synthetic [barcode part1]
gtgtactgcctcctag

SEQ ID NO: 28984 - DNA, 16 bp, Artificial Sequence
  synthetic [barcode part1]
agtagagagaggtcgt

SEQ ID NO: 28985 - DNA, 16 bp, Artificial Sequence
  synthetic [barcode part1]
ttcctaaccgagagac

SEQ ID NO: 28986 - DNA, 16 bp, Artificial Sequence
  synthetic [barcode part1]
cgcaagaggttcaacg

SEQ ID NO: 28987 - DNA, 16 bp, Artificial Sequence
  synthetic [barcode part1]
tcggtggttatacttc

SEQ ID NO: 28988 - DNA, 16 bp, Artificial Sequence
  synthetic [barcode part1]
gttactctaaggcggt

SEQ ID NO: 28989 - DNA, 16 bp, Artificial Sequence
  synthetic [barcode part1]
tcgtagaggacacttc

SEQ ID NO: 28990 - DNA, 16 bp, Artificial Sequence
  synthetic [barcode part1]
cctatacggtcgtcgt

SEQ ID NO: 28991 - DNA, 16 bp, Artificial Sequence
  synthetic [barcode part1]
tgtcgttgacgtgcct

SEQ ID NO: 28992 - DNA, 16 bp, Artificial Sequence
  synthetic [barcode part1]
taggattgtcgcgact

SEQ ID NO: 28993 - DNA, 16 bp, Artificial Sequence
  synthetic [barcode part1]
tagttgcggacacttg

SEQ ID NO: 28994 - DNA, 16 bp, Artificial Sequence
  synthetic [barcode part1]
actacagtatcgcgac

SEQ ID NO: 28995 - DNA, 16 bp, Artificial Sequence
  synthetic [barcode part1]
ttccgtaagtccagtt

SEQ ID NO: 28996 - DNA, 16 bp, Artificial Sequence
  synthetic [barcode part1]
ccagtatctaatctcg

SEQ ID NO: 28997 - DNA, 16 bp, Artificial Sequence
  synthetic [barcode part1]
cctagtaagtagtccg

SEQ ID NO: 28998 - DNA, 16 bp, Artificial Sequence
  synthetic [barcode part1]
gttgatcggttgatcg

SEQ ID NO: 28999 - DNA, 16 bp, Artificial Sequence
  synthetic [barcode part1]
atcctgccaagttcgc

SEQ ID NO: 29000 - DNA, 16 bp, Artificial Sequence
  synthetic [barcode part1]
aacgtgccttcggtct

SEQ ID NO: 29001 - DNA, 16 bp, Artificial Sequence
  synthetic [barcode part1]
cctactgtcttcaacc

SEQ ID NO: 29002 - DNA, 16 bp, Artificial Sequence
  synthetic [barcode part1]
actccaactgatcgag

SEQ ID NO: 29003 - DNA, 16 bp, Artificial Sequence
  synthetic [barcode part1]
tgcgtgacgaagaatt

SEQ ID NO: 29004 - DNA, 16 bp, Artificial Sequence
  synthetic [barcode part1]
tgtgcctcttagtaac

SEQ ID NO: 29005 - DNA, 16 bp, Artificial Sequence
  synthetic [barcode part1]
caactggaacttcggt

SEQ ID NO: 29006 - DNA, 16 bp, Artificial Sequence
  synthetic [barcode part1]
tgagtgcagttgcgtt

SEQ ID NO: 29007 - DNA, 16 bp, Artificial Sequence
  synthetic [barcode part1]
gcggaattcgtaggtg

SEQ ID NO: 29008 - DNA, 16 bp, Artificial Sequence
  synthetic [barcode part1]
agatcgcacagaagtt

SEQ ID NO: 29009 - DNA, 16 bp, Artificial Sequence
  synthetic [barcode part1]
tacgtcacacacaacg

SEQ ID NO: 29010 - DNA, 16 bp, Artificial Sequence
  synthetic [barcode part1]
tcgccagaactactag

SEQ ID NO: 29011 - DNA, 16 bp, Artificial Sequence
  synthetic [barcode part1]
tgatatacctccggcc

SEQ ID NO: 29012 - DNA, 16 bp, Artificial Sequence
  synthetic [barcode part1]
aacacgcgaccagagt

SEQ ID NO: 29013 - DNA, 16 bp, Artificial Sequence
  synthetic [barcode part1]
taaccagtgcggtatc

SEQ ID NO: 29014 - DNA, 16 bp, Artificial Sequence
  synthetic [barcode part1]
cactgatagagagttg

SEQ ID NO: 29015 - DNA, 16 bp, Artificial Sequence
  synthetic [barcode part1]
ttcgattgcaccgacc

SEQ ID NO: 29016 - DNA, 16 bp, Artificial Sequence
  synthetic [barcode part1]
gtccgaagtgacgagt

SEQ ID NO: 29017 - DNA, 16 bp, Artificial Sequence
  synthetic [barcode part1]
tctcgtaacacgaggt

SEQ ID NO: 29018 - DNA, 16 bp, Artificial Sequence
  synthetic [barcode part1]
tgacgttggtgaatag

SEQ ID NO: 29019 - DNA, 16 bp, Artificial Sequence
  synthetic [barcode part1]
cgtagacctgcagatt

SEQ ID NO: 29020 - DNA, 16 bp, Artificial Sequence
  synthetic [barcode part1]
tgtcgccttcgcaagt

SEQ ID NO: 29021 - DNA, 16 bp, Artificial Sequence
  synthetic [barcode part1]
actaacctgcagtgtg

SEQ ID NO: 29022 - DNA, 16 bp, Artificial Sequence
  synthetic [barcode part1]
gttccaattctctccg

SEQ ID NO: 29023 - DNA, 16 bp, Artificial Sequence
  synthetic [barcode part1]
gacctaattccgcacc

SEQ ID NO: 29024 - DNA, 16 bp, Artificial Sequence
  synthetic [barcode part1]
gagactcctacttgtt

SEQ ID NO: 29025 - DNA, 16 bp, Artificial Sequence
  synthetic [barcode part1]
taaggcggtgaagtag

SEQ ID NO: 29026 - DNA, 16 bp, Artificial Sequence
  synthetic [barcode part1]
tgtcgcgagtcttaag

SEQ ID NO: 29027 - DNA, 16 bp, Artificial Sequence
  synthetic [barcode part1]
cgtattggaagaatcg

SEQ ID NO: 29028 - DNA, 16 bp, Artificial Sequence
  synthetic [barcode part1]
taagtcggcactctcc

SEQ ID NO: 29029 - DNA, 16 bp, Artificial Sequence
  synthetic [barcode part1]
atacttcctctgcacc

SEQ ID NO: 29030 - DNA, 16 bp, Artificial Sequence
  synthetic [barcode part1]
actcgtaagtcacgtg

SEQ ID NO: 29031 - DNA, 16 bp, Artificial Sequence
  synthetic [barcode part1]
ccttgacacacctgac

SEQ ID NO: 29032 - DNA, 16 bp, Artificial Sequence
  synthetic [barcode part1]
tgcagagtaacgattg

SEQ ID NO: 29033 - DNA, 16 bp, Artificial Sequence
  synthetic [barcode part1]
tgtcgtccaagtccac

SEQ ID NO: 29034 - DNA, 16 bp, Artificial Sequence
  synthetic [barcode part1]
tctcagtacgtggcct

SEQ ID NO: 29035 - DNA, 16 bp, Artificial Sequence
  synthetic [barcode part1]
gaatcggcgtggttag

SEQ ID NO: 29036 - DNA, 16 bp, Artificial Sequence
  synthetic [barcode part1]
gttctcacgccggatt

SEQ ID NO: 29037 - DNA, 16 bp, Artificial Sequence
  synthetic [barcode part1]
gtcgcgtattgttccg

SEQ ID NO: 29038 - DNA, 16 bp, Artificial Sequence
  synthetic [barcode part1]
tactaggacgacttgc

SEQ ID NO: 29039 - DNA, 16 bp, Artificial Sequence
  synthetic [barcode part1]
acacacttccacagag

SEQ ID NO: 29040 - DNA, 16 bp, Artificial Sequence
  synthetic [barcode part1]
gttaacacactccgtt

SEQ ID NO: 29041 - DNA, 16 bp, Artificial Sequence
  synthetic [barcode part1]
tcgataacaaggacgt

SEQ ID NO: 29042 - DNA, 16 bp, Artificial Sequence
  synthetic [barcode part1]
tcgaggtgaacagatt

SEQ ID NO: 29043 - DNA, 16 bp, Artificial Sequence
  synthetic [barcode part1]
gtggaggtcgagttgt

SEQ ID NO: 29044 - DNA, 16 bp, Artificial Sequence
  synthetic [barcode part1]
tattcacctgttcgcc

SEQ ID NO: 29045 - DNA, 16 bp, Artificial Sequence
  synthetic [barcode part1]
gacgagatccttaacc

SEQ ID NO: 29046 - DNA, 16 bp, Artificial Sequence
  synthetic [barcode part1]
cgcctacctacctatt

SEQ ID NO: 29047 - DNA, 16 bp, Artificial Sequence
  synthetic [barcode part1]
acaactcctactggag

SEQ ID NO: 29048 - DNA, 16 bp, Artificial Sequence
  synthetic [barcode part1]
aattgcgaatcgagac

SEQ ID NO: 29049 - DNA, 16 bp, Artificial Sequence
  synthetic [barcode part1]
gaattgagtgcgttag

SEQ ID NO: 29050 - DNA, 16 bp, Artificial Sequence
  synthetic [barcode part1]
tctgtatccagtgatc

SEQ ID NO: 29051 - DNA, 16 bp, Artificial Sequence
  synthetic [barcode part1]
tgtgccttgttcttgc

SEQ ID NO: 29052 - DNA, 16 bp, Artificial Sequence
  synthetic [barcode part1]
ttcgaacgtgactacg

SEQ ID NO: 29053 - DNA, 16 bp, Artificial Sequence
  synthetic [barcode part1]
acttaggcctgttgcc

SEQ ID NO: 29054 - DNA, 16 bp, Artificial Sequence
  synthetic [barcode part1]
tgtaacacgcctactt

SEQ ID NO: 29055 - DNA, 16 bp, Artificial Sequence
  synthetic [barcode part1]
gaggtcacgattcttg

SEQ ID NO: 29056 - DNA, 16 bp, Artificial Sequence
  synthetic [barcode part1]
gccagtaatccgagtt

SEQ ID NO: 29057 - DNA, 16 bp, Artificial Sequence
  synthetic [barcode part1]
tacaggtccactccac

SEQ ID NO: 29058 - DNA, 16 bp, Artificial Sequence
  synthetic [barcode part1]
tctcctccagtcgatt

SEQ ID NO: 29059 - DNA, 16 bp, Artificial Sequence
  synthetic [barcode part1]
actataggataggcgt

SEQ ID NO: 29060 - DNA, 16 bp, Artificial Sequence
  synthetic [barcode part1]
ccaaggcagtattgtc

SEQ ID NO: 29061 - DNA, 16 bp, Artificial Sequence
  synthetic [barcode part1]
aggtcgttgaaggcgt

SEQ ID NO: 29062 - DNA, 16 bp, Artificial Sequence
  synthetic [barcode part1]
tacaattcgcgaaccg

SEQ ID NO: 29063 - DNA, 16 bp, Artificial Sequence
  synthetic [barcode part1]
gtgacagttcagtctg

SEQ ID NO: 29064 - DNA, 16 bp, Artificial Sequence
  synthetic [barcode part1]
caagaggcaactatac

SEQ ID NO: 29065 - DNA, 16 bp, Artificial Sequence
  synthetic [barcode part1]
atactgcaggtaagtg

SEQ ID NO: 29066 - DNA, 16 bp, Artificial Sequence
  synthetic [barcode part1]
gcagtagattctccag

SEQ ID NO: 29067 - DNA, 16 bp, Artificial Sequence
  synthetic [barcode part1]
cgtatacctggttgag

SEQ ID NO: 29068 - DNA, 16 bp, Artificial Sequence
  synthetic [barcode part1]
gatcggttcaactggt

SEQ ID NO: 29069 - DNA, 16 bp, Artificial Sequence
  synthetic [barcode part1]
cagtgcgcaatctctc

SEQ ID NO: 29070 - DNA, 16 bp, Artificial Sequence
  synthetic [barcode part1]
taacctcacgtgccgt

SEQ ID NO: 29071 - DNA, 16 bp, Artificial Sequence
  synthetic [barcode part1]
aatatacctcttcggc

SEQ ID NO: 29072 - DNA, 16 bp, Artificial Sequence
  synthetic [barcode part1]
tcaaggtgagttccac

SEQ ID NO: 29073 - DNA, 16 bp, Artificial Sequence
  synthetic [barcode part1]
caatcagactggttgc

SEQ ID NO: 29074 - DNA, 16 bp, Artificial Sequence
  synthetic [barcode part1]
gtacaaccgattgtgc

SEQ ID NO: 29075 - DNA, 16 bp, Artificial Sequence
  synthetic [barcode part1]
agtactgactgactgc

SEQ ID NO: 29076 - DNA, 16 bp, Artificial Sequence
  synthetic [barcode part1]
tgttactgtccggacc

SEQ ID NO: 29077 - DNA, 16 bp, Artificial Sequence
  synthetic [barcode part1]
gtacagtggagaattc

SEQ ID NO: 29078 - DNA, 16 bp, Artificial Sequence
  synthetic [barcode part1]
gtagtcgattgcgtgt

SEQ ID NO: 29079 - DNA, 16 bp, Artificial Sequence
  synthetic [barcode part1]
caggccttctagatag

SEQ ID NO: 29080 - DNA, 16 bp, Artificial Sequence
  synthetic [barcode part1]
tccgtgttcagattac

SEQ ID NO: 29081 - DNA, 16 bp, Artificial Sequence
  synthetic [barcode part1]
cactgatccttgaccg

SEQ ID NO: 29082 - DNA, 16 bp, Artificial Sequence
  synthetic [barcode part1]
aggattcacgacgttc

SEQ ID NO: 29083 - DNA, 16 bp, Artificial Sequence
  synthetic [barcode part1]
cggcctaacaattcag

SEQ ID NO: 29084 - DNA, 16 bp, Artificial Sequence
  synthetic [barcode part1]
tcacgtattctccaag

SEQ ID NO: 29085 - DNA, 16 bp, Artificial Sequence
  synthetic [barcode part1]
aacagtcggttgtcac

SEQ ID NO: 29086 - DNA, 16 bp, Artificial Sequence
  synthetic [barcode part1]
gtagttctgtcttcag

SEQ ID NO: 29087 - DNA, 16 bp, Artificial Sequence
  synthetic [barcode part1]
attgcctacgagttct

SEQ ID NO: 29088 - DNA, 16 bp, Artificial Sequence
  synthetic [barcode part1]
agtcaggcgagttcag

SEQ ID NO: 29089 - DNA, 16 bp, Artificial Sequence
  synthetic [barcode part1]
agttctctggccttct

SEQ ID NO: 29090 - DNA, 16 bp, Artificial Sequence
  synthetic [barcode part1]
taagtattctccggtc

SEQ ID NO: 29091 - DNA, 16 bp, Artificial Sequence
  synthetic [barcode part1]
tagtgacctgaatcgc

SEQ ID NO: 29092 - DNA, 16 bp, Artificial Sequence
  synthetic [barcode part1]
taattgtctcggtctg

SEQ ID NO: 29093 - DNA, 16 bp, Artificial Sequence
  synthetic [barcode part1]
cgtgttcttcgtactc

SEQ ID NO: 29094 - DNA, 16 bp, Artificial Sequence
  synthetic [barcode part1]
actagaacgcggtcag

SEQ ID NO: 29095 - DNA, 16 bp, Artificial Sequence
  synthetic [barcode part1]
ttaggcgcagagtggt

SEQ ID NO: 29096 - DNA, 16 bp, Artificial Sequence
  synthetic [barcode part1]
agattgcgacgtaggc

SEQ ID NO: 29097 - DNA, 16 bp, Artificial Sequence
  synthetic [barcode part1]
cgcgatatcacagtgt

SEQ ID NO: 29098 - DNA, 16 bp, Artificial Sequence
  synthetic [barcode part1]
tcggaatacctcagac

SEQ ID NO: 29099 - DNA, 16 bp, Artificial Sequence
  synthetic [barcode part1]
tcgaatcaaggtacag

SEQ ID NO: 29100 - DNA, 16 bp, Artificial Sequence
  synthetic [barcode part1]
ttatagtaccgcgacg

SEQ ID NO: 29101 - DNA, 16 bp, Artificial Sequence
  synthetic [barcode part1]
tcaactgttggtcgag

SEQ ID NO: 29102 - DNA, 16 bp, Artificial Sequence
  synthetic [barcode part1]
tccacgttaattcgac

SEQ ID NO: 29103 - DNA, 16 bp, Artificial Sequence
  synthetic [barcode part1]
tgaatccgcgacagag

SEQ ID NO: 29104 - DNA, 16 bp, Artificial Sequence
  synthetic [barcode part1]
gtgtgcctatcaacag

SEQ ID NO: 29105 - DNA, 16 bp, Artificial Sequence
  synthetic [barcode part1]
tcgtagatagagagtc

SEQ ID NO: 29106 - DNA, 16 bp, Artificial Sequence
  synthetic [barcode part1]
cgatatctactcgccg

SEQ ID NO: 29107 - DNA, 16 bp, Artificial Sequence
  synthetic [barcode part1]
gtagtctacctgacag

SEQ ID NO: 29108 - DNA, 16 bp, Artificial Sequence
  synthetic [barcode part1]
gtaactgttggttctc

SEQ ID NO: 29109 - DNA, 16 bp, Artificial Sequence
  synthetic [barcode part1]
actcctcttctccaag

SEQ ID NO: 29110 - DNA, 16 bp, Artificial Sequence
  synthetic [barcode part1]
gcgtatagtgtgtgtc

SEQ ID NO: 29111 - DNA, 16 bp, Artificial Sequence
  synthetic [barcode part1]
gtcgaatactcttacc

SEQ ID NO: 29112 - DNA, 16 bp, Artificial Sequence
  synthetic [barcode part1]
atccacctgaggtctc

SEQ ID NO: 29113 - DNA, 16 bp, Artificial Sequence
  synthetic [barcode part1]
gttgtcagtgtcctcg

SEQ ID NO: 29114 - DNA, 16 bp, Artificial Sequence
  synthetic [barcode part1]
gtaacaacctacagag

SEQ ID NO: 29115 - DNA, 16 bp, Artificial Sequence
  synthetic [barcode part1]
tcctagaatccacttg

SEQ ID NO: 29116 - DNA, 16 bp, Artificial Sequence
  synthetic [barcode part1]
attactcctacagacc

SEQ ID NO: 29117 - DNA, 16 bp, Artificial Sequence
  synthetic [barcode part1]
aagttcacgtcggtgt

SEQ ID NO: 29118 - DNA, 16 bp, Artificial Sequence
  synthetic [barcode part1]
gtaatcgttggtcttc

SEQ ID NO: 29119 - DNA, 16 bp, Artificial Sequence
  synthetic [barcode part1]
acactggaatccacgt

SEQ ID NO: 29120 - DNA, 16 bp, Artificial Sequence
  synthetic [barcode part1]
gcggaattccagacag

SEQ ID NO: 29121 - DNA, 16 bp, Artificial Sequence
  synthetic [barcode part1]
atcacggagatcctgt

SEQ ID NO: 29122 - DNA, 16 bp, Artificial Sequence
  synthetic [barcode part1]
tgactctgcaccggtt

SEQ ID NO: 29123 - DNA, 16 bp, Artificial Sequence
  synthetic [barcode part1]
accggataacggttct

SEQ ID NO: 29124 - DNA, 16 bp, Artificial Sequence
  synthetic [barcode part1]
gagaccagtgtccaag

SEQ ID NO: 29125 - DNA, 16 bp, Artificial Sequence
  synthetic [barcode part1]
gtacaatccagtcctt

SEQ ID NO: 29126 - DNA, 16 bp, Artificial Sequence
  synthetic [barcode part1]
cctcttcaaggtctct

SEQ ID NO: 29127 - DNA, 16 bp, Artificial Sequence
  synthetic [barcode part1]
gtcacaggagtaagtt

SEQ ID NO: 29128 - DNA, 16 bp, Artificial Sequence
  synthetic [barcode part1]
ttgcgtctgttggacc

SEQ ID NO: 29129 - DNA, 16 bp, Artificial Sequence
  synthetic [barcode part1]
tctccgtattcagtag

SEQ ID NO: 29130 - DNA, 16 bp, Artificial Sequence
  synthetic [barcode part1]
aggtgttattccgttc

SEQ ID NO: 29131 - DNA, 16 bp, Artificial Sequence
  synthetic [barcode part1]
acagaaggcgttctct

SEQ ID NO: 29132 - DNA, 16 bp, Artificial Sequence
  synthetic [barcode part1]
tcctctgactcagacg

SEQ ID NO: 29133 - DNA, 16 bp, Artificial Sequence
  synthetic [barcode part1]
acgcggtctctctaac

SEQ ID NO: 29134 - DNA, 16 bp, Artificial Sequence
  synthetic [barcode part1]
gatctaccggaacgag

SEQ ID NO: 29135 - DNA, 16 bp, Artificial Sequence
  synthetic [barcode part1]
gcacaagtgttaggcg

SEQ ID NO: 29136 - DNA, 16 bp, Artificial Sequence
  synthetic [barcode part1]
tctctggactacgtgc

SEQ ID NO: 29137 - DNA, 16 bp, Artificial Sequence
  synthetic [barcode part1]
tacacctacctggcgt

SEQ ID NO: 29138 - DNA, 16 bp, Artificial Sequence
  synthetic [barcode part1]
tagaactgtcgaccgt

SEQ ID NO: 29139 - DNA, 16 bp, Artificial Sequence
  synthetic [barcode part1]
ttgtccaacggtgcct

SEQ ID NO: 29140 - DNA, 16 bp, Artificial Sequence
  synthetic [barcode part1]
tcctatacagttcgac

SEQ ID NO: 29141 - DNA, 16 bp, Artificial Sequence
  synthetic [barcode part1]
cctagattacctcgcg

SEQ ID NO: 29142 - DNA, 16 bp, Artificial Sequence
  synthetic [barcode part1]
ttgcaaggacaacaac

SEQ ID NO: 29143 - DNA, 16 bp, Artificial Sequence
  synthetic [barcode part1]
gtcactagtcggattg

SEQ ID NO: 29144 - DNA, 16 bp, Artificial Sequence
  synthetic [barcode part1]
tgcgatacacttgttc

SEQ ID NO: 29145 - DNA, 16 bp, Artificial Sequence
  synthetic [barcode part1]
tcctagatccacttag

SEQ ID NO: 29146 - DNA, 16 bp, Artificial Sequence
  synthetic [barcode part1]
acgaacttccttagtc

SEQ ID NO: 29147 - DNA, 16 bp, Artificial Sequence
  synthetic [barcode part1]
gatcgcctctgtgttg

SEQ ID NO: 29148 - DNA, 16 bp, Artificial Sequence
  synthetic [barcode part1]
ttctcgacgcgtaatt

SEQ ID NO: 29149 - DNA, 16 bp, Artificial Sequence
  synthetic [barcode part1]
gtagaggacacttctc

SEQ ID NO: 29150 - DNA, 16 bp, Artificial Sequence
  synthetic [barcode part1]
gaaggtctaactgtag

SEQ ID NO: 29151 - DNA, 16 bp, Artificial Sequence
  synthetic [barcode part1]
tgtggcgaataggcac

SEQ ID NO: 29152 - DNA, 16 bp, Artificial Sequence
  synthetic [barcode part1]
ttcctctggtcaactc

SEQ ID NO: 29153 - DNA, 16 bp, Artificial Sequence
  synthetic [barcode part1]
gttggtgcggaggatt

SEQ ID NO: 29154 - DNA, 16 bp, Artificial Sequence
  synthetic [barcode part1]
aacagatatcctggag

SEQ ID NO: 29155 - DNA, 16 bp, Artificial Sequence
  synthetic [barcode part1]
agtggtctgtatcctt

SEQ ID NO: 29156 - DNA, 16 bp, Artificial Sequence
  synthetic [barcode part1]
ccttaactcaacacgt

SEQ ID NO: 29157 - DNA, 16 bp, Artificial Sequence
  synthetic [barcode part1]
taatagtccttgcacc

SEQ ID NO: 29158 - DNA, 16 bp, Artificial Sequence
  synthetic [barcode part1]
agtcggtcacggtatt

SEQ ID NO: 29159 - DNA, 16 bp, Artificial Sequence
  synthetic [barcode part1]
cactggaatctctgtt

SEQ ID NO: 29160 - DNA, 16 bp, Artificial Sequence
  synthetic [barcode part1]
cagattgtcctgcgtc

SEQ ID NO: 29161 - DNA, 16 bp, Artificial Sequence
  synthetic [barcode part1]
cctggtcctctaactt

SEQ ID NO: 29162 - DNA, 16 bp, Artificial Sequence
  synthetic [barcode part1]
gcgtcttattattggc

SEQ ID NO: 29163 - DNA, 16 bp, Artificial Sequence
  synthetic [barcode part1]
aacctgtgaattcgcg

SEQ ID NO: 29164 - DNA, 16 bp, Artificial Sequence
  synthetic [barcode part1]
cctcgatacgtgactc

SEQ ID NO: 29165 - DNA, 16 bp, Artificial Sequence
  synthetic [barcode part1]
tatcactgttcagacc

SEQ ID NO: 29166 - DNA, 16 bp, Artificial Sequence
  synthetic [barcode part1]
actagtgccactattc

SEQ ID NO: 29167 - DNA, 16 bp, Artificial Sequence
  synthetic [barcode part1]
gaagacactgccaggt

SEQ ID NO: 29168 - DNA, 16 bp, Artificial Sequence
  synthetic [barcode part1]
tcggtgaacgatctgt

SEQ ID NO: 29169 - DNA, 16 bp, Artificial Sequence
  synthetic [barcode part1]
cgtgcagtagatctac

SEQ ID NO: 29170 - DNA, 16 bp, Artificial Sequence
  synthetic [barcode part1]
tctccgatacacggtc

SEQ ID NO: 29171 - DNA, 16 bp, Artificial Sequence
  synthetic [barcode part1]
ttacctgtatcgtggt

SEQ ID NO: 29172 - DNA, 16 bp, Artificial Sequence
  synthetic [barcode part1]
aattgaggcaattgcg

SEQ ID NO: 29173 - DNA, 16 bp, Artificial Sequence
  synthetic [barcode part1]
gacttaggcacctctc

SEQ ID NO: 29174 - DNA, 16 bp, Artificial Sequence
  synthetic [barcode part1]
aggagactactgatac

SEQ ID NO: 29175 - DNA, 16 bp, Artificial Sequence
  synthetic [barcode part1]
aggttgttggatcacc

SEQ ID NO: 29176 - DNA, 16 bp, Artificial Sequence
  synthetic [barcode part1]
atacggtgaagagttc

SEQ ID NO: 29177 - DNA, 16 bp, Artificial Sequence
  synthetic [barcode part1]
tctgagttctaactcg

SEQ ID NO: 29178 - DNA, 16 bp, Artificial Sequence
  synthetic [barcode part1]
atcgagtggatcactc

SEQ ID NO: 29179 - DNA, 16 bp, Artificial Sequence
  synthetic [barcode part1]
cgtaagtatccgcaac

SEQ ID NO: 29180 - DNA, 16 bp, Artificial Sequence
  synthetic [barcode part1]
agtacgtgtgttgacc

SEQ ID NO: 29181 - DNA, 16 bp, Artificial Sequence
  synthetic [barcode part1]
ttgagtcggttgtcag

SEQ ID NO: 29182 - DNA, 16 bp, Artificial Sequence
  synthetic [barcode part1]
gcacagactatatccg

SEQ ID NO: 29183 - DNA, 16 bp, Artificial Sequence
  synthetic [barcode part1]
ttattcgacggacgac

SEQ ID NO: 29184 - DNA, 16 bp, Artificial Sequence
  synthetic [barcode part1]
cacctggaggaatcag

SEQ ID NO: 29185 - DNA, 16 bp, Artificial Sequence
  synthetic [barcode part1]
tcgtctgagatcctgc

SEQ ID NO: 29186 - DNA, 16 bp, Artificial Sequence
  synthetic [barcode part1]
ttgagtgcagaacggc

SEQ ID NO: 29187 - DNA, 16 bp, Artificial Sequence
  synthetic [barcode part1]
gtgtctcttgacgacc

SEQ ID NO: 29188 - DNA, 16 bp, Artificial Sequence
  synthetic [barcode part1]
gaaggcgattcctgtt

SEQ ID NO: 29189 - DNA, 16 bp, Artificial Sequence
  synthetic [barcode part1]
tcctgtacgcaagagt

SEQ ID NO: 29190 - DNA, 16 bp, Artificial Sequence
  synthetic [barcode part1]
atcggtgatccagact

SEQ ID NO: 29191 - DNA, 16 bp, Artificial Sequence
  synthetic [barcode part1]
taccgttacggttact

SEQ ID NO: 29192 - DNA, 16 bp, Artificial Sequence
  synthetic [barcode part1]
gccacaaggacaggtt

SEQ ID NO: 29193 - DNA, 16 bp, Artificial Sequence
  synthetic [barcode part1]
ccggtacagtcttctg

SEQ ID NO: 29194 - DNA, 16 bp, Artificial Sequence
  synthetic [barcode part1]
aggttacggtagttcc

SEQ ID NO: 29195 - DNA, 16 bp, Artificial Sequence
  synthetic [barcode part1]
tccactgtcttatcgc

SEQ ID NO: 29196 - DNA, 16 bp, Artificial Sequence
  synthetic [barcode part1]
gacgtcaactgactgt

SEQ ID NO: 29197 - DNA, 16 bp, Artificial Sequence
  synthetic [barcode part1]
cgcgcaatacttcacc

SEQ ID NO: 29198 - DNA, 16 bp, Artificial Sequence
  synthetic [barcode part1]
aacactgacgttgtgc

SEQ ID NO: 29199 - DNA, 16 bp, Artificial Sequence
  synthetic [barcode part1]
tgtgtaggtgagacgc

SEQ ID NO: 29200 - DNA, 16 bp, Artificial Sequence
  synthetic [barcode part1]
tatcctataccgcctc

SEQ ID NO: 29201 - DNA, 16 bp, Artificial Sequence
  synthetic [barcode part1]
tctggtcctctaatcc

SEQ ID NO: 29202 - DNA, 16 bp, Artificial Sequence
  synthetic [barcode part1]
atagaaggcgtaggac

SEQ ID NO: 29203 - DNA, 16 bp, Artificial Sequence
  synthetic [barcode part1]
gccgaggtaattatag

SEQ ID NO: 29204 - DNA, 16 bp, Artificial Sequence
  synthetic [barcode part1]
gttctgccttaacctc

SEQ ID NO: 29205 - DNA, 16 bp, Artificial Sequence
  synthetic [barcode part1]
gacgttactggtcaac

SEQ ID NO: 29206 - DNA, 16 bp, Artificial Sequence
  synthetic [barcode part1]
taggatctcgattggc

SEQ ID NO: 29207 - DNA, 16 bp, Artificial Sequence
  synthetic [barcode part1]
agaacaagttcgtgac

SEQ ID NO: 29208 - DNA, 16 bp, Artificial Sequence
  synthetic [barcode part1]
tggaagacgtacgatt

SEQ ID NO: 29209 - DNA, 16 bp, Artificial Sequence
  synthetic [barcode part1]
ttataccggtgacttc

SEQ ID NO: 29210 - DNA, 16 bp, Artificial Sequence
  synthetic [barcode part1]
tccttagtagttgcgt

SEQ ID NO: 29211 - DNA, 16 bp, Artificial Sequence
  synthetic [barcode part1]
actcaggtattgtcct

SEQ ID NO: 29212 - DNA, 16 bp, Artificial Sequence
  synthetic [barcode part1]
actgcaatctatctgc

SEQ ID NO: 29213 - DNA, 16 bp, Artificial Sequence
  synthetic [barcode part1]
ccgaatacaagacggc

SEQ ID NO: 29214 - DNA, 16 bp, Artificial Sequence
  synthetic [barcode part1]
aggttctctcctcttg

SEQ ID NO: 29215 - DNA, 16 bp, Artificial Sequence
  synthetic [barcode part1]
cgcaccttgtcagact

SEQ ID NO: 29216 - DNA, 16 bp, Artificial Sequence
  synthetic [barcode part1]
gaccgtatacggttgt

SEQ ID NO: 29217 - DNA, 16 bp, Artificial Sequence
  synthetic [barcode part1]
gtggtcgtctctcaac

SEQ ID NO: 29218 - DNA, 16 bp, Artificial Sequence
  synthetic [barcode part1]
cgtagatacctcgtcc

SEQ ID NO: 29219 - DNA, 16 bp, Artificial Sequence
  synthetic [barcode part1]
aattgcgttgactctc

SEQ ID NO: 29220 - DNA, 16 bp, Artificial Sequence
  synthetic [barcode part1]
gtctgttgagtcttgt

SEQ ID NO: 29221 - DNA, 16 bp, Artificial Sequence
  synthetic [barcode part1]
actaggcacctccact

SEQ ID NO: 29222 - DNA, 16 bp, Artificial Sequence
  synthetic [barcode part1]
tagtacgtggtaagac

SEQ ID NO: 29223 - DNA, 16 bp, Artificial Sequence
  synthetic [barcode part1]
cctacacactgaattc

SEQ ID NO: 29224 - DNA, 16 bp, Artificial Sequence
  synthetic [barcode part1]
tcggtccaataacggt

SEQ ID NO: 29225 - DNA, 16 bp, Artificial Sequence
  synthetic [barcode part1]
aaggataactcggcgc

SEQ ID NO: 29226 - DNA, 16 bp, Artificial Sequence
  synthetic [barcode part1]
agactggtctcagttg

SEQ ID NO: 29227 - DNA, 16 bp, Artificial Sequence
  synthetic [barcode part1]
cagagtgttgtgtaag

SEQ ID NO: 29228 - DNA, 16 bp, Artificial Sequence
  synthetic [barcode part1]
ttgccaagtgtctccg

SEQ ID NO: 29229 - DNA, 16 bp, Artificial Sequence
  synthetic [barcode part1]
ccagtaataccttcac

SEQ ID NO: 29230 - DNA, 16 bp, Artificial Sequence
  synthetic [barcode part1]
cgaagaacagtgtgtt

SEQ ID NO: 29231 - DNA, 16 bp, Artificial Sequence
  synthetic [barcode part1]
gaccacaacgttggtt

SEQ ID NO: 29232 - DNA, 16 bp, Artificial Sequence
  synthetic [barcode part1]
gtgcagagacaacctg

SEQ ID NO: 29233 - DNA, 16 bp, Artificial Sequence
  synthetic [barcode part1]
cacggcgacgaatagt

SEQ ID NO: 29234 - DNA, 16 bp, Artificial Sequence
  synthetic [barcode part1]
tgtactcgacgtaggt

SEQ ID NO: 29235 - DNA, 16 bp, Artificial Sequence
  synthetic [barcode part1]
gccacagatctacctc

SEQ ID NO: 29236 - DNA, 16 bp, Artificial Sequence
  synthetic [barcode part1]
gtactggccaggtatt

SEQ ID NO: 29237 - DNA, 16 bp, Artificial Sequence
  synthetic [barcode part1]
cagtctagtccaacag

SEQ ID NO: 29238 - DNA, 16 bp, Artificial Sequence
  synthetic [barcode part1]
tgtacttgtccgacgc

SEQ ID NO: 29239 - DNA, 16 bp, Artificial Sequence
  synthetic [barcode part1]
gaacacgttagtggcg

SEQ ID NO: 29240 - DNA, 16 bp, Artificial Sequence
  synthetic [barcode part1]
tcgcaagtactgacgt

SEQ ID NO: 29241 - DNA, 16 bp, Artificial Sequence
  synthetic [barcode part1]
gacggcctaattcagt

SEQ ID NO: 29242 - DNA, 16 bp, Artificial Sequence
  synthetic [barcode part1]
gtgagtgacttacctg

SEQ ID NO: 29243 - DNA, 16 bp, Artificial Sequence
  synthetic [barcode part1]
gcgaactaccggaagt

SEQ ID NO: 29244 - DNA, 16 bp, Artificial Sequence
  synthetic [barcode part1]
aatattggcacacgcc

SEQ ID NO: 29245 - DNA, 16 bp, Artificial Sequence
  synthetic [barcode part1]
gcgatattgactgacc

SEQ ID NO: 29246 - DNA, 16 bp, Artificial Sequence
  synthetic [barcode part1]
gagtcttgtgtcgtag

SEQ ID NO: 29247 - DNA, 16 bp, Artificial Sequence
  synthetic [barcode part1]
gcgtaaggatacgaag

SEQ ID NO: 29248 - DNA, 16 bp, Artificial Sequence
  synthetic [barcode part1]
acttgttaggtctcac

SEQ ID NO: 29249 - DNA, 16 bp, Artificial Sequence
  synthetic [barcode part1]
tcgatcttaggtctgt

SEQ ID NO: 29250 - DNA, 16 bp, Artificial Sequence
  synthetic [barcode part1]
tctcgcactaagtcgc

SEQ ID NO: 29251 - DNA, 16 bp, Artificial Sequence
  synthetic [barcode part1]
gcactcttggcaatcc

SEQ ID NO: 29252 - DNA, 16 bp, Artificial Sequence
  synthetic [barcode part1]
gattagaggtggtgag

SEQ ID NO: 29253 - DNA, 16 bp, Artificial Sequence
  synthetic [barcode part1]
tgcgtccttcaatagt

SEQ ID NO: 29254 - DNA, 16 bp, Artificial Sequence
  synthetic [barcode part1]
caactcaactcggtag

SEQ ID NO: 29255 - DNA, 16 bp, Artificial Sequence
  synthetic [barcode part1]
aggcgtaagtcaccag

SEQ ID NO: 29256 - DNA, 16 bp, Artificial Sequence
  synthetic [barcode part1]
agacagaatctcaggt

SEQ ID NO: 29257 - DNA, 16 bp, Artificial Sequence
  synthetic [barcode part1]
gtggcacgttacaatc

SEQ ID NO: 29258 - DNA, 16 bp, Artificial Sequence
  synthetic [barcode part1]
aacacaactcagtgag

SEQ ID NO: 29259 - DNA, 16 bp, Artificial Sequence
  synthetic [barcode part1]
tgaggtcgtattgcgt

SEQ ID NO: 29260 - DNA, 16 bp, Artificial Sequence
  synthetic [barcode part1]
cgcaagagttgtcgag

SEQ ID NO: 29261 - DNA, 16 bp, Artificial Sequence
  synthetic [barcode part1]
agactgtgtctccgtc

SEQ ID NO: 29262 - DNA, 16 bp, Artificial Sequence
  synthetic [barcode part1]
gtaactctccacgtcg

SEQ ID NO: 29263 - DNA, 16 bp, Artificial Sequence
  synthetic [barcode part1]
gaacggagttcacttc

SEQ ID NO: 29264 - DNA, 16 bp, Artificial Sequence
  synthetic [barcode part1]
acgacgacttagtctg

SEQ ID NO: 29265 - DNA, 16 bp, Artificial Sequence
  synthetic [barcode part1]
ttcactactaacgtgc

SEQ ID NO: 29266 - DNA, 16 bp, Artificial Sequence
  synthetic [barcode part1]
tatccttgttaggtcg

SEQ ID NO: 29267 - DNA, 16 bp, Artificial Sequence
  synthetic [barcode part1]
cctagtaggcaattcg

SEQ ID NO: 29268 - DNA, 16 bp, Artificial Sequence
  synthetic [barcode part1]
ttgttacgtgagttcc

SEQ ID NO: 29269 - DNA, 16 bp, Artificial Sequence
  synthetic [barcode part1]
ccagtataatctcctg

SEQ ID NO: 29270 - DNA, 16 bp, Artificial Sequence
  synthetic [barcode part1]
tgtactgagtcctccg

SEQ ID NO: 29271 - DNA, 16 bp, Artificial Sequence
  synthetic [barcode part1]
cgcgaatcactgtcct

SEQ ID NO: 29272 - DNA, 16 bp, Artificial Sequence
  synthetic [barcode part1]
agtaaggcgcagacct

SEQ ID NO: 29273 - DNA, 16 bp, Artificial Sequence
  synthetic [barcode part1]
gaggtgacttactgtc

SEQ ID NO: 29274 - DNA, 16 bp, Artificial Sequence
  synthetic [barcode part1]
tggtctaacagaggcg

SEQ ID NO: 29275 - DNA, 16 bp, Artificial Sequence
  synthetic [barcode part1]
atcgcaggtctcaagt

SEQ ID NO: 29276 - DNA, 16 bp, Artificial Sequence
  synthetic [barcode part1]
tccacgtgtcaccaac

SEQ ID NO: 29277 - DNA, 16 bp, Artificial Sequence
  synthetic [barcode part1]
cctgaattcgtgcaag

SEQ ID NO: 29278 - DNA, 16 bp, Artificial Sequence
  synthetic [barcode part1]
cggaacaacaactgcg

SEQ ID NO: 29279 - DNA, 16 bp, Artificial Sequence
  synthetic [barcode part1]
gacactgagaaggagt

SEQ ID NO: 29280 - DNA, 16 bp, Artificial Sequence
  synthetic [barcode part1]
ttcctcgacgaagtag

SEQ ID NO: 29281 - DNA, 16 bp, Artificial Sequence
  synthetic [barcode part1]
cgaccaacacaacact

SEQ ID NO: 29282 - DNA, 16 bp, Artificial Sequence
  synthetic [barcode part1]
tcttcagtgacacgtt

SEQ ID NO: 29283 - DNA, 16 bp, Artificial Sequence
  synthetic [barcode part1]
atctcaccggaagact

SEQ ID NO: 29284 - DNA, 16 bp, Artificial Sequence
  synthetic [barcode part1]
accgttccactacttc

SEQ ID NO: 29285 - DNA, 16 bp, Artificial Sequence
  synthetic [barcode part1]
tgtgttgtcagttctg

SEQ ID NO: 29286 - DNA, 16 bp, Artificial Sequence
  synthetic [barcode part1]
gacaatacgaacactg

SEQ ID NO: 29287 - DNA, 16 bp, Artificial Sequence
  synthetic [barcode part1]
caccttgagtatccgc

SEQ ID NO: 29288 - DNA, 16 bp, Artificial Sequence
  synthetic [barcode part1]
gttggcctaataccag

SEQ ID NO: 29289 - DNA, 16 bp, Artificial Sequence
  synthetic [barcode part1]
acacgcaactagtcgt

SEQ ID NO: 29290 - DNA, 16 bp, Artificial Sequence
  synthetic [barcode part1]
gtagtgtatcgtgacc

SEQ ID NO: 29291 - DNA, 16 bp, Artificial Sequence
  synthetic [barcode part1]
cgcgatccgataagag

SEQ ID NO: 29292 - DNA, 16 bp, Artificial Sequence
  synthetic [barcode part1]
acctcggatactacag

SEQ ID NO: 29293 - DNA, 16 bp, Artificial Sequence
  synthetic [barcode part1]
acactagtacgtcgac

SEQ ID NO: 29294 - DNA, 16 bp, Artificial Sequence
  synthetic [barcode part1]
tctatcgtgacgaggt

SEQ ID NO: 29295 - DNA, 16 bp, Artificial Sequence
  synthetic [barcode part1]
gaactcgttacgtggt

SEQ ID NO: 29296 - DNA, 16 bp, Artificial Sequence
  synthetic [barcode part1]
cggtacactctaccgt

SEQ ID NO: 29297 - DNA, 16 bp, Artificial Sequence
  synthetic [barcode part1]
gcgactaagagtcggt

SEQ ID NO: 29298 - DNA, 16 bp, Artificial Sequence
  synthetic [barcode part1]
gtattaagaggtggtc

SEQ ID NO: 29299 - DNA, 16 bp, Artificial Sequence
  synthetic [barcode part1]
cggtgcacgatagaac

SEQ ID NO: 29300 - DNA, 16 bp, Artificial Sequence
  synthetic [barcode part1]
tagttggcgatcgatc

SEQ ID NO: 29301 - DNA, 16 bp, Artificial Sequence
  synthetic [barcode part1]
gtcagaggtattggcg

SEQ ID NO: 29302 - DNA, 16 bp, Artificial Sequence
  synthetic [barcode part1]
caactggtctccttct

SEQ ID NO: 29303 - DNA, 16 bp, Artificial Sequence
  synthetic [barcode part1]
gtcgtataaggtaacg

SEQ ID NO: 29304 - DNA, 16 bp, Artificial Sequence
  synthetic [barcode part1]
gtcgtgccttctaacg

SEQ ID NO: 29305 - DNA, 16 bp, Artificial Sequence
  synthetic [barcode part1]
aactggtacgtacacc

SEQ ID NO: 29306 - DNA, 16 bp, Artificial Sequence
  synthetic [barcode part1]
taaccaacgcgacgtt

SEQ ID NO: 29307 - DNA, 16 bp, Artificial Sequence
  synthetic [barcode part1]
gtcactcacctataac

SEQ ID NO: 29308 - DNA, 16 bp, Artificial Sequence
  synthetic [barcode part1]
ttacttccgacctctg

SEQ ID NO: 29309 - DNA, 16 bp, Artificial Sequence
  synthetic [barcode part1]
tgcgttatcaattccg

SEQ ID NO: 29310 - DNA, 16 bp, Artificial Sequence
  synthetic [barcode part1]
tagtcgtatagtcgcg

SEQ ID NO: 29311 - DNA, 16 bp, Artificial Sequence
  synthetic [barcode part1]
ttatcaccgccacttc

SEQ ID NO: 29312 - DNA, 16 bp, Artificial Sequence
  synthetic [barcode part1]
agactggtgattgtag

SEQ ID NO: 29313 - DNA, 16 bp, Artificial Sequence
  synthetic [barcode part1]
cactactgtagtcact

SEQ ID NO: 29314 - DNA, 16 bp, Artificial Sequence
  synthetic [barcode part1]
tctggtcctaacttcc

SEQ ID NO: 29315 - DNA, 16 bp, Artificial Sequence
  synthetic [barcode part1]
tctgttggcgcgactt

SEQ ID NO: 29316 - DNA, 16 bp, Artificial Sequence
  synthetic [barcode part1]
agatccgtgttctact

SEQ ID NO: 29317 - DNA, 16 bp, Artificial Sequence
  synthetic [barcode part1]
tgtgtccagtggtctc

SEQ ID NO: 29318 - DNA, 16 bp, Artificial Sequence
  synthetic [barcode part1]
tataggacgcaaggag

SEQ ID NO: 29319 - DNA, 16 bp, Artificial Sequence
  synthetic [barcode part1]
aggcagtctagtgcag

SEQ ID NO: 29320 - DNA, 16 bp, Artificial Sequence
  synthetic [barcode part1]
gttgttcctgtaggtt

SEQ ID NO: 29321 - DNA, 16 bp, Artificial Sequence
  synthetic [barcode part1]
caactagagtcctgac

SEQ ID NO: 29322 - DNA, 16 bp, Artificial Sequence
  synthetic [barcode part1]
gaaccgaacgcgttag

SEQ ID NO: 29323 - DNA, 16 bp, Artificial Sequence
  synthetic [barcode part1]
ccagtggtaagagtgc

SEQ ID NO: 29324 - DNA, 16 bp, Artificial Sequence
  synthetic [barcode part1]
agacagagtaggcagt

SEQ ID NO: 29325 - DNA, 16 bp, Artificial Sequence
  synthetic [barcode part1]
attctggtagtgccag

SEQ ID NO: 29326 - DNA, 16 bp, Artificial Sequence
  synthetic [barcode part1]
aagattgtgcgagttg

SEQ ID NO: 29327 - DNA, 16 bp, Artificial Sequence
  synthetic [barcode part1]
aaccagtctgagatcc

SEQ ID NO: 29328 - DNA, 16 bp, Artificial Sequence
  synthetic [barcode part1]
cctgcgagtaacagag

SEQ ID NO: 29329 - DNA, 16 bp, Artificial Sequence
  synthetic [barcode part1]
aggtggtccaatatag

SEQ ID NO: 29330 - DNA, 16 bp, Artificial Sequence
  synthetic [barcode part1]
ccactattgcctaagt

SEQ ID NO: 29331 - DNA, 16 bp, Artificial Sequence
  synthetic [barcode part1]
ttccacggattgttac

SEQ ID NO: 29332 - DNA, 16 bp, Artificial Sequence
  synthetic [barcode part1]
agtcgagactcgagtg

SEQ ID NO: 29333 - DNA, 16 bp, Artificial Sequence
  synthetic [barcode part1]
gcgttgaactacttct

SEQ ID NO: 29334 - DNA, 16 bp, Artificial Sequence
  synthetic [barcode part1]
acgtgttgtgactgtg

SEQ ID NO: 29335 - DNA, 16 bp, Artificial Sequence
  synthetic [barcode part1]
agacgttacggattcc

SEQ ID NO: 29336 - DNA, 16 bp, Artificial Sequence
  synthetic [barcode part1]
cctatcggactacgtc

SEQ ID NO: 29337 - DNA, 16 bp, Artificial Sequence
  synthetic [barcode part1]
gttcgtctctagaatc

SEQ ID NO: 29338 - DNA, 16 bp, Artificial Sequence
  synthetic [barcode part1]
tccgttctctggaacg

SEQ ID NO: 29339 - DNA, 16 bp, Artificial Sequence
  synthetic [barcode part1]
tgtagacgtcctgtcc

SEQ ID NO: 29340 - DNA, 16 bp, Artificial Sequence
  synthetic [barcode part1]
cgacagatatcgtctg

SEQ ID NO: 29341 - DNA, 16 bp, Artificial Sequence
  synthetic [barcode part1]
acgcaacacgtatcgt

SEQ ID NO: 29342 - DNA, 16 bp, Artificial Sequence
  synthetic [barcode part1]
gaacactgtggcgaac

SEQ ID NO: 29343 - DNA, 16 bp, Artificial Sequence
  synthetic [barcode part1]
tgagtgtcaacttctc

SEQ ID NO: 29344 - DNA, 16 bp, Artificial Sequence
  synthetic [barcode part1]
tgattcgtgtctctag

SEQ ID NO: 29345 - DNA, 16 bp, Artificial Sequence
  synthetic [barcode part1]
gttggcggcaattatc

SEQ ID NO: 29346 - DNA, 16 bp, Artificial Sequence
  synthetic [barcode part1]
acaccggtatattggc

SEQ ID NO: 29347 - DNA, 16 bp, Artificial Sequence
  synthetic [barcode part1]
caacgagaagtgacag

SEQ ID NO: 29348 - DNA, 16 bp, Artificial Sequence
  synthetic [barcode part1]
tgtgaactgccactcc

SEQ ID NO: 29349 - DNA, 16 bp, Artificial Sequence
  synthetic [barcode part1]
atctatcgacagacgc

SEQ ID NO: 29350 - DNA, 16 bp, Artificial Sequence
  synthetic [barcode part1]
acttccaacctggcgt

SEQ ID NO: 29351 - DNA, 16 bp, Artificial Sequence
  synthetic [barcode part1]
tcctgatccttcgact

SEQ ID NO: 29352 - DNA, 16 bp, Artificial Sequence
  synthetic [barcode part1]
cgaaggattgaaggac

SEQ ID NO: 29353 - DNA, 16 bp, Artificial Sequence
  synthetic [barcode part1]
caattcgcctacaccg

SEQ ID NO: 29354 - DNA, 16 bp, Artificial Sequence
  synthetic [barcode part1]
agatacactctgcacg

SEQ ID NO: 29355 - DNA, 16 bp, Artificial Sequence
  synthetic [barcode part1]
tacttcgccgcaggtt

SEQ ID NO: 29356 - DNA, 16 bp, Artificial Sequence
  synthetic [barcode part1]
gtcgagtccgttaagt

SEQ ID NO: 29357 - DNA, 16 bp, Artificial Sequence
  synthetic [barcode part1]
tgacactcctatctag

SEQ ID NO: 29358 - DNA, 16 bp, Artificial Sequence
  synthetic [barcode part1]
ttgaccaactggtcag

SEQ ID NO: 29359 - DNA, 16 bp, Artificial Sequence
  synthetic [barcode part1]
taagatcgccgcaact

SEQ ID NO: 29360 - DNA, 16 bp, Artificial Sequence
  synthetic [barcode part1]
cgcagatacaagtcct

SEQ ID NO: 29361 - DNA, 16 bp, Artificial Sequence
  synthetic [barcode part1]
tacacaggacaacaac

SEQ ID NO: 29362 - DNA, 16 bp, Artificial Sequence
  synthetic [barcode part1]
ccggtacaagatcgag

SEQ ID NO: 29363 - DNA, 16 bp, Artificial Sequence
  synthetic [barcode part1]
tagtctcggtcgaagt

SEQ ID NO: 29364 - DNA, 16 bp, Artificial Sequence
  synthetic [barcode part1]
tattctcggtctaacg

SEQ ID NO: 29365 - DNA, 16 bp, Artificial Sequence
  synthetic [barcode part1]
gaatcaccgttagacc

SEQ ID NO: 29366 - DNA, 16 bp, Artificial Sequence
  synthetic [barcode part1]
actgatcctccaagag

SEQ ID NO: 29367 - DNA, 16 bp, Artificial Sequence
  synthetic [barcode part1]
ttaaggtcgtcgtggt

SEQ ID NO: 29368 - DNA, 16 bp, Artificial Sequence
  synthetic [barcode part1]
tgtcacctgccttatc

SEQ ID NO: 29369 - DNA, 16 bp, Artificial Sequence
  synthetic [barcode part1]
tcaagtgattccgttc

SEQ ID NO: 29370 - DNA, 16 bp, Artificial Sequence
  synthetic [barcode part1]
tagtggttgacagtcc

SEQ ID NO: 29371 - DNA, 16 bp, Artificial Sequence
  synthetic [barcode part1]
gttggtgactcaggtt

SEQ ID NO: 29372 - DNA, 16 bp, Artificial Sequence
  synthetic [barcode part1]
cgtctacttgcaatac

SEQ ID NO: 29373 - DNA, 16 bp, Artificial Sequence
  synthetic [barcode part1]
tgacgtgatcactctt

SEQ ID NO: 29374 - DNA, 16 bp, Artificial Sequence
  synthetic [barcode part1]
tcgaatcctaacgacg

SEQ ID NO: 29375 - DNA, 16 bp, Artificial Sequence
  synthetic [barcode part1]
tctaggaccagtcaac

SEQ ID NO: 29376 - DNA, 16 bp, Artificial Sequence
  synthetic [barcode part1]
gaggcgagttctactt

SEQ ID NO: 29377 - DNA, 16 bp, Artificial Sequence
  synthetic [barcode part1]
cggcacgaaggattgt

SEQ ID NO: 29378 - DNA, 16 bp, Artificial Sequence
  synthetic [barcode part1]
acggtagtatcgatag

SEQ ID NO: 29379 - DNA, 16 bp, Artificial Sequence
  synthetic [barcode part1]
ccaacctgcgattgtc

SEQ ID NO: 29380 - DNA, 16 bp, Artificial Sequence
  synthetic [barcode part1]
actcagagtaggttcc

SEQ ID NO: 29381 - DNA, 16 bp, Artificial Sequence
  synthetic [barcode part1]
cggttcggataacttg

SEQ ID NO: 29382 - DNA, 16 bp, Artificial Sequence
  synthetic [barcode part1]
gtccggttacaccttg

SEQ ID NO: 29383 - DNA, 16 bp, Artificial Sequence
  synthetic [barcode part1]
tgcgcgtactatagtg

SEQ ID NO: 29384 - DNA, 16 bp, Artificial Sequence
  synthetic [barcode part1]
aactgtggaggtcgac

SEQ ID NO: 29385 - DNA, 16 bp, Artificial Sequence
  synthetic [barcode part1]
atcctacggcacacct

SEQ ID NO: 29386 - DNA, 16 bp, Artificial Sequence
  synthetic [barcode part1]
tgacttctaacgcgtt

SEQ ID NO: 29387 - DNA, 16 bp, Artificial Sequence
  synthetic [barcode part1]
tcctctgtccaattcg

SEQ ID NO: 29388 - DNA, 16 bp, Artificial Sequence
  synthetic [barcode part1]
tcaaggcacctatctt

SEQ ID NO: 29389 - DNA, 16 bp, Artificial Sequence
  synthetic [barcode part1]
tactgtcgtcttccgt

SEQ ID NO: 29390 - DNA, 16 bp, Artificial Sequence
  synthetic [barcode part1]
aacgtctcggaagacg

SEQ ID NO: 29391 - DNA, 16 bp, Artificial Sequence
  synthetic [barcode part1]
caacttccaatcgtgt

SEQ ID NO: 29392 - DNA, 16 bp, Artificial Sequence
  synthetic [barcode part1]
ttccacgttgaaccgc

SEQ ID NO: 29393 - DNA, 16 bp, Artificial Sequence
  synthetic [barcode part1]
gtgtctcaatctgatc

SEQ ID NO: 29394 - DNA, 16 bp, Artificial Sequence
  synthetic [barcode part1]
ttctaggagtgagtag

SEQ ID NO: 29395 - DNA, 16 bp, Artificial Sequence
  synthetic [barcode part1]
cgtaggaccaggttag

SEQ ID NO: 29396 - DNA, 16 bp, Artificial Sequence
  synthetic [barcode part1]
aggtaccactctgcct

SEQ ID NO: 29397 - DNA, 16 bp, Artificial Sequence
  synthetic [barcode part1]
cgaacaccgtatcagt

SEQ ID NO: 29398 - DNA, 16 bp, Artificial Sequence
  synthetic [barcode part1]
cgtaacaacggtgttc

SEQ ID NO: 29399 - DNA, 16 bp, Artificial Sequence
  synthetic [barcode part1]
gtacggcagaaggttc

SEQ ID NO: 29400 - DNA, 16 bp, Artificial Sequence
  synthetic [barcode part1]
tggtcctgttaatacc

SEQ ID NO: 29401 - DNA, 16 bp, Artificial Sequence
  synthetic [barcode part1]
acgtgccagtgtattg

SEQ ID NO: 29402 - DNA, 16 bp, Artificial Sequence
  synthetic [barcode part1]
aaggttcggcaagtgc

SEQ ID NO: 29403 - DNA, 16 bp, Artificial Sequence
  synthetic [barcode part1]
agttaattgaccggcc

SEQ ID NO: 29404 - DNA, 16 bp, Artificial Sequence
  synthetic [barcode part1]
tccgaagtcggaactt

SEQ ID NO: 29405 - DNA, 16 bp, Artificial Sequence
  synthetic [barcode part1]
tgagaggactgtgtgc

SEQ ID NO: 29406 - DNA, 16 bp, Artificial Sequence
  synthetic [barcode part1]
tctacgtaacctggtt

SEQ ID NO: 29407 - DNA, 16 bp, Artificial Sequence
  synthetic [barcode part1]
tacgatctacggatcg

SEQ ID NO: 29408 - DNA, 16 bp, Artificial Sequence
  synthetic [barcode part1]
ccgatcgttaatcgag

SEQ ID NO: 29409 - DNA, 16 bp, Artificial Sequence
  synthetic [barcode part1]
tcaccacacgagtctc

SEQ ID NO: 29410 - DNA, 16 bp, Artificial Sequence
  synthetic [barcode part1]
gattagattcgcgaag

SEQ ID NO: 29411 - DNA, 16 bp, Artificial Sequence
  synthetic [barcode part1]
actcaaggtagactcc

SEQ ID NO: 29412 - DNA, 16 bp, Artificial Sequence
  synthetic [barcode part1]
gaccagtagaactcct

SEQ ID NO: 29413 - DNA, 16 bp, Artificial Sequence
  synthetic [barcode part1]
cacgtcttgaactatc

SEQ ID NO: 29414 - DNA, 16 bp, Artificial Sequence
  synthetic [barcode part1]
gcggacttcttcgatc

SEQ ID NO: 29415 - DNA, 16 bp, Artificial Sequence
  synthetic [barcode part1]
tgcacttacttggtgt

SEQ ID NO: 29416 - DNA, 16 bp, Artificial Sequence
  synthetic [barcode part1]
gcctcttagtcagaag

SEQ ID NO: 29417 - DNA, 16 bp, Artificial Sequence
  synthetic [barcode part1]
gtgccacggtagatag

SEQ ID NO: 29418 - DNA, 16 bp, Artificial Sequence
  synthetic [barcode part1]
tctggatctatcgccg

SEQ ID NO: 29419 - DNA, 16 bp, Artificial Sequence
  synthetic [barcode part1]
aatcaacgtaccgcgt

SEQ ID NO: 29420 - DNA, 16 bp, Artificial Sequence
  synthetic [barcode part1]
gaaggcggacaactct

SEQ ID NO: 29421 - DNA, 16 bp, Artificial Sequence
  synthetic [barcode part1]
gtcacgcggaataacg

SEQ ID NO: 29422 - DNA, 16 bp, Artificial Sequence
  synthetic [barcode part1]
ttctgatcggtctctc

SEQ ID NO: 29423 - DNA, 16 bp, Artificial Sequence
  synthetic [barcode part1]
tcgagaggagaatcag

SEQ ID NO: 29424 - DNA, 16 bp, Artificial Sequence
  synthetic [barcode part1]
tgtggatcgtcactcc

SEQ ID NO: 29425 - DNA, 16 bp, Artificial Sequence
  synthetic [barcode part1]
ttgcctgtgttcactc

SEQ ID NO: 29426 - DNA, 16 bp, Artificial Sequence
  synthetic [barcode part1]
tgcagacgacaagatt

SEQ ID NO: 29427 - DNA, 16 bp, Artificial Sequence
  synthetic [barcode part1]
taattggcgcgacgtt

SEQ ID NO: 29428 - DNA, 16 bp, Artificial Sequence
  synthetic [barcode part1]
tacgtcagtgtgtcag

SEQ ID NO: 29429 - DNA, 16 bp, Artificial Sequence
  synthetic [barcode part1]
atctccactaccaagt

SEQ ID NO: 29430 - DNA, 16 bp, Artificial Sequence
  synthetic [barcode part1]
taatccttgtacgacc

SEQ ID NO: 29431 - DNA, 16 bp, Artificial Sequence
  synthetic [barcode part1]
aagaacacaggagtgc

SEQ ID NO: 29432 - DNA, 16 bp, Artificial Sequence
  synthetic [barcode part1]
tcggtaagtctccacc

SEQ ID NO: 29433 - DNA, 16 bp, Artificial Sequence
  synthetic [barcode part1]
atccgtcagacagatc

SEQ ID NO: 29434 - DNA, 16 bp, Artificial Sequence
  synthetic [barcode part1]
cgttgtctagaaggtc

SEQ ID NO: 29435 - DNA, 16 bp, Artificial Sequence
  synthetic [barcode part1]
gcctggtattaggttg

SEQ ID NO: 29436 - DNA, 16 bp, Artificial Sequence
  synthetic [barcode part1]
tggatcaggaacacgc

SEQ ID NO: 29437 - DNA, 16 bp, Artificial Sequence
  synthetic [barcode part1]
cgtagttaaggtaacg

SEQ ID NO: 29438 - DNA, 16 bp, Artificial Sequence
  synthetic [barcode part1]
tctattgacgcaactc

SEQ ID NO: 29439 - DNA, 16 bp, Artificial Sequence
  synthetic [barcode part1]
tggtgagaacgcctag

SEQ ID NO: 29440 - DNA, 16 bp, Artificial Sequence
  synthetic [barcode part1]
atagaccgattgcgtc

SEQ ID NO: 29441 - DNA, 16 bp, Artificial Sequence
  synthetic [barcode part1]
tctgtacgtgtggagt

SEQ ID NO: 29442 - DNA, 16 bp, Artificial Sequence
  synthetic [barcode part1]
tcacctaggcactatt

SEQ ID NO: 29443 - DNA, 16 bp, Artificial Sequence
  synthetic [barcode part1]
tgatcggtgcggtatt

SEQ ID NO: 29444 - DNA, 16 bp, Artificial Sequence
  synthetic [barcode part1]
agtaagatcagtacgc

SEQ ID NO: 29445 - DNA, 16 bp, Artificial Sequence
  synthetic [barcode part1]
taacgcagaagtaacc

SEQ ID NO: 29446 - DNA, 16 bp, Artificial Sequence
  synthetic [barcode part1]
agtacgttggttgtgc

SEQ ID NO: 29447 - DNA, 16 bp, Artificial Sequence
  synthetic [barcode part1]
cctgcacagttattgt

SEQ ID NO: 29448 - DNA, 16 bp, Artificial Sequence
  synthetic [barcode part1]
acgttagaactcacgc

SEQ ID NO: 29449 - DNA, 16 bp, Artificial Sequence
  synthetic [barcode part1]
aataacggaactcacg

SEQ ID NO: 29450 - DNA, 16 bp, Artificial Sequence
  synthetic [barcode part1]
aaccaactggttggtc

SEQ ID NO: 29451 - DNA, 16 bp, Artificial Sequence
  synthetic [barcode part1]
ttagtgacctggcagt

SEQ ID NO: 29452 - DNA, 16 bp, Artificial Sequence
  synthetic [barcode part1]
cagacagataacactg

SEQ ID NO: 29453 - DNA, 16 bp, Artificial Sequence
  synthetic [barcode part1]
tagaccttctggacag

SEQ ID NO: 29454 - DNA, 16 bp, Artificial Sequence
  synthetic [barcode part1]
cacacttcaccttcgt

SEQ ID NO: 29455 - DNA, 16 bp, Artificial Sequence
  synthetic [barcode part1]
tctctcctgacactgt

SEQ ID NO: 29456 - DNA, 16 bp, Artificial Sequence
  synthetic [barcode part1]
gtccgtcaacgtcgtt

SEQ ID NO: 29457 - DNA, 16 bp, Artificial Sequence
  synthetic [barcode part1]
tctgaactggactcag

SEQ ID NO: 29458 - DNA, 16 bp, Artificial Sequence
  synthetic [barcode part1]
gaactgtactctcgcc

SEQ ID NO: 29459 - DNA, 16 bp, Artificial Sequence
  synthetic [barcode part1]
gttgcggacttacctc

SEQ ID NO: 29460 - DNA, 16 bp, Artificial Sequence
  synthetic [barcode part1]
gatatcggtcacagtc

SEQ ID NO: 29461 - DNA, 16 bp, Artificial Sequence
  synthetic [barcode part1]
cacttgttgaggttct

SEQ ID NO: 29462 - DNA, 16 bp, Artificial Sequence
  synthetic [barcode part1]
taccactcgttccgtt

SEQ ID NO: 29463 - DNA, 16 bp, Artificial Sequence
  synthetic [barcode part1]
tggtggtctgaactgt

SEQ ID NO: 29464 - DNA, 16 bp, Artificial Sequence
  synthetic [barcode part1]
tagtgtagagacggtt

SEQ ID NO: 29465 - DNA, 16 bp, Artificial Sequence
  synthetic [barcode part1]
tgtacgacgaactcac

SEQ ID NO: 29466 - DNA, 16 bp, Artificial Sequence
  synthetic [barcode part1]
tcaagaaccaacgtag

SEQ ID NO: 29467 - DNA, 16 bp, Artificial Sequence
  synthetic [barcode part1]
tcgttcgaacaccacc

SEQ ID NO: 29468 - DNA, 16 bp, Artificial Sequence
  synthetic [barcode part1]
gactacactggccttc

SEQ ID NO: 29469 - DNA, 16 bp, Artificial Sequence
  synthetic [barcode part1]
tgatctgcactgagtg

SEQ ID NO: 29470 - DNA, 16 bp, Artificial Sequence
  synthetic [barcode part1]
gaccaattcggaactc

SEQ ID NO: 29471 - DNA, 16 bp, Artificial Sequence
  synthetic [barcode part1]
aagaatatccgacggt

SEQ ID NO: 29472 - DNA, 16 bp, Artificial Sequence
  synthetic [barcode part1]
ttactgtagatccacc

SEQ ID NO: 29473 - DNA, 16 bp, Artificial Sequence
  synthetic [barcode part1]
aggcctatcgttatct

SEQ ID NO: 29474 - DNA, 16 bp, Artificial Sequence
  synthetic [barcode part1]
gtgttccttagaccgc

SEQ ID NO: 29475 - DNA, 16 bp, Artificial Sequence
  synthetic [barcode part1]
aactggtcagtactgc

SEQ ID NO: 29476 - DNA, 16 bp, Artificial Sequence
  synthetic [barcode part1]
ccgtaccttcgtactt

SEQ ID NO: 29477 - DNA, 16 bp, Artificial Sequence
  synthetic [barcode part1]
acaattggagaggtct

SEQ ID NO: 29478 - DNA, 16 bp, Artificial Sequence
  synthetic [barcode part1]
tcaacttagacgtctc

SEQ ID NO: 29479 - DNA, 16 bp, Artificial Sequence
  synthetic [barcode part1]
accgagtatcttcact

SEQ ID NO: 29480 - DNA, 16 bp, Artificial Sequence
  synthetic [barcode part1]
tcgtgaagtggagtgc

SEQ ID NO: 29481 - DNA, 16 bp, Artificial Sequence
  synthetic [barcode part1]
tcgagttattggaccg

SEQ ID NO: 29482 - DNA, 16 bp, Artificial Sequence
  synthetic [barcode part1]
tacacacaaccgatcg

SEQ ID NO: 29483 - DNA, 16 bp, Artificial Sequence
  synthetic [barcode part1]
atagactgtcagaggt

SEQ ID NO: 29484 - DNA, 16 bp, Artificial Sequence
  synthetic [barcode part1]
gaacaggttatccacc

SEQ ID NO: 29485 - DNA, 16 bp, Artificial Sequence
  synthetic [barcode part1]
acgtcggtaacaaggc

SEQ ID NO: 29486 - DNA, 16 bp, Artificial Sequence
  synthetic [barcode part1]
tgcgtccaataacctt

SEQ ID NO: 29487 - DNA, 16 bp, Artificial Sequence
  synthetic [barcode part1]
cggagtcgtcaattac

SEQ ID NO: 29488 - DNA, 16 bp, Artificial Sequence
  synthetic [barcode part1]
gcgattactgagaggc

SEQ ID NO: 29489 - DNA, 16 bp, Artificial Sequence
  synthetic [barcode part1]
ttgtccgccacagtac

SEQ ID NO: 29490 - DNA, 16 bp, Artificial Sequence
  synthetic [barcode part1]
gttggatacttggcac

SEQ ID NO: 29491 - DNA, 16 bp, Artificial Sequence
  synthetic [barcode part1]
gtattatacctgtccg

SEQ ID NO: 29492 - DNA, 16 bp, Artificial Sequence
  synthetic [barcode part1]
gacgtattcaactctc

SEQ ID NO: 29493 - DNA, 16 bp, Artificial Sequence
  synthetic [barcode part1]
gtcgttagtgcaggag

SEQ ID NO: 29494 - DNA, 16 bp, Artificial Sequence
  synthetic [barcode part1]
cgacgaacttaagtag

SEQ ID NO: 29495 - DNA, 16 bp, Artificial Sequence
  synthetic [barcode part1]
agtcctatagagtccg

SEQ ID NO: 29496 - DNA, 16 bp, Artificial Sequence
  synthetic [barcode part1]
gacgtattacaaccgc

SEQ ID NO: 29497 - DNA, 16 bp, Artificial Sequence
  synthetic [barcode part1]
agaattcgtagacggt

SEQ ID NO: 29498 - DNA, 16 bp, Artificial Sequence
  synthetic [barcode part1]
gcgactgtaattgcac

SEQ ID NO: 29499 - DNA, 16 bp, Artificial Sequence
  synthetic [barcode part1]
ttcgccgaagacgatt

SEQ ID NO: 29500 - DNA, 16 bp, Artificial Sequence
  synthetic [barcode part1]
tcgcaggtagaggatc

SEQ ID NO: 29501 - DNA, 16 bp, Artificial Sequence
  synthetic [barcode part1]
ccgagtgttacagatc

SEQ ID NO: 29502 - DNA, 16 bp, Artificial Sequence
  synthetic [barcode part1]
gcctgaatctgccgtt

SEQ ID NO: 29503 - DNA, 16 bp, Artificial Sequence
  synthetic [barcode part1]
tacttgtggcgttatc

SEQ ID NO: 29504 - DNA, 16 bp, Artificial Sequence
  synthetic [barcode part1]
cggattgtagtgacct

SEQ ID NO: 29505 - DNA, 16 bp, Artificial Sequence
  synthetic [barcode part1]
acggttgtacgtgact

SEQ ID NO: 29506 - DNA, 16 bp, Artificial Sequence
  synthetic [barcode part1]
ttcacgtcaacggcct

SEQ ID NO: 29507 - DNA, 16 bp, Artificial Sequence
  synthetic [barcode part1]
tgacgcgagaataatc

SEQ ID NO: 29508 - DNA, 16 bp, Artificial Sequence
  synthetic [barcode part1]
gatcgattcagagtcc

SEQ ID NO: 29509 - DNA, 16 bp, Artificial Sequence
  synthetic [barcode part1]
tgtattctgccggacc

SEQ ID NO: 29510 - DNA, 16 bp, Artificial Sequence
  synthetic [barcode part1]
gtcgtgaacgagtggt

SEQ ID NO: 29511 - DNA, 16 bp, Artificial Sequence
  synthetic [barcode part1]
agtggttaccagactc

SEQ ID NO: 29512 - DNA, 16 bp, Artificial Sequence
  synthetic [barcode part1]
ttcagtgcctgcgttg

SEQ ID NO: 29513 - DNA, 16 bp, Artificial Sequence
  synthetic [barcode part1]
attctcgcagactact

SEQ ID NO: 29514 - DNA, 16 bp, Artificial Sequence
  synthetic [barcode part1]
agagtcgcacgtcaag

SEQ ID NO: 29515 - DNA, 16 bp, Artificial Sequence
  synthetic [barcode part1]
gttgtgtagtcgtgtg

SEQ ID NO: 29516 - DNA, 16 bp, Artificial Sequence
  synthetic [barcode part1]
agttacgttggcctcc

SEQ ID NO: 29517 - DNA, 16 bp, Artificial Sequence
  synthetic [barcode part1]
attacttcctggacgt

SEQ ID NO: 29518 - DNA, 16 bp, Artificial Sequence
  synthetic [barcode part1]
attagtattgccgtcc

SEQ ID NO: 29519 - DNA, 16 bp, Artificial Sequence
  synthetic [barcode part1]
taattctcgcgtgact

SEQ ID NO: 29520 - DNA, 16 bp, Artificial Sequence
  synthetic [barcode part1]
ttagattccgacggtg

SEQ ID NO: 29521 - DNA, 16 bp, Artificial Sequence
  synthetic [barcode part1]
cggcaatagaggtatt

SEQ ID NO: 29522 - DNA, 16 bp, Artificial Sequence
  synthetic [barcode part1]
tcaacaaggcacaagt

SEQ ID NO: 29523 - DNA, 16 bp, Artificial Sequence
  synthetic [barcode part1]
tccttcgagtatatcg

SEQ ID NO: 29524 - DNA, 16 bp, Artificial Sequence
  synthetic [barcode part1]
aacctgagttggactc

SEQ ID NO: 29525 - DNA, 16 bp, Artificial Sequence
  synthetic [barcode part1]
acgttcttcttcgcgt

SEQ ID NO: 29526 - DNA, 16 bp, Artificial Sequence
  synthetic [barcode part1]
tccttgacgtggtcgt

SEQ ID NO: 29527 - DNA, 16 bp, Artificial Sequence
  synthetic [barcode part1]
gttactctaccgcctt

SEQ ID NO: 29528 - DNA, 16 bp, Artificial Sequence
  synthetic [barcode part1]
gttcgattggtggttg

SEQ ID NO: 29529 - DNA, 16 bp, Artificial Sequence
  synthetic [barcode part1]
gtcgcctcgaacactt

SEQ ID NO: 29530 - DNA, 16 bp, Artificial Sequence
  synthetic [barcode part1]
ttggagtgtagtgtcc

SEQ ID NO: 29531 - DNA, 16 bp, Artificial Sequence
  synthetic [barcode part1]
gtaatccttcgtatcg

SEQ ID NO: 29532 - DNA, 16 bp, Artificial Sequence
  synthetic [barcode part1]
agaatactcctgcgtg

SEQ ID NO: 29533 - DNA, 16 bp, Artificial Sequence
  synthetic [barcode part1]
atcgaggcgtacagtg

SEQ ID NO: 29534 - DNA, 16 bp, Artificial Sequence
  synthetic [barcode part1]
cggtattggacagacg

SEQ ID NO: 29535 - DNA, 16 bp, Artificial Sequence
  synthetic [barcode part1]
gatcaatcgaccggtt

SEQ ID NO: 29536 - DNA, 16 bp, Artificial Sequence
  synthetic [barcode part1]
gccaagtcactgagtt

SEQ ID NO: 29537 - DNA, 16 bp, Artificial Sequence
  synthetic [barcode part1]
attccgtgtccttcgt

SEQ ID NO: 29538 - DNA, 16 bp, Artificial Sequence
  synthetic [barcode part1]
cgaattcgtgagttcg

SEQ ID NO: 29539 - DNA, 16 bp, Artificial Sequence
  synthetic [barcode part1]
aagttgttggagacgt

SEQ ID NO: 29540 - DNA, 16 bp, Artificial Sequence
  synthetic [barcode part1]
gacgtgtagaactagt

SEQ ID NO: 29541 - DNA, 16 bp, Artificial Sequence
  synthetic [barcode part1]
cgcgtactcagaattg

SEQ ID NO: 29542 - DNA, 16 bp, Artificial Sequence
  synthetic [barcode part1]
gtataacggtctctct

SEQ ID NO: 29543 - DNA, 16 bp, Artificial Sequence
  synthetic [barcode part1]
gtacgactcctaactt

SEQ ID NO: 29544 - DNA, 16 bp, Artificial Sequence
  synthetic [barcode part1]
tcgccacagtgttcgt

SEQ ID NO: 29545 - DNA, 16 bp, Artificial Sequence
  synthetic [barcode part1]
gtatataggaggaggc

SEQ ID NO: 29546 - DNA, 16 bp, Artificial Sequence
  synthetic [barcode part1]
taggaggaccacacac

SEQ ID NO: 29547 - DNA, 16 bp, Artificial Sequence
  synthetic [barcode part1]
tctggccaccaacact

SEQ ID NO: 29548 - DNA, 16 bp, Artificial Sequence
  synthetic [barcode part1]
gtacggataccttcag

SEQ ID NO: 29549 - DNA, 16 bp, Artificial Sequence
  synthetic [barcode part1]
tcaccgcacggattct

SEQ ID NO: 29550 - DNA, 16 bp, Artificial Sequence
  synthetic [barcode part1]
cgaaggtagactgtcg

SEQ ID NO: 29551 - DNA, 16 bp, Artificial Sequence
  synthetic [barcode part1]
tcttgttcgaacgccg

SEQ ID NO: 29552 - DNA, 16 bp, Artificial Sequence
  synthetic [barcode part1]
tgtacgtgttgtggtg

SEQ ID NO: 29553 - DNA, 16 bp, Artificial Sequence
  synthetic [barcode part1]
ccgtagatagagaact

SEQ ID NO: 29554 - DNA, 16 bp, Artificial Sequence
  synthetic [barcode part1]
accttcaattcggtgt

SEQ ID NO: 29555 - DNA, 16 bp, Artificial Sequence
  synthetic [barcode part1]
gacgtgacaaggatag

SEQ ID NO: 29556 - DNA, 16 bp, Artificial Sequence
  synthetic [barcode part1]
tcgtgtccactgaacc

SEQ ID NO: 29557 - DNA, 16 bp, Artificial Sequence
  synthetic [barcode part1]
tcgccgttatcactct

SEQ ID NO: 29558 - DNA, 16 bp, Artificial Sequence
  synthetic [barcode part1]
gttactgccaagtcag

SEQ ID NO: 29559 - DNA, 16 bp, Artificial Sequence
  synthetic [barcode part1]
gtagatctgtgccaac

SEQ ID NO: 29560 - DNA, 16 bp, Artificial Sequence
  synthetic [barcode part1]
tggtcttgtgtgttgt

SEQ ID NO: 29561 - DNA, 16 bp, Artificial Sequence
  synthetic [barcode part1]
tgcctgtaacactatc

SEQ ID NO: 29562 - DNA, 16 bp, Artificial Sequence
  synthetic [barcode part1]
tcagactggagacacg

SEQ ID NO: 29563 - DNA, 16 bp, Artificial Sequence
  synthetic [barcode part1]
gtaggccttggatatc

SEQ ID NO: 29564 - DNA, 16 bp, Artificial Sequence
  synthetic [barcode part1]
cagagtctgacactgt

SEQ ID NO: 29565 - DNA, 16 bp, Artificial Sequence
  synthetic [barcode part1]
aagtccagataacgac

SEQ ID NO: 29566 - DNA, 16 bp, Artificial Sequence
  synthetic [barcode part1]
cgattacggatcggag

SEQ ID NO: 29567 - DNA, 16 bp, Artificial Sequence
  synthetic [barcode part1]
gcctactgtcctgaac

SEQ ID NO: 29568 - DNA, 16 bp, Artificial Sequence
  synthetic [barcode part1]
aacactccggattcag

SEQ ID NO: 29569 - DNA, 16 bp, Artificial Sequence
  synthetic [barcode part1]
tcgtgccggattgtct

SEQ ID NO: 29570 - DNA, 16 bp, Artificial Sequence
  synthetic [barcode part1]
aattcttcggcgaggt

SEQ ID NO: 29571 - DNA, 16 bp, Artificial Sequence
  synthetic [barcode part1]
actcagagaacctacc

SEQ ID NO: 29572 - DNA, 16 bp, Artificial Sequence
  synthetic [barcode part1]
tgcgtctgttcttgtc

SEQ ID NO: 29573 - DNA, 16 bp, Artificial Sequence
  synthetic [barcode part1]
gttacctactccacct

SEQ ID NO: 29574 - DNA, 16 bp, Artificial Sequence
  synthetic [barcode part1]
cacggattatcgttct

SEQ ID NO: 29575 - DNA, 16 bp, Artificial Sequence
  synthetic [barcode part1]
cctaaggcacgatact

SEQ ID NO: 29576 - DNA, 16 bp, Artificial Sequence
  synthetic [barcode part1]
aggatctggatctcac

SEQ ID NO: 29577 - DNA, 16 bp, Artificial Sequence
  synthetic [barcode part1]
cgaaggatctcaactc

SEQ ID NO: 29578 - DNA, 16 bp, Artificial Sequence
  synthetic [barcode part1]
cactcaaccgaatacg

SEQ ID NO: 29579 - DNA, 16 bp, Artificial Sequence
  synthetic [barcode part1]
actcgtccgtcgtaac

SEQ ID NO: 29580 - DNA, 16 bp, Artificial Sequence
  synthetic [barcode part1]
tcgaagtggactctac

SEQ ID NO: 29581 - DNA, 16 bp, Artificial Sequence
  synthetic [barcode part1]
tcggagagttacttcg

SEQ ID NO: 29582 - DNA, 16 bp, Artificial Sequence
  synthetic [barcode part1]
tgtgaatcggacacct

SEQ ID NO: 29583 - DNA, 16 bp, Artificial Sequence
  synthetic [barcode part1]
tacgtgaccaccactc

SEQ ID NO: 29584 - DNA, 16 bp, Artificial Sequence
  synthetic [barcode part1]
atattcaccgtcctag

SEQ ID NO: 29585 - DNA, 16 bp, Artificial Sequence
  synthetic [barcode part1]
tgaaggagtatcggtt

SEQ ID NO: 29586 - DNA, 16 bp, Artificial Sequence
  synthetic [barcode part1]
acgtggaccgttagag

SEQ ID NO: 29587 - DNA, 16 bp, Artificial Sequence
  synthetic [barcode part1]
ttcaatccgtgtggcc

SEQ ID NO: 29588 - DNA, 16 bp, Artificial Sequence
  synthetic [barcode part1]
gacaataccacaggcg

SEQ ID NO: 29589 - DNA, 16 bp, Artificial Sequence
  synthetic [barcode part1]
gagtatctccggatac

SEQ ID NO: 29590 - DNA, 16 bp, Artificial Sequence
  synthetic [barcode part1]
atcaccttcacctcgt

SEQ ID NO: 29591 - DNA, 16 bp, Artificial Sequence
  synthetic [barcode part1]
ttgaatagacaaggcc

SEQ ID NO: 29592 - DNA, 16 bp, Artificial Sequence
  synthetic [barcode part1]
cacgttccggattacc

SEQ ID NO: 29593 - DNA, 16 bp, Artificial Sequence
  synthetic [barcode part1]
cgcctgatcttgtcag

SEQ ID NO: 29594 - DNA, 16 bp, Artificial Sequence
  synthetic [barcode part1]
taccaagttacgtctc

SEQ ID NO: 29595 - DNA, 16 bp, Artificial Sequence
  synthetic [barcode part1]
agactctataccgcag

SEQ ID NO: 29596 - DNA, 16 bp, Artificial Sequence
  synthetic [barcode part1]
cacctactcacagtgc

SEQ ID NO: 29597 - DNA, 16 bp, Artificial Sequence
  synthetic [barcode part1]
ccttacctagatactg

SEQ ID NO: 29598 - DNA, 16 bp, Artificial Sequence
  synthetic [barcode part1]
ccagaacggatagatt

SEQ ID NO: 29599 - DNA, 16 bp, Artificial Sequence
  synthetic [barcode part1]
tacgacaatctcggac

SEQ ID NO: 29600 - DNA, 16 bp, Artificial Sequence
  synthetic [barcode part1]
cggaatcgaaggaagt

SEQ ID NO: 29601 - DNA, 16 bp, Artificial Sequence
  synthetic [barcode part1]
acctacctattgtgac

SEQ ID NO: 29602 - DNA, 16 bp, Artificial Sequence
  synthetic [barcode part1]
tctgacttcttggcct

SEQ ID NO: 29603 - DNA, 16 bp, Artificial Sequence
  synthetic [barcode part1]
cctaagttccacagag

SEQ ID NO: 29604 - DNA, 16 bp, Artificial Sequence
  synthetic [barcode part1]
ttaccgtggtaggact

SEQ ID NO: 29605 - DNA, 16 bp, Artificial Sequence
  synthetic [barcode part1]
aggacgaggtagaatc

SEQ ID NO: 29606 - DNA, 16 bp, Artificial Sequence
  synthetic [barcode part1]
ttcgcgtactatcggc

SEQ ID NO: 29607 - DNA, 16 bp, Artificial Sequence
  synthetic [barcode part1]
aagacgacaaggcagt

SEQ ID NO: 29608 - DNA, 16 bp, Artificial Sequence
  synthetic [barcode part1]
tctgaccagagaatcc

SEQ ID NO: 29609 - DNA, 16 bp, Artificial Sequence
  synthetic [barcode part1]
tacggtgaccttgagt

SEQ ID NO: 29610 - DNA, 16 bp, Artificial Sequence
  synthetic [barcode part1]
attgtccagtgttcgt

SEQ ID NO: 29611 - DNA, 16 bp, Artificial Sequence
  synthetic [barcode part1]
cggtataactggaggc

SEQ ID NO: 29612 - DNA, 16 bp, Artificial Sequence
  synthetic [barcode part1]
aatccgaacgcggaac

SEQ ID NO: 29613 - DNA, 16 bp, Artificial Sequence
  synthetic [barcode part1]
aggacactgtgaagag

SEQ ID NO: 29614 - DNA, 16 bp, Artificial Sequence
  synthetic [barcode part1]
caccgagttcgtgttc

SEQ ID NO: 29615 - DNA, 16 bp, Artificial Sequence
  synthetic [barcode part1]
gtaaccagtcacgtac

SEQ ID NO: 29616 - DNA, 16 bp, Artificial Sequence
  synthetic [barcode part1]
gaacgagttcgtctac

SEQ ID NO: 29617 - DNA, 16 bp, Artificial Sequence
  synthetic [barcode part1]
ccactacaagtgacac

SEQ ID NO: 29618 - DNA, 16 bp, Artificial Sequence
  synthetic [barcode part1]
ttctatcgtgaatccg

SEQ ID NO: 29619 - DNA, 16 bp, Artificial Sequence
  synthetic [barcode part1]
cgacctctggtgtact

SEQ ID NO: 29620 - DNA, 16 bp, Artificial Sequence
  synthetic [barcode part1]
cagttccaactctctc

SEQ ID NO: 29621 - DNA, 16 bp, Artificial Sequence
  synthetic [barcode part1]
attcgaacaaggtggt

SEQ ID NO: 29622 - DNA, 16 bp, Artificial Sequence
  synthetic [barcode part1]
cacaatcgagataacg

SEQ ID NO: 29623 - DNA, 16 bp, Artificial Sequence
  synthetic [barcode part1]
attatccggactcgcc

SEQ ID NO: 29624 - DNA, 16 bp, Artificial Sequence
  synthetic [barcode part1]
gagacaacactgtcct

SEQ ID NO: 29625 - DNA, 16 bp, Artificial Sequence
  synthetic [barcode part1]
tgaggtgtaccaatag

SEQ ID NO: 29626 - DNA, 16 bp, Artificial Sequence
  synthetic [barcode part1]
taggacggatatatcg

SEQ ID NO: 29627 - DNA, 16 bp, Artificial Sequence
  synthetic [barcode part1]
ttgtccgataagtggc

SEQ ID NO: 29628 - DNA, 16 bp, Artificial Sequence
  synthetic [barcode part1]
taggtctgaattcgcg

SEQ ID NO: 29629 - DNA, 16 bp, Artificial Sequence
  synthetic [barcode part1]
taccggagttcttgtt

SEQ ID NO: 29630 - DNA, 16 bp, Artificial Sequence
  synthetic [barcode part1]
ttaacgcggtcgagag

SEQ ID NO: 29631 - DNA, 16 bp, Artificial Sequence
  synthetic [barcode part1]
tggtggacaaggtaag

SEQ ID NO: 29632 - DNA, 16 bp, Artificial Sequence
  synthetic [barcode part1]
acttacgagtccacag

SEQ ID NO: 29633 - DNA, 16 bp, Artificial Sequence
  synthetic [barcode part1]
tctataccggtccgac

SEQ ID NO: 29634 - DNA, 16 bp, Artificial Sequence
  synthetic [barcode part1]
tgtcgtcggattgaac

SEQ ID NO: 29635 - DNA, 16 bp, Artificial Sequence
  synthetic [barcode part1]
tgcggacaagtctatc

SEQ ID NO: 29636 - DNA, 16 bp, Artificial Sequence
  synthetic [barcode part1]
agaactccactgtgac

SEQ ID NO: 29637 - DNA, 16 bp, Artificial Sequence
  synthetic [barcode part1]
taaggcgttgtgtaag

SEQ ID NO: 29638 - DNA, 16 bp, Artificial Sequence
  synthetic [barcode part1]
gcaggaatacaccttc

SEQ ID NO: 29639 - DNA, 16 bp, Artificial Sequence
  synthetic [barcode part1]
gagtctaacttggacc

SEQ ID NO: 29640 - DNA, 16 bp, Artificial Sequence
  synthetic [barcode part1]
gcaaccaagaaggcct

SEQ ID NO: 29641 - DNA, 16 bp, Artificial Sequence
  synthetic [barcode part1]
cagtgataaggcacgc

SEQ ID NO: 29642 - DNA, 16 bp, Artificial Sequence
  synthetic [barcode part1]
gtgtgttgcctctcag

SEQ ID NO: 29643 - DNA, 16 bp, Artificial Sequence
  synthetic [barcode part1]
tctgtcgtgtagattc

SEQ ID NO: 29644 - DNA, 16 bp, Artificial Sequence
  synthetic [barcode part1]
cgtataggcgactatc

SEQ ID NO: 29645 - DNA, 16 bp, Artificial Sequence
  synthetic [barcode part1]
aatctgagtgtggagt

SEQ ID NO: 29646 - DNA, 16 bp, Artificial Sequence
  synthetic [barcode part1]
cgcaatacttaaggcc

SEQ ID NO: 29647 - DNA, 16 bp, Artificial Sequence
  synthetic [barcode part1]
ttcgccgagtcgtgtt

SEQ ID NO: 29648 - DNA, 16 bp, Artificial Sequence
  synthetic [barcode part1]
gtcttgacgcaatacg

SEQ ID NO: 29649 - DNA, 16 bp, Artificial Sequence
  synthetic [barcode part1]
actcttgttgcgcctt

SEQ ID NO: 29650 - DNA, 16 bp, Artificial Sequence
  synthetic [barcode part1]
ttctcgacgtaatcgt

SEQ ID NO: 29651 - DNA, 16 bp, Artificial Sequence
  synthetic [barcode part1]
cgagtattgtatcggc

SEQ ID NO: 29652 - DNA, 16 bp, Artificial Sequence
  synthetic [barcode part1]
ttggagtctgcgatac

SEQ ID NO: 29653 - DNA, 16 bp, Artificial Sequence
  synthetic [barcode part1]
caggaacagtggttcg

SEQ ID NO: 29654 - DNA, 16 bp, Artificial Sequence
  synthetic [barcode part1]
ttccagtcaacggagt

SEQ ID NO: 29655 - DNA, 16 bp, Artificial Sequence
  synthetic [barcode part1]
gcgttaagtcagaggc

SEQ ID NO: 29656 - DNA, 16 bp, Artificial Sequence
  synthetic [barcode part1]
gcaactaggtcctctc

SEQ ID NO: 29657 - DNA, 16 bp, Artificial Sequence
  synthetic [barcode part1]
cacttgtgtagtgtct

SEQ ID NO: 29658 - DNA, 16 bp, Artificial Sequence
  synthetic [barcode part1]
ttgtcactgtccaagt

SEQ ID NO: 29659 - DNA, 16 bp, Artificial Sequence
  synthetic [barcode part1]
tgtatagacggccact

SEQ ID NO: 29660 - DNA, 16 bp, Artificial Sequence
  synthetic [barcode part1]
ttccaaggagtaagtg

SEQ ID NO: 29661 - DNA, 16 bp, Artificial Sequence
  synthetic [barcode part1]
gttgttcctcaccgtt

SEQ ID NO: 29662 - DNA, 16 bp, Artificial Sequence
  synthetic [barcode part1]
gtgtgcactagttggt

SEQ ID NO: 29663 - DNA, 16 bp, Artificial Sequence
  synthetic [barcode part1]
tgcgtggatagaacgc

SEQ ID NO: 29664 - DNA, 16 bp, Artificial Sequence
  synthetic [barcode part1]
acggttatctcagttc

SEQ ID NO: 29665 - DNA, 16 bp, Artificial Sequence
  synthetic [barcode part1]
tcacaaccacacacag

SEQ ID NO: 29666 - DNA, 16 bp, Artificial Sequence
  synthetic [barcode part1]
cacacaggcaactgtt

SEQ ID NO: 29667 - DNA, 16 bp, Artificial Sequence
  synthetic [barcode part1]
cgatctagtgactcag

SEQ ID NO: 29668 - DNA, 16 bp, Artificial Sequence
  synthetic [barcode part1]
cggacacttggatatc

SEQ ID NO: 29669 - DNA, 16 bp, Artificial Sequence
  synthetic [barcode part1]
tcgccgcagataatac

SEQ ID NO: 29670 - DNA, 16 bp, Artificial Sequence
  synthetic [barcode part1]
gaatccttcggaactg

SEQ ID NO: 29671 - DNA, 16 bp, Artificial Sequence
  synthetic [barcode part1]
gcaagtggagtaagtg

SEQ ID NO: 29672 - DNA, 16 bp, Artificial Sequence
  synthetic [barcode part1]
ccggtctacggttact

SEQ ID NO: 29673 - DNA, 16 bp, Artificial Sequence
  synthetic [barcode part1]
cactaacagttcttcg

SEQ ID NO: 29674 - DNA, 16 bp, Artificial Sequence
  synthetic [barcode part1]
acggttggaggagtct

SEQ ID NO: 29675 - DNA, 16 bp, Artificial Sequence
  synthetic [barcode part1]
agttggtgtcagttgc

SEQ ID NO: 29676 - DNA, 16 bp, Artificial Sequence
  synthetic [barcode part1]
tctagttcggttacac

SEQ ID NO: 29677 - DNA, 16 bp, Artificial Sequence
  synthetic [barcode part1]
tgataaccggttcggt

SEQ ID NO: 29678 - DNA, 16 bp, Artificial Sequence
  synthetic [barcode part1]
gccgaataacacaagt

SEQ ID NO: 29679 - DNA, 16 bp, Artificial Sequence
  synthetic [barcode part1]
ttagtctacggttacc

SEQ ID NO: 29680 - DNA, 16 bp, Artificial Sequence
  synthetic [barcode part1]
cgtcttacgtcgtctt

SEQ ID NO: 29681 - DNA, 16 bp, Artificial Sequence
  synthetic [barcode part1]
gtcttactggatctgt

SEQ ID NO: 29682 - DNA, 16 bp, Artificial Sequence
  synthetic [barcode part1]
tgccaggaagttactc

SEQ ID NO: 29683 - DNA, 16 bp, Artificial Sequence
  synthetic [barcode part1]
agtgaatcctagaacg

SEQ ID NO: 29684 - DNA, 16 bp, Artificial Sequence
  synthetic [barcode part1]
ccttagtaggacgact

SEQ ID NO: 29685 - DNA, 16 bp, Artificial Sequence
  synthetic [barcode part1]
tgagactcgatatcgc

SEQ ID NO: 29686 - DNA, 16 bp, Artificial Sequence
  synthetic [barcode part1]
aagtgatacgcaactg

SEQ ID NO: 29687 - DNA, 16 bp, Artificial Sequence
  synthetic [barcode part1]
gtcaataagaccaggt

SEQ ID NO: 29688 - DNA, 16 bp, Artificial Sequence
  synthetic [barcode part1]
gtggattggaacgacc

SEQ ID NO: 29689 - DNA, 16 bp, Artificial Sequence
  synthetic [barcode part1]
cagagacaatacggag

SEQ ID NO: 29690 - DNA, 16 bp, Artificial Sequence
  synthetic [barcode part1]
gcggaattgtctggag

SEQ ID NO: 29691 - DNA, 16 bp, Artificial Sequence
  synthetic [barcode part1]
atacgcagtatcgtgc

SEQ ID NO: 29692 - DNA, 16 bp, Artificial Sequence
  synthetic [barcode part1]
gcagattaaggtaacc

SEQ ID NO: 29693 - DNA, 16 bp, Artificial Sequence
  synthetic [barcode part1]
ccacgtgtagtatacg

SEQ ID NO: 29694 - DNA, 16 bp, Artificial Sequence
  synthetic [barcode part1]
tcctcggttagtcctt

SEQ ID NO: 29695 - DNA, 16 bp, Artificial Sequence
  synthetic [barcode part1]
acgtacgcacaacgtt

SEQ ID NO: 29696 - DNA, 16 bp, Artificial Sequence
  synthetic [barcode part1]
taaggtaccgtgtaag

SEQ ID NO: 29697 - DNA, 16 bp, Artificial Sequence
  synthetic [barcode part1]
agatagattcgcctgc

SEQ ID NO: 29698 - DNA, 16 bp, Artificial Sequence
  synthetic [barcode part1]
gtgatacacgcgtatc

SEQ ID NO: 29699 - DNA, 16 bp, Artificial Sequence
  synthetic [barcode part1]
gttctcagtggcctgt

SEQ ID NO: 29700 - DNA, 16 bp, Artificial Sequence
  synthetic [barcode part1]
gacttctcgcggactt

SEQ ID NO: 29701 - DNA, 16 bp, Artificial Sequence
  synthetic [barcode part1]
cctgcgaaggcaatag

SEQ ID NO: 29702 - DNA, 16 bp, Artificial Sequence
  synthetic [barcode part1]
aaggaacggtacgcct

SEQ ID NO: 29703 - DNA, 16 bp, Artificial Sequence
  synthetic [barcode part1]
atctgttgagttctgc

SEQ ID NO: 29704 - DNA, 16 bp, Artificial Sequence
  synthetic [barcode part1]
acactctatcaccagt

SEQ ID NO: 29705 - DNA, 16 bp, Artificial Sequence
  synthetic [barcode part1]
acagtgtcagtgtcac

SEQ ID NO: 29706 - DNA, 16 bp, Artificial Sequence
  synthetic [barcode part1]
ttggttcttgccgtct

SEQ ID NO: 29707 - DNA, 16 bp, Artificial Sequence
  synthetic [barcode part1]
agtcggataccggtag

SEQ ID NO: 29708 - DNA, 16 bp, Artificial Sequence
  synthetic [barcode part1]
caacgagtagatactg

SEQ ID NO: 29709 - DNA, 16 bp, Artificial Sequence
  synthetic [barcode part1]
tcttgattcctgccac

SEQ ID NO: 29710 - DNA, 16 bp, Artificial Sequence
  synthetic [barcode part1]
aagaacgacgaggact

SEQ ID NO: 29711 - DNA, 16 bp, Artificial Sequence
  synthetic [barcode part1]
tgtgtccgacaactcc

SEQ ID NO: 29712 - DNA, 16 bp, Artificial Sequence
  synthetic [barcode part1]
gaagtctaacactgcc

SEQ ID NO: 29713 - DNA, 16 bp, Artificial Sequence
  synthetic [barcode part1]
gactgataatcggtcc

SEQ ID NO: 29714 - DNA, 16 bp, Artificial Sequence
  synthetic [barcode part1]
aacactaacgccgtgt

SEQ ID NO: 29715 - DNA, 16 bp, Artificial Sequence
  synthetic [barcode part1]
agtactctctgcagag

SEQ ID NO: 29716 - DNA, 16 bp, Artificial Sequence
  synthetic [barcode part1]
gttgtctgtggtgagt

SEQ ID NO: 29717 - DNA, 16 bp, Artificial Sequence
  synthetic [barcode part1]
tcaagacctcgcctac

SEQ ID NO: 29718 - DNA, 16 bp, Artificial Sequence
  synthetic [barcode part1]
gaccaactggttgact

SEQ ID NO: 29719 - DNA, 16 bp, Artificial Sequence
  synthetic [barcode part1]
taggaccgtcgattgt

SEQ ID NO: 29720 - DNA, 16 bp, Artificial Sequence
  synthetic [barcode part1]
cacttacgtaggtggt

SEQ ID NO: 29721 - DNA, 16 bp, Artificial Sequence
  synthetic [barcode part1]
ttcgaacttcaatccg

SEQ ID NO: 29722 - DNA, 16 bp, Artificial Sequence
  synthetic [barcode part1]
cgattctactgacact

SEQ ID NO: 29723 - DNA, 16 bp, Artificial Sequence
  synthetic [barcode part1]
tgttcgtcaggtgagt

SEQ ID NO: 29724 - DNA, 16 bp, Artificial Sequence
  synthetic [barcode part1]
gcggtgcgattaatct

SEQ ID NO: 29725 - DNA, 16 bp, Artificial Sequence
  synthetic [barcode part1]
ttctacggtcaagtct

SEQ ID NO: 29726 - DNA, 16 bp, Artificial Sequence
  synthetic [barcode part1]
taccaggatccttgtt

SEQ ID NO: 29727 - DNA, 16 bp, Artificial Sequence
  synthetic [barcode part1]
gtggttgcagtgtact

SEQ ID NO: 29728 - DNA, 16 bp, Artificial Sequence
  synthetic [barcode part1]
agtgtacctccttggc

SEQ ID NO: 29729 - DNA, 16 bp, Artificial Sequence
  synthetic [barcode part1]
gcaactgaagaagtct

SEQ ID NO: 29730 - DNA, 16 bp, Artificial Sequence
  synthetic [barcode part1]
atcgccttccgaacac

SEQ ID NO: 29731 - DNA, 16 bp, Artificial Sequence
  synthetic [barcode part1]
cgatctaacttctgtg

SEQ ID NO: 29732 - DNA, 16 bp, Artificial Sequence
  synthetic [barcode part1]
cacttcaccgttctgt

SEQ ID NO: 29733 - DNA, 16 bp, Artificial Sequence
  synthetic [barcode part1]
gcgagaatcgaatcgc

SEQ ID NO: 29734 - DNA, 16 bp, Artificial Sequence
  synthetic [barcode part1]
tgactcagaattgccg

SEQ ID NO: 29735 - DNA, 16 bp, Artificial Sequence
  synthetic [barcode part1]
gttcttggcgaggatt

SEQ ID NO: 29736 - DNA, 16 bp, Artificial Sequence
  synthetic [barcode part1]
taatcgcaggtactcg

SEQ ID NO: 29737 - DNA, 16 bp, Artificial Sequence
  synthetic [barcode part1]
gtattaagttggaggc

SEQ ID NO: 29738 - DNA, 16 bp, Artificial Sequence
  synthetic [barcode part1]
attgattgtgccgcag

SEQ ID NO: 29739 - DNA, 16 bp, Artificial Sequence
  synthetic [barcode part1]
tcgttgatcctgtgcg

SEQ ID NO: 29740 - DNA, 16 bp, Artificial Sequence
  synthetic [barcode part1]
accagaggattccttg

SEQ ID NO: 29741 - DNA, 16 bp, Artificial Sequence
  synthetic [barcode part1]
tctgattgtcgtgtac

SEQ ID NO: 29742 - DNA, 16 bp, Artificial Sequence
  synthetic [barcode part1]
ttagtatcgtgcgacg

SEQ ID NO: 29743 - DNA, 16 bp, Artificial Sequence
  synthetic [barcode part1]
tatccactaggactct

SEQ ID NO: 29744 - DNA, 16 bp, Artificial Sequence
  synthetic [barcode part1]
acaatccggactatcg

SEQ ID NO: 29745 - DNA, 16 bp, Artificial Sequence
  synthetic [barcode part1]
aacagttcacgttcct

SEQ ID NO: 29746 - DNA, 16 bp, Artificial Sequence
  synthetic [barcode part1]
gactacgaagatcagt

SEQ ID NO: 29747 - DNA, 16 bp, Artificial Sequence
  synthetic [barcode part1]
tgcaccgaatcttccg

SEQ ID NO: 29748 - DNA, 16 bp, Artificial Sequence
  synthetic [barcode part1]
ttgagtccgtattctg

SEQ ID NO: 29749 - DNA, 16 bp, Artificial Sequence
  synthetic [barcode part1]
agtctactccaccgtg

SEQ ID NO: 29750 - DNA, 16 bp, Artificial Sequence
  synthetic [barcode part1]
ttagtaatctggcggc

SEQ ID NO: 29751 - DNA, 16 bp, Artificial Sequence
  synthetic [barcode part1]
gtggtcctgaggatag

SEQ ID NO: 29752 - DNA, 16 bp, Artificial Sequence
  synthetic [barcode part1]
aactgcggcactgatt

SEQ ID NO: 29753 - DNA, 16 bp, Artificial Sequence
  synthetic [barcode part1]
aatccgttgttatccg

SEQ ID NO: 29754 - DNA, 16 bp, Artificial Sequence
  synthetic [barcode part1]
cctgaccagagaactt

SEQ ID NO: 29755 - DNA, 16 bp, Artificial Sequence
  synthetic [barcode part1]
gagatctggcgagtac

SEQ ID NO: 29756 - DNA, 16 bp, Artificial Sequence
  synthetic [barcode part1]
cgtccgactaatacag

SEQ ID NO: 29757 - DNA, 16 bp, Artificial Sequence
  synthetic [barcode part1]
ttctccttaactggcc

SEQ ID NO: 29758 - DNA, 16 bp, Artificial Sequence
  synthetic [barcode part1]
aagtctgcactccgtc

SEQ ID NO: 29759 - DNA, 16 bp, Artificial Sequence
  synthetic [barcode part1]
tcggttcgttcttcac

SEQ ID NO: 29760 - DNA, 16 bp, Artificial Sequence
  synthetic [barcode part1]
ttcaaggaaggtcctc

SEQ ID NO: 29761 - DNA, 16 bp, Artificial Sequence
  synthetic [barcode part1]
cgttaggcgtcgaatt

SEQ ID NO: 29762 - DNA, 16 bp, Artificial Sequence
  synthetic [barcode part1]
aagaactggaaccgag

SEQ ID NO: 29763 - DNA, 16 bp, Artificial Sequence
  synthetic [barcode part1]
actcacctgttcactc

SEQ ID NO: 29764 - DNA, 16 bp, Artificial Sequence
  synthetic [barcode part1]
acagtcgaatcctctt

SEQ ID NO: 29765 - DNA, 16 bp, Artificial Sequence
  synthetic [barcode part1]
gtgtcaggatctgtgt

SEQ ID NO: 29766 - DNA, 16 bp, Artificial Sequence
  synthetic [barcode part1]
gtagacgaacaccgtg

SEQ ID NO: 29767 - DNA, 16 bp, Artificial Sequence
  synthetic [barcode part1]
tggtaacagttcggtc

SEQ ID NO: 29768 - DNA, 16 bp, Artificial Sequence
  synthetic [barcode part1]
cacgttactctaatcg

SEQ ID NO: 29769 - DNA, 16 bp, Artificial Sequence
  synthetic [barcode part1]
cgagtacacacttggt

SEQ ID NO: 29770 - DNA, 16 bp, Artificial Sequence
  synthetic [barcode part1]
acgaataggcgagtag

SEQ ID NO: 29771 - DNA, 16 bp, Artificial Sequence
  synthetic [barcode part1]
acctgaacttgttacc

SEQ ID NO: 29772 - DNA, 16 bp, Artificial Sequence
  synthetic [barcode part1]
aacgactctccacgtc

SEQ ID NO: 29773 - DNA, 16 bp, Artificial Sequence
  synthetic [barcode part1]
ttcttgtcagaggcag

SEQ ID NO: 29774 - DNA, 16 bp, Artificial Sequence
  synthetic [barcode part1]
cacggtgaagtagacc

SEQ ID NO: 29775 - DNA, 16 bp, Artificial Sequence
  synthetic [barcode part1]
gtataaggttcctgcg

SEQ ID NO: 29776 - DNA, 16 bp, Artificial Sequence
  synthetic [barcode part1]
gaagaattcgtcgtcc

SEQ ID NO: 29777 - DNA, 16 bp, Artificial Sequence
  synthetic [barcode part1]
gagtgagtctaggacc

SEQ ID NO: 29778 - DNA, 16 bp, Artificial Sequence
  synthetic [barcode part1]
ttgcacacctctcgag

SEQ ID NO: 29779 - DNA, 16 bp, Artificial Sequence
  synthetic [barcode part1]
cacgtcgtgatatacg

SEQ ID NO: 29780 - DNA, 16 bp, Artificial Sequence
  synthetic [barcode part1]
ataattctctacgccg

SEQ ID NO: 29781 - DNA, 16 bp, Artificial Sequence
  synthetic [barcode part1]
gcgttctgatcaccac

SEQ ID NO: 29782 - DNA, 16 bp, Artificial Sequence
  synthetic [barcode part1]
cacgtgatactggtgt

SEQ ID NO: 29783 - DNA, 16 bp, Artificial Sequence
  synthetic [barcode part1]
tggcaatcgtgtcctc

SEQ ID NO: 29784 - DNA, 16 bp, Artificial Sequence
  synthetic [barcode part1]
cacgaagtcggtaacg

SEQ ID NO: 29785 - DNA, 16 bp, Artificial Sequence
  synthetic [barcode part1]
agtactctcaccaccg

SEQ ID NO: 29786 - DNA, 16 bp, Artificial Sequence
  synthetic [barcode part1]
caatacgttctgtcac

SEQ ID NO: 29787 - DNA, 16 bp, Artificial Sequence
  synthetic [barcode part1]
ccggtaatcacgcctt

SEQ ID NO: 29788 - DNA, 16 bp, Artificial Sequence
  synthetic [barcode part1]
gtgtggcaactggaac

SEQ ID NO: 29789 - DNA, 16 bp, Artificial Sequence
  synthetic [barcode part1]
tgtagtggaaccttgc

SEQ ID NO: 29790 - DNA, 16 bp, Artificial Sequence
  synthetic [barcode part1]
taggcgcgtgtaattc

SEQ ID NO: 29791 - DNA, 16 bp, Artificial Sequence
  synthetic [barcode part1]
ccggatacgttgcctt

SEQ ID NO: 29792 - DNA, 16 bp, Artificial Sequence
  synthetic [barcode part1]
attcctaactcggtac

SEQ ID NO: 29793 - DNA, 16 bp, Artificial Sequence
  synthetic [barcode part1]
acaggttaattcgcgc

SEQ ID NO: 29794 - DNA, 16 bp, Artificial Sequence
  synthetic [barcode part1]
accaagttaagaacgc

SEQ ID NO: 29795 - DNA, 16 bp, Artificial Sequence
  synthetic [barcode part1]
gccttattctgtgagt

SEQ ID NO: 29796 - DNA, 16 bp, Artificial Sequence
  synthetic [barcode part1]
ccgttatctcaccgtt

SEQ ID NO: 29797 - DNA, 16 bp, Artificial Sequence
  synthetic [barcode part1]
gaggtggagtactcgt

SEQ ID NO: 29798 - DNA, 16 bp, Artificial Sequence
  synthetic [barcode part1]
ttcgtcggattgtgcc

SEQ ID NO: 29799 - DNA, 16 bp, Artificial Sequence
  synthetic [barcode part1]
tggaggagtgcactac

SEQ ID NO: 29800 - DNA, 16 bp, Artificial Sequence
  synthetic [barcode part1]
ccactctgttaggaag

SEQ ID NO: 29801 - DNA, 16 bp, Artificial Sequence
  synthetic [barcode part1]
gtgcaattgcgtaacc

SEQ ID NO: 29802 - DNA, 16 bp, Artificial Sequence
  synthetic [barcode part1]
actaacgtaggtccac

SEQ ID NO: 29803 - DNA, 16 bp, Artificial Sequence
  synthetic [barcode part1]
actcagaccacctcac

SEQ ID NO: 29804 - DNA, 16 bp, Artificial Sequence
  synthetic [barcode part1]
tcaacaagacgtaggt

SEQ ID NO: 29805 - DNA, 16 bp, Artificial Sequence
  synthetic [barcode part1]
tagagatcttgcaccg

SEQ ID NO: 29806 - DNA, 16 bp, Artificial Sequence
  synthetic [barcode part1]
attaccttcacagacc

SEQ ID NO: 29807 - DNA, 16 bp, Artificial Sequence
  synthetic [barcode part1]
cctcactatcctgttg

SEQ ID NO: 29808 - DNA, 16 bp, Artificial Sequence
  synthetic [barcode part1]
gcaaccagatcggagt

SEQ ID NO: 29809 - DNA, 16 bp, Artificial Sequence
  synthetic [barcode part1]
tagtgcgtggccttct

SEQ ID NO: 29810 - DNA, 16 bp, Artificial Sequence
  synthetic [barcode part1]
agtcttcgcgtgacct

SEQ ID NO: 29811 - DNA, 16 bp, Artificial Sequence
  synthetic [barcode part1]
acgactattgactctc

SEQ ID NO: 29812 - DNA, 16 bp, Artificial Sequence
  synthetic [barcode part1]
agtacgtcagtgtgtc

SEQ ID NO: 29813 - DNA, 16 bp, Artificial Sequence
  synthetic [barcode part1]
acgtatcttgtcactg

SEQ ID NO: 29814 - DNA, 16 bp, Artificial Sequence
  synthetic [barcode part1]
agttcttgactacacc

SEQ ID NO: 29815 - DNA, 16 bp, Artificial Sequence
  synthetic [barcode part1]
ttgacaatctgtgcct

SEQ ID NO: 29816 - DNA, 16 bp, Artificial Sequence
  synthetic [barcode part1]
gagtacgtgacctgag

SEQ ID NO: 29817 - DNA, 16 bp, Artificial Sequence
  synthetic [barcode part1]
ttatccttggcaggag

SEQ ID NO: 29818 - DNA, 16 bp, Artificial Sequence
  synthetic [barcode part1]
agtacgcaccgatact

SEQ ID NO: 29819 - DNA, 16 bp, Artificial Sequence
  synthetic [barcode part1]
tactaccactcgaact

SEQ ID NO: 29820 - DNA, 16 bp, Artificial Sequence
  synthetic [barcode part1]
attctctgcaccggtg

SEQ ID NO: 29821 - DNA, 16 bp, Artificial Sequence
  synthetic [barcode part1]
actctcgaggtgtaac

SEQ ID NO: 29822 - DNA, 16 bp, Artificial Sequence
  synthetic [barcode part1]
cggacgtgtgtaattc

SEQ ID NO: 29823 - DNA, 16 bp, Artificial Sequence
  synthetic [barcode part1]
aactggcgttacggtt

SEQ ID NO: 29824 - DNA, 16 bp, Artificial Sequence
  synthetic [barcode part1]
acgcaaggagttaccg

SEQ ID NO: 29825 - DNA, 16 bp, Artificial Sequence
  synthetic [barcode part1]
tctgtgcgattgttac

SEQ ID NO: 29826 - DNA, 16 bp, Artificial Sequence
  synthetic [barcode part1]
gacgacttggtaacct

SEQ ID NO: 29827 - DNA, 16 bp, Artificial Sequence
  synthetic [barcode part1]
aacctcctacgtcgac

SEQ ID NO: 29828 - DNA, 16 bp, Artificial Sequence
  synthetic [barcode part1]
acgaggtataagtctg

SEQ ID NO: 29829 - DNA, 16 bp, Artificial Sequence
  synthetic [barcode part1]
ccacttgtaccgcaac

SEQ ID NO: 29830 - DNA, 16 bp, Artificial Sequence
  synthetic [barcode part1]
tggactaccaggttac

SEQ ID NO: 29831 - DNA, 16 bp, Artificial Sequence
  synthetic [barcode part1]
tgtgacgatcctgagt

SEQ ID NO: 29832 - DNA, 16 bp, Artificial Sequence
  synthetic [barcode part1]
agatccagttcgagtc

SEQ ID NO: 29833 - DNA, 16 bp, Artificial Sequence
  synthetic [barcode part1]
aggatcttcgcctgtc

SEQ ID NO: 29834 - DNA, 16 bp, Artificial Sequence
  synthetic [barcode part1]
gcgtcgaagaacgatc

SEQ ID NO: 29835 - DNA, 16 bp, Artificial Sequence
  synthetic [barcode part1]
agtgaatacggcgtcg

SEQ ID NO: 29836 - DNA, 16 bp, Artificial Sequence
  synthetic [barcode part1]
gataggagtgcaatct

SEQ ID NO: 29837 - DNA, 16 bp, Artificial Sequence
  synthetic [barcode part1]
accacgaggatcttgt

SEQ ID NO: 29838 - DNA, 16 bp, Artificial Sequence
  synthetic [barcode part1]
aacaactgagacgtgt

SEQ ID NO: 29839 - DNA, 16 bp, Artificial Sequence
  synthetic [barcode part1]
ttagtcctactgacgt

SEQ ID NO: 29840 - DNA, 16 bp, Artificial Sequence
  synthetic [barcode part1]
cgcgaattgtcgtcct

SEQ ID NO: 29841 - DNA, 16 bp, Artificial Sequence
  synthetic [barcode part1]
tgtgttcgcagagact

(The sequence listing continues in the following parts.)

What is claimed is:

1. A method for producing one or more polynucleotides of interest, the method comprising:
   obtaining a plurality of RNAs associated with one or more samples, wherein
   the samples are obtained from one or more subjects, and
   the RNAs associated with a sample are present in a separate reaction volume;
   adding an adapter molecule to the RNAs associated with the sample, wherein the adapter molecule is generated using an enzymatic reaction and comprises a universal priming sequence, a barcode sequence, and a binding site,
   wherein the adapter molecule is generated by contacting a template molecule with one or more enzymes and the template molecule is a DNA molecule comprising an RNA polymerase (RNAP) promoter, and the one or more enzymes include an RNA polymerase; and
   incorporating the barcode sequence into one or more polynucleotides associated with the sample,
   thereby producing the one or more polynucleotides of interest.

2. The method of claim 1, further comprising generating the adapter molecule using the enzymatic reaction.

3. The method of claim 1, wherein the RNAP promoter is selected from the group consisting of T7, T3, and SP6.

4. The method of claim 1, wherein:
   the template molecule is bound to a solid support,
   the solid support is contacted with an aqueous solution, and
   the adapter molecule is released into the aqueous solution as it is generated.

5. The method of claim 4, wherein:
   the template molecule comprises an endonuclease restriction site,
   the one or more enzymes comprise a restriction endonuclease, and
   the adapter molecule comprises a portion of the template molecule, said portion being generated and released into the aqueous solution upon contacting the template molecule with the restriction endonuclease.

6. The method of claim 1, wherein the adapter molecule is generated in a compartment, and adding the adapter molecule to the RNAs associated with one sample comprises combining the compartment with the reaction volume in which the RNAs are present.

7. The method of claim 1, wherein the adapter molecule further comprises a unique molecular identifier (UMI) sequence.

8. The method of claim 1, wherein the adapter molecule is an RNA molecule.

9. The method of claim 1, further comprising reverse-transcribing the RNAs associated with the sample to obtain a plurality of cDNAs, wherein reverse-transcribing an RNA comprises synthesizing a first strand of cDNA using a reverse-transcriptase and a first-strand primer.

10. The method of claim 9, wherein:
    the reverse transcriptase has template switching activity,
    at least some first strands of cDNA associated with the sample comprise a 3' overhang,
    the binding site of the adapter molecule comprises a 3' portion complementary to the 3' overhang, and
    the adapter molecule serves as a template for the reverse transcriptase, such that the barcode sequence is incorporated into first strands of cDNAs associated with the sample.

11. The method of claim 10, wherein the 3' overhang comprises one or more C nucleotides and the 3' portion of the binding site comprises one or more G nucleotides.

12. The method of claim 9, wherein producing polynucleotides of interest comprises amplifying the first strands of cDNA for the sample using a first primer and a second primer, the second primer having the same sequence as at least a portion of the first-strand primer, wherein the first primer or the second primer is the adapter molecule.

13. The method of claim 1, wherein the sample comprises a cell.

14. The method of claim 13, wherein the cell is a blood cell, an immune cell, a tissue cell, or a tumor cell.

15. The method of claim 14, wherein the cell is a B cell or a T cell.

16. An adapter construct comprising an RNAP promoter sequence, a universal priming sequence, a barcode sequence, and a binding site.

17. The adapter construct of claim 16, further comprising a unique molecular identifier (UMI) sequence.

18. A solid support comprising the adapter construct of claim 16.

19. The solid support of claim 18, wherein the adapter construct is bound to the solid support via a covalent bond.

20. The solid support of claim 18, wherein multiple copies of the adapter construct are bound to the solid support.

21. The solid support of claim 20, wherein at least 10, 30, 100, 300, 1,000, 3,000, 10,000, 30,000, 100,000, 300,000, or 1,000,000 copies of the adapter construct are bound to the solid support.

22. The solid support of claim 20, wherein each copy of the adapter construct comprises the same barcode sequence.

23. An adapter template library comprising a plurality of the solid supports of claim 18.

24. The adapter template library of claim 23, wherein the plurality comprises at least 10, 30, 100, 300, 1,000, 3,000, 10,000, 30,000, 100,000, 300,000, or 1,000,000 solid supports.

* * * * *